United States Patent 7,868,149 (PLANT GENOME SEQUENCE AND USES THEREOF) - sequence listing, part 5

SEQ ID NO: 2028 - DNA, 44839 bp, Oryza sativa
  unsure (1)..(44839): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttcacttaccttgattttcctttcataattaaatttacttgttcttcaggggacaagagtgaacatcccactaggtttagaaaagattcaatcaatcaaatactattaaagagaaccgaagtggttcgtttcacctgtttattttgtccttaaatcagtagtactcctagcaaacgccccaaaggccaaaaatctatcctgggccgaacggcacgtgccaaatcgttctgcgtgtactgcagggccgaatccgcgtctccgccgaatgagtaacccgaagcacacggcatagccgcatgggcgccagggtgggaaactcggtgcaccacagccgttcttgttccccccgcgcgatcccatcagctcaccactacaaaaagttttcacgcactcacccaaccagcaagaacgaaggaactaccacgctcgatcttccgctgcgcgcgccgatttgagctttacgccggcctacccaattacccaatccagcaagaacagcatatactcgtcccgcccatggcaggatcgactctgttccgatggctcttcttactgctggccatcgtgtcgcttgccgcggcggatagcggcagcggcgaagcagagaccaccgtccccggacaaattcgcctgagctgcggcgcgtctgcctccgccaccgacggggacggccgggcgtgggacggtgacgccgtgtccacgttcgcgccgtcggtgaccggcgtcgcggccgacgcgtcgtaccaggacccctcgctgccttcccccgtgccgtacatgacggcgcgcgtgttcagctccagctacacctactccttccccgtcaagcccggccgcgtgttcctacgtctctacttctacccgtccgcctacggtaacctcggcgccgccgccgccgccggggacgcgctgttcggcgtcaccgcgggcggcatcacgctcctccgcgacttcaacgcgtcgcagaccgcgctcgcggtcggctacgcgtacatcgtccgcgagttctcgctgaacgtcagctccggcgccacgagcctcaacgtcaccttcgccccctcgccgcgtggcgcccccggccacgggtcccaccactacgcgttcgtcaacggcatcgaggtcgtgcccacgccggacatgttcacgacgccggtgcccgccttcgccaacggcgggcgcccgaacccgatgcccctccgcgccgacacggcgttccagacgatgtaccgcctcaacgtcggcggcgaggccatcaccccacgggacgacgccggcggtttctaccgcacgtgggacaacgacgcgccctacatcttcggcgcggccttcggtgtgaccttcgcgaaggacagcaacgtcagcgtccggtacaacccgccgtcggtgccgaagtacgccgcaccggaggacgtgtacgcgacggcgaggtcgatgggcccgaacgcgcagatcaacctcaactacaacctcacctggatcctccccgtcgacgccggcttctactacctcctcaggttccacttctgcgagatccagtacccgataacgaaggtgaaccagagatcattcttcatctacatcaacaaccagacggcgcagtctcagatggacgtgatagtgtggagcggagggatcgggagggcggtgtacacggattacctcgtcgtcacggcgggctccggccagatggatctgctggtggcgctgcacccggacctcagctccaggccggagtacttcgacgccatactcaacggcctcgaggtgttcaagctccacaagtacggaacccacagccttgccgggccaaacccgccgatcccgctgaagcaggtattcagcacggtggacggaagcagatcggagtccaggaagaagagcgtcgtctgcgccgccgtcggcggtgtggccgccggttgcttccttgcggtgttggttgccttcgccgtcgcgtgggctgttcgcaggaggcagaggaaggccgcggcggagaaaccggctgatgggcttcttggcccaacaaaaggctccgccctttatgacccggtccaaaaataaacaggccaattttttaagccttttgttttgataatattatagggtatgtatagctataattgggttaacatgaaagaattataaatgggcccaaaaacatcacatgctttggcaatttttcaaggagagaactatatattacctcccttaactatagcatgagctcaaatatttccctcaaccgcaatatcagttatcgcacatctctcaactaccaaaacttatttaattgagataatccaagaaataccattgacaagcgtgcaaatactagaaatgccatcgacaagtgtgagttccaagaatgccattgtacaaacaactctataccaaaaatgccatcgatcttaggattctgtccattccgcgccgttaagttctataggatgaacagtgtatttaatggcgcaaaatggacgaaaccttaacggcgatggtatttttgggacaaaatcgtttgtacgatggcacttcttgaaactcacacttatcgatatcatttatcgatatcatttctggtacttgaatgcttggtaatggtatttcttggattatctttatttaatttgtctccccaagcgattttaatgattattttattttattttttttgcggggaataattttatttgacatgacgctggcatgatattactttttttttttgggtacgaaacgctggcatgacattacaattagaaagaaagaggaaaaaatgggtctcagttgtcaatgatgaatgatccactcctgtcctaatttttatccctctgttttttttccctccgaggtctgtataactaaaattgggccgtcctgaaagaagtatattaatgagcccaaaaatgtaacatgctcttgcaatttcatctccatttctgtgtagcgtaactttccttctgtctcaacggcacgtcaataaggtgtgagccagatgtttggattaggttgtggtttgcctttcgcttgtatgggcgaccaaccaacaggatgctaacaaatttggctggtttcggttcagcatgcctcacaaagttggcacttgccacaattcctggtggaccaaccgaaatgcaaaagcccggggcaaaattttccgtgtgtatccaagcaagaaacctcctgcatggtgacagcatttgcctgtgatgtcacaggcgaattaggtcacttacggcaccatcaccgagatcgcattgtgatcatcctgggtaatcaatattagtacacgtacattggctggattttcctgaatagggcatagtgcttagtactagctctagctctgttcagtagtgtttctgaattgactaatcatcggtactccatggcagagaagtcttttttatttccatggcccgtcaagcaatcaagttccatgtgacgctcttttaccgtacgaaacaatcccgtttcagtgaaaattaggcaacctcaagcaatggtttcggtatggtctcgatgtaattttggtgtaactgaaactctatggcagtagtcttgaatactgtatgaaaggaggaccgttcaagttatgcctttttggattttggtagtgccatcctcagagtaggagagctactccattggaaagtgtaaggctcaacatcatcatgtcaggacaactctagtaagatcagaaagagtaaagtgaacgaagggaaagaaaaatgcaggcagctcatgctcatcataatttgggggaggggcactgaatgccatgaggcagcacgacacagaggcaggagaaatggagaattcatcgccacggcgccaaaacaaaccaaagtcttcgatcccttctccagacatggcacccagactgtgtgggtggccatggcgatagaaatataacccattgagaaaatccgcatgctaagtgtgcaaggcaagcaacactgcttgcttcctttgctttgggttaaaaggcacgggcttgattgatcttttgcactaacaaaaggggcctcgccacttgccaggatcggtgccaacacttcactctagtcggctgcgtactccaatactccatgcatgcctggatgatccattgatcctgctctcactgacagaaaaaacagggtagtagcagtcacaagtagctctgaaactgtttaattagtttccttctaaaatactcctgctaatagcctgtcattacctgtgatgctcaacaagtgacaactagtactgatatttatttactagttagcagtacaaacatcagtactctgtactcatactctcagcactgacgcctggtgggattaagagattgacctgaataatcggagatgtagccatgtttctacagatcattatcagcaacatacacgttgatttatcatgatgttaacacttgctgagttaggacatcgaagtatgtttgtttccctcttggattagtttctcaaattcccatgctgattgcacgtcataggtgcatctagcgaagcaagggacccacggtccgatacgtgtctcatcatagagttgataaacaccggacacgcaaattaatatttggtgccgcattgcattacagcatttttgtacaacaacgggtttgcgctgctttacgttaccctagtacttcaccccttgatccaacggcttttaattggttttacagtttggtgaaaggtacagcatgaacactgcggtacaggggtacgtgctgggatgcagagtttactagcatgttcaggtttcatgctaatctgctctgcaaacagaatcactgttgctgctgtaatgcagtatttttactgcggatttgattctttgcacgtacttaagttcactaaccagtgtacaacattgtactattgtgcaacaaactatcgaattgcaaacagttgagctgctgtctgctcaactgctatgcgaaattttccacgtagcagtagtagcagaatttcaggttgcaaagggcaggcagaggtagaaaagtagaaaccgagacgtggattggtttccaaggctgacctccaccatttctgggatctctccatcaggagagtgcaaacccgccactatttacttccggcctctgcatccgcaccaccaccaccgcgcactccaaagaaacccggggataaaaggcgcgagaggtctcattcccgggcgggttaagttaaaccattctcaagctaaggctaagcctcgccatggcgtccactctctcgtctccgtcgccgccgtctgccgatcccgtcaccggatcctccgacgccgcctcgtccttcctcccgtctctcctcatcatcgctgctcttcttgccttcgttctactagcgtcggtctcgatccacctacttctcagacttctgtccaggtcgtcgccgccgccgccgccgccgccgccgctcccacggacgcgccgtgaggtgcacaacgtcgaggcggcggacgcttctccggtgcggcgtaatggggtttgtgaggggaagaaggaggtggtgggcgacgagaagcagcggctgatcgagtcgctgccgctgttcacgatggcgtcgtcgctggcggcgctccccaagagctcaccggactgcgccgtctgcctgtcgccgttcacgctggacgccgagctgcggctgctcccggcgtgccgccacgcgttccacgccgcctgcgtcgacgcgtggctccgcaccaccccgtcctgcccgctctgccgcgccaccgtcacgctcccgcacccctcgatctccgccatcctcgccgccgagcagccgccgccgccggagccgaggagcagggaccgttccaggagcttccgcgtcgagatgggcagcgtcagcaaccgcagcgcgtcgacggccaccggcggcaacgcccgccccacctactcgctcggcacgttcgactaccacatcgacgaggaggtcgaggccgtcgtctcccgcgccgcgcccatgacaaccaggagcgccgccgcagtcaaggaagacaagccagcagccgagcagtctccaccgcctcccggcgaggcggtggccgaagcggcgggcgcgacgcgcggctggctgcgggagtacgtggaacggctggccacctccgcgtcatccctatcgtccttctccgggcggtggagctcccggtggagccagagctaccagagccaccatagccacagccaggaggagccatggctgtgggacgcggaggcggtgaggatgtcgccgccggggacggaggaggaggagacggcgttcatggtgctgtaccggtggatcgcaggggtataaacgtaattaccataaaaaggcacaggaaggctttcgtgtcaaattgtcatcttcagatagatagccttcatcaggtactcaggtgaatggtgaatccaatgttttggatgcttctgtgttgactcgatcgggtacaaactggtaggcgtaagcagtttgcaggcctctctttgcacatagttatcctcggagttcggattttggaaaccgaggagagcataattagcagccagggtaggaaggaatcatgcatgcaaaatattgttcttttccgtggacgagtttgatgcatcttgtttattttcccagagatgtagtagtagttgttgttgtgtactttgtgtgacttcatcatgtgtgtcacaacgtgtcagtcagagcaccaccatggaggcgcctggtgaaatgggaaagagtgccttggcatgccatgcgtggcggtagctatgaaacgtgaaatccaatttcagagttccggtgcatccatgtataatccagctagttcgctgatgctgcttatttacatgtgagctgcttgttgctttggtggcaatgccagtgcactgcacgggcagcccgagtgcgagcggccgagtataaattaagcggcagaaaaggcccaaatttgatcggtttcacccgtttctcgtgcacacgccgagtcgctgtgttgacggcagtcaatgtgtcaaatcgcctgcagcagcagctagctactctatctagctcgctgatgtgattcgggtcaccaactctatcgcccatgcatgacgagagcacaggtctcctggtggtcaaaaccacggcacaagcgttgctgccttcacgcaacgacgcacagatccgacgacctgcctgcccttcgatccgtagatacgatttggttttggtgcaacgattgcatctcgagcgaccgaatagttttaccatcagatcttgtcgtcattagctgcatcctgcatgctgaattgctgatgctttttgcttagcggtgccgtattagctaggtacgttacgtagcgaaatgcgcatgcgcaactttggtacggatgcaatttactgacgtacggtgtgagtaccggactaccggtgctgtcgaaacgagaagtgcagacaacgtttcggtacaggtacagccgtacgtacagtgcgaagtcacatttatattcgccggtgttcccgtacatactacatactgcatggctcgatcagtacggctcgtggagaggtccatgactttattgttatatacatttactaacaaaagtgttcatgcgttgcacctggtgattacggagcgtgtatattgaccaaaagtattgtttggtttagcaaaagtgcctctgcgttgcaacggaaagcgtacagatgagaagaatatgcaattaattaaaatataaattcactgaaatatttggtatctttaagtaggtatgtatacaattaaataaatttacaagtaaagtaagtgtgagaaataaaatgatatggttaaatttaattttattaaattctccatgattagtttcgctctttgaaattttattggaattttcagagcttaattgctaattttaataatacaaatatcatttaacaattatttaattggaaatctaatttaattttttgttgggccggccgacctacgtgcggcccatcactgatgcggcccgatgatggaggccagcccaacacgggacggctcagatcggctcctaatctatcaaaacccccaacccaaataaaccctaaccctaatttcattcttccccttcctcccctccacgcaggccgcctctctccctgctggcggccacgccacacccccaccggcgcacctctccacgctcctccccaaccggcgacgccttttgcccccctccccactgccggcagccttccccaccgagcagcggcgacgacggcggcagcggtggcgacggcacactccctcgcagcgggcggctgtggcagcacggcgatggtggcgccgctccctctccccactgccggctccttctctcctcgtcgggcggtggccaccgcaccactctctcggcagatccgaaggtggcggcggtcgcgggccggtggcggctccctcctcccctctcgcctccctcctgcccctgatccggcggcgatggcggtgtcggcgggtgggtccgtggccgacgacgaggtggcgaggagcagcgcgctgcagcctccggtccggctcgcccctccctctcctagtcatctcgtgttaatatgatgttttctaatgattccgatttagatttggactgggattttgtgtttgatttggatttggattgtgatgatttgagattggagagaaggtgtgctcaatgtgggattctatttgtgtgatgatggaattccaactgggttttttgaggggggatgaaaaatcaccgtatggatgaggtgacgaccagaaaaatccgaatatttatattagttatagatatggctcgtggagataattatttttggagatggtctcaacataaaaaggcagtgttggaattgttgaacaacctactatatcccgctttgctgaccacatggaatgtcctctgggctttgaaggtaaacaatgcctaccggccttttttggtctagaaacagaggggaataagtccactttgactcccttaaatttgactcccttaaaagtaacccgaatctaatatgtgaccctcaaccacaaaaccggatagaacgactccctaaactattgaaaccagtgcaatttgactcccttggtggttttggagggtggttttgcttatgtggcgctgacgtggcgatgttgacctagttttcgtcccacgtggcgcttacgtggcattagaattaaaaaaaaaatctatggacccacatgtgattcacacataaaaaatattgtgggccccactgacatgtggccctacatgtcattcactctctccttccccttccctctctccccgttctctctctttatctctgtcacaccctgaagttctcctcctaagtctaaaattgaatttataaatcaccctaagaaaatgccggtgcaaatcaagagaaaaccttaataaattaatgcaaataataatcgaaattggcatgtggaattttttttttgagttctacatgtcgaaatacgctaacaagatttttagtggaattttcagagctctcgaaataattttaaccaattaaaattgagcacatgcaattttaatcctatgaaaaatcctttttccttctttttcctttttctttcttttcttttccccttttcctttgaataggccgccggcccattcctcctttttctccccctcctcccgctgggccggccgaaggccaaggcccagctaggccgcgcgggccggccgcccgcctcctctcacccgggtcgctgacaggtggggcccacctatcggacccgtctcccacctcgcgccgcgccgccgcgcccgcaaccaccgccgcgcccacgccttcgccttctccgggccacgtcggccacgcccgcgcatgcgccgcacctcccgcacccactcccccctcttcccgcgtcttccggccgcgcccgcgcacgagaagggcaggattcgattttgaatcgtccccaccttctctctctcctcccccacgtcgccggcgaaatcggggtgcctcccggccacgtccgcctccccctccgcctataaaatgctccccatgccctcctctctcgttttccgctctcaccgctccatcccgtgccccctaccgagctcgcgccgccgctgcttgcgccgccgcactccggccgtgtgccgccgctgctagagccgtcgccgcgctaagccaccgccacccctagcttcgccgccgcaagacctttcccggccgccgctttgcgtcgccggaatcccaccgaaaccccatctccctcgtgtcgccggtgagttctctctcccctccgactccggccggcgtggatggtcgccgtgagggtttcccttcgtcctaattcctcctctcttttccctaggtgtcgccgtcgctcttccgcacctcggcatcgccggtcttcgccgcctccctcgttttccgccgccggccgttgccgccccccccggtgaggtctccctccccttcctttccttccttttttttcccgtgcgccgccgccctcttcgcgcgctcgccatcgcgttcggccgtcgccgctcgcgccgccgcccgccgtccacgccgccgtttgccgtcgccggtggtcacatgcgcgcgccgccgctttgccatggccggccggtcggcttgatgccgggcctggccggtacatcggcccgtggagccggggccgtggggcccgcttgccagccgtgccctccccttgagccgctgccgagtggggcccacgtgccgccgccccttcccctctctcccgagccactgaccagtgggacccgcccgtcggcgccacccccccttgatgacgtcagccctgggagttattgcgcaataaattatttaaggactttttttatagtaataaacacagtgaatcttctaaaattcataactaattcatccgagctccgtttaagcccattcaagtctcagtaaatcaagaaaaatgtgtagaatccattaaaaatagttttgttctctgtttcagtagtcttatagcctgtttgcattgtttgctttgtatgtcgcttagattccggttcttccgacgctccggtgtacttcgaaatagtcgccgaggttcctccagcagcagagcaaggcaagttatgcttgtcacttgaacatgttgatcctatattgcaaatgctctattgtttttcttcaaatactgcatcgttttataatgttattatgggatgtttacctattgttacagccatgctattttggtaccttgctcctttgttagcttgggttataacatgaatagacattggactaggagttgcttagccatgcttagttcaactagtacacaatggggaaaatcctattaatgtttagactgttggttctaatggtattgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcatgggcaacggctgggcttgtagtgtagctttcctctagctgacgcatccaggcaagggtgggcgtgatggagcgggacgggccctgcgacggcctctgtcgcttccggattcacctaggcatgagaggggactgcccgctgccttgcgaggagtgggggtgaaacctgaggtgtggtgtgcttggttagagggggttatgcgaaaggtcttgtcacagcctctttacggtatgttgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctattaaaattggatagtataggtggatggttgggcctgtcgcaacgtggtatagcgttggacagtggatgattaatattgattaattattacaactgttttcttctttaaacttctgtttataaatgctcgctttatgcaaatgaaccactctagctctcctttgataattccctgcatcatacccctattccggtatgacttgctgagtacagtgggtagtactcagtcttgctctatttttcccaaccccagagtacgagtatatgtcagatggaggtttctccgaggagtaggcttcgtccgtgccgtcgaggatgcctgtggagtggtgttcccgctgcagttctagtcaaggcttagctcctgttgtctttcatttttccgctgcatttatgtaatacgtttatgatgtttgtaagacgtggatctgaatgtcaacattgtcgtttgtgtactccggccggtcctggacggggattttaatgcacattctgcttggaattctattcgggaatttctgggcgtgacaatctcccccctttctcttcaccttctctctcgtagcgtaatctgcaggcaagggcggcgacggcaagcgggagccggagtggcggcgacggcgatggctgacgcggcagcagcaggcgggcgccagcttccccatcgccatcgacctcgacctcggcgtatccgcatgcgtgatggcggcggtctctgtcacgcccagaaattcccgaatagaattccaagcagaatgtgcattaaaatccccgtccaggaccagccagggtacacaaacgacaatgttgacattcagatccacgtcttacaaacatcataaaagtcttacataaatgcagcggaaagaaagaaagacaacaggagctaagccttgacttgaactgcagcgggaacaccactccacaggcatcctagacggcacggacaaagcctactcctcggagaaaccttcatctgacccgaactcgaactctggggttgggaaaagtagagcaagactgagtactacccactgtactcagcaagtcataccggaataggggtatgatgcagggattcatcaaagaagagctgaagtggttcatttgcataaagcgagcatttaaaaacagaaattgaaagatttaaacagttgtaataattaattaacatcaactatccactgtccaacgctaacccatgttgcgacaggcccaaccatccacctaaactatccaaattaaaagattacactaaggtgagactaatcacggtgaatctggttgaccgcccataaccgcgggcacggctattcgaatagttttactctgatcagaggtgtacaactgtacccacaagacacagccccacgacacgttttcgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagatatactacaagtccagccgttgcctacgctggcttgtggtaagtacgatatgttcttccagggcatcccgcgaaccggtccttaactgccatgggtgcgaccagcaaaaccatgcacccacagcccaccatgtggtttattttaattaaccaacacccaaacggtgtcactaatccaacaacaccattggaaccaacagtctaaacattaatatgattttccccgttgtgaactagttgaactaagcatggctaagcaattcctagtccaaactctaatcatgttataaccccaagctaacaaaggagcatggtatccgaaaagcatggctgtaacaataggtaaccatcccatagtaatattataaaacaatgcaatatttgaaagaaaacaatagagcatttgcaatataggatcaacatgttcaagtgacaagcatgacttgccttgctctgctgctggaggaaccttggcgactatctcgaagtacaccggagcgtcggaggaaacggaatctagcgacatacaaagcaaacattgcaaacaggctataagactactgaaacagggaacaaaaccatttttaatggattctgcacagttttcttgatttactgagacttgaatgggcttaaacggaactcggatgaattagttatgatttttagaagatttactgtgtttaaaactatacaagaaaaaccttaaactatttattgcgcaatatattccagggctgacgtcagcacggagggagtgcggcgccgacatgcggggcccaccggtcagcgacccgggagagggcggtccacggcggatcgggtccacggaccggggaggagcggcgccgacatgcggggcccactggtcagcgacccgggagagggaaagaaagggcggcggcacgcggctcggattggctcaaggccggccaaccgaccgcggcgacggcgacgacgcgcgcgcgaacgcgttgccagcgacgcatgcgaccgacgacggcagcgaccggcggcacgcgaggcggcggcggtcgaaggcgacagcgcgcgacttgaagcggcggcgcggcactaagaggagaggaaggggaaaagaggggaggggatgcctcaccgagggtggccggcgcggaggaagacgatggcgaacggcgacggcaagccacgggaggacgacgtcggcgagcggacgagcttcggggtgccctaaggaaggaggagagagggattattgagagggagatgagccacggcgaccggaagccatggccgaaggcggcggtagaggtgatgctcactcgagtgcgagggaacgagggctccggcgacgaacctcgacggaggagaggtggacggggtggatcccggccacgcgaacccgacggcggcgatggcgcggcctggcggcgaccctaacggcggctagcggcggccggagtagcggaaacagcggctgcggatgggcgcacggcgtgagagcgatgggaggctcgagagagtacggcggaatggggaaaaagtgagaggggacgacggcgatgcttaaatagggggagagaggaccggacgtggccgggagaggcgggaatcgccggccgacgtgggggagtgggggaagagagagaggcgggattcgaaaatcgaatcccggccatctcgggcgcggacgcgagcgggagaaaaagaagagtgggcgcggaaaacgcggcgcacgcgcgggcgtggccgacgtggcccggaggaggcgaaaacgtgaacgcggcggcggtttcgggttcggcggttgcgggcgcggcgtcggccggagaaaggggaaagacctgacaggtgggccccacctgtcggcgaccccgggagagaaggaaggcggccggcctggctgggcctcggcctgcggtcggcccagcaagggggagggggaaggaaaggggagaatgggccggcggcccattcggaaaaaaaaaggaggaaaaagggagggaaaagaaaaagaaaaaggaaaaagtattttccctggaattacaatattgctggctcaattttaactggttaaaattatttctagagctctgaaaattccactaaaaatccagttaatgaatttcgacatgtagaactcaagaaaaaaaattccacatgttaaatccgattattatttgcattactttcttagggttttctcctgatttgcaccggtattttcttagggtcatttataaattacaattttggcttgggaggaaaacttcggggtgtgacagtctccgcggatgcagtccataaacccagcctggcaatccggccaacccccacaatgctccacgggtcagcctcggcagaatcgagcagcagtacaacaaacacaccaatgtagcagcataggagaaggcgagcaagcaagaggatgtgtatagctgtatagctcgattacttcctgctcatcaaaaatcatgtcgagaaggtgatgatatgcctcgccttcgtcccaaggcaggcatcgctacatgcataccatcatggccaaaggcgaggatggagctcggcctcctcctggcgcttggcccaggggcttcgacctctatggctgggcgtacagtgagggactccatcggcaccacggtggggatactctttggcgggtgtgctcgttggcgccatcgccgccgctgtcggcactgaacgtgagctggcagatcaccgggacgctgaccgacttgacgttgcacgccatcatgggggagtgcggcttccggtggcatgaggagttcctggagacgctgggcgaggcacagaagaaggcgactaggttcggcgtcgctgacctgttcccgtcgtcgaggctcctccccgccgtcgggagccggagtggtgacggccggcaggagctgacacgggagctagctggagcggcggtggaagtgggctggagctgacggaggctaggaataatccagcgcgctagtcagaggcagccgcagccgcagccgcctcgttggaggtctgtggcgtggggtggtttccaccgccgcagccactcaagcccctcctgtcgccgcctccttctcctccgcctccacccgcattagctccaacccgccgccgcttcagctcccgctggccgccagcacttcggcccctgccccaccgccgctccagccgtgctccccgcggacggtggaaagggagagaaagagagaagggagaaagtgggggaggaagaagaaagagagaggatgacatgtcagtgggccccactttttttatgacaaatgggtcccacatatatgtttttaattaaatgccacctaagcgccacatcaagaccagagtagatcaacaccgccacgtaagcaccacgtcagcgaaaccaccatccaaaaccattaaggaagtcaaattgcaccggtttcaatagtttagggagtcgttctatccggttttgcggttgagggtcacggattagattcaggttactttttaagggagtcaaagtggacttattccaaacagagcccgagtacccaaccatacgccctctacatgggcaacggcccatcagcgtggccagattgcagcggtcgcggccgaggccgagagcccgataatactcgtgggccttatccgctaaacgctcatggggatcacggtagtctaagcccatagaaaacggcccatctgagtgggctaaatcgctcaggtgctggcggtagcccatatggtgatctgagctttttgttattattttttaaacaaaaaatacataaatataattttcttttacaaatttacaaacatcatactcctttcaccctatgggagagtttttttttcataaattgcctctcaaaaggcggttctgatggagattatggtggttgaatattgcgtacatgcctttcccatgctccttagaggcgacttttatatgccacccaacccaaagacagtgaaattaaggcctatatatgcttgcgagaaaaataacggtcatgagaaatttgcatagactacttttgttctctaggtgggcgggatatttaaaattattctctaggagtgtgataaggggctatacgcaaatgtcccatgcctaatgccacgtcatcagatctgccctctagaagggctgtttttaaagcaaatccctaaaaaaacactcccacggtgaaggagtattttttaaaaaaatttacagaagcgaaaaatatattcctgtaatttaaaatatatattaaaataaaaaataaatatttgagcttccatttgttagttaccatttttggaataaaaaatggttggatccataattttcttcatttaatgtatttcaagcatatcatgtatcgttgtattttcaattatatttttcaaaaggagttttataaagcaccctatgtatcgttgtatttttaattgtacatgcctaatttctcttttcgagggtacaaaaataaatcaaagacctataagaggaaaaggtgaaaaatacaggcatagggatttatgcatcagtctaatcccaaattttgtagcttccactcccattaatgtttgggaatccgataatgacatatccatgtttatgtatttattgtctttttttctgtaaagagatttagaagcattaaattaagcaaaacatatatacacgtacttcatttattgtggtgaagccaatagtgtgcacacacactcctacccacaccatctatatattcatgcactccttggctagatcacaaaacacacaccaaacaatcgagcacagcaaacaaaggtgaggactgaagcaagaacaccatggcttttctgagggcactctctcctctcgtcttcaccctgctccttctactcgccgcctacacattcgacgccttcatcttggaggaaacctgcaagtcgctcgccggtaaccacacgggcatcgactacccctactgcgtcaggttcttccaggccagcaaggagagcgccaccgccgacacgcacggcctcgccgccatcgccgtgaggatcaccgaggcgggcgccgagggcaccgccaagcgcatcgccgccctgcgatcctcgcacaaggaggagaagatgcaggagtgcctccgcataagctccgacctgtacgcctacatgctggccgttctcggcaacgaggcgaaagccgccgccctggtggacggcggcgcgcagcatgcggcggcgtcgccgccaacgcccgacgtcgcgcggtatgtcgcggatggttgcgagggcaggttccgtgggaacaaggagaccctgccgctggttgcggagtacgccgagtttagacagagtgcgtccattgctctcgcattgatagaggcgatatcaccaccgagtgatcagtgaatgtgtgtttttactctcagattttgtaagccaaacaatgtagatgaataaacatggcaattatcaatctattgttttcctgtgactataatctttgttaattttctatttcatttttatggccgagttttgcgttgaaaaccggttatgcttttgaaaaaaaaaagatgaagtcaccctttgctactttgtttagaaaatagtcattcatcgtcgcataagtagaatagttatctttgctaatttacttataaattaataaattgtgtgatttgataaaagtggattaatcttaaaatatgctccgctagctaatttgatctattgattttaactactccgttaattataccgtaaatcatcagttgagtgtgtttggcaaaaaaaaaaaaaagcgtcaacaatgttagtagtactttcgatgcaaagtataacagccaacaagcacttgaaatatagtgatatgctacctctacaccaaaataagtctatttttgagatagattaatacaaatacaaactaaaaagtggactaaaatacaaactattttatcaaactaagaagactaaaatactttgcacttgagatagactaaaataactctaatttattaaatatcaatgcaattatttcttattttatccacttccaatgcatatatcaaacaaatactttcacaaacttcaatgcaatgattactccaaaattaacttattttactagaaacggaaggaactaaaaataaacgtatccttctcttgagatagtatctatcaccactgttggcgtttgcaagatttgtgtatctacatcatatctgttacgggccttccagcccactgcccacgccaaattcacctctccaaactgcaaacatccggacaacggaatttaaggcccaggtggcaactatcagttattctcttatttcacgattattaagcagactctgtttcgtaataagagattttcgaatttcgaccatgaatttgtaaagggaccttttggaacttcccccgattaagactctggcagttcgacatgtggtgtctaaacatttcgtcatgacatgaaactatatagattagatttggctcgaaaggaacagggaccctgtcagcaggtggctgatcctaatttctgaagaagagcgatcctggttcctggatcccgagactcgcggcaggcgtgaagagactgcgagacacccgccaacgtttcagcaggcgtcatccaggaaatcctcttgaatgaatgaatgaatggtgtaatatctcgtaatgattccagtgcaatcaacagctggatcctcttttattgttcagagattaagatgacgatacctgctagtataaagttgttggttctaccacgaaaaaacacaccaaacaagtaaccaagcggcaccaggacaagaaaagccatgacgaccatgaagcttgtgcgatcgttctctcctctcatcgtcttctccttgctcctcctgctcacctcctccacgacgtccagagcctccctcgtggacgacgcctgcacgtcgttcgcggctagccacgcggacatcggctacgcctactgcgtcaggttcttccagtccgacgagggcagcgccaccgcggacaggtacggcctcgccgccatcgccgtgaagatcagcgcggcgacggccaggggcaccgccaagcgcatcgcggacctgcaggacctggagcgcgacaagaggaggaaagattgcctgagcgcgtgcggggaggtgtacgactccgccgtggacagcctcgacgaggcggccaagggcatcgcgtcgcgcagcgccgacggcctgcgggacgcggtgaccgtgctcagcgccgcgctggacacccccgacacgtgcgaggacgggttccgcgagctcggcctggcctcgccgctggtcgccgaggacgaggagttcagcaaagagtcggccatcgctctcggtgtcacatcggccttatcgccgccgagctaggatgacgtcacaagagttacagcgtctgtaatcctataaatcctttgcgtaataaattaattactctggaaaatcacaggacaaaattacattttctcactaattccgttgtcatataattttccatttttggaagaaactggttggattccttgtgcacctattctgagaccgatccggccattagccatgagatgcacgtacgattgttgtttttttcccagtggaacgcacacttaatttacggcatatcttgtgaagaaattattgcatttcagctaagatataatcggccggcatctttgcttaaaaaacaacaatctgctgggccgttccaacggagattggcagctacctcgccctgtaaacgtcatgcacgtctccacggatcacgacgtgacggcgtccgaggctccgagccagcggcggcgcgagctttggtgatgcaatttgttgggctttctgcttgccttacctgggccgacctgtatgcacgaattgggctaaattcccaaaaggaatccaaatctcccttcaaaaaaaaaggaatccaaatccttttcgttcccgggggagagggataagggatgaagatttgttgaatacttggagcaagttttatagctaatttcatgcataccatataatagtaagaggtaatatgtatttccacatttttattgaagtttatgtaggagttgtttcttccatgagaggtggtactttctctcttcactcttctctactctatctacctcaccattagtccaatgcgatatctttgggtttgtagttagatgcctgtagtacttagcgacaacaacagcaagctcttccactttttcggtgttgacgatgatagatatttggattaggatacgggtgggagaagaattaaggtgagggaaagatgcagtttttcgagcttagagaaatgactaaggagcagggagatggtaaacctgtggtgacatatatgacgtgcgacgaggcggtgttggcatcatagccatgagattgatggtatggacatgggatctagagtagttaggagatagaggcaatggtagcatctccaatgctaggggccgctgaagacaaaaaaaaaaaaagggcaaggcaagggcggcaagggcgcctggccgccgcttaggcttagagaggagaagcgaagggagagaaagggggtgaaagggaggaggacgattgagctgggctggttagcatctagatagcgcaagccatgcaaaggggggcaagtgggtgaggatgggtgggcagtggcgcaagggttttatccaagctttgcgaggagagatggtatctctagtatgacagcacgaatcatgaagtggtattggccattagaaacgaccgaaatttaggcatcttagtgtgaccaaaactatgcaccaaaccaccaaaggaaaaaaaaaaccattttattttccgaactatttcattggttaatggaatagtaaaatagacttttttttcctaccaagtattgtcagcctatggcccaggtcatactgaaaagtggattttggcccacccgtcgtggaaagctaaagattcggcccatgcacagtaagacgagacaaatgtggacgacgtcaacgtgcacaaaaccttctcttctgtatcggccgcttgaagtacaactttccgctatcgcggtgcgcgcggaaggccccgctgcggcacgtaaacgttcgtcgtgtatcgcgctttaacccggaaaccgtggaaacccgcaaaactctgcatctgcataccgctgcaaagcggaaaaggaaaaactccccgaagcgcgcgacgacgacacgagcgcggccgcggcggtgaaacgaacgggcggaccggttcttcttctcccgctggtctccggcccctccctctccaacacctctgcatgcccagcccccatgcatgccctcttgttctctccaccgcgaaacatgagcccccgcaattctcctttgccaccacaccctgcgctcctctcgcctcctcctcctcctcgtcttcttcctcctcctgtcctggatctcacagggtggcagttcctcgaataaaaaaatggcggacagtaacgccggcggcaacaacagtagcggtgccgcgaacaacgccgaggtccagataccgatcccaggtcagtctcagtctggtccgctctggtcgctgttatgtttccatttcatcttattgcatgaagggttagggtgaaaaaaaaacatgagaagcgggctatgcttttgcgttccaatcgtgctgtgcacctgggaagcacctgtgctggattatccgtgaacactcgtgcgaattgatcattccgttggtacattggggaaatttttagggatgatctgtttttagcctttgtgagtacgatttgttacacttaaactctgttgctcttacatggacctctattgcatcgtgttcagaaactttcacccactgatgaaatgtaaagcatcattaaaaaaattttacctgttacgtttggtactaactttctaccatcttcattacaaatcacagctccatccaaggctgaagctgcagcagctccggaaacaccagcaggcaagccatttcgatggtgggcgatggtggcagtggacgtcttcttcctcatcgccggtcagacatcggcgacactgctgggcagatactactacacccaaggcggccgcagcaagtggatatcggcgttcgtgcggacggccggcttcccgatactgttcttcaccctcttcttcttcccctcgaagtcaccgtcctcctgcaccaacactcccatggccaagctcgccgtgatatacatcgtcctgggcctcatcatcgccgccgacgacatgatgtacactggtggcctcaagtacctccccgcttcgacctactcgctcatctgtgccagccagctcgcgttcaatgtcgtcttctcatacgtgctcaactcccagaaggtcactcctctgatattcaactccgtcgtgctgctcaccatgtccgcttcgctcatcggagtcagcaaggagtctcagggggtcaccggcgtctcgggagggaagtatctgctcggtttcgtgctgacgctgggggcgtcgtgcacctactcgctgatcctcgcgctgatgcagctcaccttcgagaccatcatcaagaagcacaccttctcagccgtcctcaacatgcagatctacacggcgctcgtggcgacggccgcgtcggtggtcgggctgttcgcgagcggcgagtggaggtcgctgaggggggagatgaacgcgttcaggtcggggcagttctcctacctgatgacgctgctgtgggcggccgtgtcgtggcaggtggccaacatcggggtgctcggcctcatcttcgaggtgtcggcgctcttctccaacgtgatcagcacggtgtcactgccggtcatcccgttcttcgcggtggtggtgttccacgacaggatgaacggggtgaagatcgtggccatgctgattgcaatttggggatttatttcgtatctgtttcagcactatctagatggcaagaaagcgaagaaggcttcatcgggtgatagtgcgcaggggtgatcagattaggtggccacagtgatattatcgtggtagagattgattgctctccgccaataatcttagctagttttgttggctgcgaggtactagatgttcgttacttatgttatgttgcaggttgttcgtcagataaaaactagtacgtactttgtttttttgtgttgccaacgtgttcagatgtacaattttgctggattactagtagttttcttgttcttttcttcatgtgcgtttgtgtaagggtatgacgcataattgtatatcacgaaagaatagaaatagtagtactagactagtaaagaactctttatttgcttcgtcctgtcttatgtcaggttgatcctggtggctgatggacacgaataatttggtactacttctatttcagttgtggaaaacaattagtatctgattaaactacatctgaatctgacacttccgcagaatcttgggtgaagaacaataattggcaatctttgtactcttttgtcaaattggagataagattgattccgtctggatgcagcgatcgacgttgtcctcacttggaaattttggcatcgcacgcattgaattttccaagaggcaggacataaacattgactcgccggagtagttttgaaacgtttgacggcaaaattagccccttgcgcatgccctatcaacccttttatctttttatcgtttcattgattgatgacgactccaagttggcaagtttcagccttccgctgctgctggacgagtggatgacgagcactaggcccatcttgttgtttatcctttttctgaacctcacaatgagcgatgctactgaaattcagctgcagattacaggtctctctcggtcatgaactgccaaatcgatcacagtttcgaattgagatgtgatgtgagatcgatcgaaactagtccagtttttatactgatgagacggatgattcgtatgtgcaggtgtccgaggccaagaagacgtggtagcagagtctgacaagagcacgtctcgagcagatggaactgcggcggcggcggcggcggcggcgccgctgccgcctgtgtccagccagcggctgcggtggtgggcggtggtccttgccaacatcgtgttcgtcctcggcgggcagagcgtggccacgctcctcggccggatttactacgaccagggcggcggcagcttgtggctggcgacggtggtgcagtcctgcggcgcgccgctcgccgtcccactgttcctgtatcttccggcggccagaggcctccccggtggcacgtccgccgctgctcaagatcgctgccatctacgccggccttggcgtcctcctcgccggcgacaacctgatgtactcctacgcgctcctctacctgccgctgtcgacgtactccctcgtctgcgccacccagctctgcttcaacgccgtcttctcctacttcctcaacaaggagaggttcaccgcgctcgtgctcaactccgtcgtgctgctcaccttctccgccgcgctcgtcggcgtgagccactcctcggaggagaccaacagcagcgtcccggagggcaagttcgcgctggggttcgtcctggcgctgtcggcgtcggcggcgttcgccctgatcctgtccctgatgcagctcacgttcgacacggtgctcaggagcaacgcggcacacgccgtgctggagctgcagctctggagcaacgccgccgcgtcgtgcgtgtcggtggccgggctgttcatctccggcgagtggagctccctgacggcggagatggacgggtacaagaagggcgaggtggcctacgggatgacgctggcgtggacggccatctcgtggcagctcgccacgatgggcatggtggggctcgtcgcgacggtgtcgtcgctgttcacgaacgtgatcagcacggtggggatgccgctgtcgccgatcatggcggtgatcttcctcggcgaccggatggacggtgccaaagtgatagccatgctcattggcatctggggattcttgtcctacgtttaccagcactacctcgatgacgccaagagcaagaacacagctgggtcagctgacgtcacacaaacttcagaagcaaaactctgaagcctgatacgcctgatagtgatacccagagtgaattttactgtacttgatctcttttttttcacggaatcaattggaaatttggaatactggtcttatcttccctggaataacggggtcaatcagagtaactgcagaataacaggaactcgataatcgctttttgctcaaaaacattacagcatcgaggaagatccccgtcttcatcagtttctgaaacgacactgtagttgtcaatactttctgacagtagagggtcatctcaggtaaagactgtttttcattagtttcaccgtgtgacgacagatgaaatcttaagggattacagcgggaaatctgtctagatttgaacgactgatgttgccgacttgacattagcaatcaaaacgtccatggtccataggattggtcgaatatacccagaattttgcttccttaagccaagagataaacccagatctcagggtgtgtttagttcacgttaaaattaaaagtttggttgaaattagaacgatgtgacggaaaagttgaaagtttgtgtgtaggaaagtttcgatgtgatggaaaagtttgaagtttgaagaaaaatgtcgcaacaaattggccctgtttagttctaaagttttttttttccaaactttcaactttccatcacatcgaatatttcatacacaacttttttatcacatcgtactaatttcaactaaacttctaaacttcagtgtgaactaaacacacagccaaaacacggcctcagtgtaatattccgcctaacgcgaatgcgaccgattacgattggtgccagcagcagcactgctcgtgctcggcgtgcaaacgatactgacaggcaaaaactgtactgctactagctttacttttggatcttcactgaatctcatgtaagatggcgtgtatggtaacttggtccgtcctactagctgcaacaggggggagatgaacttgtcaaactgcctctttttcgtatctgatcgctacaggtatcatgaacctgacgtagaaatgtcacactggtacagtagtctttatcgacatcatgatgcaaattggaagaacgtctgtttcatggttgggggaaatatctatctgcagccccggggcacggctcaaagttatgcgggcgatccgtcgtctgctctcgtactcgttgtcgatttcttacttgttgagttcggctgtgtttatttcagcgcaaaatttggattttggttgaaattagagatgatgtgactgaaaagttgtgtgtgtatcaggttaatgtgatggaaaggactggagtttggatccaaaaacagccttcgttcaatgtcccaatatgatactgctccggtcacgaatatttccaaggacgcctggtcgccccgctccagggcgacgcgggcggcaaaacctcgccgtcgcctcctcactctcctcctctcccccacctcgccgccacccgaacagccgccggcaaagccgggcggctgcgaagacggcgacggcggggctcccttctccctcactcccggtcagccggttggggcaccgacgacaccagagagcgagagcgcggccccggcgatgacggccaaatccggcgccgttgggtttggatctggccccttggccggatctgggctgggacgcgcgggtcggcggcggagtgcacggaggcggcggccgcggcagcggcgcgggaggcgcccgtgcgaaggtggggggggggcaaaggtcgccggctccgacgacgggcaggcgccagatccggtcgccccgcttggccggggtgaccggcgacgggctcggtcgatgacggcgccgctccacggacctggcaggggggtggctggcgacagcgatggtggcggatgtggcggcgacgaaggcggcggactacggcgtgtgccgcgacgccggccctcgtcaagaacctcgccaccacgaggagggcgcggcgcccatcaattgtacgccgtgcccgtgacgccttcctccatggcgccggcgacccgcactgcgcgttgcaccttcaggtctatgccaccccggccggtctggacggctggcggctggcgacggtggcggctggacggtggtggctgacggtggcagttggacggtggtggctgacggtggcggctggacgggggtggcggtggcggtggcgatggtggctggcagtggtggctgtcgacggtggtgcaaggccatcatccggggctgacggtgtgtcgtcgtcggcagcggcatgtggaggcaaggaaggaggagtccgggtgcgggcgcaccatcgagaactgtgggcggtggccttggccgaatttctgaagggacaatgttgttgaccaacgaagatccttcttgtgcggattggtggtgtgggtttggacagggaatcgcgagcgaaagccttgccgagccgtttggccagctgacgacggcgacgcccgtcgccgttctcctccttggaggcgttgtgttagattacccatctcctttcctaaccatattctccgggtgaaaaccttgcttccttccgaacgagcggtggcggcgatccacgtcgcgtcctccttgggggcaccgctttggagaaacctcttcgtgcaaggattgtcaagggtctatgcattggcttcgaacttcagtcctaggctttgacgaggccttctagctccactttttgttttgcttttcttagtttgggtcctctatttttctgtttgatgtgttcaacttgtcttgaactacactctcttctggagtggaactttgtaataattggctgtagctctttttgagcaaatgccgggatattatatatctatctcagacggtcctccatgtcccggcatggaccgtcagcactgctgcactgcacatggctggttatgtgagtagaaaaacatgttaccagaactgataattaatcgagtgatgcagcacagaagaatactacgagtagcatactctgtgctgcactgctgcatcaccaagtgcctagtttttcttgcatcccggccttcccgggtcctatgcaagaattcgcctcaatcatactccctccctaaaaaaaaaaaagaaaaccctgggttttcatgtctaattttgattgtctgtcttatatgaaattttttttataattcgtattttcattgttgctagatgataaaacatgattaatattttatgcgcgacttgtctttttaatttttttttataatttgttcaaataagatgaaaacgttcggtacggaaaccaggattcgtctttttttagacagaggtagtagacagcgaaaaaggatcaaatgatgcatgatgggtctgagtgactgcgaccgagtaaaacgtgagccatgattattcaaacatgtatatcctaaatcaccactaaattaccatatagtcccggattttgtcctctttcggggacagggtccatgggccatgacccacggaagagaaaacgtgcccctcctttcatttcaaaatataagagtttttaaaatttttaataactatttaaaaaaataataggtaaatttaaatagggaatgttattattgattggaaaaatagataaaaaaattaaatgagaatattatgattgtttaaagagaagaagttaatatattttgtgataaattttaaatgatataagttgcaatattttggcatagaacgagaatcatccaaccgttctggtagtagatgtcgctttgctacattaaacaattaggtcgagtcgttatatatgccaatagggagccatgagtccattctgcgttaggaaggctaatgaagacgtgaagtagaagctgtagcagacaccctctatcaatatggcgtacgctcaagaaattcagctccaaatcagaggtgcctccactgctcctcaccatctttagtctcctctcgtgtaacccttcctttctggtgcttaatctcgtgacaatggtttaaaacttttaaacggctctcggttttgcaaattgccctcgttttctcgatgtttagttggtgtggttttctgcttccgctctaatgaagtttggagttttgcgagtgaaatggacgagaaagacggtatgtgcgtctgaaatgtccagcttaggagctgtttccaaggatcgagttctggcgcatggtaacctagatggtatgtgcgtctgaaatgtccagcctagtttgttcttgctctggctcgctggcagccgtcctgagccagcaagacagagctgttgggatcatcgctcttgttcttcttcttgttgggatttattttaggagtttcttcaaacttgggcgaggtaaccgcgtacaaggagtgctcaatagaaatagaaaatagtttttcagtttccaaatagagaaatactagtagcaaccattagaggaataacaggggcggagctacagtgatgcctatgtattcccaggaatacccaactttttttatcaaaaaacaactatacttcagtatatacacataacacatatacacatattagttgtccccactcctccagagtccctcgctcggctcacgcctcaccctcacgcgcaaatgcgctgctcgcccgctccccaattccccatttgattccaaaccctaggtggcggcgttcggcggcggcgcggcggcgcggcgaccggcggaagcggcaaggcgtccggcgaccggcgacgggagcagggagctagaccagcggtggcgcggcgaggcattcggcagcggcgcgacgccgtggcgaggcattcggcggcggcgcggcgaagccgcgagacggcaaccgacgggcgaccggtgacggcgggagcgaggccacgaggccgaggggcaggggcgcggcggcggccggccaacagctgcagctcagcgggacagcgcccagcggcactgcggcaggcgcaatttcaggtgacaaatcaagagttcaagattcaatcagtcctaaatccactcactatgtgtccatgtctgatgtttttttaccttagtctctgagtagtttctttttcctgtacttttgtagttctgtagattgaagaactctcaaaatgaagaagaaatcgattgatttgaagactttgtgggatagacattcaaagtctaggaaggtagggttaggttctggttctggatcaacaacacaaccagttagaattgacagtgaagttgctgttccttctgttcagccgattacagatgcaaatgagagtccagttcagattcagattactgcagttgaggttgtgcctgaggtagcagccagtgatgcagcaagagatgtgacagaacctgaaacagaggtagctagcaatgatccagacatagcaacagcagtgacacagcaggagcaaccttccacttggtctcctatcagagattggtctcccatcagagatggtgatgatgaagagacagagtatgactcaagtgatgaagctatttatgacattgatttactttgtcatgatcctggaaggcgaattgcaatcaaaaattatgatgtcaatgaacggaattctgtgataaggggatatattgcattagggccatgccaaccacgcagccacaattttcctataaggaaaattggaggtaagcctcggcgcttccttcctagttggtatgacgaatttaaatggcttgaatatagtgtggaacaagatgctgcattctgttttatttgttacttattcaagcataaaattaataattctggtggagatgcatttgtaaataggggatttaggaattggcacatgagaaaaaggattgcaaaacatgttggtggtatgactagctttcacaatgtggcacaagataaatacaatcacttccttgcacctaaaacaaatattgttgagagctttgctgccaccaatgaacaagacaaggctagatatatggctcgtttaacctattcaatgaagtgcttgaagtttcttttaaggcaaggtttggctgcccgtggacattatgaaagtgaaaagtcacttaataaaggaaatttccttgagatgttgagtatgctagcagaaaactttgaagaagttggtaaggtggttttgaataatgctccaaagaattgtaagttgactgctcccgaaatacaaaaacagatagctaattgttgtgccaaagaaactactaagcttatcatggaagaccttggtgatgaatattttgcaatacttgccgatgaatctagtgatgtgtaccaaaaagaacagttggctctttgtttgagatatgttgataaaaaaggaagggtagttgagaggttccttggtgttgttcatgttgaaaatactacttccttgacacttaaagctgcaattgaatcattgcttatggagcattccttgagcttgtctaaggtccgtgggcaaggctatgacggtgctagtaacatgaagggtcatgctaatggactaaagaaattgattatggatgagtgcccttctgcctattatgtccattgctttgcacatcaactccaattaacacttgtggctgttgctaaggaaaacccagattgtgtgtggttctttgagcaacttagatttttgttaaatcttcttgggaattcttgtaagaagacagaaatgcttagagttgcacaagctcaaagaattgtagaagaactagatttgggtgacattgaaactggaaagggtttgaatcaagaaatgggtttgggcaggccagcagatactcgttggggatctcactataaaactgttatgcatgtcctatctttgtatccttcaattcaaaaagttcttataatggttggcaaggatcgctcttttggtgcagaatgtgcaaatgcacaaacagtgttgacaatattccaatcatttgagtttgtttttatggcacacttgatgcaaacagtacttgggttcacatctgacttgaatcatgctttgcagaagagggatcaagacattgttaatgcagtaggactgattttattgacaaagtttcaattgcagcaattacgcgaggatcctggatgggatgattttcttcaagaagtgcaatctttttgtgtgaagcataagatcaagattcctgatatggactctttctatcggccggttggaagagataggaggttctttattaaaatcaagaatatgcatcgcttccatgttgacatgtttctaagtgtcattgatagacaactacaagagcttaatgaacggtttgatgaggtaaacacagatttgctcctttgtatggctgcatttagtcctatagataactttgctagttgggacaaagataagttgattaagcttgcacggttttatcctaatgatttctcaagcacagagatgaaccatcttccatcagcattgaaactcttcctcactgagatgcgtatagatgaaaggtttagaaaagtaaaaaatcttgctaatctttccattatgattgttgaaacaaaattgcacaatagacatgagattgtttacaagcttctcaaattggttctggtacttccagtagcaacagctagtgttgaaagaatattttctgccatgaattatgtgaagaataaattgagaaacaggatgggggatcaatacttgaatgattgcttggtcacatttattgagcgtgagatgtttttgaaagtcaaggagtgtgatattataaaccgctttcaagccatgaaggaacgcagaattaaagctactcttccaagccacgaaggaaccgaaatagaaaattagaggtaccatgtaataatttgtaattttatttcttagattatcggtattgacatactgtgaaccattgattttttttactatgaatttttttgttagacgggaatacccaactttcaaatcctggctccgccactgaggaataaataaaaaatatatagagaaagtgggaaacatcacttctccatgcatgggccctcttattattttttttttgagggcactcttagtcttatcttcatcatatagtagtgtgactagtgtcattgaattcaacacaagtaagaccagagtagacgtaagcaggcttagcaacaacacataaggcatggtccacaggccccatcgcgttgtattttgcaaagaaaaacaaaaagacaaaaaaacacacagaggaatattttttatatacgtaaatgacatattctctacttctcaaattgatcatcatagaacaaaatccaaaatttcttaaattgatcattatataactgcatgatataactgtatggacacaaattttatcggaatacgattaatataacatgagagaatgtgtgcatgctagggcgtaattggcatattgttttaattgatgtatacattgtggaagaatgtgtgcatgttgtcttgattgatgcgatttaaattattattggtcttggtgtataaatatatatgatgatcaatttagaatggcggaagtatttactttgaaacttataaggtatttttttcgcagtacacacgctatttaaaagtagtatataaaaatcaacttaaaagaggagacatatgagattcagagaggtagcaattacattgaaaaaagtggctgaaatcaaatagtatatgatgtcgtatttttttagcaaaaccgttttcttattttacatgtaaccttttgttttgtttccccctaaatttcccttattttatccacgatcccttaaaactagatcgtcactccagttccttgtgatatttgtacctttttttttacaaatattctttcaaaaaatggagaactatcagatgagaaatgataaagttgatcttttccgttgcttacattttgtgtttgagaagtaagcttactgatgacggtgacactaaacagccatgtcttctgtttgcaaacttatgccagaacaagagtctgaccatggcgaggacggctctgcaccaaaagccgccgccgtgcgtggtgggtcaccgagaggcggcgtccggtggtggctgtcggtggcggcggacatgttcatggtgctctgcggccagaccgtggccaccctcctcggccgcctgtactacaactccggcggcaacagcaagtggatggccacgctcacgcagtccgccggctcgccgctgctcgccatccttctcctcttcacgccggcgcccgccgccgacgagcccaggccggcggcggcaaagatggcgcccatctacgtcggcctcgggatcatcatcggcttcgacaacctgatgtactcgtacgcgctgcagtacctgccggtgtccaccttctcgctcgtggccgcgacgcagctcggcttcaactccgtcacctccaggctcatcaacgcgcagcggttcacggtgctgatcgccaactccgtcgtcgtgctcaccttctcggcggcgctgctcggcatcggggcctcctccgacgagaccgccagcagcgtgccgaggggcaagtaccccgccgggttcgccctgacgctcgccgcctccgccgtgttcgcgctcatcctgtcgctgttcgaggccaccttcgagaaggtggtccggacgcggacgctccggtgggttctgcgcgcgcagctgtggaccaacgtggtggcgtcgacggtgtcggcggtggggctgctcgcgtcgggggactggaggacgataccggcggagatggcggcgttcaaggacgggagggcgaggtacgtggcgacgctggtcgggacggcggtgtcgtggcaggtgatggcggtgggctcgctgcggctgatcgtgagggtgtcgtcgctgttcgccaacgtgacgggcacgctgtcgctgccgctggtgccggtgttcgccgtcgcgctgttcggggacaggatgaccgggatcaaggccgtatccatgctcatggccgtctggggtttcctctcgtacgcgtaccagcagtacatcgacggccggcgcgcggccggcgccgggaaggggagagcggcggcggagtgccgcgtttgcgccgcgcgcgccggcagcgatccggactcgcccgcgtgaggggcccgcgttttctcacggcccaacaaaccgaaagtagctcacgtctacttttcgcctgaggcccaatacacagaggacatgtaggcccatcggcttgtgttttgagatactgtttaggttttaaaccgtgtatccatcatctgtagggccccttggaaaggaataattcactcgaggttctttaatttgtcaacgaatctgattttcatatttcaaccaaaatatttttccttcaactgttaaaaccggtgcaatgtagatcacatggctaattttagctgatgtgacatgtacatggctaatttgacttgatcttcatttgacgtggcatatgaagcaaaagttaacaatttaaaaattaaaataaaatatataggcccacatgtcagtcagaataataagattaaaaacagcgagacccacgtgtcagtagaccccacttcatccacctcatcctctctcttcactatctccttcccttctccttctcacctcttccccttcttccctagaggtggtcaccacgagcaccagcacgccagcgaataggagtagaggcacgacagaggcggaatcggcggaggccggtgagcaagggcagggagggaggagcatcaccggcccgggctcttcgcgcattgcccaccgtcactaagcccgcgagtatctgctggcgagtgcacgtagagggggacgaggcggggaggccggcgagggtggaatagcacgttgcacggcctcccgcaccctggccatggcgggaagatgaagctgctcctcttcctcgaagatcgcagctgtgcgggatttttctccggtgccctggtcgcgagcgaggccgacgtagccgcaaccgcaaccggcacacgacaccgtcaaaggttcgtgacacgcttgttgccggaccagataccggcaacaccgatgccaagcaagaactcgacaagcaatgcctcatcttcgtcaccgttctcgcctcagtgccagtagccaaagcaagtggagggactagagatcgtcgaggtggcaaccggcgagcggctgtcagcgcacgacgtcaggctcatcgagatggccggcagctcggtcaatgtctttgcggagttgtcggtgaagtcgtggagagggtggaaggacaagggggtgagatagagaatagaggggctaaggtagaggaagtagggcccactgacatgtgggcccactattttttaatcttattatttgactaacatgtggtcccatatattttattttatttttaaaattgttaaatttcgcttcataagccacgtcaaatgaagaccgagtcaaattagtcacgtagatgttacgtcagctaaaaccaccatccaaactgccatgggacctatatccactggttttgatagtttaggaacatgttgtatctggttttccagttgaaggacgaaaataggattcgtcgacaattaagggatctcatatgaacttatttaccttggaaatacatgaattggccgctgcggagtatccaaatttatccaaggaaaaagtacacccaaggtccctcaacttgtcatcgagatacaaaatcgtcccccaatcacaaaaacagataccggacgtccctcaactaacaagacagttcgctttaggtccctcggtggttttgaccctggttttgtccgatgtggcggctgagtcagcgtgggacccacgtaggccccacatgtcagtcaatccacgtcagcctcccccttcctcatctcttcctctcttctacacacagtcacacacccaggcggtagcgcgtcggcgcgtcggcagctgcggcggtagcgcctccacagcgccgcggcgaggcgggggtagcgcgtccacgacgacggctggcagcggcgggggccgcgacgggggaggggagaagggagggcgttggcgtcggcgtcggcggcgacatgggagaaggggagggcgtcgccgcgcgggcgaggtcgaggacggagaccccggcagcggcccagcgaagctcctcggtggccgaatatgggcccgggaaggcggtagtgaggcgggaacggtgcgggcgtgcaggcggcggcggcggcgcgcgcctcccgcgtccgtgcctcccgctgccttcacgcaccacgctggcgcctgcacggccgcgccctctccgtcccgcgtcagcgcgtccggccgatgcccggcggcctcccggctcagacactcactttgacctcccgccctgcagacgccaacatagatggtcatcttccggtccttcccttgcttgggtgacgacatcaccctgcagcaatccctccttggagactgcacgcgcgccggtttaagagcaacattacaaaaaatcaagggtttttttgttgtacgtacaaatcaattcagtcttttaactacagtgtgtgtttgattacccttttccagaggtcggggtcgggcttcttgaggacgatgacgcggtcgagcagagcggcagggtcacggatgcgccagccgcacttggcaggcacgacgcggcggcgctcatacacagtgacggtggtgttgcggctgtgataaaatgtgaagcattgaaccatttgcctcgggccgcatctctgttaaatagtggtagaaacagcctctaccgtggcttacaatgttcagttacaagtgataaggagatagaacagatttggagataagaaactaatcctaacaaccttatcactggatgagctattacgggtgtgagcagctgcgccactactggagatggaaaggctcccgtgtgctcaaaacctacgggaacaggccaaaaacacacggtaacgtcgttaccgagttctagctcacggtaacgctcacacggcggcttcatcggtttaccatgtggacttcccgtgagttcgcacgaaaaacgcacgggatggttgaaaattttaccgagtgtactcaaaactcgggactcatggtaacactcacgacgtaacggcgctcccaacagaacggcgggttaccgtgcaccaggatcacacggtaacagtttgtttgttaccgtgcgtccacagtatcactcggtaagttttttagtgttaccgtgagttgagcaatatcgggcactcggtaagctttttagcgttaccgagagttcagcaccatcgggcactcggtaagctttttagcgttaccgtgtgctgtatgctattgacgcacgggaagtcacactcagcactctttttttatttatatttctatttctatatttgcatgccaatatagatcacctgcaaaaagtcacacagaagactgcaatgcatcccaatcatttgcaattcatcatgacacattccatcacaatacaattcactgcattgcatccctatcatttgagattcatcaagacaaattttcatcacaatacaattcaccaagcatagaagagatgccaaatcccagacataggcatatattttggtaaaaattggttgtaatgaataagcatacaagctgatcatggtccatgtcacttaaagcaaatactcaaatctttgagacaatagctagcaccagattatttagttcattggtcctagaacatgcagttgaaacttgagaatacacctgcaattgtgagaaacttataagaaattaatttttcttgcaaggactgttgagtaggaaccatatgaaaatggtgctatgggtgctgctgtatccttgtgcatttctcatattatgaattttttcactaatctgcaccagcctcatgtttgatgctttacaaagaagtattgacatttaatttgaagcaaaagaataatatgagctagtatcaaattatcctccataattcggacccatgtactgttacaagctaattaaaccaaaacaaagaagaccaaatggtcagttctataagctgagaaatggatttgcttggaataaaaacatgagaaaatatgtatccacctagcaaacctacacacttgccattatgcagagtagcagaactatcatataagtaatgaaatgaaacatgcattactatatatcttgtgatttgtcaatatggttaagaacaatcaataatgtaacttgagcagtttttcacagttgataaaatgtatgcatctgttgatgtacagcaccaaccaccatccatgaattgatcttaaaactgatgagatgaaagtagataccttttctgatcagctctaatgatgctacttatattgcttcataacctgtaggaattagccacacattagtaagaacatgcaaggagactgatcaatacattgtaattatttgagaaatgattaagtagggaaggtttgaatgaaaaacagatcatgtccatgtagaagaaactaaagtgtaagaaaaggcaaatacattaagcaaagcatacttagcaagtcagcacagaagtggtcctcgtcgttgtcatcttcatcggttctattaaagcagggtggaaatcaatagaataagacatcaaatgagtcatcttcatcaattgtagaataaaatgaacatgtaaaaaagcaaaaatattacttagaaatattcatcaatgatggggccctcctcctcatcttcatcaaactcagaactatcagattcatcttgttgtagcacattggatccatttagaagctgcaagtccttgtcattgacaatgccttcggcatctctagtggtggcttcagaaacattatggagtccttccataagatcaactacaaaagtgccttggagaccatcttcttggaaataatggacattatcattgttgggaagaaagtcgtagtccttatccacaggggctgctatttttccagttggctgaaccttgtaaactacccaccaatcgatcagggctggtacagatttgcatgggtatggtatgtaataaacttgtgtggcttgatgagctacaacaaatggctcatacactgcaagtgttgatgaatgggcaacttccactaaaccatactgtggggtgtaccttgtttgggcagggtcaaaccaatggcagttgaaaagcacaagagtgagttcactatcaccatgaaaactaagttcaattatttctttgatgtagccataataatcagtgatatcactattttctccttgtcctattgtcaccaagccactatttatggtggttgcatttggcctctccttctcatatttatttgtacggaatcgatagccattcacatcataaatactataggtcttcactctagtatggcatcctttagctacttgcttcagatcatcattcatattcatgtctataagactctacaagtgaagtgaaataattttgatgaattatagttattaacaggtgcagaaattagatgttcaagttgaatattgaaattgaggaattacttgttggtagaaccaggttacgaaattaggacaaccattcctagcaccattccgtaagaggttctccttttgctgtcttgttggctcgcctcgtctactccactcctcatgtaagaatttcctgtaaacacagaactcatgcatgtcaagaaaggataaattatttcatgctatgaactggatgtgacccaaataaagtgcttacccaacgtagtcatccacttcaggcaggtttgtgaggacgtacaacatggcagcctcccactccacttcagttaagtgtctagtgactcctcggctagtagaatcacccttaatagagaagaggctaagtgagcattctctcgactcaacagtaacattgtaccgagggactggattgtgaactgtgtacacttgatcagcaaagtatatggttgtgaagtttgcgatttcatctagtatatatgcttctgctatagatgcttcaacacgagctcggttttttactttgctcttaagatccttttggtctctttcacctggatacatccatcggtactgtactggccctcccatccttgcttcgtatggtaggtgaagaattagatgctgcattggattaaaaaatccggatggaaagatcatttctaacttacaaagcaaaacaggcacttgaagttccatgctttcaagctcaattggatctacctcttttgcacacaatttacgataaaagaagctcaactccgctatcacttcccacaaataaggttgaaagtagccacggaacatgactggtaaaaggcgttccatcattatgtggtagtcatggctttttaacccattgattcgcatctttttgaagttcactcctctccttaggtttgatccatacccatcagggaatttgagtgtttgaaaccattctaatatttccttcttttgagtcctattcaaacaaaaatcagctcttggcttcaaccactgcccagatgtttgcctccggatcatgttaagatcaggtcggttacagagtattgcttgatcaagtcgagccttcacattatccttcgttttctctggtatatcgaaacaagtgttaaatattgcctcagcaacatttttttcattgtgcatgacatcaatgttatgaggaagtactaatttatggaagtatgggagcctccacaagcctggaatgtgtgtccaattgtgatcctcaccgtaaccttcaaacccctctccattggcagcaggttgcagacgttgcaagcgaacatgaacctcttcagttttgaaccgatgaggtggttcagtcgtaacagtagtatttgcaagaaaagagtttgggtcatttctaaaaatgtgaccatgaggaaggaattgtctatggcaatcaaagaaggagtactttccaccaaacttcagccgtctttctttaagcacctccatacagactggacatggcatcttaccatgtacacaccacccacaaaatatcccataggctggaagatcatggaacgagaataaatatgacacccgcatgttaaaattctgtttagtggcccgatcatatgtctgcacaccatgctcccaggcatggagtaggtcatcaactagaggctccatgtacatactaattttcttgccgggataatcaggtccagggataatcaaactaaggaacatgttgtgtttctgcatgcaaacaccaggtggaaggttgagagggatgacaaacacaggccagcaggtgtaggaggcagcacccataccaaatggattaaacccatctgttgctattgcaatcctaacattccgagcgtctgatgcaaattccgaaaagtcgcgatcaaattgcttccatgcttcagcatcagcggtgtgtactatcttgttaggatggtacctatggccatacttgtgccaagtcatttgcttggcttgtggttcagacatgtataaccgttgaagtcttgggatgaatggtatataacgaaggactttcattggaatatttagttgcttcttttcaccatagctgttctgcacctccacatatctactctcaccacacttgtcacaatgggtcttctctgaattttcctctctaaagagcatgcaatattttgggcatacatctattttctcatatggcatggtcagtgcacttagaaatttcttagcctcatataaattgagaggtagcttgtggccttgtggaaggagagcaccaaacacattcaacaatgcatcaaaccctgcaatggatatggaaaattgagacttcactgctagtaaccgtgtgatggcatctagttgagatacttctgtgtgtgcatggagagattgatttgatgcagtcaacatttcataaaaagctcgtgctataggttccggttcttcctcctcaactgatatatgtgcatcacgcacatcatctaccatgtcatccatccgatgaacctcagcatccccatcttcatcaaaagtacgttgccggagcacatcatcgcgtgtagggtctgagtcagactcgccatggtaaacccacacagtgtactccggcctaaacccatgcttaaaaagatgtttc

SEQ ID NO: 2029 - DNA, 27355 bp, Oryza sativa
tgattacgctttctacgtccattgtacatccaactgcgatcctcttccatccttttttgctgcaaagaaatacaacgaaacaaaaactaagggttgattcatatattgaatttttgggaatgagaaagagagaaaaataaaaatggctactgctcacttacacagtgttctttcaggagaggccacaggctccagtgctccagatggcgatggtggccagcagcgtcgttgcggccgatgagggcgtcctgcggctgcgctccgcgcggaggctcccagcaggagaggggcctgcgactccgacgaaggaggctgacgaccgcgcaggccaagaaaacggggctgacggagggtctccgagaagaaaggtggctgcaatccggacggacggagaaggcagccgacggcgttgaagctggagaaagcagccggtcgcgttgcaggcaggcgccgcgcgcgggagaggaaagaggtgggcggcggcggaatcgattctagggttggctgtgagggagttcgcgcgaaaacaaaattggggaaagcgtgttcggctgatagaacaagctgcagtagagaaacatatggcggggggatttctgacattgtgggccactgtgtcatatttacctgcagtacagaaaaattacatatttctgtttctatcttaactagttctatttctatttcgttactattcattctaatcaactagtttgacttctacagtatttcattattatacattcccctgtgtataataattaatttgtgcctttgtaataatgattagataacatctatgatttatgagaacaactaaaaatgttttttatttgctaaaatatcatttgataagattctctaaatatatttattctaatcaactagtttagatatcatatcattgactaatttcgtttttgttatttagtacttatcaaaacccaaggttaacggtattgggatacgtcattatcgtacgatattatccgggtaaaacgacacgtgtcggttgtagtatcgttttcgggtggtatcgctctagtgtcgggatacgaagcatagaataattagaagcgcacaaaaatcagtatactgatagtttccatcgaaacaatattactatattttgtaggatcctacgagattttttttatttttgaacttatttctaaaatatgaaccttttaaccacgccaatctgcctggcgtcgcaaaacaacattgacacggcttacattgcgattgttacagttcaaaattttaaaaagttaaaaagaaaataaaataattcaattatacaattcaatactactttaggaaaaaaaaacaatactaactagaatctcgatactaacaactttatcaaaacccttttagatttttgcaactataactataataccgcggtgtcaaatttactctattgataacttgatcctcacattgaaaccctatggactctcctaatatttgtaactagcatggtggcccgcgcagattgcgtcgctagcatcattatattttctccgaatttcaactatttctaaattgtatttctatatggactctgtttttctttttctctaattaatatgagaatttctaggccgtgaaagcgaacgttaaggctcttttttctattccttaaataagttaatagatagatgttaaatccaaaatatagatatttataaattactttccactactttccacatttttctatactttctatagccacttggttaattgcaaattcaccgtgttcaatattcacacgtaaccatatttgtaaactatgatcaagtgtcgaattgaaaaccatgtcactgtgatttcagattgagccagtattgtgcagacaagtttgacatggtctcaacaccacatctggctatcaacattttccaaatcaatttacatctttctgagaatcaaattccatgcgcataacataatgaagttcataagcttcattaatactttccatcagcataggttcttccctacaaagtacttaagttaccaccactaaatgtgcatctcaccacagcgcacagcaccgttaggcatacacaaaatatacaacttcatcagctgataacgactacacaaaatatactacctcatcagctggtaccaattagtactgctcaacaaacctacagataattagtgggaacaaccaatgggtaccaacatgagcccatcacaacaaccaggacatacaccagaacaaacaggacttggcacagtcctacttcacagttacatcacaccaaaacacccacaagtttctggtatcacaaaagacttcccaatttctagttctttcggtgaagagcgattttcagatactgcacgcctaaagctgctgcctgctattactggcaccaacatccaggttaacttgcactgggatatttggctcatggaccagtcactcagtggtggtaactggatttccaatagagacttcagatccagatgtagcctgaattagcaatgtttgttagaaaacaaacaacaagtttgtattaatcatacaggacatgtctatcctgcaacattacactcaccggatgagtcaacgtaggtgtgcaaggaggcagaaagtttatgttgagctttctttgcagtacctgcaatttattcagacaatgttttaggttaaaattatcaccagttcaaggcactcacaattaattgattcagcagcaaacaatgcggacagttgtgtaaacaggatactaccagttacctccaaagcacatgtaaaatagcttgttttctcctggaacaactcgtgctcacgtacccgctccacacgtgcctgctctctctcctgctccatctccttgcgtgtccgctccatttcctcaagtgcccgctccctctcctcacgtgcccgctccctctcctgctccctctcctcgcgtgcccgctccctctcctgctccctctcctcacgctcacactgaagttgacgctcaagctcctcaatccgggcactatcatcagggtttggcctcagccgtctgctaggccgtggatcatcaagtgagcacctgcttctcccaacatcagcaagaacatctggtgtcttaaggagtccattaagcaggaagaagcgtccatgtttcttgccaccaccagccatgtgcacagccacaccatcaatgggttcagtccgccaattactgtcttctccgtgcctctcagtaaaagcgcgagcataggcctcctattacagattcaaatgaaaatggcagttaaccaaatggaatgtagacaatagagtagtacaacacaaatttcaatgtgtaaggcacttacgagcaacatattctgagatgaatcttcatcacagtagccctcgtctgggtctaccctattggcatgagcataagccttcaatacatgcactggtgtgcccattttcttctcctacattcaaaataaatagtttaacactattaataatgtgctgctgcaattcaatgaacaccgtacaattaaagtctaaagctatgcaggtcttggtattatgtctaagaaaaactaacgaaccaaattcttgtggtaacgatgaaggttagcactgccttggcgatgggctggcgttttcatctttgccctgcgttcgctacaagcacgggagtaagcctgccattctggattgcaccacctcaaatctgacaataatgcccacgcacgaccagcatttaggaaccaccatggcttagcctataacaaacaaacttgcgcttagtcactaatatgttcaaaagctaagcatctaataacattttcttgttcaagcgagcttactttcatatactccgcctttgtgagataagtcctgcaagcagttggccgatctatatctgttttcagaatcttcttgtgataagtaatcacagctaggatacgagcctcatagaatatatcaacaaagagtttcttgacgcagttgtgcacaactcttctagcctccacttctgtcccctctgcccacctatagaacccctgcaactaccaaaagttaaccaaacaatacatgatctatgtaacttgaaagaaactaagttggtaaagaaatacccagaattcttcctcaacgcgatggaggaggcttggcaagcgtgcttgattagcttttgcattatcaggtttaagcaagtaatgttccggagaccatgcaggctcatctctacccttgaatttcaccacaccagggaaattttcttttatcaatgtagtcaggataccattggggactctagtactctgaccataatcttgtacctcccattgcctgcacaaatcccaaccaaaagctagatattagcttcatacttgaaataacagcaatatatagcacaagcaacacacttacatatcccctattggcctaagcacaggtttatcctcctctcgtgtaggtcgtggtggcacccttgtagggccacaaaaccagaactcatcatcttcctgctcctcttcttgaacaggatcagtaggttgctgagaggaagatgaccttgtcctattcctagatgagatggcagcactagctgaaccatctgcagaactggaggcccctctagagcccgagcttaatcgtcgcatcctcctgcaaaacatttcagcatatttagagaacaaacaatttttgattgcacggctttaggaaaagcccaaacatagaccctttacacgaaaaggtcaaacaaatagaacaaacagatgctcggattgcaagctttctaacagcaggactacagatgtttccctccaccaaactcccaaaagtagacatctaactgaaacccaagcacataaccatcccgacaggatataacaatcatctcttgttacaagaagaaaggcaccaaaaacacatcctttaatagaacatcaggcaggacatccataggcaccaaaacaatctagaattgcaaggctaaataggaacagtatacaactgcaatacttcttcaacttcacaagtattggtaggtcagaattacttcagaaataacagcatgccatcacattaaaatcctaaagctaaaaagactgctagaggacacaagcattttagtctacgatctaaagcaaaacatgagattactgaagcaataatcaagagactatatttcttatttgataaatccagagaacaaagggattaatttctcctttcttatttcttcatcaaacatcaagagactatacaagctagccaacattcgacaatcacataccttgatgttgggcagattgcgtgcaggtgcggagagaagagggcggcgtgcaggtgcggcgagggaagggggcggcgcaggtgcggcgagggaagggggcggcgcaggtgcggcgaggaaggggcggcgcgcaggtgccgcgaggagggagagaaggagaagggcagcagtggcgaggtgtttgggactgtggcggcgtgggctgtgggagccggtggggttttagggttaggatttgttttcctttttcttttttttatccaatcgacatgtgggccatcactcacttcccgtgcgctgaatgaaaaaaaaacacgggaacaccccttctgtttcgcgccagcgaaaaattgggccgcgccaaacggagctaggcgcgcgccaaaagaaatccgttcgcgccaaagagaaaaatactactcgcgccaacagagtttgacgcgcacagacggaaagtaggtggattccggtgttcccgtgagtcatctctaacacacggtaagcgcttgatggttcccgagtttattgttctactcacggtaagttaccgtgtgttcagagaaacacccggtaatattcgcatgcacacgggagccttcccatctccagtagtgcgccattatcgcatgcatgcgccatgcaccacgcacaggatagagttaggttgtttcacagcccctcctgaaggaactgacagtgactttgtaaacccattagcaacttgatctcctgaaggaacaaaatcaatctctaaaagcttatgtgacactcgttctcttacaaaatgataatcaacctctatatgctttgtccttgcatgaaacacaggattagctgataaatatttggctcctaagttatcaccaaatcttgacagctttaggagactcaattcccaattctcttaacaaggtttgtacccacattaactcagctgtagtattcgccacagccttatattctgcctcagtgctcgaccttgacacagtggattgtttcctagcactccaggacacaagattagaccccacaaatatagcaaatcctcctgttgattttctgtcatctatactacctgcccagtctgcattagaatatccatgaacaagagtagacgcactcttatgtatattaagtcctagacttgtgcactgattcaagtatctgagaattctttttactcctgtccaatgacgggtagtaggagcatgaagaaactgacaaactttatttactgaataagctatgtcaggtctagtcaaggtcaagtattgtaaagcaccaactatacttctatattgtgttgcatcattaggtcccaagggtgatccttcatataaagttaatttttcactgacagagagaggagtactaactggcttgcagtttgacatattaactctttttaataaatcattagcatacttctcttgagtcaaaataataccattggaaactttagttacctcaattccaaggaagtaatgcaggtcacccaaatccttaagtgcaaactccttgtttaaatccttcagaagtgctgtagttgccttctctgtagaactagctacaattatatcatcaacataaaccaatacaaacataattatccctcctttgttaagaaagaataatgaagtatcggcctttgaagcttcaaaaccaagttcaacaagtttcttactcagcctggaataccatgcccttgttgcttgttttaaaccatacaatgctttatccaatttacatacataattaggtttagaggatgactcaaaaccaggaggttgttgcatatagacttcttcttgtaagaatccatgaagaaagacattttgaacatctagctgtctaagactccaacctctagaaatagcaatagacaggatgattctaatagtagcagctttaacaacagaactaaaggtatcctcatagtcaataccatatctttgtttaaagccctttgctacaagtctagctttgtatctgtcaagtgttccatctgcctttcttttaatcttatatacccatttacacccaataatattttgtcctttctcatacggaactaggtgccatgtattattttttatcaaagcatcatactcagcttgcattgcagctatccagtttttatctcctagagcctctctattattttgtggcctctctatcattttgtggttcacgagtagtgtggagattatggatatctcatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcatgtgttgattttctccaaatcatacaatcaataagatactcggcggattcatccccggacaggagtagggtattacttcttgaataagaaggcctgaacctgtataaatcctttgtctccaaacccattcacttctccagcttgatagccacccccttttattattgccgaaatctagtttcgacagttggcgcgccaggtaggggggcgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggagtcagaccagtcgggagagaaccggatttcagtcccgtttggactcccaaacgcggctgaaagttacttcaagaccatctcaatcgagttggcttcaaaccactcgggcgagatcgcatcttctccaatgtcaccagatcaagatgatgaggcttacccaccgatcctgatgaagctccccgacgatttggcggccgtctccatcacgacagcgtctccatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgtcccaccgacatcgtagagtacgacgagtttagctctcgctacaacgacccggatctcgacgacttcgacggaagcctagatgacaactacacccctctctacttcggcgtcttcatggccgataacgagacggaggagcaacgccaagcccgggaaaccgaagcacgtcgcgagactgagcgtcgccgactggaggaggagcgtcaagcacaagaacaagaacggctacggcgtgagcagcaggagcgtgagcgaaccgcgaaggaggctgaggaccgacggcagcgagccttggaagcagggcgccgagcgcgtgatttcaacggccaacaagatgttgaagggacaccggttttccgcacccctcaacagaatgcggttgccgcgatcaccctcctcgacaccctcctcaaggaaaacgagctcaatcaatctgatcacgtcgtcaacatcttgaaccagacaaagaccatgattgcggcttcggtcccagttaactccgaaagcgtccgcacgccgactggcagccgactcccccacttccgatctcatgactaccgtcatccaagcctcagcatcactggcgcaggatccaatcgcaggagcaggggtcacgacgagcggtccgttcattcgcctcccgaccatcatagggagcgccgagtggaacggcctcgctcaccacctcgtcgccgccccgtcgatcttcgcgacacaatcatacagcgccgagcagctcgaggccatcatcattcgccggaccgccacgacgacgaccttgatggagtagcagccttcaccgacgacctgcgtcgagtggattggccagccggcttcaagccgactggaatagagaagtacgacggtaccaccaacccagaatcgtggcttaccgtctacggtctcgcgatccgcgcagcaggaggagatagcaaggccatggcgaactatttaccagtggctttagcggattccgcccgatcttggctccatggattgccccgtggtacgattggatcttgggccgaattacgcgaccacttcatcgccaacttccaaggcaccttcgagcgtcccggcacacaattcgacctctacaacgttgttcagaagtccggagaatcccttcgagattacatccggcgattttctgaacaacgtaacaagatctccgacatcaccgacgacgttatcatcgccgcattcaccaaagggattcgccacgaagaattggtcggcaagttcgggcgtaaacctcccaggacagtcaaacttatgtttgaaaaagtcaacgagtacgccaaagccgaagacgccgtcaccgcatcaaagcagtcgggtcccagttggaagccaaaaaaggatacgccggctacgggaggaggtggaagtaacaatcataaggaccgcaagcgtaagcctgaggaacttgttgcaaccgccattcactcttctcgacagcgttcgcgcgtcaacacgttcgacaagatcatgaactcccaatgcccgcaccatcctaactccaaccacgtggccaaagattgtttcgtctacaagcaattcgcggagcaatacaccaagactacacggaagaactccgacgaagaacaaagcacgtcgaggaagaaggacgacggcgacaccccggtaggatttcaagaccaccgcaaggagctcaaccatatcttcggcggccccctggcttatgagtctaaaaggaagcaaaagttgaccgaacgggagatcaatgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggaggcagtgcactcaatatcctcttcgccaagaccttggatgatatgcagattcctcgctccaagctaaaaccaagcaatgcgccttttcacggagtaattccaggattatccgcaactccactcggccagatcaccctcccggtcacttttggcactcgggaaaacttccgcacagagaatatcagctttgaagtcaccgattttgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaacccgcgagatggcgtctgcccgagaggatatccgactggctgcagccacggcgagcgaaggagaagtgcccgctaccaagacttcaaaaagtggagaaagcgaagccaagactaagaagattcccctagatccttctaatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcggcaggcttcatcaaagaagtccatcatcccgactggctggcaaacccggttctagttcggaagaaaacggggcaatggcgcatgtgtgttgattatactgacctcaacaagtcttgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggagcatactgctatgtcaccatgccgttcggactaaaaaacgcaggagcaacttatcaacgtatgatccagagatgcttctcaacgcagatcggccgcaacgttgaagcctatgtggatgatgtagtcgtcaagaccaaacaaaaggatgatttaatctcggatctagaagaaaccttcgcgagcatccgcgctttcaggatgaaattaaaccctgaaaagtgcaccttcggagtaccgtcagggaagctgcttggttttatggtgtctcacaggggtatccaagccaacccggagaaagttactgctatcctcaacatgaaaccgccaagtacccagaaagatgttcagaagctgactggatgcatggcggcgctcagccgatttgtttcgagacttggcgagcgggggatgcccttctttaagctactgaagaaaacagatgatttccaatggggacccgaagcacagaaggccttcgaagattttaagaaactcctcaccgagccaccggtcttagcctcaccacacccgcaggagccgttgttgctgtatgtatcagccacctcccaggttgtgagcacagtcttggtcgttgagcgtgaggaagaaggccatgtccagaaagtccagcgaccgatttactttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcataaccgcggagcaaacggacggattgctaagtgggctttggagttgatgtctttggacatatcattcaagccccgaatttcaatcaagtcccaagcgttagctgattttgtcaccgaatagaccgagtgccaggaggatacccccgcggagaagatggagcactggaccatgcattttgacggatcaaaaagactttcgggcactggagcaggagtggttctaatttccccaactggagaaagattaagctatgtgctttggatacatttttcggcgtcccacaacgtcgccgagtatgaggcgctccttcatggactgcgaattgcgatctccctagggataaagcgtctaatagttcgaggcgattcacagctggtcgtcaaccaagttatgaaagagtggtcctgccttgacgacaacatgatggcatatcgacaagaggtacgcaaattggaagacaagttcgatggactcgagctcagtcacgttcttcgacacaataatgaagccgccgacagacttgccaactttggatccaagcgcgaggtggcgccctccgatgttttcgtcgaacacctttatacgccgacagtacctcacaaagatactactcaagttgcgggcactcatgacgtagctatggtttcagccgactggcgagagcccctcatacgattcttgacttctcaagaactcccccaagacaaagatgaagccgagcggatttcaagacgaagcaaactttatgttatgcatgaagctgagttgtacaagaaaagcccttcagggattctgcaacgctgcgtatctttagaggaagggagacaattgctgaaagacatacattctgggatatgcggaaaccatgctgccgcacgcaccattgtcggcaaagcttaccggcagggttttttttggcctactgcagtgtccgacgccgacaaaattgtgcgcacgtgcgaaggttgccagttttttgccagacaaattcatctaccagctcaagagttgcagaccatcccactgtcttggccgtttgcggtttgggggctcgacatggttggcccgtttaaaaaggcagtcggcggttacacgcacctctttgtggccattgacaaattctccaagtggattgaagctaaaccggttgtcacaatcacagcagataacgctcgagacttcttcatcaacattgtgcatagatttggagtgcccaatcggatcatcactgataatgacagataattcactggcggagtttttaaagacttttgtgaagactttggaattaagatttgctatgcctcagtggcacatcccatgagcaatggacaggtggagtgagccaatggcatgatacttcaagggattaaagcgcgagtttttgaccggctaaaaccctatgccggcaaatgggtggaacagctaccatcagtactttggtctttgcgtactacacccagtcggaccacaggccagtcaccttttttccttgtctatggggcagaagcaatgttgccgagtgaagttgaattcgagtctttgcgctttcgtaatttccgcgaagaacgctacgaggaggaccgagtggatgacttgcaccgactggaagaagtccgcgaagcagctttgattcagtcggctcgatacttacaagggttgcgacgttattataatcgcaatgttcgatcccgtgcctttctagtcggcgacctcgttttgaggaaaattcaaactacacgagatcggcacaagttatctcctctatgggaagggccatttatcatctctgcagtcacccggccaggttcctatcgactcaagcgcgaagacggtacactcgtcgacaactcttggaacatcgaacatcttcgtcgtttctacgcttaagcttatcactgtacttccctatcttgactgtcaacatcaagttttcttcttgaagttgtcagtcgggggctatcatcataataacggagtgtgattttttatcaattcaatttgcttccttggtctatcattgccttgtttgatttttctacttagtctgcgaggactgaaagtttttaatagcttctttgggttttaggctcaacaaagcttgataaaagcttttaagaaatcaaagacttggctagaattatcaagcacagcataaatacaccagtattgtacaagttatgcctccatttgctacatttatgctcagtcagaatcagtcctttcatcatcagagttattactactcggctgaaggtcggtgttgcggaattgatctacgacgtcacttgcaatcttgtcagccgcattttgagcattgctgataagatcaagagcagcctctacgcttgtcccgtctgcaaagccatcaatggcgtcaatttcaatcctcgggtacaaggatttggtcatcgccaatgccgtgctagctcccatacttccagctttcttgatattcttgaaatatacatccggagcaactctcagcttgtcgaagatttcggttgcgtcgagtgcactcggaccactgttattgaggaacatagcttggacgagtggtgtagcgacattagcgacttcatctcttgctccttcaagcctcttgatcttaccaaccaggacgtcaaattgagcttgagatttgattttgcggtctacaaaacacatttatgataaaaatctactgcattaaaaagagagaagttcagattgtcagctggcagtaccttcaacctccttcaaggccgagtccctttgcgcagccagttctaccttgtctctttccagggcttcaatttgtttctccatttgagccatcctggcggcttgcgctgtttgaaatccaaatggttgaggatacagttacgacagcgtaaattaatgggacagatctagagattaccttttgatgaaccactcagctcgaagtttgaatcctggagctgagcaattcggtcccttaattccttctctgtctttttggcgagctccttggcctcgtgtagctggtccctaactgcttcaagagttcccaaatgaggaaccagcttttctaaagttgcggtcttggcctcattgcgaagatggattctctgcatgatggttcatggtttagttttgctgaagagaaaacaaagtcatcaaaggcagtcacccggaagatttacattcacaatgcgagtggcttctccaagtgccttcttcaactggcacacttcctcatcttctttttgacgatttatgacgatgccggcagcttgtgagttctcgtcccaccatttgagcaagataggaggacgagagtcatcagctgcctttatgcgaggaatttcttcttcgtcatcgcctggtggtcctgatgtatttccaagatattagacgaataagctgaagttatttaaatcggcatcacttgagaagatgagttacttgaggatgttcctagctgagcgtggggtgatccttgttctttatctggagacccaatcatcgagtcgttaccagcctctggtccttgagaagttgttgtctgcgcttcaacttcgggagtttcttgatctggacctacatccgactggtttccagtcgggggctcttgggttgttgtagtttcagttgctgccgactggtttccagtcggaggctggtcactcggattggccttatcacctgaagtatgggcgccagtcggctggctttcggcagtcggctcagaatccttggatgaacttggttctgtcacagtcggatcaggatcttttccagttggatctatgtcggatggtttcctgcaaagtgttctttcaatattcagtattatttccatgagagaagcatgtcgaagtgaaatggtaccaaaaggtttatacctggaagatgttctaatctttggccttggacgactagccagttttttcctgggagtggtatgctttgggagtttattgggcgagcctttgtccccagatttgttgccgtcgtcgcctttgtcgtcattaagcaccagctttctcttgcgagaacctgtctgcccagtcggattggaggtttgaggttgcggatctgatctgattgtcggccctccacctccctgaacggtgtgctggcgaggagaccggcgctgagtgattggggggtcagacttcatcaatacatattcctgaatgagatgcctccacggttagttaactcaacatgaagacaagattatgttttggtcatgggttgaagatttcggatacgtacctgcggaggcggattgaatgcgttatatggcacaactggcagctgatgtgagtagctgacgacaatagcatttgagaagattttacacattctctccttcatgattttaaaatccagagaatctggttcttcacgattaggatcatgcttgccgtcaaactcgaatgccgtacgggatctttctttaattggtgccaatcggcatttgatgaagtgtcgagtaatctgctctccttgtaagccttgttctttgagttttagcatgcgatccatcagctccaaggcttgggctgcttcatccccaatcggaagagagttccaggcatcttggtacaccggaggaagacaagagtactcgggaagagcaggctcaggattctgaatataaaaccagtttgcatgccaccctttgtttgaggtcttgaagggcatagagaagtacttctggctcagagtccccctcagctgaaatccggcccctccgactacacatggcttactcttgtttggttggggcttgagaaagaagattcggcgaaacagagcgaagtggggcttaattcccaagaaggcttcacaaacatggacgaaattggcgatgtgaactatggaatttgggtttaggtgatgcaagctgattccatagaagcttaatatcccgcggaaaaattttgaggtcggaagagcgaagccgccatagaagaaatgggagaagaccacagcctcgtgtatatcgggggtcggaaaagcctcaccgcacgctggccgccacccgatgatttccttggcagggagaacgccgtgcgccaccatctccttcaggttctcctccgtcacgtcggatggcgcccattggccttcaaagctttccttctcttccgccattgattttttccgaatgcgctgatttgattcgagggatggctagggagaggtgagggattgaggcggtggatcacgggaaggattttgatgaacttttcgaaggtggattcgagtggaatggtgaaccctagtttgccggcgtagctctgtactgtagcagggagtggggaaaatggcgagagttccggcggggaagatgaagtgtcgcttggatctcgggatttcttgttaagggtatcggaggtgcgaatgggcttaggcctgaacagtacctcagcccagtacttttaacagcgtggcccattgtgctccttagggacttaggcattttttgctttggcaatttatgcgcacaatagtgttgcccaatgctgataaaatcctttttacgcggtcatataattctttggaattattgcaatgcaaattaaaaggtgcccgacagaaaggtgttatgctgtttttgtaagcttttttaggctacaaaagctgtctgggttaacttggaatgacttgtttttaccatagtcatttccttggtatgttatatgcctgttttcattatggtaaatagtcatagcctaggctattagacttattcattaccataatttttataatatttggtgggtaatctttagagttttctattcggatgcctgtcaagtgtgttcattcgtgaaccttttagagtgttaaccactcggattccttttaattatggctaaaaagcagtcggctaagaatgcttctttaggcgccgtgtatgcttttgtcatatgatgcacgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcatgtgttgattttctccaaatcatacaatcaataagatactcggcggattcatccccggacaggagtagggtattacttcttgaataagaaggcctgaacctgtataaatcctttgtctccaaacccattcacttctccagcttgatagccacccccttttattattgccgaaatctagtttcgacaagtagaattaaaacaaccatatttaacagttcgatcaatatatatcttttcttttctaataccactcagcaggcgagtgtgtggtctcggtgcacgggctgctgtagctgtcacatcaggctgcaccggctgggaatctgcactgctagcttcgccacttgctgctgcgccatttgcttcggcatctcccagactgacactgtcccctccagcgccagaggctgcagcagaggctgcgccactgctgtcagcgtcctggtcaggcacagtgctgctgtcctgtagcgtcgattccagtgccgcctccccatgcacgatgttgccatgcacgtccccatgcatggtattctccatttcctgctcatgtgttgtaccattttctccagaaacaacatcatcagcatcagacacaattaaattattactaggtaatggaatattagccactggtgtaactacatgtgtgccccctggactagtcgtattataatttgtcatggaggaaggcaatagaagaatttcagacctaagtcttgctcctgcatttgagtgaagagtagaaaagggaaatatattttcatcaaagataacatctcttaagatgtagacatggcctgatgacacatcaagacatttaaatcctttgtggtgagtactaaaacctaggaacacgcactgtttggaacggaattggagtttatgtgtgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatgccctctagagggcctcctgcccaccttatatagaatggggggcaggattacaagatagaaaccttatccaatacggtatcggtttcctaactctactttacaatcttatcaaaccaggactttaggccgttccgtaatatacaaggaaacgtaatacccaagtcataatctgttacatattccatacatataagttatcccctataactagtcggataaccatgccgtgtgggtatggggtacccataatctccacagtagcccctgagaccttcacagtcgaaaagataatcttctctcgaaccagattactccaaggccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggcttcgataattatagttaaccaagcgacttgatattaatatgtagcatatgcggtgtaaatccctgaataacatgatccgagtgatataccgactgctttgtaaaatatgatgagtgtaacctaaagttggctacattattgaaaattcacatagcaaaacagctataaaaaagcttgtatgttgtgaataaagaaatttccaaagtattgggcatacgccatgcgcacactgctttaacagatgtgcttaagtccctagaagacacatggttccaccacacctggaaatatacggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtaaccaatcaattgctttaaaacccaaacagcaccatgactatattaaaaagtcagcgggacagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgttcttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggtcagctagcagtgaagatgtaggcgcccaacaacaacgaaagaacagtcggtggtgacaaaagcaaaccgacgatgaagatgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttggaaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccagtgccgaagataataaagaagaagtcgctccaccatgatgacaaagttgcatcgccgtgatgaagtgaacacgagtcggcagcaacagaagcaaactggtagcgaagacgcgcagttgtgaagataaaagcactagtcggcggcggcataaccagtcggcaacggaagacgatgatgtccatcagtagtggtagctgtataaaccagacgtagaggtgagggcactagtcagcagcagacgagacgaccggcggtgaagaagataaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaaggtagcatcagttggcgttataacaggccagccgtgcaggcggtgacaccagtcagcggcggatgcggcggccggtcggtgaagacgtagacgcccaacaacggcagcataataagtctgccgtgcaggcggaagcaccaatcggtagcggcgaaggcaagccggtcggtgaagacgtagacgcccaacaacggcggcataataggccagccgtgcaggcggaaacaccagtcggcggcggcaaaggcaagccggtcggtgaagacgtaggcgcccaacaacggcggcataataggccagccgtgcaggcgaggacaccagtcggcggcggcgaaggcaagccggtcggtgaagacgtaggcgcccaacaacggcggcataataggccagccgtgcaggcgaggacaccagtcggcggcggcgaaggcgagccggtcggtgaagacgtaggcgcccaacaacggcggcataataggccagccgtgcaggcgaggacaccagtcggcggcgacgaaggcgagccggtcggtgaagacgtaggcgcccaacaacggcggcataataggccagccgtgcaggcgtggacaccagtcggcggcgacgaaggcgagccggtcggtgaagacgtaggcgcccaacaacggcggcataataggccagctgtgcaggcggaagcaccaatcggcagcggcgaaggcaagccggtcggtgaagacgtagacgcccaacaatggcggcataaaggccagccgtgcaggcggaaacaccaatcggcagcggcgaaggcaagccggtcggtgaagacgtagacgcccaacaacggcggcataaaggccagccgtgcaggcggaaacaccagtcggcggcggcaaaggcgagccggtcggtgaagacgtaggcgcccaacagcggcggcataataggccagccgtgcaggcgaggacaccagtcggcggcgacatatgagtgacatgagttcgtcaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtagccgatgtgggaacgaagcagtccatcaatggtgacaaaaacgccagtcggcgccagtggaaccaagccagtggtgtagatgatgaagcccattaacagcggcgaagtccgtcaaccgtataggcaaaaacaccagtcggcagcggcgaaggccagccggtcggcgaagacgtggacgcccatgaacggtggtgtgaccgaccaaccgtataggcggggacaccagtcggcggcgacgaaggccagccggtcggcgaagtcgtagacaccgaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggtggtgaagtcgtagacgcccaacagcggcggcataataggccagccgtgtaggcggaggcaccaatcggcggcgacggaggcaggccggtggtgaagtcgtagacgcccaacagcggcggcataataggccagccgtgtaggcggaggcaccactcggcggcgacggaggcaggccggcggtgaagtcgtagacgcccaacagcggcggcataataggccagctgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcagcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcagcccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgctgagtgtgtattgatctgacgatcaggttgtctcatgccctctagagggcctcctgcccaccttatatagaatggggggcaggattacaagatagaaacattatccaatacggtatcggtttcctaactctactttacaatcttatcaaaccaggactttaggccgttccgtaatatacaaggaaacgtaatacccaagtcataatctgttacatattccatacatataagttatcccctataactagtcggataaccatgccgtgtgggtatggggtacccataatctccacaatgtgtattgtaaggacgaagatgaggccaacaagcacaaccaaacactctcaaggatgagtagtcaggtttttgtttgaacaatttttctagaggtgtagaattttggatgattctactaggcacacgattgatgagataagtggctgcaacaaaggcttcatcccaaaatttaagaggcattgatgcataagataaaagagagagacccacttcaacaatatgccagtgttttctctcagctgacccattcagttgacgagtgtgaggacatgacacatgatgatcaattcctatttttgcaaaaaaaggaattaagtttttgatattctcccccccaatcagtctgcatggcaataatctttctatcaaacattcgttcaactagaacctgaaattctttaaacttctcaaagacttgagacttatattttagcactaaaatcatcaataaaactcacataatatttatttctcccaacagactctggggcagggccccaaacatcagaaaaaacaagttcaaggggaaattgagacacactagtagatctaacataaggtaactgatgactctttgcttcttggcaagcattacacacagactgatcgactgactcaactaagcatgggagattatttttgctaataactttcttaacaataggaagagacggatgtcctagacggctatgccacctggacaaggatagcttgacggtgccaagggcttgtttgctggttgatcagccaaaggagttagggatcaggtagagaccatgcctacatttcccttcaagcaaaatgtccttcgttaccagatcctttatggaaaagaatttcgagtgaagttcaagaaaagcagaattatcagcggctaactgactagcagatataagatttttcttagcttgaggaaaataaagaacattatttagatgaatgttacgactaggggtatgcacaatagtatgaccaatgtgactaatatccatacctgctccgctagccgtgtgaatctgctcgccgccgttgtacttttccttggtggtaagtttctctagctcaccggtaatatgatctgtagcacctgtatcaatataccaatttgtatctataccatatgagttagtagcagcagcggcaagcttttcatctgcgacgtagtcctcgtcgaagcgataccagcagtctgctgcggtatgcccgcgcttgaagcagacctggcaggtggggcacctgtcttggccctggatttttcacattttggtccttttgaaaaacttatttcgcaagtagacccctagaaaaacttatccaaaaaatggtcctttttgaggcgccagagtggctggcgccgtcgttcaacaggacggcgccagcctctttggcgccgtccccctgccgacgtggcggggtgatgctgaggtggctaagggga

SEQ ID NO: 2030 - DNA, 1067 bp, Oryza sativa
cccccccccccccccgaaattttttatttttgttttatttgtttgatattttttcacgcttagggacacacaagaaccaaccatagaaaaattgaactcaaatagacgtaatatgtgacatgtagaatttttcctctcctctcttctctccgaactagtgcagaggagagagatgtgcaacttttttatttttattttattttttgatatttttttcacccttaggaactcacaggaaccaaccatgtaaaaaataaactcaaacggacgaaatatgtggcatgtggaattttccaaagctccaccgaaaaacttctctcctcgaaaacacaatcttgcaagcggaatttgggggatttaatatcaccgaacccggcaaagctagggagaattggatgtaactttttctgtagatgtccgtgcatatattattttcctgatttcaagtccgtatgagaaagttacgcctattttaatagatgacatattttgtccgtttcgatagagttttggaaaattctacatgtcacatattttgtccgtttgagtttattttttatacggttggttcctatgttctcctaagtgtgaaaaaaatatcaaaaaaatgaaataaaaataaaaaaattgcatctctatgtactgtttaacttatatatgtcatttcatgtggttatattttgaattagattaagtaatttcatatagtggtagagtgcattatgtttaacatgctgatcaaagggttttagtaaaggagttatggtctaattttagtgaaggtgcaaagtagactaagtggtatgctagatattttcagacttagctaagtggtagttcgagtttaaattttttttgtggttggttgtatcgtgatcctgagtgtgaaaaaacatccgaaaaaataaaataaaaatgacaccgttgcaactccatacagagaaacaggaatggaggcggcggcgccagccatgctggcgccctcctccttggggcggcgccagcatagctggcgccctcctcctaccacgttggttcgcgtgcgccatggtggcaggaggacggct

SEQ ID NO: 2031 - DNA, 6678 bp, Oryza sativa
tggcgccccaaaaaggaccatttctagaataagtttttttaggggtctatttgcgaaataagttttttaaaaggaccaaaatatgaaaaatccagggccctgtgccgcgcccctggccaccgcgtgcttggccaccaccgcgtccgcgcagcgctcccctgccgctgccgccgttgaagttgttgtgggcgccgtttttgttgccgcgcccgccgccgcgattagcgacgaaagcagcccctccctgaccggtgttgcggtagagatcaaggagagtttcaaagttgaggagttgagagtacagctccccaaccgtgatgggatcggacttggtgcagagagcagagacgatcgggctgaagtcttcatctaaccctgagatgatgtactgcaccatatcctcttcatcaagaggacgaccggcggcagccatctcatcaccaagagctcgcatcttggcaacgtattcagcgaccttcattgttcccttcttcgtgttggtgagggcgagcctggtattcaccgatcttgcacgggtgcggctggagtagagttcctcgatggctcaccaagcttcagccgccgtcttgcacatggcgacttgaatcagaacatccctcgaaagagatgacaggagatagccaagaacaagttgatcattggcttcctaatcttcgaatgccgggttcggctttgtcacagtcttcccatcgacggtgactgaaatctcggcgtctagagctttcacagcgccggtgaggtagccctggagacgggctccgcgcactgcagcgctaacttgcgctttccacagtgcatgattgcctttccgagtttctctgtaacggaatggccctgagcgaggtttacagctgccgcgcctgaggaagacgacgacggcatgagtggtggaagatagatgcaatctaccgaggtggaaaaggctctgataccatgtgataaaatgtgaagcgttgaaccctttgcctcgggccgcatctctgttaaatagtggtagaaacagcctctaccgtggcttacaatgttcagttacaagtgataaggagatagaacaaatttggagataagaaactaatcctaacaaccttatcactggatgagctattacgggtgtgagcagctgcgccattatcgcatgcatgcgccatgcaccatgcgaacccccacgacaccgacactgtccactgcttgtcgccgtggtagcacaccgactgctgcgccacgcccgccgaaatggcgccgtcatcctcgatctctccttcctctgtcgcctctcccggaccgcccgacgacagccatcggtggcgtcgccgccggcgcatcggccctcggccctcggcgcgttgcagttcatgacggcggtggaggagatcgcgcgtaggcgggcgacgccggtgctggcgccagcgtggggccgcgacgcaatcccgtgcctgccgtccgccgccgtggacccgctccccgccccgacggagctccgcctccagtacctcaccgtggacatctcgccgccgctgccgccttgctcccctgctcccgcgtcgtctccgccgccacgtcgccggccgccggacctcctctcccacctcgcaccgtcgatctcctccccacctgtcggccggcggcgccgggctacccagagtcaccagagagaagagcgagagagagaaggggaagggagagaagagaggaaagaaatagaggctgactggacaagctgacatgtggggcgcacgtgggtcccacgctgactcattagacacgtaggataaaaccgggatcgaaaccgccaagggacctattgtgaccagttttatatagttaagggatcctatatatctggttttgcggttcgaggacggttttgtatcccgttgacaagttgagggaccttcggtgtactttttcctttatccaaccatggtaaaggtgcagctagggcccaaacactttactggtcctgtttgtgtgtgtctcaccacggcccaattatgtaatgggctgattctgggttgtttcacagaaggtccaaccacttgtcacgccattgacaactccgtttgcaattttgctttatactccctccgtcttaaattataataacttaaaactggataggatataaaccaaaatataataatttaaaatcggataggatattttctaatactatgtcccatcggttttagattcttatatttcgggacggatgaagtatttgtttgctcagtttgacctagcaaagaagcgtatcattgctacaccttctcttctctctcttttttcgcgaggaattttccaattattgatcgctccaagttttcccgtgtaagttgaagttttgtcaaattcatgcaacaaaactaaagtaatccgacaggaatgtatggtcagaaattaatggcctcaactgagaaatgtatagtcagaaattaaggacctcaacggtataattcgacctaccactcagccaggcctctgttgtacgtgtgtgacaggcataaaagaaaagggaaaatttgaaccatgccattataattttgaaaaatttgagctataccatcctgacccacatgccattgactcatgtgggttctacgtgtcattgagataccgatgacatatctcaaacgttacaaaattataatgtcatggttccaaattaccaagaagaaaagggaaaaatgtttggtctagactatagagcaagatgattttgatccacaaaggcctcaactgaagctgacacgcaactccttggtcacatgcataatcttatatggactgcagatggattcagaatgcctaattaattggcccaataccacttgctgtgctgaaaatggcgtggtttagaaaatcttcggctggtcgttgcttattctgagacttttgagttctgacgcggaaaaagaacaagattgggaaggttgatcctgttgcttgctgtgctgaattgaagcagcaaccaagccactgttgtcacttgtccctgcttgcaaattgttgtcataatctaatataaggattcagaacttatgcagtttcttgtcaagctttcactgaaaagagttattgcagctaaccgaaacaaatcagtactgcactggcaatcgtctccctcggatgggcattagttcattcgataccgtcaacgagtaggagttttctgttggcctcatcaatactgtaacaagaactcgggtactggactaacctagtgttcactcccccaaagccaataatacgcgtacttgacccggttgacaatggcatgtggcttcggagttcatacagcgaagcaatgtgtactagcaaaccaacggccgtcagacagtcagcattaaagctttatgttcctcatcaaaatccacttttcatataattggcttctatataataattggctgtagctcttttgagtaaaggccgggatatttatttattccattatctaaaaaaaatcaaaatccacttttcatatactcctgtccttaataaacatatagtaatacccagcggagtgtagaaaagctctgggattactgcgaaaatcgaacaaaaaatacgccttttccatagtgatatcatgctgcttcttttttctcaagagatgcagcaaccggcaggcagagcgcacgatcgatcacaaggcgagcagaggttcgtgcatccacccatcacacgcccggcgcgcgcatcacagctcaccgcgattcggtgaaatcgcaagcttttggcaggacgacaacgacgacggccacggccaccaccaccgcactagcggagctaacctctgattaaccggaaaggtagcgacctttctcgaccagagcgagagcacctgccatgatgggagtccatccgagatgatgagaaagcgagctcgcacgcaacaaaccccggccaatctctgtcgaggcaatcacctcccaactcaactgcccatgtcgatggtggtttctagctaagcatgccccatgattgcgagcttttcatcagcaagtttattcgccaaatctgcagccgttaatgtatcgagtttgactttttaaatgcatcgatgagaatgatgaagccggttgaccttagtggcgcgccggtgagagcctgagactgagaggtgatggcaacagccatcaaacgagatcaaaagaactgtcaccgatgtagattcagaatttcagatcaaggtggcagtggaggatatgcagtttcagaagttacgaaaacctgcagctgggagaacgggagagccaacctacgtctgttggaggaccagtctgaagatttgctggatttgttgaccaaaacttcatacctgttcgagtacctcatcctgtacattacatgcaacgcgataacgtcaacgaactagtaaatgttgccaacggactgtgtactgaatccggcaactgtcgtcgtgtggttgaaacagtgctcgactggaagagccataccacaattatagtttcccggacgaaaatggaaacaatcgcttggtgcgcagtgtaccggcaaaagcaatgaagaaacaacaggaagagatcttgaatttcttgatcatgtcaacctctgccttcagaaaaagagaaaaaaggggacaaggtctctgactagatggtaaaatggataaattatccttatgaccttatcataaagttgattacgattctacaaccatcagccacgatccatccacagtgcccactcatcagacatcagatcgtggagggttcatgacttcatggatgcatgagtacagagttactccaagttgacattagcagttcagcactactgaagtactcccttcgtccaaaaaaagacaaactctggtttccgtacccaacatttgaccgtccgtcttatttaaaaaaattatgaaaaaaattaaaaagataagtcacgcataaaatattaatcatattttatcatctaacaacaataaaaatacgaattataaaaaaatttcatataagacgaacagtcaaaattggatatgaaaacccaaggtttgttttttttttttgggacggagggagtaagtaggagtacttagttctcagagttcagatcttcaattcataacgctcacattcaattccgctcacatggcttcattccctccatgccagacacacaactaaatctattggcttgggaatctcaaacacaagaaagaaataatatcttgaaaataatttaaaagctaggagtaatcctgtacatagataatgcaagaagcttttttttttacagtggcttgcaacatgttcaactgacaaacagtaacctttgacaaacgtcggtgcctacatgtcagtgggacagcttgccagctcgtggttggccaggatgaattcttcttttccagtttacacgtaaaggtaaaaaggaaaaaagaaaagcctcccaaaagggataaataatgtcggagcgcgggaaaaaaattaataaaggataggatcaccggaagcggccgccgtcggcgagcttccatgaccggcagtgggggagcgaggagccggaggagaggcggtggagcggtgacggccccagctcgccggagaaggcggcggcgtccggcgggtggcctcccccgcggtggtgccgcgccgggctgggacgaacgagcgggctgatgcagacggcgaagcccgagacgccgccggccccagtcgcgcctcccggtctgcgccggcagggggttttccgcatcggcgaaggtcgccatggcgactccgccggcgagctcccctcctcgccgccttcgtcggcgtacctcatcgccggcgagagcccgcggttgctgatcacgtggcaagagtgccgcggcggcgacgcgacggccggatccttcttccgggggccccagggtgccatgatcgccgcgagccaagaacggtgcttccgctccttgctactgcgcttttcctccgacccgtgttgccgatgggctccgaagagcgcggcgagcacgaagaacttgctgctgcggcgccggatctcgaattctatgtccccttcctcgaatccacttgcgccgcctccgccgccgccgccgccgccgtaggccggccccacctgcggcgtccggaaaaagaggaggctcggcgtgcgcctcctcgccccggaggcgtcggacttccggcggcacacgtacggcgacaccgacctcgggaaaaccggcaccggctccggcggcggcggcaatgaggaggcctcgttctgcgcggcggcgagcgcgagcaggcggtcgcggaggcacggcgcgcacacgccaaccccgccctcgtacgggtgcctgctgcacttcattgccctcttctctttgccttctccattatcaagcacagcagcagaggggagggaggaaggaaggaaggaagaggaggacgacgcggtctctcctctgtatatagaggcgccgcttttcaccttttcgtagttttcgtttgttcgatcggttcgcatctctctgttccctcgcttgcgtggctttttatggaagtgtgttcctctaccctactctaggaatagatgcacggttgcacactagtaggacaaaaacttccgataagaaatattgaaaaataggccgagtttagttacaaaattttttcttcaaacttctaacttttccactaccattgt

SEQ ID NO: 2032 - DNA, 7804 bp, Oryza sativa
acacaaactttcaatctttccgtcacatcgttccaattttagcgccacattttgaattgaatttgttcaacattgttcgaatgcagctttgtataaggtgggtttagcactttagatgcccgcgtggccgcgtgtgtgcgcctccatcgtgaccgtcacgagacatcgcttggactgggatcgcagcagccagaggccagagccaagatccaaacctgcgtgcgtcgcaattgccacttgccaacccattgaccaggcgcgcgagcgcgaaaacgagccgcgagtccgtgaccgaagcttcaccgcgcggcaggcagcctccccacgtgccactcggggttggttctcccggagccttttccgctcgcggcggcgtgtgcagcagcggcttcacccggatccctgtcagccaccacggcgaaccaacaaaaggtggcaacattttctcgacgggaaaaagtggtcgcggtggcggccgtgacggagtgatcgagaagagaagtaaattacggcgttttttcccgtgctgggttgcctgaaccatctttcaccaagacgaaccataccgattggatgtatcctctttattactcttccatcgatcgccccaaccaccggcagagaaaactcgcgcaggacccgacgacgaggcgatgaggtgatgaggcgtgtgttcttgggcaatggcgatcgacgagcgacacgatcgtctttggtgtttcgcctggaatcgacatgggagtacggacgcgcggtgtctcggagaaggtggcgagcgttgatccatcgtctggtggtcgaagtcgaagggggaggactgactgacgacgactcgtcgtggcgcgagttgggaggctctcgccccgacagggctgtcgggtccgcgtgctgtcactcctcgcgcgccgcgctttttggcgtggctgtcaatcctcgtgcgccggtgaacgattggccatttttgtacttgggcgggccggcaaatttgatgatttttaccaccaatttttagatcaggtgatacatgggaacaaatgcgcgtggtagtcaatcatcatcagatctctaatctaaataggtgacaaattatcgaatcagaacctggatgatggttgatgagttgaagaagaatcacaggaggagtgcgccgtacgcaggagactttcttgtacaccacttgatcagaggaacgcaaaaaatggtcatgagatttgcacaagttccatgagggaacgaaagaaactttgccgtcgtacatgggcttttagaaccgtgtaaggggggcccaatattttatgggccaaatctcacttctggaccaatgctttctcctttcaggcctagttttcaccgggccgtcacgggcccacgtcgcagtctaccccgccgaaatctctaccgcgcgggaactccaatttccaaccccgcccaattcccctccctttcggccattccccttccccttctcggctcctctcctctcctcctcgccttcccaccaccttcccttcccaacccgatcccccattccgccgccgtccgccgccttcgccgtatcgaaccgcctagcgaccggaaagaagaaaaccctagtcctcaacacagccatggctccacggaagcggacgggggcggcggcgggggcagcttcgaagaagccgccggcctcgcagccgtcgcagccggccaagttcggcattctccacttcttcgagcgccagtcccaggcctcctcccagaacgccaagcgccagaaggccgacggccccttgcagcctcccgcgccgccgccgcctccgccgccaccgccgctcatcgaggaggagccatcggaggtgtcgccggaggtcaccaagactctggcgccgaagcgggtcaggttttctcctgggatggtaagtattggtcttgcgcttggtccgatttggaatgcattagttggcgtttggatcgactcttaggtttggtggtttcttgtttggtgcggtccagctgattaagcagagccaggacgatgggggtggggaggttgtgacttggaagatctcgccggtgaatgatcgcctgcgcatggtcacttcaaggcagatgactggtatggcgcttcatccgtgctcaaacaatgaggtatatactggagtttctttatgttcttgcgaggtatataccggcgtgcaatgcacgtatgtatgtgcattggagccggtggagacacaacactttcttgtgtgatgaaattaatcgttttttgtggctttctggtttgctattcgatatgtaattgtattctagaagcattcctcggtcgagtctacaaagaaatggcattcatcactgctgggcatgtcaagatgtactgcttcagcacgcaatttggatatgtgtggaactggtccaggtggctgtgacggtgtggaggacacccaaagcccatttcggactcctccatcactgtcctataggtgcagtgaggtacatacagttatacgatgaattgttgtgtgaatgctagctaatgtagttccaaatcgtgttgatggagtaatggttttgtgcatgaagcagcagcttaatgggggtgtggtttctgatggaggacctgagcagttgggggcaggggagcacaaaaaggtgaactaagataacactaaatgtcctgggtgccattggtttcatgatattattacatgtaagaactaagttgccaaagaattgatcgacaaaactatgccatttctttttaccaggcactacttgatcttttagatcaagtggaagatgcaatcatggaagaagaattacctgctgatggtgagaataaaggagagcagctcataaatggtgatccgaaaaacattagttgttctcctattgctgacagcgatcaaaatgtaccctcccagaagtcccttgatgccccgcccttcgatagctttttggtgttggaggtttgctttctttacctccatgggttggtttctatcgaagttggagctgctctagacttctagtacaatagagatttatgtgtttaattacttttcaggtgtcagaaaagcacaaaggcgataacttaccatgtgatcgctatcctgttaaggtatatatcctctttacctatctggatgagctagtttgcaattaaatttttgttattttgcaaagttgctaactgttttgacaggttttacgtttgctgaatgagcacggtgggaaagagcatgcagtccatttgtgtgatgagtggtgagttcctatatgcaactattgacatgattccatttttattttctatatacatatgaaccttcatcaatctattgcctatatatttcaaaccactacaggttccatagccttattagcccaggcgacacagtaagtgtcattggagaattcactgaccatggaatatgtattattgatcatgacaaaaatcttgttatagtgcatccagaattactcatatctggaacacgggttagtattagcctccccccatctctttattataacctttgtagtcaatatcccagatcaatatgaacaagctgctatgatatcctcaaatattattttataagaactgtttgtaaaaatacattcatcttatcttgtcatcatattttgatatatagcttattttaggttgcttctagttttcattgtccaagaaggtctgttctcgatgacagactaaaaagcaatgaatattcaacaagtgctttgattggtactctgctgcatcaagtattccaggttcgttggtgcaagaaaaattggcagctctggttaatacatcatgcactttatcttcatgtaacagttgtgtgtgcctcactttgtttctttcctcttgtgcctcaggcagggctacttgaagatgttccttcaacgcaattcttagagcagcaagccaaagaagttcttttgaaaaatattgagagtttatatgcatgtggaggtaagattcgtgacaacatttttaatccataaaaaacacactacacaaaagtatgacactatgacatggactgttcatgacttattatgttatactgagtgccctgaccaataatgtttttcttactctattcttagagcaccgattcagtaaggctatagttatcagtaaattatcatgtgctactaaattttttgtgaaactttatatttaatttttgaatgttgctttgactaatttgatccaattttctgtgctatatccttcctattatttttatatgtttacacaaggaacatggaatgtcattccaaaagttctgcaaatctgttgtgtttgttctgaaatatcaacatacattgtggttgttctcatacatcctcatttactcaagtcatattggtatatgtcatgtttgattacagtactgtactgtagctcagcttctttattgatatttataacattacacaaactatcttatatccccagccatgtgcatatcttactggttttgacatttttctatgcagccagtgaaagcaacacgcttaaaacgctgattgaagcagtccccaaaatattgaattggtacaagtgctttatgaaggtggagtagatgacttgcacagcagttttttatattcactgttggggctccttaaatgaccacaagaattttcgaagtccatagagttgcaccatggtcatgaatactccacttatttttgttgaattggaacctgttgttatacccatatggcactcttctatttcttttcagaggttctaggcaatgattaatcactcgattgagccattttgtttttaattgctaatatatgccatttctattacggagtataattttttaagagaaagttttgatctagtctttcctttatcaatcctggactaacttgcctgcaaagttcaccggtggatatattgcatgtcttgtcctttacttgtttaaagaagatactgttacatgttctgcgctaatcatcgtcggcacatccaggtatcaaaatgtaacaatgtaaattttggtcaaattgaaggacaaaagactgttggagttgtggaggtaggcaacatcttgagcttgcaaaactttggaatatgaccttttcatattatgtaacttatatgtaatatctagcaagttcgtttcatgatggtaaactcctgtagtccttgtgattctcagccatcaaaattaggccaacacagaactttcactctccccatgtccttcagtacttgagtgttgacttgcacacctcattcttaatggctttattgaaatgaatttcaccttaggtaatggatattgaggagatggcctgggctccaagatatggtttgaaagggattattgatgcttctattagatcaagggtttcatgcaatggtagttcatacgacagagtaatgcctctggagttcaaaactggtaaaggaactagtggtcaggtaagcatatgctcctggatagtggatccacttgaagatatattatatctttttctggcatgagatatttttgtcaccggggttctggaaactatttatgcaataaattagtgaagtattgcaacaaccaggcttcttgaaagattgtgctgattccataatccatattaattcttacaagtagtcatgctctcaattttttaatcaaaacctgacgagttcattgaggtttatattgcacaggccagaactgttgttttctgtctgttttccataatgtaattactggttgcttacttgaattagattccctgctctattttatccaaaactttaagctttagttacaattgactagaaacctgtcaaccacctagtcatgtccattctgtggcaacaaccaatcaataataatgtcctacaacaactaatcgtaccttaaaaaaacccaatcatagttcattacaaaataataattaatcaataatccggagcctcagttccattctactttcacaaggtcaacatccttcagtagttttgataattaatacatgtcacatgtagcggcatccaaatatatattttgataccttttttgaaatgtgattgtgactattagtgttatctttactttatgtccatttctgaaaagaatattgtgttatttttgtggtgtttcacatactgtgtagcactctagtgtctcctatttacctaaccatgtctgaaaaaacaacaatttagtccttcagaatagatccagttacttctctattgctcttcacaatggtttatatatttccagacagctgtggaacacactgcccaagtgatattgtacacgctattgatgacggagaggtatgatctatctatttcttccactgcaggctttccatatatatatattccttaccatgcttttccatgtcttcagatacttgaacaaggatattgacttgggtcttctgtattatcttcacacagaccaaacattggtaatcttctaaaacgacactcaacataaattctgtacccatccttatccatttcttgttaatttctgaagggcatcaaagtcaagaggtctgatttaattggattaataatgcgtcggaatgagcttgccactgagatcctgaaggcatcgatttcacagagttttcccccgatgatacaggtggaactaaaaacttgtacataagtaattcatttgttagaactcaaacaaaatctttctttcagagtccatctacatgtaatggatgtcgacacctggtttcatgcaccatataccacaaggttcaataactctattctttttaatataaatgtgttttttgatacagtcctgttggtacaaatttgttcaattacataatatatacatgtgaaaagccatacttatattctgatgcaacaggcgcatggaggcaatgctgcaactagtgggcttggtgatttatttgataatctcgtgaatcacttgacagttgcacatcatacctttcttaaacactgggacagattgatcgatcttgaagctagagtttctcaggtatctttagcttttctcacgtgccgtgtatttgatttgtactctcttgatctcatctcatgcaaaattcaggtcaagaagaaggaaattttccagccacatcattcaaatactgggagcaggcattcttccccatcttattttgtccttgatgttacaaatggacattcaatagattcatctggaaaaagcaaaagatacatatatacttttctgcgccagaagttgcagcctgagacagctgatcagccaggagaacatgttgaaagtgtagattttagcctcaaatgcggtgattctgtggtaaaccttgtacactttctgtattcaatattcagcaacattactatgttagctatttcaagttcccagcaacattgatatttttattgcatatatttggcacaccatattgcaaatttgtaatgtatggctccatctcattttgtttggagtgtagggttctttccgtttgaactgttatgtgcttaatgttggtaaggaagtagaactataggttcatagaatatgctcagtgcatataaggaggttaaatggcaaatataataccagttgaaaacttctgcagctactgctaaccgatcaatcagcaacagccagctaacactttggagtattgtagcgttatattactttgtttttatcctcctgttttgtgatgtttactttagtgctgtaggcctatggccacaaaggggtcatttttttatgcgttattacacatatagtagctcacacccctttgcttcatggatacttagctattatagtgatgcatg

SEQ ID NO: 2033 - DNA, 693 bp, Oryza sativa
ggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggtggtgaagttgtagacgcccaacagcggcggcataataggccagccgtgtaggcggaggcaccactcggcggcgacggaggcaggccggcggtgaagtcgtagacgcccaacagcggcggcataataggccagctgtgtaggcggaggcaccactcggcggcgacggaagcaagccggcggtgtaaatgacgatgcccatcaacggtggtgtgaccaaccgaccgtataggcggggacaccagtcggcggcgacggaggcaggcccgcggtgtaaatgacgatgccccataacggtggtgtgaccaaacgaccggattggcgaggacacca

SEQ ID NO: 2034 - DNA, 770 bp, Oryza sativa
tcttcaccaaccggctcgccttggtcgccgccgactggtgtcctcgcctgcacggctggcctattatgccgccgttgttgggcgcctacgtcttcaccgaccggctcgccttcgtcgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggcttgccttcgctgccgccgactggtgtcctcgcctgcacggctggcctattatgccgccgttgttgggcgcctacgtcttcaccgaccggcttgcctttgccgccgccgactggtgtttccgcctgcacggctggcctttatgccgccgttgttgggcgtctacgtcttcaccgaccggcttgccttcgccgctaccgattggtgcttccgcctgcacggcagacttattatgctgccgttgttgggcgtctacgtcttcaccgaccggccgccgcatccgccgctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatgggtggatgaatctggcaatggtgaatgggcctatcttctt

SEQ ID NO: 2035 - DNA, 40906 bp, Oryza sativa
  unsure (1)..(40906): unsure at all n locations
nnnnnnnnnnnnnnnnnnnnnnnnnnnnnnnnnnnnnnnnaaaacaaaaaataaaaaacataaaaggtccatcatgggctcatggcaaaacaattaaggaacctctctcagacatctgctgcttgtcaacatctttcatgagcctgaggggtatgtatatcgtatttagctccactggtttgcctgaaaggaatgaattgagcatgtaaagagtatgctgcaaaatgcttcggccttgagtttatgtaggaaatgatttttgtagtcatggagaaggcatgatgcatacccgtaggtggcacattcaacactttctcatacttcttcatatggtgcatcatggcacagtgtagagggggaggggggaagtgtggtgtgtgcagacgctggatttaggaggggatatgtggcctcatcactaccattatttacggctctactctcatgcaccttgcgtgtacttttttttttgttattgagtacccttaattagcatatttaaccgtttttggtacatttgtcatgttaaattgttattgggtatggacattgggcattgtcatgttacagcaatgctagtgcatgactatggccgtgctcaacttagttggatacaatcgcaacatagtttcccctactcatcactaccattgtcgatgcactacaacctattgaaaatttggtcataattcgttatattttaatccaaaataacaagataataaacatgatatttataatgggatttgatccattgatagtggtgaatgtaatcaacatgagtatgcttaatgtagaataagcatcaacaatcacataataacacaatattgacattgcgatgaacattaatagtaaaacttctaattgaaataatgtaagaaggttataccccaagaatagtcctccgctggagtttgaggcagtattgcctccgttggtgttgacgggagcctccttctccttgtatccagtgttgccgttgtctccagtgttcaacatattggtgaaggtgaagtagatgttgacgaacagtgagtagtcgcgccttgcgctccccaaaaacctgatcgcccgcccgtccgtgcaaacgtcgcagcagcgcgtggtttcggaggcctactctcccaacgcgtgtgcacacactcgtcgcgttgggattaccgtagcagtaacagcgttggaaaaaggatgaaagtgtgtcttcctctttcgcgggagatcaaatccattatcattttataagaggaatggaagatgaagagtaagagtcatggaatagaaagaggaatagagtaattaattctcatcaattagccatcaactatcctccactacacaaccatcaccgatggaataggaagaggaatagagcaactaattgtcatcaactagccataaaccatcctccactacacaaccatcaccaatggaataggaagaggaatatagcaactaattgtcatcaactagccataaaccatcctccactacacaaccatcaaccatccatcaattaggactaattgatataagttaccaattccctaatcaaatggattaattctcaaaactcttcatcccattgatatcccataaaaaaataaattcacatgaattcctagcataatgagccttgaaatttatttgatttaattgatttaaatggatcaattacccaattaaatctaacacaaccatagcaaacccaaatcggactcaagtgctgatatgtgctgctcaggtgcttccttgtgactttgcctgttagtcgccagttcgccattgaatcaagacttaatttagggagcttgtcagctcggagccgctgtggcattgctagccacgtctgcattgcactgcgttgtgtcgtcgcccgtcgccatgtcggtcagcccctcagcaatatgagaactcctccttgctctacgagggccctgagacgaaagcgctggcgtgaaggaggtcgagtcgaagcggttttttttagataatggaataaatattccggcctttgctcattagagctacaattaattattacaaggaatcacacaaacactgagtaaaatggagctacacagcgtaggtgggaccaggggcaggaaggtgaggtcatatttatagttgagctttagaatagggtcaaataagcaattgtcttataaaatatagatgttgttctgtggtgacacatgagagccatatccggtccatcttgacctctagatcatcatcaagtgttactgacgtggcacaccatgtctacccaaatatgatgactcactcgatcgggttctcatatcgcacgctccttttgagcttaatagcgggaaaccacctcattaacacaaacaaataacatgtttaggtagccaaacccttgttcccccacctttttttattcctggtccaccaacgccacaaatcttgcacctgacgtgtccaagtctagagccaatcgatccaggtagacctgttgtcggggcccatggaagctttagttttggagcttaacaagcgtgtcaaaaatctgactttgagcctatttgcttgggcccactccaagagtggcgcttagagtgaagtcgtggagcgacttagagcagcgcttaattgaacttttagctcaccgagatatggagccagagttggagcttaccaaataaaccctttaggagggaagaaactcccatgtgttcttgcatgtttcataaagtttactttctctataccataaaaaattaacctaatagcagatgttgatatatcgtagtattatgaatctaaatatattaggtagttttagctctggttaacccaattaagctttactactatgaaatggtaatacacacacacaaaaaaaaaaaaaagagaagtttcattcttcgtataagagcaaattggtaaaaaaaaatgatgattggctgtgatgggctccaacaaaagacactgttgaaattgggcgatagatagaaacgtttactgtccaacgtgaaacattattaattgggtgtttttgcctaattatgctcaactgttttttgagctatcgttaatattattcgcgaagcggcatacttccatatggaaaataatttataaataaaacttttatatacgcgtacttagcgatataaaattaaaggctaaaaaataatcttcgatagtaaaaatctcaaaatcaagtctaaatatatttaagattgaaaatttaaacttttactaataaacataaacatatgcgaaaagttagaggccagtatacgttaagaacaagggtagatcaattcaaagctgatatgatgattatttggaaagatggttcactttaggtagaagggacagtagcaatatttatttttggtaaaatcgcccagtttatcacggcctcacgggaaaaatttaaattttcaaacgttgttatgaacttgtaattttatttaatataacctagttttcaacatttgattctaataatttcttaagaacacaaatataaaaaaatatttccaaattaattttaatttttagtaaatcaaaccaatgagtctgttggtgcgttacgacgaaatcactacacagaactgttaatctgggcgggctaacaatcagctcattcaaaataactatcaaaagtgtacaacgaggaatggttagatatcgtaacatcgcgtgttcttctcgatgggccagaaatttagtgtgcttgagagcgacgtacaaaaaacaactgcaatttccaccgaatttcattcaattctcttcgaaacttgatttaacttacaaaattgtaattttacatagttggtaggagatttaacattgcaagccgtcaatacaaatgtttttactaatgggcgagtttgtgcagattcagatttcctctaatgggcgagtttgtgcagattcagatttccgtcaagagggaagtccgtagatttgaattcgaatacaccaacggagtttaaatcgcgcaaggttcgaagattcctatttccataaaaaagaaaggtttgtagattagagatagaatacaccaatggagtttaaaccgcgcaaggatcggatattcacataacacagaaaactggattccaaaatagaaagcagatgattgattgaaaaaaaaaggaatggtttttggtgctcagattctatgggtgtataggagtcgatcacgcagatctcccatcaggacgaggaatgattttataatcactgcaccacaaccaaaccatctcccaaatcaatcgcacaagatccaaacagacaaaatgcagcaaaccccaagaatttaaagatagaagagaatttggaggcgagcgtaacccaatatccaactggaaaacccacggatgagggctctaagcgccacctgatttcatctcgggagctttcaaatcgaaacgagaccgagatccaccctagacgacggtggccggcctttgggacagtgctcccatgaacaggtaaacatccaaattcctatccaacgccagatgaaaccaaccccaaaaaacaaaaaacaggagaaaaatcacatctcatctgaatgaaacaagatcgagagagagcaacagagaaggagagcgtgccgccgcgagcgcgaggatgaggagatggagaggagagaggcatggtggtgtttatataatggcggatggacgcgtggaagccctagccgacgggttcggcccatgggccttattctctcttcgtggatagaaatgggccgaatatattaaagatttggaccgaaagtgttgtgcagggtgtccaaatagccggcccactatttatttgtactatattttttctccgaaaacaaatggagagatattacgaaatggagggcatatcagcctctctcaatttacataatacccttctaaaacccatatttatactcctcctaattttcgagaaatttgaaaagaaaattaaggaacttgaaattatacgcattaacttaacactagtcgacgtgacgacggaaaccttcaagctactaccattccttcccatggtgctttctctctttctcctacgtcatcaacgacgccacgccgccgttcgacaactgggccggggcggcgccgccgtgggcgccgttcgccgtcgagcgtaggaggcgggacagccctatcagcacggcggcgttgcgctgcgcctcgccgaggcggcgccggagcacgcccgcctcggcgtggtgccgcgcgttcgcgccgcgcacggcgagcgcccgccgcgccgtggcgtccagcctcgacgccagcgcgcgccgctcggcgcggagctcgtccgcggcgcgctccagctcctccacccgctgccgcctccgcgcccgcgaccgccgcgccgactcccggttcgagatcttcctcctcagccgccgccgcctctcctcctcgccgtcctcgccgccgccgccgccgccgcctccgccgtcacagtacaacaacacatcaccaccaccaccactcccatcgccggcacctaccaccggcgacaagccggcggccgcatccgaggcaacaccatcgtatccgaacgccgccgcgtcgacgccgaacaagccgaagccgacgtccatgtccgggaggccgaagtcgagcggcatggcgtcgtggagggacagcattgcggcgatcagggacctatatgtaatatccgaaaacttgtgggttcgaagcgcgagtagttggggttggggaagagggggggagggaagacgaagaaggcgagggttatttatacacgccaaaggccactcctacccacgagcttcaggtgggcccgcttcaagtggggcccactgcgacgtggacgttgtggcgattcggccgtcactttagtttcggcgcggcgaagccgacctcctcctcgtacgtacgtataagtgtacgtatacgtacgcctccgtggcgggagagcacgtattgtacgtacgtattggaatcgacggctgaggagggaggtcagcgtgtggatggacggcggatgatgtgggtgatccggtgatctctagcttaagagcgaagtaatggtggggatgcaacgggagggacacgtgtagggctctccttcgtcgctgcacttcaggtgtttgctttttagggcttgttttttttgaagattttctttctgtttttcttttcatcgtgcaagctttatatgaagctagctatgagcccatgcaagatggtatatattgctatgtgcattgcgttacttaatcctctacgcattgaatgtacatatcactgggactactttcctaggttttgcaagaaatttacaggattatatcgtacaaattagttcaactcctgtaaaaatttcttcaagatcaccttccattttattttaaaggaggcttcttagtactacctccatattttaatgtatgacgtcgttgattttttgtccaacgtttgacccattcatcttagaaaaaaaattatataattatcatttattttattatgacttaattcgtcatcaaatgttctttaagcatgacataaatatttttatatttgcacaaaaattagggagtacatttttttggtgaccaaagagtataggaatgccgtattgataaaactaaggatcaaccacatttcctagtcaggattcagttggagaaaaatgtagacacacgaaccaaacgtagatcggacttgagcgggtgtgtgcgtatgacggggctatgtccaattatgctagtggagattacaataacttaaagtgttctaaaatcccgatggatagtggataaaactaagcttgtaacaatcatgcgaggacacaaataaataaattgataatattaaaaagaaggttgaaagaccaatgcaatgtaagatatagtttcataagaaatgtttatttagtgaataaagattatatatgtaaaaaatgtactatttaggatcttaagatgtttttaattaatccgatgttgcattctaagtccgataagttgcctctctttgggggggaaagagagataagaaagcgaagaagcgagtcaagttggctgctggttgaatacaggcgggcatgggcgacaacgatgcaaaacgaatatcttcaaaaccagtgaatgcaagggagcgattccctccgttaatttattccgataatatctaacatctcgatccaagttactgtcattttttgttttttgagctatctaacgatcgctaattcgctatatatgcatgtaggggcgctttgttctaatatgacccatcaatctatttctttcatctcttttatgtgttgcttaccagctataaatggctaagaggttcagtgttttgggttataagcttttttccctttctcaaaaagaaaaaaaaaacatgacaacgttagattctttctttctgtgatattaactgctactatgaactttatagtatatatgatatagcaataggttttatctctgtcggctgtggtattatatatgtactaagtgattccccgagttttgcttaaagaattcctaaatattttttttaacaaatgagctaaaaaatatattagttattaacaacaaataaaactgatttgtcaaactatgttcagagagaaatatatttagtacactctgtataagattgtagatgaaaaatgatatcccacactttggttatatatggatgaatatatgtttagtattataaaaatgatggatatatatgttaaaaatattataaaaaataatggaaggaagatgattggatattgatttgtagaattcaatgaataatagatgatgttacatgtttgcataagttttgtatgttactattgcttatggatgatgaggtagaatgtttgcatattgagctttagatttaggagtcctactccggtgctttctactcggagtagaaagtaatctaggccctttatcatatttaattatagggttaagatctagttctactcctaccagaattagtggaagtagaaatgtggaggggtgtttttgtccaagaaaaataattcgcgaaggggtattattgttttctgatccatagatcgatcaccatgtcatcctcgtcggagttggtcgtgcaagatcttaatcgatccatgtaatccatgaaacaacacagtgatcggaaatggcaagaagacgaatgagccgagacgacgccgccaagcaaatgacattgcgtgcgtgcgtgacactgccgccgaagcccaggccagaatttttactaccgccagaactcctgctcaagatcgtcgctcgctcggacgccaccacactcgtctgctcccagacggacgatgcgactgaggaagcagacaaggcggcaaaggcggggaatacggatggcgacggagggggcggacaaggcggcgaggccgggggaggaatagcgaggtgactgcgtgcaacggagttcggacctgatacgatgcgaacagaagaaaacatcccatgccaaaattacccctaaacgatattaggagattacttacctgccctttaaaataaacggtcaagattaattctacttggagtaaaatactgcaagtagattgcaccggagcattactctagatttagtgggttataactttgtagtaagataggactctactccctttatcccaaacttcacatccggtactagatttttatattttaggacagatcaagggagtaagtagtttctttaatcaacctatgattttgttgtttgcgcttattcgatgacctaccatgcctctgtgataattggttatagtttattttgaaacaaagtcggaatgaatcttattataaaaaaaattatatcataacggcatatgtataaatacttgtcaatgatataatgtaggagtacgttgttaacaccaaaagcacatgcatttcgttaatgaacaatcattagccaataataatcagctttcgacttgctgtaatcttcccaccaaacgtatctcaggtaggccatcctgaagccccctgaactacacttggcttaattctattcagagatagctaaagtgtgtttagtttccattagatagcgtgttaagggcccaataactttttcccaaaaccatcccattgaatctttggacatatgcatgtagtattaaatatagataaatttaaaaactaattgcacagttagaggaaaccgcgagacgaatcttttgagcctaattagttcatgattagccataagtgctacagtaacccacatttgctaatgatggattaattaggctcaaaatattcgtctagtggtttccaggcgagttatggaattagttttttcattcgtgtcccaaaacccctttcgacatctggtcaaacgtccgatgtgacacccaaaattttttttttcgcggaggccctaattccctgatggacgagcagcgatatgatggtacatcgatcaagcagaaacttgccacgtggacaaatgaacctgacatatgcatattggcttaattaattgattagttattttgttagattaagtgttgcatgctgacatgatatactgcaaaagtaatttcagaaaaagaaaatgatagtagtacccaaagaaggagacaggaaacaaccgaatggaaagtgccctttaatcaattattatttgtgttcgtcaactaaaactaattaagcaagccgtaagtagtactatatgagaatatatacaaaaagctacagcaaagttgagaattatttgagcaatgggtgcacttggtactgtatacattatggagcagcttcctcttttgggattttctttgcttttttattttctctgaaatcatccaggatccatccgatgcatgcatgaagctttcacgccacaaaattatactatccaataacgaaactaattaaaagatctagctagttaattagctactagcgccgaaagatcgaattgcatgtattgatcttcagttcatcctgaatctgtcaataaatccaaaggaaataattgtactactgatctgttagaaacttaattagaataaactgatttacatctatcgactagatacatatatacattgtttacagaacatggagctagctaggccggcttcaaagttcagattcttcagatatctcatctgaaaaaaggaattttcagtattcctggtcaggtgaaggacacgcaggggctgagctctgctttgcatgcatatgttcgtcaagaaaaagttgtattagtacttgtaatatacacgtgtcctgctcatagatttgtagacttctcacctgtcatctctgtacatggacacactactactgctactgctagctgatctatcctgtttcttctttactggaacttgcagctactagctaacactagtactctgctccattcatggtgtcatcgacatataatcagttcagattgattatgagcatgagcatggaaggttcttataaaataatcaaaaggtaattgctttctaagctactacaacttttgttattatggatcatgcatcatcctttgtgatatcctctctctttcctttagtctttagataacaatagataggagcatgatgttttggagacaatgtatatatgcagagcttaagcagcttagatagatatggccatggaaattcagatatgaagctgcagaaggaaggagacaggaggctggtagctgctgtgcgaaagccaatcacgagggccctagctaccataccataccactgcatgccaatgcaaagttcagcttcagatcggcgtcacagtcagagtatcacttggaaactgatacgtggcaatgcaagaacacgggttcagtacctgcaaatgcattgtgtttgtgacaatttgtggtgcagggttccttggcgatcttgatctcggttggtccctgaatgtataggtgctaggtctctttctcgaggcttttggcattgatctctgcatctgcatgttgacacatgtcttcttgagtgtcttctctttagtgaaacgggaaaccgagcagcatgcatatatgggtgtgatgttgaggaatgaggacgatggttcagatatgcaggttagaacaggtgcaatagcagactattagttagctataaacatattttaatgagataaaagatgagagagaagagcagcgagctacagatctatagccagctgcagcacgaactataagacgcaatgtgtgtatgacatatgggaccatatattaatattatagtaagcaactattgtatgacttagggcctgttcactttgatgccaaaaaaaaccttaccaaatttttggcattgtcaaaattttggcatagttaccaaaattttggcaacttacccgaattttggtaggatttcttatatagttactaaaatttgatagcaaactaaatgtagtcacttttttgacaactttactaaaatttggtaaggttgaaaatggcatcaaagtgaacaggtccttagctattagattggctatagatgaattggagctagtagtgggctatactattaaacttgctcttattgaaatgggacagtgcagaatggacaatgcaccaactgctgcagcaaacagaagagtgcatgaaattgcatacagattcagagatgcagacaaagcagatggagaggagatagatagtagtatgctttgtgggctggaatttctttttagcaataattggaggcccattcgattcacagaaactgttgcatatgcccccaactatgcatgctctttcagtcacctcttgcaacaggtaagcaaacacgccctaagcgaaaggtggctaattggcgcagctgcgctcacaatgtacacacgcttgtgcacccttgtactctcgtgtatttcctcagttccaaaacaaacggacagtgatatatcctaatactacgaatttgaatatgtgtgtcactactagaaaaaagatatttcatggcgtcaccctattattttctttggcggctatacgtaaaaaccgccagcaaaaacataacgaggggtgggaggctacggaccgccagcaaaaatagattttcgctggctgttagataaaacgagccaccagcgaaaatatagcatcttcgctggcagtgcacttaacacaccgctagtgaaatgtacaatcttctctggcggcaggtagcgtgggctgccagcgaaaaaagtgccgacgccagcgaaaaaatccaccctatttaaaatctatccatagctccaccacccaccctattaagaacacgcaagagatatttcctaacacattcactcctcaactccccctctcccgtctcctcttcctcaccacccactcacgtgcagagctcctctcagcaacgggaggctccacagctctcggcgacggcgaaggccacggcggcgacggtaggggggaggcggcagatctgacgatggcggcgacgacgacgtccgcgaccgccaggtgggcggcggcggcgacgccaggtgggcggcggcagcgacgacaaccccaaccgtggcggcgacgacgacgacgctgctgctcccctcccctccccccaaccgaggcggcgacgacgaccccaaccgaggcggctcctcacctcccctctccctctcccagatctaccctcgggggtgaggggggagggggcggcggcacgagaacaaccgtgacgacgacgaccgtgaccgcggcgacgacgacaacgacgacgacactgcgcgctggccgggagtgcggatctggcggctccttcccttccctccttttccctctcccagatctagctagaggggacgaccgcggcgacggcaggtgggcggcggccgatctgacgacggcggcgacgacgacggccacgaccgtggcgacggcaggtgggcggcggcggcggatctgaccgcagtggcgacaacgacgaccctaaccatggcagcgacgacgacgacgctgccgctaccggcggctcgatgcgtggccggtggttgtgatattgatttttgcatgttgaatgcttgttgaaaatgtggtgaaaattgatgtattgttctctgtatgtggatttgagtatggatctgatatcgatttgatttgattttgattttggattgaaaaaatgcagctgctcaggatgtcgattgcttttttttattgggaaaaaatcttttcgctggcggttctcttaagggtccgcctgcgaaaagcgaaaatagattttcacaagcggttctcttaagggtccgcttgcaaaaatagattttcgcaagcggttatattaagggtccgcttgtgaaaatatattttcgccggtcctcttaagcgtccgcctgcgaaaatcgattatcgcaagcggattgcaaccgccagcgaaaatattagatcttcactagcctttactttgtggcggctcggaataccgccagcgaaaacccaaaatgactgccacgaaaaatggttttcctagtagtgtgttcagattcatatatcacatcatgcattatattggtttgttttgggacggagggagtagatcactcatgaaccaaaataggcatgcatgatgtttaaagcatttttttattaagcggtttagaataggttaaaatttataagttgttaaaattttctatttgaaagttatttttggattatttttttaaaaataatagttttaagtcatttttaatacttattaattcaagtaagaattttgcaataaaccttttcaactgaaatttttattttagatctggaattcttacaatcaaatttaggatactatgtataatattgacactaagtatgagttatgactcagatatataaggcctcaaaagtaccaattaacctagacgatcgaagttaaatgaaggcgcaaacgggacttgtaatattgtcaaacaactcaagcgatgaacatgcacatgtgtcaaaagggtcgaaatgtcgatattaaggtttgttcgtatcgacgacttaaacttccgtacgacgtcgaaagattaatttgaagattcaaataagcagaaactaagcatttttctagatggatcaaggaggatagggacaaataaaataaatactatcaactttatagtatacacagagtactcgaattaataattaatctatgaaatgtatagtcatgcgatcgatagacaatatattcaacgttgtactcgaatgcgttaatggtggttgtgccaaaccagattaacgtaaaacagcccggatcaaaagagttgaaaagctaaaatttcttaaaaacgcaatcaattgtgctcaaggacaattaatttaaatcggcgggcaaaaaggtccagattaatgcattgcagagtgcttcttgtagtactttgttgcatcgcgaatattaattaacttaggaaactaaatcgatcgtattcacagtttgaaattaatttgtatacgcaaagcatctcattcattcgccaaactgtttttatcttctccgttttggatagacgatgaggacttatagcacgtacgaacatattctctgatcttggcatgcatgcgcctacgtacaaccttggtttttttactgcacatatcatcgagaattttttactgcacgtactgcacattttttactgctccgttcttaaatataaatatttttaaattatttaacaaagattaataaacaaaaaaaatatttttcagtcgtcttattagttaatttttaaattgcttatattcccttcttaaatactaactagtctgaaaatgtttgaattccccttattaaaagtcggtgttccaaaaatggttatatcatgtcaaattttttgaaggatatgaaataaatccgacctttatatctaacttgatgtgcatggtcaatattatgtttatgtacaactttttttttgctaaaagcttaaaagtatttgtattcggtggagtagcaaagatggattcatatcctacacatgttataccagtacgtgacaacaatattgtcatcacgtcatatagtatagtatatggccgagtttctcacgctaaatcatgcaaatatacatacacacatatagtcagtggtggccacaagctgtagtgtgacgtgcacgttggtccaataatagttataacctggaacggatggagcattaaaatcggtgctccagaaatacttatgtacaaattctttttaaggatataaaatgaaataaacccgacctctatatctaaccgatatacacggtcaatattatgtacaaccttttttaaaaactttaaaagtatttgtattcggtggagtaggaaagatggattcatatactacatgttataccagtgacaacaatattgtcacgtcatatacatacatagagccgagttgctgacgcttaaaacatgcaaatatattgtatatacacataatatgtagtcagtggtggccacaagctgtactgcgacgtgcacgttggtccagtaatggtttatgcttgttgcatatgcatatgtgccaaattgttgccggccgttgtacgcacgtgactgacttttgtagtctgaacgtacacgaaccggccggatcctatattgctcaagccttttcttttctaccatgcatagctggcttggaaattaactgaccggccggtctcccattaaccaatcaacgacttgtgcagttgatttggtccaaaacagagtaaattttttaagttataatttatctatttttactatatgtgcacctcctcagtgtaaacttaagcacccacgtcagcttaaatttggtccaaaacagagtaaagcaaagcatgtggcaccctctctatttcactctagcttcacccctagcagttgttctctggagtagctggtcatataattcgcttataaaagatggatgagatagtgtgctactgttaacttcttcttcttcttcttctttttttgggagaaagggagagcacctcccccgttttcattaacgaaaacgcaacgattacagaagttccagagtaattcaccgcaaaagcaaaggaaaatagaaaacgattatagtgtgcaattgttttataacttcttgatgtagtaatattgttttcgtttcattgtttttctttgagcaagtcgaattagagtcgtatggtagtttggagtctaagtactcgtttatgtcaaacattggttttgtctctctatgtgtaaggagatgaatgttgagtctagaaactcttgtatgtttggttggttgtgtacatccgtttggatgtaggctggtttaatccattatctaaaaaaaatagggaccgcacaaatatataactttgtaaggtttttctttcttttgccatgtacatcctggttgaatgtaaaagtcacgttttaattaatccattataacaaaaaaaatactaaccttgtaatctgaaagtacgatcataactatgtataagtaagtactctaagagtggatcctgaaaagaaattacggtttactagtgtttcggtatcaagatacattagtttcactcggtaaatagtatcactttcattcagttagttatggattttactagagatcgtcgtactgtcgaggcttgttgaccccgctgaatgtaccgtagctccaccgatgtgtaacacatagcgcaaagtgttctactagtcgatttgatcatctccatcgacattacttgagaaacgcccaggggtcttctggctagctccataagttgatgggctagacaacctaggttcaaagcctcacccttctaattatttgatattaggttattccctgatattcgcttccatcgacattacttgtcttggtataagtacacgctaggtaaagtctctatatggcctatgcgtacatatgcagagatgcacgtcatgatctcgatcgtactgatgattcagtgagacactctagaaactagatatatttgcattaaagatttagatatatttcagatatgatcaatatcaagtcataaatacagcaggattttactcttgccttgaccaacatccaatgagatcatcacgaaacaaacacgcccacaacaaagggtggctttaaatcacaaatagaaataaaccacaaacgacacgatctgtagaagtacatcaaacatagcctattacgcatacctaataagtatttatatctatcaacacgtgcgtaaaatcataccttagatagatcacatctttctataatttgttgtcacgtcgcatcctctttgggggcaccgctttggagaaacctcttcgtgcaaggatattgtcattggtctatgcattggcttcgaactttagtcctaggcctggacgaggccttctagctccacattttgttttgcttttctcagtttgggtcatctcttctcttgtttgatgtgttcaacttgtcttcgaactacactctcttctggagtggatctttgtaataattggctatagttctttttgagcaaaggccgggatattatattccattatctaaaaaaatattttgtagtcactaaaaaggaacacaattgatttttcctcccactctaaaaacctcaaaaaataacacccgcgttgtctctcgctggcagcagtgcctatgagactatctcagaaggtaacgggcagccaccgacaaagcgggcccacaccaccctcacgttgggcccacgtgtaggtagcccccatacacgtggcgcgtcgtggaccgtacgcgtggcacatttccccccgcgtggaccgcgcagatgattccgatcgctcgcgtcagaggagtcaacagcgccgtttcgtcgtcgtcggctttaaatacccccgcgccaccaccaccgcttcctcctccacgccattactgctcctcaaacgagaccaagaaatcaatcgttccagcgaagaagaagaagaagaaggaggaatccatggcggcgaggacggtggcggtggcggcggcgctcgccgtgctgctgattttcgccgcctcgtcggcgaccgtggccatggccggccggccaacgcctacgacgtctctcgacgaggtacgtatatatacgcgatctcctcgacctcatctcgtccttctcgttcatcatggatggatgcatgttcgatctgatcgatgattgagaatgaatgaatgaatctgcaggaagcggctcaggcggcggcgcagtcggagatcggcggcgggtgcaaggaaggggaaggggaggaggagtgcctcgcgaggaggacgctgacggcgcacaccgattacatctacacccagcagcatcacaactaattaatcttatcgatcaatcaataatcaatcaatcaatcagtcgcttcctcttcgatctaccaatactagtattggtatataattaaaactgcaaatccgtcatgcatgcatggtatgcccatcgatccatccatgattatctctagttagatgtagtaacaaactgcatgcgcgtgttgtgctcatcagtgttaattttggccgcccccctgttgataaacagttcttgatcgatgagagctagctttcgttttgttttgatttgttggttggttggttgatttgagagttgagacagatcgatctctgcttgaatggtacctgtcccaatttcagactttcagattctaattacaacgcttctgattgatgagatgctttgaaacgtaaattacgtacagtggcatgcttggatagatcgacgaggaaaatccaactgtgtactgcatggttgaacatgtcaaatttggaccatcggtttcgaggaatcatgacagagcagtactactacagtagtaccaggaatttcgcagcatcttttgcaattgattctttaccatgattggactaatttcgattcgcactaggctttactccattccattccaatttggttcttggccaattgctatgtaattttattttttttaagataatgagttgctatggccgagtttatttctaaactttttcttcaaactttcaatttttctatcacattattctaattttagcgtgaactaaacacaccttatataatttctacccctatgtagatcgcacacttactttccacccctatgtagatcacagacttactgccttatgacttcgagagattagcgtatgtggaccccatgattagcggactcatcttagaggatcgtatgtctgggagtccattcgcaatgatttggctattctagcccatttccactctcaagtacaggtgcaactagtgggtcgactcacgattcacaatcccaattatatgccaataaatacccaaaagtatatttctaaaattttgtttttgaaattcctaatttgattctaatatgtagatagatttttatcaccaagagatgtcttaaattaagtcccaacaataaaaagtgtacctaccctaactaacagaaaaaacaaatcgctctgcccatcccctcgtcacgtgcccacgtccaatcctcttgtcacgtgttgccctctccttttatatatggaaattgggagcgagagtatctcctgacatgtggagaggacagagaaggaaaaatagattccaatttttgaatacataccaagagaactgtaggagtaagttttcacaaaagaaaacccaactcactcggggacattgttgatcatgctctaagtgtgttcacgggtagattcacttgaaccactacctaaaagtctcaacttacagcaccaattgtttcccagactgcaacaaaacaaagcaaaaataaagtctttgtgggacggagggagtagtatatagagacaacacgtatatataagcttgtaggtttttttttttgcgccatgtagatacttgttgagtgtagaggccacgttttaattaatccattataaaaaatttataacctttgtaatttgaaagtatgatcgtaactatgtaagtaagtactctaaaagtggatcctgtaaaaaaattacgatttactggtgcatcggtatcaggatacattagtttcactcggtaaatagtatcactttcattctgttagttatggatttccctagagatcattgtattgtgtctaactctaaaacttcttatattctgggacaaagggagtactatcatggtatttatgtctgcatgtacttaattaatttctacccctatatagatcacaaacttagtgtcccttgactttaagaaattaataagttgtgggccccacgactagcggactcatgtatgttagggagtccctttgcaacaatttggctattctagtccatttccactctcaagtaagggtgcaactagtgggtcaactcacgattcacaaaccccacctataggccaacaaacataaaaaaaatctatctctaaaattttgtttttgaaattcctaatttgattttaatatgtagatagatttttacatccaacggatatcttaagttaagttccaataataaaatgtggacccgcatctaactaaccgaaaaacaaatcgctccgcccatccccttcccatgcactatcctcttcccgcgtatctagatatgcattcaaaaataatggattccaatctttgaatgcatatctagagattgggagcgagagcatctcctgacgtgtcgagaggagaaagaaggaaaaatggattccaatttttgatgtatatctagagatctgtaggagtaatttttcataaaagaaactctaattttaaaattgggtttcacttagggatattgttgatcatgctctaagtgggttcacgggtggactcacttaaccactacctgagagagtctcaacttacagcgccaactgtttcccagcctgcaacaaaacaaagcgaaaaacaaaaccatttcaaaatactaatgtacggccatttataaagcatgatatcagatgctccaattactcacaagtaaacaagtctcttgcagagttgcagtactactctgctgatgcaggccgggtcaccggcactacatattctggatggatgcctgaaacagtaggaccggcagcggcgacctcgctgacaagatcatcagcttcaaataactcaaaaggagtttttgtacaatagctaactctgccattagattctggccaaatgaactccatgacaagaagagccattgacattgctcatacccagaagaggtcacactgctgttgcaatataattcagtatagtattacatgacgttgacgacacactgcctgcttagatacgtagtatatatacatacatgcagataagcattggattggattgattgcctcctgtgctacacttgcttgtctaatttattaatccgatgcttacatgttcatgtctcaatcagacttgttcctttttcctgctgcaccaaaaggaattattgatattattatcatcaacctgggtgttagcttccgtacgtcgtctaaattgtaagggattgtcaagtcagattagaagcatcgtctgtaagagagattgttagtttgtaattgattgcacgagccatcggattacctgcatgacagtgacaatggagatgacttgactacttgtgcgtgtgatggccgtatccggtctctagaacggcacacatccatttttccatagcaactcaagaactgcagcttggtggatgaaagattgatcttgacctgcatccaccttcccttatctctgactgatactcccaacacttgtgcggatcatgacagcctgcatgagacacaacggcacagctgatgggtatgcaggtaggaacaggcaacctggttcatccaaggtttatgaaagaaaatgcaaatggcactatggcagtcaaacaatcttttattttgaaaatgaggttggtactgtacaatttcttgcaaaccgaaatgtagggtctgaagttgaggagcatcattacctgtagctagcctgtcgattctgcacggatttggtgttctagagaatggcgcggacctgaaataaaaaaagccagcatagaaaacgacatgccaatctgtgttcaaggattcaaacctgatttgagaaaattctgaagctctccaaatttgacatagcaatcagttgtaggataggttccaacacctctgaaagttctttgctaacctgcagccactagaattttcaatgcatcagttcacgtagttggacaatacaatttgaaaacatgacatgtttggcaccttgctggctgttactccacaactcagcaacaaactgacagatgcgatctagattctagaagactgagaaaagcaatacgaattagatgcagctcagagaggagggaaagaaatgtaagtgtgaaactaatttggaatcggaaagcagagctctctgtcaatcatgtgcccgcagcaaacattaactcaagcttctaaggaaagaagtccactctaacaatttaaaaaagaaatgatgcactccaaaaggttctctaggttcattccagttcaagaaacctgttaccgctacaaaatcaggtttggcatgaacttccagaaatccaaaccaagggccatgacttagggtgtgttctttagtcaaggtttccaactttacctccatcattttccacgcaaacggtgcattttttgccaaaaaaataattctatagtaaagttactttaaaaaatcatattaatccatttttaagttcttttaagctaacacttaactaatcatgtgctaatctgctgctccatttccgtgtgtggatgattagctcccaacctacactaaacacagccttagagaaacataaacagatgtagtgaattagtatggagctgtacaacaattacaaattgcaacagataaaaaatgttaaaaggggcctcaagcccaactcacctagccgaaaatacagtagtatattcctcaataaaaagcagagataaatccaggaagtactaacacatatgactcactgtcaagcaagctgtaagttttggccaaaaagggaagagttacaacctagtgtaaaaaaaaggaaggataataagttacaaacttccattacaatacattgtctatgcaatccacatcagctgaacaagcaatcaaatgacagatgatgtactgaattaggtctgaccaactaaaacaattgccatctcttcactttcactcgaatagtttgctgatctatgcagattatacgtagctaaatgagaagtggggacagttaacaataatatgctcagcagcagttgagcgaaacataaactagcctatctcaagcatcatacacaatatagtcaaacacaactaaacatgtttgtgcaaaagaaaatacatctcaccaaaagatatcagcaataatacaagcaaagttactctttcagaaattttattagctgtatgaaggtcagaattgttacataacgttatcaactgaatcctctctgctccccgtactcccttttacatttacagcttcagtatatcctatactccattttttctgtacacaacaatagatgaaaatcttacagccataaacatcataactgatcaacagaagcaggctcaggccgggtcatgagccatgcgccgttcaacaaatgcaagcacaatgctatgcagattgcagcgataaccatggacctttcgctcatgtgcctcaaggcacacaatccagccccaatcgcggcatcacccccagccctcgcgccttcatgaagtctccacatcacaaagtcgagaaacgatcgcactgcctcaaatgttgccctcccagtcaaatccagcacgagcctccggttgctcggcaccgcaagcacggtcgacaccgtctccacccatccttccccatccccaccattgccactaccactaccactaccattgttactaccattttgattggaattggcattggggttagggttagatagtacactatgggatgtttttaccagtgtctccatggaggcattgcagagtgcgacgagaagctgctgtagcctggcgccataggaggggttcgtggcggcggcgaagagctggtcgtaggtgttgatgtggatggtcttgtctatgaacacccccacggcggtggccgtgaagacctcgacccagctgcggatcgctctccggcaactcccggtggtgaccacatcgacccagctcggcgacgacgagcccgacgaaggatcggacggggcggagtagtaggcgagcacgagctggctcccgaagctgccggcgacggccgacgcgaggcgctcgccggaaggggataggatcctgtcgagcaggcggtccgagaaggccgcctcgtcaccggaggaggaggcggcggcggcggtggcgtaaccgcggatcacgccggtggtgagggccccggagagcgcggaggcggaggcggaggcctcgggagaggaagcgagcttggagagctgcctgaccgtgggggggatggagtcggagtcggagcggaggaaggcggcgaggtcggaggccacgtcggcgacggcgtcggcgagggacgcgagggcggaggcgacgcgggcgatgcggcggcgccgcgcggcgacggccgggtggtggtataccaggtaggcccccgcggaggcgcctgcccacgcgagccagcggcggcggcggcgggagaaggcgagaaggcggtccatggcgcggcggcggcggcggccggagttgggtttcggatggggaactctgctcaagggctccatgagtacgtggcgtgtggtgatgggtagctcgcattttcttttttttcttttttattttttagagggatagtagactcgcaaattggatcgtggaaaataaatttggatccaatttggcccaatacaaacttctattattccatttaggcccatcttggtgggcccattcgagtttttaaagtctagaacgaaatttgcaaagtggttaggccgaattttgaccgcacacggggatttcgtacctaatttggcccgtgacagtttagagtagtgacagatgagaagtgtatctaatccaattcggcccgtccatttttggattcttaataagagtatttgtaatttttaatagtactcattccaaaataaataaataaatagtactattctgtatgcaatttttgtcaagcactgtataggagtatgagatggcaagagatcgggttaaacacatcatgcactaagatgtacacgtggacgcaggggattggtttggtgaacgcatcaacagagatggataatgcaagtgggttctgtgggtggatggcagctgcagctagtaaagtctccgtcactatctgctttgtcaacttaatctcttcttcttttgtgcatggaacaacgcgtggattcattcagtatactggttcgtacactgaagtttgtagtatattttttgcagtattcaacggaagatacacatcatcatcatccatgcgagagattttcttattcttctttttttccgagatatgtatgtgccaaaagtcaaaaacagtttcgagttgttctgttgtttccgatggatttttgttgtttcctcgattagctagtttagccggtgcgcagcaatccacttctgaatctgacagacatgttcgtggtttctgaatgagaatgaaaaaaaaaaagaaacataatgctttatgcttaatgttgaagggtctgacataacataagcctgcaattttctcctctccgtaactccgttactgcaggcaggttcaaaccctctagatggagtagtaatttgtgtgcgaaaatgcagtagaaatgacggtaattagtgcacgattagtcaatcgaatcagcagtattaacggcaggcgatcgatcgccatgtccgaggtgagcggcagcgacgacgaagggcttgttttggagtcccgagccggccgcccggcggcagcgtaggcagatggtcggccggcagagtcaaaacaaaagatctcgccaacaggaaggttaaactttggaatttatctatcactcgtaaacctcgaaaacacaatgcctctgaataagcgagcgaaattagacagccagtcaggcaggtccagattccagcaacgccgcatttacacgggaccagcaatttgagctctttgttttatcgtctctgacagcgtcttccaaaccaagaaaaaaatgcatgttaaggtcaggtcaggccaggagagatgagcagtttatcattttgcatcagactcaacagctcaccagttatcaacatccacaataacgctactagtagtggagttacctgctaagtgtccatcagaaccagatagctactaagagtcctgctccctcaattctaaaaatataagagacaactaccattgatccaaagataaagaaataattattatcatcttattgttataagtataaaacctgtttaaattgtagccaaaataaaccttaccaaatttttgcaataccaaaattttagtaagataccaaaattttggcaggatttcttatgtatttagcaaatttagtaacaactaaacgtagacatttttttataactttaccaagaaaatggtatggttgaaaatgacatcaacgtaaaccgaaccataatgtatggatccaataaaatttagatttaaagataaatgataaaaataataatttagtgaagataagatgctagttaattgattatacgcatacatgtttttattgtagttatgccttatatattttgggatggagggtgtctgttcaggttaagattgaacccacttagagcaggtacaatagcaggctataagccagctgcaaacatattttaaggagataaataaagagagagaagagcagcgggctacagatttgtagccagctgtagcacggactccaagacgcagtgtgtgcatgacaggtgggaccaggtattaatagtgtagtatataactattgtatggatgagctattagattggctatagatgaattggagttagtagttggctatactattatacttactcctactataagcttatgtgaaagagagatgtaacaaaaagttaaggggtgttggctctcatgcaagagctagcttaacacaagctccaagacaaatacaattaatgtataagtgagagatagagagaggagaagaaaattgtagccaaccttataactaatttattatatgtgttggctttaagattaattaatagtaagaagtgagtcctattattatccctgctctcagtgactgacaggcagctcaaccacatcgattcgccacgcagcaacaccacttgcaccaccgcccctcgtctcagctcatctcctcgtcaaacttcgctttccccaaagtcttcctcttccctcctctctctctctctcccccatctccatgccgccataagtatcagcagcatcgcacccggaatcggaatccccaaacccaaccccatcaccccccaacaacaagagatcatcgaagccccaacaagtcgcatgacatccatggcgacgccgccgcccaagaccctcctcctgctcgtcctcgcgctatccgtcatcctcgtctcggccaccgcgttccaccaccaccaccaccacgacggaggagccgaagctggaggaggaggaggagggggaggcgggttcttcgaggtgccgtggttcggcccgccggggggaggcgggtggggggcgtggggagccggctacggcggcgccggaggacacgagatggcgcggccgtcgacggtgtgcatggagaagggcgcctgctacaagaagcggctcacctgcccggaaaagtgcttcaagtccttcagcttcaaggacaagcacggcggcggcggcggcggcggcggcgggtgcagcttcgattgcaacaagtgcgaggccacctgctaattaatcaaaccgaatgatccatggatggcgaagaatcgatggccctctctactgaaactgatggatgtgtatggtatggggtgttgaattaatcgtcagttattagagttttgttaattagctacttactgaatggaatggaatgtaatgaaatatattttggtgagctgcgagagtctgtaagtattcaggtgtgtgtgtggtgttcttgatgataatgatgaataaaacgagaggaattcatcgattctttgaccgtatgaatttgatttgagctgagctgagcagcaatagtagtagcgaactttaacgatcagcacttcgtctcttcttcttgtccttcacatcgtccgtagaattgtcaagcagtccatagtgaaggaattttttttcctacttattactggtacaggattaaattgttttccaacaaaaataaatcttccaatccaaagagcctcttaatcaaaatctacgagaaggttgatgctgagccgactgatacattagttcggtttgccggactgattacaggcggagatgatttcgacgtagaactaccagctgctctcgttgatttccctatcaaaaatgaaaccagctagtttttctttttttaaaaaaacacgcttcaagaagtttcatttcgttgcagagtcaaatcaacaacaacaatgagaagaagaaaatgcatgaattccgtcaccaagttaaagttggagctgatgtgaacagaatgaaaatgtgtagtcaaagatggatagttgagctgggccaacagcccatccatagcctaggccagcccatcacttgctctggattttggtacgtttgccttccgtgggcttctcatgtggatagatgggtcatgggcgcggccgcgcgggctgggctaatggatttggagttggttcacttttcaattgggccaggccctccaggaaaatttgctggattactttcaactgggcagccctattagtagttgggccgccttcccccatttgtcatgctcattatctcatcaagaaatggttgggtttatgtctttcatgacgagattagtcatggatatttttctcttctctcaatacagcttgtttggttcacagaggtgagagagtgcatttcattagttcagagtacatactgtcctgttcttttctgattaagatccagattttatctcggtcttaattagtacacttttcaaactactaacaatagattttttacgaaaactttatatatagaagttgctttaaaatatcaaatatatctatttatcaagtttttaataattgaatttaattaatcatgcgctaatgattttcccgttttacgtacgtcaacttaatctttgtaataaaagattcagtattttgtgcagtgtgttcgttctactagcatcttcatggaaggagggggaaaaaggaacaccttccatctacacacacacacacacacacacacacacacacacacacacacacacacacacacacacacatatatatatatatatatatatatatatatatatatatatatatatatatcccaattgtcgtctgtcctgttctgaatatttttcttgttattatcttggtcgtatgctggaaaacatgctgttttatcgcacgttgatcccatgggatgccggcatcatatgatcacacgacttttcacctttcctcgacctcctgaagcctccaaaccaaagaacaaattacgacaaaccaggcaaaaaaaaaaaaaaaccacacaccaaactatctcaactctgaaagtctgaacttctgaagtccaaaaccgaaagtctgactgataacacgcacgaattaatgattccgagaagaaagaaagactcttactaatccaatgggggatagatggcgatgctaactaaaaatacgccaaaatttcttccctctaccgacggctcgtgtctgacttgctgaccggtgaaaattcggcgtaaaaatcctaaaccttttgcccatctcgcgtatgttgaaagcatctgtttttctatattttaatcttaatctaatcagttgccgtcacttgtcagtcatcaggatcgcgtgttctgactatccatttggggatttcttttttcttcccaattttgtttgtctcctctgtccacgaatataaaactatttttcaaaacagtgataagttaaatatttttaaatttaatcgttaatataaaagtcataaatactaacgatgtaaaaatgatattatgtagatttatccttaaaaaaaaaccatcataatatacaactctaatacgttttagaggtattattggtcaaggtagcacattggatatcgcattgatatctaaaatgcttataattatgtaagaagatggtagatgtatatttaatgaaaagtcatcttcctccttggtccaaaatagtatctccatcccaaaatatatgatgccgtggatttatcgtataacgtttaactatttattttattattaaaataatatataaaaattatttattttattgtgacatgttttatcactgaagaaactataaattaacttataattttatatatttatattaatttttaaaataagacaaatgatcaaacattatgaaaaaagttaatggtgtcatgcatttcgaaatgaagataatacttgtgaagtttcaagcagccactgattggtacctacatattctcaattttgttaaagtttaatcagcttatcagcatgggcaattaccaacgtgacagattaccaaaaactatactaggaccaatgaccattgaagtaaatcaacgcgtgcttttgttcgaagacttttctgtagatgcacgtggatttgcatgggagatatatgttgctgctgttgttttctgatcagaatttcagaaccgtatgtcctaaaaaaattcagaacccgtattgtggcctggatgggccaggagatgaggagatgatggagatatctcatgttccaacgaccatagaacagaacgatgatactctctccgttttaaaatatttaacacctttgactttttagcacatatttgactattcgtcttattaaaaaaattcatgaaatatgtaaaacttatctgcacgtgaaagtatatttaacaatgaatcaaatgatatgaaaagaataaataattacttaattttttaaataaaacgaatggtaaaaacgtactaaaaagtcaacggtgtcaaacattttgaaacggagggagtattatacataactgtttcatgctgctactgctgttgttatctataactcatcgctgaattaattgtcatggatggttccatgatgtaagtgggcaagtccacgaacccacctataatataaataaacagtaacctgtctagttatctactaatttactctatcccaaaatataagagattttgaagggatgtgacacattctattaacacgaatgtcacattctttaaaatctcttatattacagaacaaatagagtatattataagtggattcgtgaacctgcctgcttgcacctggttcacagccccatccttttatccattgctggttataagccatgaatccatgatgcatattagttcttaacaacttaaaatccaatcaaaatccaaggatgaaaagtaaagtaaaagaacaataaaatgatctttaaaattatgatttaaaatttaattctaattgcggtagatataaacaggagagcaacgatggagtcgttccaatctgatagtgtttgcataaaggaagagagataaacgtcaggaaatttaattaagagcgattagtcgtcattgccactcatgattatataattaagaacggtttgagcgtgtgatcactaaaagagagccagccaggccatacatacgtcaagcatttttgcttggacaagtcaataatacctaattattttaaccaagaaaagctgataacaatatcatactccatatttcatctatttggtactgggaccgagtgatacgtggtagcagtagcacacactaatttagtaatttttagtatgatcggaaacgtcactctgtttctcctacgcaattaggtatatttaacccaaagatttagctctctctctctctctctctctctctatatatatatatatatatatatatatatatatatatatatatatatatatatatctaagcttatcgatctattgattgcgtgctcatctatattagccctatacacgaatgaatgagaagttgagaacagcgcaaaaaaaaaaaacatccaccttattagtcaatagctaaatttatgatacttataacacattggaggaaaacattgttagttgccaccgacgaattaaagtcgaattccacaaacatgatcttaaccaacaaatcaaatttcttccataatgatggtagtatgattatgtcaaacatgatctcaactgacaaatcaattttcttcccaaatgatagtagtacttatcaccatttcagttagttaattaacagttattagtcaactgatggtgccatgtcatacggtgagttctcatttcccccgtggtgattagtgattagattgaacggatttctcccctatttgctcggagttacggtgatgatccgaatgtattggagccatgcatgccgtggcctttgatgcatgtagatccagctatatacggataagattttaaaaaaaacccaatgcatttttccttttaccattcatttcggcgaaccattgttctgtcgatccatcggtatcctggtcaattggcaagttgacgaaatgccccatgagcttaatttgctggttggtttatcagatacatccaaattcaaatgtaaaacttaaatttattttgagttggttttgagatttttttcattgtaatttatttttagcactggtttttaaatcactaagaaaacaacccattttgatgaattcgtttattttgtcccacaaaactaatagcactatccactttgaacaaacaagatttatttaattatgaccattcgctaatccggccaagacctttctctcttctctccctctataaaaagcctcttcctcatttcctcttccatttcttctcctacttgttggcttctatctcctgttaattaatttctcaagattagtagtaaaagggtagggtattagtggcgtgattaatttggcgggagcagcgatgagaagtggcgggagcggcggcggcggcggcggcaagctggtgagctggctatggcgggcgccgcgccgggcgctgtgccgcgcgcgggacttctacgtgcggagcatcaccggctgcgccggccacctcccgccggacgccgccttcggctacggctacccgacgttcgccgccccgacgacgccgaccatgtcgaggaacagcagcttcgcctcctcccgctactccgccggcggcggcggcgacgacgacatgcgcgagctcgtccgcgccgcgtcgcagaggctggcggcggagcgcgccgccgcggccgcggagccggcgaccgtgccgcggagccagagcgtggccatggcgaggatcgacgaggaccggccgtgcgagttcgccggagttgggctggtgttcccccggagccagagctgcgccgtgggcgccggccgcgtcggtgggcggagggggagggtagctgccgtggcatgaaccaccgccgccgatcgccgccggcgattcttgcgtgcggtgaggcgtagaacgaaagcgaaggacacgaacacacgacgtgttcttgttcaaatttcgatgttttctttttcttctgctccaaaatttgcagctgcgatctgtaattcttgttgtttgccactattgatcttcatttttttatattgttcttgttcatctgtaaacatcccattaagaagaacagaattaaattactcgtttggttggcttggtcgaccgaggtaaaaaactgagaggatttttaaggtgattttcaccctaggcgagatggattcaaagatatatcagatatctttgaatttcgggtgaattttcaagctagggagatagattcgaagatatctgcatcagaaatcttgaggtagatttcgtcggcagcccatgcgatcctatccttgtgtcgattggtgttgaataattcatctggagtagtatgcggagtcaaatcccgttttaaccagtcaacggtacaccaaccattcggaaaccgaaatggtgaaagctctgtcactattttgttctctattatccaatgcaggattatctttaattttttgtttgagatgtaacggttgcttgaaggaacgtatcaaaacaaagggcctcatcggttgccctatagtttataagccaaagccaaaatttaaattttaaaacttgattttgaatttgattttaatgttttttcaacatagtttttttcaactttggcttttcaatcactaagaacatacatacaaaagttttactcacatatcattttttaatcgctaataagccgttatggcttataataagatgcgggcaaccgatggggaccaaaggattggaatatctaagaaaatttcttatacacgccttatagagcattttgagattatcaaattcctatggattaatttcttaattcttatgccccaaatgacacttctccttttgtctctctacttcctctctcgtatccaccaaattcctgtgcatttttatatctccatgagatttggtagcgcgtgacattgtaacacgcgtgtttttgtaatttagagtatgaccaacaacttacttattctattctatatcctcagatttaaatcgcatccaacagaatcttccaataatccaggttcccaactccgggtattgcgagatgaaggaggagttggccacgcggtgcgcgcatagggatcagggtattgcgagatgaaggagaagctggccacgcggtgcgcgcataaggagcagcagaaaaaactaattttctctgttggtagttaaagggagggaggggttactgattagttttctcacttcctatattcattttagaagcttaaaaaaacatagctttgggatttgattattgtcaatctcttggtgatgctcttagaatattgcgttccaaaggagtactagattttctttaaaaggaatcacatagaacacaccacctatatatacctagccctaccatatttttaaactaagtaaaagtcactaagtttcaatttttcaaaattttcttcgaacttaaccataaacatcaaacttctacaccacaactattcttactgttgggcttggcccagccgcgccgaacactgtcgcaaaaccacgaagctgaagcctagttgggccggaaaggaatatccaagaagtgttggtccgaaacgtggcagcaagaaacattttggcccatttgagagcccacaagctatccggcccatcttctataagaacgaaacgatgataccatcgtgtcagtctcgactcgtcggctcgcctcctcccttcgccgtcgccgatctctctctccgcctcgcctcctccgccgcgcgccgcccgtacgacggcgccgccgcctccatggcgcagtaccacctcagcgcgcagctacgcggccacgaggatgacgtaagcgtcccctcctccctccctcccgcacctctcggcgtcgcttctcgcctcgtctccgctttgcttctcccgcaagtctgcgcgattccgccgtcgttccccgatccgagcgctcgccggtggggggctcgggtccgctcgcggacgccgcgggctgcggtatcgatctgctatagtagggcgatggcgcgttttgttgcggggacggcggtgctgcttgcggctccgaattgggggtagctcgacctagcttggttgcgctcgctgttctagctctcgcgctctcctcctgtttgttcggtgccttacttgggttcgtagatttcaaacgctcgtgcattgctagtttagtttagttcggtcggcaagcttgcttagtgtcagagccaactgctgttttgattgctagttcggtcggcaagttctacccaatctatcgcatgtgaattcactgtgttactgtggattttgggggtttagtggagggttatcgtggatgtcctcgccagtgattattgtactttgggtaattagtagattggtgaactcgtgagtgatcagttgcttggtctcaaatttgatgtgattctcttcatttcgtatcacagtagaacttcctgttccctgctccacccgatctcagtaattcagtcccatccagaatgttccttgtcaatttgacaacattttcgtcctttttttttcattacaaagcatgttttgttatgcatgtctgtgcctgtagaatgcgtatcttatatgacatgagctaattgcagcttttctttgtgcgatcctcaggtttttcaatttcagcgcaatatagttcaattatgcttattgtgcccttccacattaacaacacattcttctaattttacatttgcaagcacacttgtttcatggtctgcttattgcgatttactcctcaacaggttcgtggcatttgtatctgtggggatgctgggattgcaacatcctcaagagaccggacagtgagattctggacacagcacccagaaaagaagcatgaatacgttctctcgaagactcttgttggacattccagttttgtgggaccattggcttggatccctccttcagaccgctttcctgaaggaggacttgtttctggtggaatggatactcttgttttgctctgggatttgcataaaggagaggttgttgagactatgaagggtcacacttcacaagttactggacttgctgtagacaacaatggcgacatcatctcttcatccatggattggtaggttttctctgagaaatcaatataattctatgctgctttcttatatggcttggttctgtttctgcttgctaattactatcctatgctaatttcattaaaaaaatgtatgttgtcaatggcataatgtaacatgctatgataatttgtatagctttggcaccttcttatttatggatcactcattttctttcattttgtgccaattcatgtttctacttctgtttccttttcctttgaggctctgttgcaaatgttactactaataatttgtgtcaaaagctgcctctaagtatttggtattttaggcacacgcatctgctatttactctttcttaaattgtttgttctaatgacaggatggcctaatactaataaacaattaagggtccttattagagtggtttattgttgtcctatctgatatatgtattgccaattgtccatacagcactgtaagacggtggagaaatggcagtgtagtagaggtttgggaagctcacaaggttgccgtgcaaactgttctgatgctgccatctggagaactatttactggtagagcatctgttatgccttcacatttatttcgtttttacttggtacttgtttattttctgtatttgtgcactggcaccttgttcataactgatccaatgtgattggtttgagcttcctatcaaacttttggaatctgatggtttactggaaatatcccgaaagcaatggttcatctggaattgttttggctttttgaaagtacttataatagtaattcttattggatgtactaagtagctatgtgtctagcaaccgctaccttagaggcgaaggaaaatgggtttactagtataggtaaacgtctcaatttccacaatacagtgcagggggtacaaaatgcatactgaacctcaatttattatagtgtttcctgggacttgttctgaacaaatgtgaccaaaaattcgtcaaatgatctattgatgcttttcctccttcatacaggctcaagtgattccacaattaagttttggaaaggaaggacatgtctacatacattcacaggacatgcaggttatttgcctgttcctaatgcataatactctgtttattgtttatactttcttggacattgacacaaatgtatatgtgtgcaagggtgcttctactgtaatagtgtggttcaccagatagctgagagttgtcaattttactctggtcaatttttttttctcactttagaattgattctggttgcactggagcaaaatgttatgcatttgttttatgcaaagagaaaaatatcatttatgaattgattgtcagtgcccttctcaatatataagcataagtttgtttttgtgttttgttgctagctcacccatgtttatttgacctcattttgtgtaacattgttacggcagatactgttcgatgtttagcacaaatgccagggctcgggatcctctctgcctcacatgatgggtgagtaaccagcttcacttacaaatagagagataaaaactgtcggtttgtctcgaactagaaaagcagcacatttacattattgtttgatcattgttattgctgttgcttcttctaaggcctacttctcatgcaggggccctttggtttactaaaaaaatttagccaccccttaatccttttttttaaaattttatcacacacatgtgcatcactgtattttatcacgcacgctcgcaaatgatattttgtttggtcacagcactattaaggtgtgggcattaactggccagcccctgttggagatgattggacacacttctcttgtgtattctgtggacgcacattcatctggggtaattgttagtggcagtgaagatcgatctgccaagatatggaaaggtgatttgttctgcgttcttcttagactgagttcatgttaaaattcagtagtattttttcattggattgattatacttgcatagtcaactcatgagtcctaccatgaacatttgttccaaacaatttctgaactgatttttccattgtgaagtgcaatccgttttacaaactcctttgtctaaagaaatgtaactttgtagttaaaatcattatgtaagattcagcttcctctgctccagatctgatcttaactagttttgtatatgacaccttggtatggtagttggtagtacatgtttgtattcacatttcttgcttttgtaacaaaggaaacgatctttgaggtgaaacccagtgaagtgtatgttttgctaagcagggatcatgcatgctttttcaaaaaaaagggtgttttgtatggttgttataagtatgtagcagaatgcacattaagcacctcatgtacttgatcaaatgactttgctagttgtataatgcagatgggatctgtgttcaaagcattgaacacccaggttgcatatggggtgctaaattcttggaaaacggagatattgtaactgcatgctctgatggaatcgtgaggatatggacaactgacaataataggttttgcagtgatgaggagcttgcagcttttacagatcttatttctcagtacatacttagtaggttggttcgctttgcttcttgaattattctatttatgttctatgcgaagtattgacatcttctcaacgtgcccccccctcttttgggtatcaacgtgacctaattgtaaccttatcggtatgcataaaggatgcataaagtagtctatttacagtttagacatgattcttttaatctttttatttgaataatagaacctgatgtttattcatgcaatatcaagttttaatttgaccgatagtttttgtgccttttattttgcttgtatagaaagactgtcggtggattgaagttgtcggatctaccaggaattgaggcactgcaagttccaggtcacatacctcatttcttatcaatttttttagattattgttgatattcctacgttgcttaaatatacatagaaaattcttaagctgtttgccttttttttttaaaaaaaataaatcaaaacagcatgctactagagttaagaagcataagaattagacttgatctctaaatgaagttttgtacttgaaagtactttgtgggtttatgctaaattagacttttggaaatgtctagagtattttgataaaatattgcagttgtgaaactcaattgtctaccgattctttagtaactttgtgatgttcaagttgaaggaatgaaaagttcatctttctttatctttgcataatagtatcatcatttttgaacttgtttgcttgtaagcaggaaactctgatggtcagacactgattgttagagaaggggacaatggtgttgcttattcttggaattcaaaagagctaaaatgggacaaagtaagcacttttgtgcttttagtatctccattgtgtcccccctaagttgccattccttcacatgagataatatgaatgttgaaggtgtcttttcattatttgctgtttgatattgataaatatatttaacttaaatgcaacctatgcaatttgacatacctatgaggtattagcattatagggagcttaacacatttactgcgtaacaggtgtcataaatgatgctctctgtttatatttttccatgcccatgcttgacctgcactttgttttgattttatatgtgattttaccttgttattaaaaaatcatgctagattggtgaagtagtggatggacctggggatgctgcagctgcaccaggccagtttcatgatggtgttcgttatgattttggtaagttgccttctgttggatatatttttgtgctaacctcatcatttacttatgttcatctgaaatccatgcagtttttaatgttgacattggagatggagagcctatgcgaaagctaccctataatcgatcaggtatgcctcttttttttaatgcttttgtctgctactggttctagagtaacccaattagtattataattcatatgcttactttacaaaagagagttttaccatttaagtgtccactcaatgcaaggtcctttgcttgcatgtgcatttacctttagagactctcttg

SEQ ID NO: 2036 - DNA, 942 bp, Oryza sativa
gctgttgacatttgagttgtttatggttcagctaatgcatatgtacctgggcaatcagcgtcttcaactggtatgtgtccactgatatgaaaatagagatctaactgatctattttattacttttgttgtattcagtgataatggctttgctccctttccccactctcctttttttgcttcttcacaagtcctaacataatgttcaaacttgttttcagttagtgctcctaaaccaactttcaagcacataccaaaggtaatactcacctttgtcattgttgattgtggatttactgttattgttaataacttaatgtagtgactgaacagttaacatacatatgaattagcaccctgtaccaagatcttgtaacttgttattttgtaagcacatgggctcgtacacatctgatatatctattatttgtgttaaattggttggtgcttagtgccttagtggaattagctgctactatcattttgtgttgcaacctgtaacctgttgcaattttactcaaaatttgcttatgctttgcagaatggaatgctgacatttgagacggctcagtttgagggaattcttaagaaactctctgaattcaatgcaacactttcatctaatttggtaatttcaaaaatcatttgttggtgaatttgtttcttctgataatttagtattttctcccagaacctgggaagtttagcttggtttataccatcctgtcatcctgtgtactattttgaagtttagaactatgttggtgttttaatgctttagttcgtaggcaatgagttttaagcattgatacagaccattcccaccgtttgagtctcttttttttttctagctgtgtacctagcctgtttggagtgcaggaatgtcctcaattcttgcagggacagaaattttcctatgaaactcctttatttcaacttagtgc

SEQ ID NO: 2037 - DNA, 223 bp, Oryza sativa
tctatttgtattccctccatctttcagaaacggatgtagccttggatgtgcccgtgcccaatgaagaggaagagcgcaacatgaaacgtaagtacaaaagtaccggacacccacccagatcccaatagaatactgccaaatcctccgggaaattgtaatcccattcgccagctcctacatttaattaacaagagaactattgtatttatctaacacctggatt

SEQ ID NO: 2038 - DNA, 1227 bp, Oryza sativa
tatataaatatcaatagttatcaaatctttttatattgaaaactatacaagattaaaatatccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaataatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggtt

SEQ ID NO: 2039 - DNA, 430 bp, Oryza sativa
ccggtacaagtatggctgcaccacacgttgctgggcttgctgctctaatcaagcagaagttcccttattttagccctgcagctataggttctgcattatcgactactacaagtctcagtgacagggaggggaatccaatcatggcacagagaacatacggcaatccaaattcaactcaatctccagctacaccttttgacatgggaaatggatttgtcaatgctactgctgctttggatcctgggctcatatttgattccagtaagttcaactgccatttcttctgtttattttactattatcagtacctctacctttggtagagttcactggggcctatgttatacaaactccgttccaaaatataagcattttttctatgcatttttcaaaatgtatctgatgcttctatctggaacggatggagtac

SEQ ID NO: 2040 - DNA, 449 bp, Oryza sativa
tcatggaatctcggtacagatgcgattagcaagacgtagtttacatctaaatgtttggtttgcttgtgcaggccttaaccgtgaattttcaaagttacgttaacaccatgatggtaaatcttgccgtggacgaggcacaatttccagattgtcatgagcttttggatgatttttccgaatccctcaggcagataaaggatgcagctttgagcctaggaaagcatcacacgaaggcttaaggcactatttaatcattgcacacaggcatgtattcgtaagaatgattgtaccatccaaatatcaaatactactggcaagtggtatctatttgtatgcactgtagcaactaaacctaaagtcaaatgactagataaaaaccatcagatgctttatgatcagaagtttccagagaacaagctctggcttttggttaaatattctctgaaaaa

SEQ ID NO: 2041 - DNA, 3523 bp, Oryza sativa
  unsure (1)..(3523): unsure at all n locations
ttgaagcactgtggagcgatctttcccttcaggtggggatcaacaatctgatcaagaatacccttctttggcagtgtagggcccactctgccaagctaacttcttccttaccaagagtggggttcaaggcagggcgagcacagaggacctcaaatagcacaacaccaaaggagtagacatcagatttctcagtgagctgctgcctgcggaagtattcagggtcaaggtagccaaaacttcccttgacaactgtgctcacatgtgtgtgatccatcgatggcccagtctttgacagaccaaaatctgaaaccttcgcgacccacttctcatccaggaggatatttgttgtcttcacatcacggtggatgattgtgtgcttcgcaccagtgtgaaggtagtgaagcccacgggcagcaccaatgcagatctccaagcgctgcctccatgtaagtggtgcattcttggtcttgtacaggtgctcacgaagagttccatgagccatgtagtcatagaccaggatcatctcattcttctcctcacagtaaccaatcagtgacacaagatgacggtggcggagcttcgacagcatctcaatctcggtttggaactcatgcacaccctgctcagacagtggattcccacgcttgatagccaccttggtcactccaccatcaatctccccacgatacactttaccgaaaccacccacaccaaggaggagggattcatcgaagttgtttgttgcagccttgatctccgcaaatgagaaatggcggcacaggttggatggcagcgatgaagcgtagctcccagtagtatgtgatttggctgagccagatgagtgtgagttgccatagagtgaaagtggcaaccatccagaatgcccatcactcatgcctgtgtccttccccactctgctccgacgcttgcagatcataaagcagcaatatccaagtgcaagaaccaccagacctccaatcactccaccaacaataggcccaacacttgacttcttcactgctccaccatccaacgatggctcaacagttggaacagggttgagcccagcaaggctcccattactaagcggcaacttgaacacctccagtccattgaggatagcatcatagtactgtggtttagcctggacatctggatagagagctacccacaaatccatagcccctgaaccaactgttgtcactacaaagtcttgatacactggactgccgatcccattgttattagtccatgcaatcacatcggcgccctgaaaagcagtctggttgttgatgtaaatgttgaacacccgctgattgatcatagtgattggatattgtatctcacagaaatgaagcctcacaaggtatgtgaacccagcatccacctgcattatccaagtgaggttgtatgccaagttcacgttcttgtccggccccatcgaccttgccgtagcatagacatccaccggcgccacatactccggcacattgctagggtaggcaatggtgacattgtcatcttttgggtaggacaccccgaacgccgcaccaaaaacgtatggcgagtcatcgtcccacgaacggtaaccgcccgtgtccttggagggggagatcgcctggccgccgacattaagtcggtacattgtctgcagagcagtgccagcgtcgatcgggaatggctgattgttgccatccccggtgaccagattcggggtggagatgtcgaagagatcgggggaggagacaacctcgatgccgttgacgaacgcgtaggcgttggggtggcccttctccggcgtgaaggtgagctccatcgtcggggtcgtgacgttgacggagaactcgcggacgatgtaggcgaagttgagggcggtggcggtctggtaggcgctgaagttggagaggagcgtgacgttggcggcggggacggagacggagaagcgcgcgtcggcggcgtcgcggctggagtagttggccgggtagaagtggagcctgaggaacttgcggccggcgccgagcgggaaggagtaggtgaagggcgccgcggagaccctcgcggtgaggtagggcacctgcggcaccgaggggtcctgccccgcggcggacgccgagccgaggctcgccggcgcgtacttggacccggcgtccccgctccacacccgcccgtccgtgtcgttccccttccccgtcgcgccgcagtcgagcaggatgtcgtcccgcggcacgaacggccccgcccccgcagccggcgccggcgccgccgcgctgctcgagtttccgccgccttgcccccgcgcgacgcaagccgccacggcgaggaggaggaggagcaagagcacgaatctggagcttcccattgtggccacccccgctctcaactacaactagctaactgcttccgcttcacagatcgggcatcgagctttcctacctcctcgcagatctggtggatgtgggtgagaaactcgggttcaaggtggaggagacaagcaatgtgggggagggaggtttcgggactactacggccgcggcgttatgcgggagattgggggcgacgtcggcaacggcaaagcaagcgagctcctcgctctgctcggttgctcgcgtttttggttcactcctcgtggtgggatgggtttggctgacgggtggggacgggggcgggaggacgggagcgcacagcggggagatggctggagttatggaggacagctcgcaccgtcgtggcagcctgttcggggtcgggttgcgcgggatttttctgttgctttccttcggcgacgcggttgggaggggaagggaatcgtgcccatgtgcgggagacgggcccaccggcgagcggcggacgcggacgcggacgcgactgatcatggccaggtggcagatggttgttagatcgagaaacctggaaagaaaaactcaaaaaaaataaagaaaaaaaaacgaagctcggattgtgctcggatcatctgagttcagacgaaggtggcgacccaagttgccaccgaagagcttttcgtcatcgcaagggcaaggtttgtggggtgagaggggatcgaacttagacctcaggatcactcaatagctatgagacctacgcgctagccaactgcaccaccaccccttgtgtccaaaactccagattctgataaacagtcctaaacttttacaagagcagatttccgtgtcacaaagtactgagccggacaggaattgaagaacatggccgggaatggagaagaaggaaaataactaaagaaaaaaaagggaaggaggagaagaagagagattcggcggcgattagcccgttaccacgggctatttaactatttgttacttatctaaatgcccctatttgatttgtatttagtaatttaccactggagataggtgatttcttaacaatttgccacttttgtctacgtaacgagccatcgtggcgtgcccacgtggaaagcgacntggtgcccacccgtaaacccctcccctctccttcttctctacctatggccgccatatct

SEQ ID NO: 2042 - DNA, 31361 bp, Oryza sativa
gcgaaggctgaaggtggagaagaaggagaagggaggggttcacgggtggggaccacgtcgctttccacgtaggcaaaagtaggaaatagttaaggaatcacttctctctagtggtaaattactaagcgcaaatctaagaggggcatttagataagtgacgaacctaaaagtggtaaagagctaaattctccgttaccatgagtggcggcgcgatgagactattcggtagtctgttttacagctattaggattgcactgaacaacatagttgttcggctatcggttatgcatctcaaccgttgctagcgagtactagacgttgtagttgctgcagcagcactatcttacttgggcctccttatttggatcgaattggacatctatgggtcgtttgatcggaattttgccgaccacatcaagtagacaagtagaaggccagaagctagtgacgcagggccttttctcactatagaccccgcgataagtcccatacagcatttactgttactgtctaatttgcatacggccatactcctccatccaaaaaaaagagtaaatttcactttgggtcacttatattgacctcagttgcacattgggctaggggtgggtcacttttttcactttataccacttatttttaccatcctttgcaagttggaccaggtttattgattgggccactaggctgggcttcggccacgcaagtaggtgcgtttactagcagccggcaatccccgtctacgggctccggcgagggctccctcgacaacaattccgcctcccttctctggtacgagtacttccctcccaacccaaaaaagtctctgttcacacgcggttattgtgcagcggcgtgaactcaacaatcgacacacaaacgccaccgtctaggtccaccgaccaccggcgccaaggtggagcaagtctcgtcatccggccggggcgaagggcctctacctggtggacgcccatgccacctcgatcgatggcttcccgaggatggaatcactggggtcgttggctgcctcattgataggatgcttgttgggtttacgaggtagacaggtatatgcatctgctattcgatcatggatcaatctatggaggaaagttttgacccttggacttgggagagtgaaacaaagcaatgtattcagtaattcctatgagatttgggttttgtgggggtaatcaatattcctcttctgctcttcgaaaaaactagagtaattaatctgtgttcctcggttggtaaccggaaacatgtcgaattttcacaagaaaagagaagatcggatcttgattactgctaaatggaatagttggcctttgttttttttttcacatgcatgatcggaatgggatagttctggtgtggtctcagatcctgtcaacgtaatcagatgtgccgtagtattgttttgagcgtgacagggccgagcgtgatcaccctagagtccgcgtccactggacgacgacatgctcgccctcgccgatgaccaccccgacgcgtcgcgcacgctactggtatcgcgcaccactgccaccatgagcaaacaccagctgctcgcgtggattaggccgaaacgcatccctcccatgccgtaaacctggtccaacctgaaaaaggtggtaaaattaggtggtgctaactgttaagtgaaaagagaaacttagccctagcccattatgccacattggttaatataggtggttcaagatgaaatttactaaaaaaacaacttaagaggagattctagtgcaacaaatctggatagagagctgtttagattcgttgtctgaacggagggagtacgcgggatacaccgtccgatcaagactcgattcgttgtctgaacggaggaagtacgcgggatacaccgtccgatcaagactctgccgtacctgaggactgaggctctttctcaacggaacacacggcattaacacagtttactgtctgtacctttctcgagttggatctcgtactgttaccgagtgatggagctccccatgggccatggcgggggtccgccggtccgctgctggcgcccgaacttcacatggatcacagccatgctggcaggccatcgagcttcgtcggcggcttggactgataacgcgtgcaattgcttacacatcgacttcttcaagtcttcaacgacgacgatggtggtggtgtgcacacgggtaggtggcgaactggcgatggctgtgcgcatgtgcggatgtgcccccgagcatcgtcagcgcctgcaacaaagagcaggaggaaaacgctcatgaggacgacgatgaagtgccgtctcgatgtttttttgttaccctggagctcacctgccactttttaaaaaaaaaaatacgtgcaaataactgcactacaatcggggtaacaaaaaatcattgttgcatagtttgtggaaaaaaaagggaaaccaagctcagttttgctctatcatctgaaatgggcaagatgtgtgacgacccaaagtagccacgagagcttttcatcatcacttgagtttcatatggggtgagagaggctcgaactctcgacctcaggataactcaatagctatgagacctacgcgctagccaactgcgccaccacccccttgtgttcgaggtggcggccagcacggtaaaatcatattagcatggtaggccaacagcgcgctaatacgaacgtgtgctccactcgctgcatcgctggtttggttcgtgctccgctgccacgcgagcgagggcctgcactgcatctgcacgggcgaaacgttggggcaatcgtttctcgaatctcccaatgcaacgcgagcaccggccgttgcgcgcgggtactcgccggcggcgacagggcggccgacgagctcaacaggatgttcctggtggtagtgaaggccgaagagagcacgcaccggagggcgtaaatgagttcttgcgtggccagcgccaggcgtttgcaatttgcaaaaaagacaaaaagacctctccgcaccatggggagatagtaatacatgctgcgtgtcgggaacggtcgtgttttaggacctaggactttctaatcatgtttccttttctactcgtacgtacgttttgagaatcctaaatgcatggcatggccaaaatacattgttaaaataaaattgtgaaaaagaactaatcatgtttccttttctactcctagtacgttttgagaatcctaaatgcatggcatggcaaaatacattgttaaaataatattgtaaaaaggaaaaaccaagctcagttttgctctatcatctgatatcggcagacgtgtgacgacccaaagtagtcacgagagctttttcatcatcgctcggatttatggggtgagagaggctcgaactctcgacctcaggatcactcaatagctatgagacctacgcgctagccaactgcgccaccaccccgttgttgaaaccaattactccctccatcccataatgtttcaacctaagattcgtagtcctataatgagataggatgagtctaatctcattctagattgcaatattatgggacggagagagtacaataatccattaacataatatattcctcctgttctagtttgcgagctagcaggcgccatatatcatactacctccacccataatataaaagattttgagtttttatttacactgtttgaccactcgtcttattcaaaaaattttggatttattttttattttttttgacttactttgttatccaaaatactttaagcacaacttttcgttttttatatttgcacaaattttttgaataagacgagtggtcaaacagtgcaagcaaaaactcaaaatcccttatattatgggactggggggagtatgtgacatttaacttttttttaataattaaggatttgtgtctatgatacgtgggctctcatatacctataatatgcgagtctatgggtaaatcatttatcaccagtggtatgagtggcaaaaagaagttaattattcctatatgcaaagtgcattcttctacttaacatggtgacaagaaaattgagaaaaagcatgatttctcattcgtgaaaggacggagtccggtacaccattctctttacagttacagatattagccactcactcatcttgatcttacttacaccgacatgcatcaaaatgtacatcaagatcaacaaaaaatctccggtcaggttaagccccaggcagtcaaagttacccccgctgcatacgccggatcaggcagatcctttgccatattacagcgttcttccatcagtcaaatcatgaacggtgcacaaccttggagataactgagaacgggatcatcacccggtggcccttgtcgccgtagaagccgacgctgccgaagctcgcggaggtgccgttcatggtggcgttgacgacgaaggtcacctgctgcctctgcccgctggggatgaagaactgggccggcgacgcggagacggcgaccccgtaaggggcgctgtaactgaccgtgtagcgctcgtcgctcgccacgttggttacagttcttgttatcgttcttgactggttgagcactgcaatggtgatggaggggaggttcagatcagcccctgtcatggcggaggagctgcagctgttgccggtgtaattcatcactactggagcagagccgtttatgccacatagaaaggagaagaagtcgtcgtaacctgtaaagtcatgccgctgtcaggattgaataattactaaactacactgagaatttcagtctgactttatagtgagaaaaaatgttgcattgcatgtatgacattcaagctatattgctgttgctacttgctagtttgtattcatactatcaggtactccatccgttccagatagaagcatcagatacattttgaaaaatgcatagaaaaaatgcttatattttggaacggagtttgtataacataggccccagtgaactctaccaaaggtagaggtactgataatagtaaaataaacagaagaaatggcagttgaacttactggaatcaaatatgagcccaggatccaaagcagcagtagcattgacaaatccatttcccatgtcaaaaggtgtagctggagattgagttgaatttggattgccgtatgttctctgtgccatgattggattcccctccctgtcactgagacttgtagtagtcgataatgcagaacctatagctgcagggctaaaataagggaacttctgcttgactagagcagcaagcccagcaacgtgtggtgcagccatacttgtaccggaaattattgcaaaactttcacctagacagtaagtcaaaaacaacataattattcaattaatctatgtaagaaaaaaattattatataagcaaatttattaatagaagatgttataggttggattctaatgctaaacgaacatcttattaagggcttccacaataactagaacagtttttatacaaccttttctgtaaagcattatgtctagagcatgacctaaacttaggtgttaaaatgcacaattaaagagtgaaatcatgtagcgctttctgtgattacttctacataaaattttgctctatcactctatcagcgaggtaaagggaatggactaacaaaaatgcagaacaactgttggcacaaatcaatgccaaccgtaatctacaaatgattcatggtactattgaaggggaaaaaattaggctgaatcttcaattcagacataagctctctcattaacaggtattttagcacctaatagaactgttaaaaaaacagaaaatgcatgccactgttttgttttattgctattttatatgcctgatgattcaaagaataaaacttatgttctaaacaagattagaaagtaggtaaattgtcaagttaccagcaaattcagcagagtccaatccaagagaactccaagcaccccaaatggaactgccaggtgctatcagatttggcttcaggatatcagcattggccagtgagttgtcctcaggatcaggacccctggcagaataaaacattacttttggggcagaaataccataatttggattttggcctcctagtatttttgcaattgcaccaaagctgacgattttgtttgaggtctcatctctcacaagggactcattgtaataatttagaaatacctgagaatgttgcatcacatttgttaattttcttcatatcagcaagggatgagtaataacaagactcttgctttggctgtcataccttagagtcatcagatgatggtattataagtccaggcatatccattggagttggattcagctggaatccaatgacaaatggatccagatagaatataactcctgcagcactgacattctttgcagtatctaaagcttgcttcacagacgacaggccaagtacaaatcgtatggaatagctgcagaccagtatctttccccttatcagatcttcatcaaggtggcttgaatcttggcactcccctagggacatttcagtaggactggctacattgtttttcagtgcatgaggtgcagcaactagagtgaacatggaatcaccatctgttccagctgtatttgtggagtaacacaaagttagaatcaaacaacaccagccatgtgcagttgcgcacaatggaaaatactactaggaacttacgagcaaggccaactcctgtaatggtcagattgttgccaagtacaacatagttgttgtattccctgtcatgggcagatgctcctacagtaaaaatccatggactgtatgatgacatgctcttgggggaaggacctgtatttcctgcagcttgcacgacaaatatgccagcttttacagctgaaagaagagccatgtcaattggattaaagaaggtggctagtccaggaggccttctatttggggtaatggataagctgattatatcaacattatcttcagctgcctgcaatatgatgaatgacttgtcatcaataaaatgtcacaatgtgcccatatgcattgtagcattctaaaatgtggtattaatttgtgctaaatcaaaagaagatagttagcttgcaggtaaaccattacctgatctattgcagctactacatcagcagcaaaccctccaaagcttttgtacagagctttatagacagcaatgctggaaattaatttgtcattaacatttgggaataaagtggatcttatatgtctccgcagaaaaaggtaatggacttactgtgcacgaggagccattccacttgcattcccaaaatgatgcccagccacaacaacaggaattccatgattaccagctgctatggatgctgtatggctgtacgatgtacaaaaaatatatatcagaaaacagatatgctgacaaaaaaagagccacaatgacatatggagtgaaaaatgtaaatgaaatatctatgaataatttaggcagaagctgcagaactggatagtcaaacaagaaaaataagaaaactctactgtagcactatgaattctcaagaatgctactattttacttaaaatttgcaagcgtgattggacaatgtaacaaaaccagtagtagattggtaatggcttcgtattcttgctccttcaaataattttaaagggtgaatcagcagatagtacttacgtcccatgaccatcactatcagaaggtgaagcatgatcttgagaggcattgaacactcccctggttattgcagaggctgcaaaatgcctagctcccacaagttttctgttgcaggatccagatggaaaatcatttgtaacctcgcaaatgccagagtaatgagcaggaacaggataactgtcagttatcaagtcgtctgcgaagctgggatgagttggatcgattcctgtgtcgatgaggccaacaacaacaccctgaccagcacattgtgggccaccctcttgaacccatgctccttgtggcaaaccaaggaattcaggggtatgagttgttgccgtcctaactgagaagtccaacattacatttgccacttctttcgtcatagatagcctctctgccttttaaattttaatgcaaggaaaaccagttaaaaccttattgtcaatccaaatagcttcgatattttttagtgctataaaaatcagttgagatttagagaagtgaccaaatctaaacaatcatgcaataaacctgacaggttcttgagaacgatgataaaacaaccaagggtatacaaggtacaacattttaacatgctaaaacatagcaaattttagagagagatagcagtagaagcaaaatcataagtgttcagtgtatgtaacctagcagatatcaacacgccataattcatattgccatggacttttctttcgagaacattgatgcagcatctaatagtctgaagatttcagaacttctttttgaaatgcaacttaaaaaaacttgtaatgtgacgttacagaacaaaggtgcaaaagtggtggaatcaaagaaaaaaatgatacctgctgaggagtgatgacaacagcaaaaccattaatcagatagcggtagctgtagagctttatatagcgctctcctctcagtgttctcttcaagagtgaattttgaagacgaactaagtacgagccataattcataggttgggctggaccatgcctgcattacaacactggtgagcaaaaaaacgaaaacttaatttgtgacaagcaagggaaaatacttgctaaaaacttgtcagataaacagtaaagtacagaatcatcaatagcacgctagcagcacagccgcacacacattgttcatgttggtattaaattccatatcttttgtgtgttaaaaaaaccaaacatttctactgcaatagtgggttagccttcccaatattagcagcaactacaccaatgaaccgagctgtcggcagataatgacgtagcatctctaacatttcactatagaccaatcaaaatcacccaaaaactcctcccccaaaaggagagattctcacccaaactgaatcgtacatacatatttcgcataaactgtaaagatagagcaaaaccaaatcatagaggagtaataaaccatcaaaaaccttggcttcatgaggatgctagtggacggggtgtcccccccgccgccgccgccgccgccggcgactctgctgctcccaaacctctccaggtcgaggcgcttgtggaacaccggcgcctgcttcatggtcacaatgtacaccgccgtgccctcctcgaacgcgccagcggcgcccaccagcgccgccccaagaaccgccacggacagccatgcaaccgcccactgctccctccgccacgcccaacccatcgcctcaaagagagctcttcaccggtcagctcccaaagcgccgcaagaatcgccaagaaacactagctgcggcaagaatccattgggggagcaaaaagggcctcgctcgacgagacgatctcttccgagcgaggtggagctgatgaagctagtagcactactactacggcctatggggcttgctccaggctcattaatggcgatgtggaagtggccgccgcccccgccgtgccgtgtgcgctttaagccgcggcgagagtgagagagagcgagtgggttgcactgaggctgagctgcggcacaaagacgagcagcgagcacacccaataaagagcgaggcagaaagccagaaaagcgcactcctccggtcctccccttttatgcctactttgatttgattttaaaacttcggttcgtgtcaaaaataaacatgtaatacgaaattacgatccatcgtcatagtatcttatattatatttgtttattagcagagatgtaagcaactgctaaattctaatttgtttttttatcatgtagtactacttatgttttgtattataagtcgttttgattttttaaaattaattttttaagtttgatcaagtttataaaaaattatagtaatattttaacacaaaacaaagaaactattaaagtatatgtaatgttagatgtaatagaattaatttaatgttataaatgttgttatatttttttcataaaatcaaactgctaaagaggtttgttttagaaaaagaacaacttataatataaatgaaggaagtaataattattagttattctaaaagtctaaataataatctatactgtttgaaaatgctaaaaactttaagtgaaacttatggagtccaaacatgaattgacacagctgctgcgtctctcctctcagcgaaagagcaaaacacacagctcagcgttgcagagagagtgaggcagacgaggcgaggcctcggttttccattacctcgtgaactgtgtggtactccggccttctcttggaagaagccattttacagtccatttttactgccagagtacgatgaagaaaggtggtggaaaagattgatcgaacggagattgatcgaatcgctgcttgcggcacatgacaccagagttcacagtgcagtgctatgctaatatcccgatgtttcagacaacagaaattgccggtgttctgcttctgtgtacctcgcgttgcaagatcagtagtggagtactactgtcaacaacaactgctgctactgctcctttttgactaagggctgtgtttagtgcacgctaaaattaaaaatttggttgaaattggaaggatgtgatgaaaaaattgaaagtttgtgtgtagaaaagtttcgatgtgatgaaaaaattgaaagttcgaagaaaaactttaaaacaaaacacggcctaataatatttactcgtatcattttgaacaaggttattatcaaactctaaatgtcttactatataaataacttttaaaatatgtcttataaatatggtgaccatataagattttaaaaagtgcttgataaaatcatatacttattgatatttctgtatgtattgtaataaaaaatagtgatcaaaattggctttgaagatcatgtttctatccaaaatgttaagtaatattatcaggttggagggagtagtactaattcagtatatgatcatgaagtccgtgaccattgttttactcatgcacctggtcagaacgggcgtgctgtaacggaattgtatgtgcaagcgttgcatttgcactgttgcagctagagtgaacaggctgtagaacagtgctagcgctatggatttttctcttccgtttttattgatctgtactgctgtactgctatgtcacaaaaggaaaaaaaatccataccccatgatttcaatggattattaaatgggttggcccagagcgacgcatcatccgtgcacgtcatccaacggtcaattctctgggctcattagaattttctaacagttttttaatcgctctggagtactgatcttaacgtgatgctgcattgtctacccgaaaaaactgttttccagattctaactgcaggtttttcagaatcttgtctttccactatatgaaacactgttcttaccattcaagctcttattaacatgttctattagtctagtgctactcaattatcagcagctgaggtggaaagctaactgaccttaatatgctcttattaacatgtactcctacctactaatctaatattgtctctgttataaaaactggcacagaccttaataagctgaatagaaaaaatatcatagaaaagtccaaactgatgacgatctcaagacacaatatttgttactaataaggtttaagctgaaaactgaattactggaaaacttattacgaacaccacttcttgatttaacatattacaatgtatttagatatcatgacccttgattgaccatattggcgactctaattctatttgaacatctaatataactttaaattttaaactgtaatcgtttttatatacatgtttaacacaaaactcttaagagtttcaactgaaacatgcaaagcctgaatttccagttggaattctccaaccgcaaaggatcttggccacgttcagcgccggtcccagtttatcttttataacccagcactttgagctttgaagcacaataccaggcatgtccaattgataatgctgctcggtgtgcactttgactgcactttgtcgatgaccgattataaaaaccgtggtgtgcttcagtagtcgccggcagctcatgatttcgttgatcatctattccaaaggtgcacatctccaataatcatcaccaaaagtttcatggatccaaagcacaaaaccgagagaccctaaattcaaggccgtcccacccctgttgctaatccacctctgaaaatggggataagacatagcaaaggcatttgcagaaaaaaaaaacgaagtttgagcctccccaaaccaaaatgactttgatcatgtactaccacgagacaatccaagaacctttgtccatctctctctctctctctctttttgtcctaaagaaagagatctgagggagagtgtgaggcatgttaacatgcaaccaaagatactaaccgatggcgacagaacacaggccacaagaaattggagtacgtgatcacgtgatgagtagtagtagatcaatgagcaaactacgcatgcactcctggtcacctggggccagcattgctctcggctccctgcaaccagtcaaccagatttttttttaaaaaaaaaaaactgggaaaagcgactcaccaacactgttagagtaggtgacaatggcattgcagcagctgctagctagcttgctgcatctttactgtggtcctaattaacaacttgaaaagtgcaaacacttcatttcatggcctccattgggaggtagatgatggtagcactgaactatggtagccggtaggcgccaaggtcaccttttttttttttttttactgctgtctcctctgctttctgcttgcccggccggccaccaccactcggctgcagagaagcgtagtgcagcgctacgagctggtccattctcgtatcctgaccggctcgatcgatcgatcgatcgaaatgtgaggtgtttctgacgaagagggcagctagctactagctaagctgtgtgcagaagcagacgaggagaaaagggatggaaaagggttaaaggggctggaattattgcgcatagtgagtcggcgggctaaagcttggccaagcatgtccggcaattgttcatggcatgaattattcgagagcacgtacaccggcggagaaacaatgtttacagatcataaacaccactttaattagttaattatatacttggtagttttcaagccaaagtttatcatacaaaatggaaagaccatcgtagctgcaccaacacgagcatgtaaacataataaagctggcttgcacgctcgacatgatcgccccatcggccaagattccttcatatccgcgggctaccgactttgcaaatttctgtactactccctccatcctaaatgtttgacaccgttgactttttaaaatatgtttgaccgttcatcttattcaaaaaatttaagcaattattaattcttttcctaccatttgattcattgttaaatatacttttatatatacatatagttttatatatttcacaaaagtttttaaataaaacgaacggtcaaacatgtttaaaaaagtcaacagcgtcaacatttaggaaaggaggtagtatgtagtataatctgttcctacttcatcatagcacgcactcactcggatgtagattatacactactgcatgcgtactagcagtacgatttttctaagccgaagctgcacttcgctgcagggcgagcattatccggtcagtccggttcacgccgcggccgcatgcatccaaccgcttataatttgcaggttcgccgccttgttttctcctcggttccgggcggtgcggtggggcctcggcgcggctaaagattccgaaattagggggtgctgctggtgattcgatcacgggggagaatgtctctcaattccactttagtggtggtatctgctgctaatctaaggctggtttggtttgtgttctaaattggccttatcaatttttatcaatgtcaaattttgataacttttgacatgactaattttggcaaaggtaaaattgtgtttggattgaagccaaaatagcctaaattaactgttgaaatgacctattttcttagtcatgctaaaatttggctctaaaccaaatagataataaacattattaaaattatcaaatattgataagtccaatacaggcctcaaaccaaaccaaacgcctaatctgcgtcggctgtaatgtagcggccgtcgaacagtgcgggcatgtgtggcgacaggtgtgcgtgcccgcgtgggagacgttgcgagaggtaaccgttggataacactgacacggaccggctaaaaggcttaaaaagcagctaatacacagtacagtactagtctatacccaccaaaacggtccggattaggggctgattggtttggtgccacacattgccacaccacatgttagacatgccacagattgttagcttagcgtttagttgcttgtttcagttgtggcaagccacactttcttgtttcatgggcctacatgtcttatacttattttctagctaaacattgccacacttgtggccaacaaattattggccacactttatttgccatgctacatctatgacaaattaagttatggcaatattaggcaacaaccaaacaaaccctaggacaccaccaacggcatgtctccgtcgcagtactacagcggtacaaccggttggccatcggcgagagtacgtaccagtctgcgtgcctgtacgtgacgtgacacggtattcgtgcgtgcgtgagccaaaatcctcgttgcgccgccgcgccgctcggctgtgctgcgcgggcagccgacgggagcgggaagtgggtgggcgcgcgcgcgcacgcacgctggcaaatcttggcctttttttacgtcctcggctcacgcgcatccccacgcgacgccgggctgcagctttccaggagacgcggccggcggggtttccgccggctatgggggttaggtatgcggtacacgctcgcggactcgcctgtcactcgattatcacgggccggtttggctgaattatccgtggacggtggacaaatggatctcgcaccctgcagcgcagtggtccgtccgtccgtcctctttgctgcgctggcgaagtggcaagtcagtgaagtcgcaagtgagaagggaaagtaggtcaatagtaggtggtggcttcagatgttctctgggcctctcacctctggctggaaaagagcaacgttttaatgccaatgtcacgagctttttactgatgtgatatatcggttttagatggagatcctcgctgtcattggaccggttgggtgggctggcgtaccatacggccataccaggcaggagtgaaacgaagacgacaagatgtgaatcgttcacggcttcaagcgtggatcatagggaacctgtacacgaagatgctgaagcagtgtgaagatttttactagtaacactgtatatatatgaggggatatgaaaggaaaggaagcagcaacaacttttggcgtcgttcaccgtacggtcgtgtagtggccggccacgttgtaaatcgcactctcgtacgattgactaactagccgcctcttgtcagctgtgactttatttagcccagttgagatacacaatctctctctctctctctctcacacacacttgcaatgtcaatgcattcattggcaagatggcaagatgggattcatcgttcatgagaacttcatgtcctgcacaggtcatttcattaaccactttgtactactcgagttttagccttttatgcacactggtgactggtccagctatagggtacaatagcatactattagccagctatataaacatattttaataagataagagatgagagaaaggagtagcgggctataaatttatagctagctacagcacggactacaagtcacagtgtgtgtataacagatgagaccatatattaatagtatagtaagcaactattgtataaattagctattatattggctataaatgaattggagctagtagtgggctacccacaaacgcatgaccctggcagtccgcacattgctaaccaacaattacagtgttacacttttattccccacttctgtagcggggatggattctaatagctcgagtggacgtccacccgtttatttcatgtcaactaaatggctatgaaaaattttcaaaaaaattggcaagatagatcaatatgtaatatatcacttcacaaacatgcaagttaaaattcaacttctacaagttacaacaaaaataacaaatttaactgtaaatatacatatagtaatttaagttttgtttgttatttttgatacaatctgtagaagttgaattttaacttacatgtttgtagattgatacattacatattgatctattcttattcatattttttcaatttttttcataaccatttagatgacatataataaacaggtggacatccactcgagctgttaaaatagtttccccttatgtagctgtttgctggaatgaagtgtagtgccgttactgcagtaagccagtaattgcactatgtggaaatgtgggatgaatggataatacatataccaacttaccaagaacaggattttcccggttataatatttcaggattgtaatcttgttttttttccacagctatattaatatgaaacttctcaatggtataagtcgtttaaaaaaatgtagggtcatatttggcaaatgggatagggaaatgatttcccacccaccataagacatctttaaatcctaaccattcattctcccccttccatttaatcctaaccattcattcatttcacaatctcaatcccacccctcaacggaagaatatatttttcttcttattcgcacgcttgtcgcatgccgtgcagtgagtagtgactatcacggttcctgtgctcgcatgcttcagaacccaggtgctttgtagcctatagccggcaatgcgaaatgcaaagatgatttcatgttctctaccaccttgggttcttacttcttggcgagcttatcatgagatgcgtactgtctgcttgtcatgaatcaaaatcatcctagctatggatatgggaataaagtacttgcatcttttgtttcctccagcctttttcctttgtttttctgctctcttttacttttgccaaatgatgaataaagcatcgcgtaatcaacgataaggggatatatagcttcattctgacacctattcttacaattgcttccgtgtatggcatcaaaagaaatgatacaacaatgaaaattgccctctcaagttctctattcaagagggtaactacagcaaaaatcgaaagtgtatatcagtgtatgcatatccaaaaagaaaaaggcagggatcgactttctgaagaatagaatgattatgttgccctcctttttgttctgctgctacaaatataggcacagaaagaatccgatggtctttgtacgaaggttacttgcctaagatgaagcaggtagcttaggtttgttattcctgaccaaattttggacaaagagctctcctgcacgatatgaagaccgaacctgaaaaaaaaaatcacaaaatagagaataagctcatgtaagacactgacttggttatccaacattcctacatattagtcgattacagaatcgtacaacaaataataatagcactggtagctgtgttcttcactaaatttccagaactttactcatgcatcatactgatatttgtcagagcaaattatacagtactacaatttcctatttgtatttacaattttaagggtgacaactgaagagtcccactaattagatgtagcacttaccaggggtccactagcaacatagcggaaacccaccgattctccatactccttccaaaattggaacttctcaggagttacatactcccttactgtcaaatgtctttcagtgggctgtaagatcaagcagatggtttgcatcaaagactgaccagttattcttgactaatgataaagtggtactgggctaacctgcaaatactggcccagtgtcaagatatcaacaccaatggcccttaagtcaatcatggcttgtttcacctcctcgtcagtctctccaagaccaagcatgatagaggacttagttatcataccctctttgcaactttttgcatgcttcagaacagctaagctctgatcatatctgtaagaatgaggtaagaaaaattcttacaatgccagaggatatgaggaaaagaactgtgcatagtacaagttattaactgcacattgccacgagatactagaaatatagtgtatgcgcaaaatcgaggataaactggataaactatatcctaccactatacttccttcgaacagattctaagggaaaggtagttgatcaggcaaaataaatcatctcccaagattatgatgcgagaaacgttcagaaataaataagagtaccacaactcaccaatcaaacagattgcaaagctttgatatttgcaaaactattgttatgtctcatacaataaatacagcaaggaatatgcaggtcatcagatagaaaatatctatggctgtttttattttgcaatgttacagtctacaatatagtttacacttcagagacaacaatttgcaacctatatataagcactattacactgtaaagtatgcatagctcaataataattagattcatttttactcggggcgaatttaagattaatcacttaaactaagacacaccaatagcctgagaatgatcatatagtcaagctgtaaaattgatgccagggacagaatactcgaacgcagtgttaatttgtctttttaggtcagtttaagacatgactgggcacatcagtcttgtaaaaaacaataacctgaatagaatggtactccattgaatagagtaaaccacatggaattagttttaacttttaacagaaaagcgcatgcaacatgtgcatgtggatattattcaaagtttggattatgtagatttcatgtacctgtagtgtaaatgaaaatctggaactaggtacagtttagatgttcctttccagtaggaagtaatttcattagggtgatgccttgggtgaattggttattgattctctaaattataaatgtacaaatagtcctaagcaggatataatagtgtgccagtaaaatcagtgaatcacattaccctgctcgaggatccctaacaattctttgcaggctcctcacagtctcgatgttgtgcgcaaatacatccagaccagagttggccaaagctgaaacagcctccaggtcacctcgaaaatctgaggtcaagcactccaccagtatcccaggtttgagctcctgaataggaaattcagaaaacttcagcatgaaacttctacaaataaatgcccaacttctgtcaacacaaggcataaggtagtaaacctttaaagctctcactgtctgcgcaaaatggctgctaccaccatcaggcaagtcatctctgtcaacactggtcagtacaacatagtccactctgaaaagagcaacatttgtcagacaatctgtactaattttgccacacaaacaagtgcatgtgcattgattttctttacttccagacttaacaaaatgcactgttatctctgttccttcctacaactatcattccatcgatcagtaactcagacaattcggaaggcataaatggctaatctggagatggagcgaacaggcaaagttaccatacccccagcttgcaactgccaaggccgtgttcagaggctccaggggatccggtggtggaggcttgttgctagtcttcacggcacagaaacggcagccgcgcgtacaggtatcaccgagcaccatgatggtcgccgtggcgatgccgtcgccttccccgcccgcccctcccccaccgttccagcactgcgccccaggagcaaaggatttagctgttctcgcagaaattgctcgcgaggatcaccttgctctagtcccatacgatacgactgaatcgcgtacctcgccgatgttggggcactgggcctcgacgcagacggtgttgagcttgagctcgccgatcgactcccgcagccgcgcgtacttctccccctgcgccgcacgctgccgcagccacgccggcttcttcacctccgggtccctcccggtgtacggccccgccgccctacgcgccgccggcgccggagccggcggcgcagcctccgcgcggcaccgggccacggagaccgagccgggccggctccggcagacagggttcccgcaggccggccggatcgggggccgcggcaacggccgcgcgagcgagctctgcatcatggccgacgaattcggcgccgccgctcgcacccgcgcggagtcgtgtagccgtggcgcccgccgccgtcgtcgtgcggggcgatgggttcgaagcgagacttaaagattttgcttctgccgattttacccctctgctctggccgcaaatccactggatggttggatgggttaggggtaaaataggaattatagaattagccggcgatgataccaaggttgctgctcaaccagtttgacacccgctgccagttgtttgctaccagagttttgatttgttgtcatattgatattgaaacgtcaaaataggcaggaatttcacataaattagtttagttcttgtaaaattcctccatttcaaggcctaacaattgctgaagatttcatactgaaaattcctcctttccaaaagaggccctcacagatgttggaatttcatactgagatagtgtacatcaaaccgttacttgaggctagctgtaaccaatagcagcaagcacaagaccagcatattgacaccatcaaaaagacaaaagcattcaaatgctccagtttatatggctgtaataactactacacaaatttacaaataaaggcatgcagcctcaatcctggcaggaagtatatagtgcaaccggagttccctttaaacaaaatgtaggcagagtaatgaacaaaccaaacatttatgttcgcacaaggctaaaagccgaaatcttgtgccaatctgaacaagtgaagaaatgaaatgacaacaaactgtaacgatttacaattaagagatatacccccagtttccagtaccccaccatatagtgtcagtaggcacctggaaatacaggcatctccatgacattttaagtatccttccaagaaacctaataaacagaacttcattattccaacacactttggtcctgactaaaatagattaagaccagactagtgtttacttgacgctaggcaccttccacaccagtaaaacgacagacaggaaggccctagtacctgtacaaccactgctgctaagcccactaatcttggacgtcttcttcgctggggaatatgaatgttaaaaactaaattttgcccccaacgagttggctagttcatcacagcatagtgttacaacagtgtacgtacatatgcatatcaggtgggtgctatataaatgacccacagaaaggggagatcgttggtctacgagattaatctgaaacctaaagtcacaatctgaagaaggctagtttttccctgagcaaatggaactttcttccaagctcacatcttatgaagggcatgcatgtctccagatatatatgaattgccatctgcaagacaagtgcatcgagtccttttaagcatttgcgatcgaccctttggcatcttcagctatatcaaccaggaacagactcagaggtgatgtacccaccatttgccccagtgggattaataccggtcactggcattgttcgctgagcaaaatcaagcagcagctggcgttgctgatcgtttgtatgaggaaggcttgcacgtagcaactcaactggcatctccctgctggttgctttcgagacttcagatccagttacagagcatggtgactgcatgacaaacatctgcttaatactttcatacttactgaggcagtattttgtcaggagtccaaagaaagcatcaaatgatgcctgccagagagttcggtttgacactgtatagctggctgcagcatggtggtcagtcagcaactcggttgctcggtccagtactgatttaataataagagaagccccatcaccagcagagctagcaagaggacgcagaggtggctgctcagatgaacatacgacagcagcaaggcaagcactaagagcacctagttccatatggagcacacaagatgaaacagtctttgcaagagcaactgttgtttctgctgcactagaatctgatggtaaacccccaaacaagtacctcagatgtcgaaaaatagccatgcatattatacgggtcaactcgcttccaggggtaagaagtcgaaggtaccgtgacaaaagtttgcgtcctttaggaagagaaacaatccgaagaaaaacaagatcatccttaggggccaatccagatgaatggcttgatttgctcggaccaagagggtcaacaagctgaagtgatgtagctagaccttcaaggaggacctgccgtcttcgcctcagttggaaactgttatcttgtgcctggctagactgcaatagacggtcaatatcatccacctcaagaagtaggcagatggcatcttcaacagtgactctagctgccagcattggttctttctccaggggcctcagagaagacttctgatcatgagaaccatcaccagatgaaggaaggtcaacttcaagaagagaccgaggcctacgtatggaagagaaagaaaccctccctagagcatcaacctgaagatatgcatgatggtcactgctagatctggacttggaaggtaagtctttcattgatgttggggcaaaattggccttttgcctggaactggcacccttttttgctatgcaagcttgatggtaataatcaactacataaggatcactgctgtgacttgctgaatgctgcattcttaagatagattcgatctcttcagatgacatgtacttagacctgaattttagtccaccactatcaccattttgactaccagtatcagtcaatggttgagaaaaacgtgtgctgtgttttccccttcctgaccttgacctcttgtctctcaatgaaggaacattgctgatagaatcaaaccttcctgttaactctggggagtgatgttggtaaaataggtgaggtggtaaatttaggtaattctgatgggatggctggacttgaacttgtgccaatctctgctgctgttgagaaaatagcagtgatgacattgggctatttggaagtgatatttgtttctgtaacatgttcggaagtagattaaattgatccacagcatacgggttggcttggtttggccaatcattttgtattggattgcttccaggaagatttggagaaccaaaggacacgctccctccatatggtagtccatgagatagtccagccatatgatatgaagaacttggaagtgacatgcttggagaacccatttgtagaccagcaccaactgatggaatgctcccatgacgtgtaaggccttgagcagtataaggtgatctagcacctggaggtggaaaggatgtaaatggaggagattgtggtgcaatgataggttcacttgcgcggtgctgcaatggttgttgaggatatgaagatgttcggctcaatggtttggcatccccttgctgccccagagaacgtgactgtgaccaccatcttttactttcctgaagttcctcaccctctaatatgtcttgatctacccagttgggaaactcagcatcttcagcccaatcaacagttagagaacctgaaaaggtcatttgcatagttcagtaacaagttcagccttccagtgttcatttgactttgactacaccatagagtttcaatagcatggttgcttttcaacaaataaaggtgtaatagacacaagataacctttcttccagccgacattgacggcattaaaattttgaaaacatgtgtagtaatgcagaatggaagcatttcataaatgagattacatagagctttcaacaatgttgcatacaaaagctacactatagaacactcttaatgaaaacaattataattcataatgttttcttttcttttctacaacagactgttgacatgataaacaaatccacaactgtgtacagcaagtcaaaattataccaagaatgagttagaaatgaaatgcaaaatggttgacttcaacatattttaaaaatgaacaatcatgcacaaaagacatgcatattgtcaatattgtagtcaacatctttaaaaacaaaacatcattagtcattttccatcagaacataatgctgacttacttcctcttgagatggatcttctgtcaccaataacaccaggattccgtgttccactaatgcttcggttcaactgatgataaaaaaaatgtaaataaatcaatgtgcaacagcagaacaagcgcataaaagaaacaagaacagaagccaaggttaaaacaaaatatcatgcaattacggatccatatgcaagcaatatgtcaggtgtagataaaagttgaggcctcattactcattagtgattatcccaatcctcttgggactaagggatgggatatataacgtatccttagaaaaagagcagcagcctagttgatcactccgaaacaatttcagacattacagacttggtagttggtacctactcctagatcttctatgtgcaaatgggccttagatggggcaaaatacttacagatgcaaaacaggctaacgcaagaagaagctacattcagcctaaagaccactaatatgtatcatttatccagtacatgcttggggtagcaggcagcccaattgtagtggaaataatcagatagccagaactacaaatgaataaaatgggcacttaatgtttagattatttcagcttttggggggaggggtataagttatatgccccacaaagattgcacctttaggatttgcacctgcatgtatcgttgacatgtggcctgggggtgcaattttctggagaaatataattatttatcaatacaagaatgaagtatggaagagtcagagtaaccacttggccaacactggtaaggcataacagggccttaacatatctaatacttaaacggctactgcaaagtgaatccatccaagcgaagtcactttttttttaaataatgaaacatcaatttataacactggagtttgtgaaacaaacctttgcaaaagtgctcgcaagatcatcaatttctgacaagttactcagattatcaatctgcagaacatagtaaattgaatcagaataactccacaacactaaagacgatagtaaatccataatttatgatgagaagaagaaagggaaagcgctacaaaagtaaaattcatgtatggggtgcaaggctgttcaaacatgcagacatccctaactccttgtagagtcttaccttccacatgatacagttccaaatattgatggcaattgtaatgtaatattggccaattgtaatgaaatattagacgattttttgcccatcacaataaactccaagtggctatttagaaatgcacattaactaattaaattcaacccccctaaagttgtttcatccaaccagcataagtataaagttgttatacattacaattgctgaaaactagttgtgttaaccagcacaagcttaggattacatgatattgataataaaaaccaccatttgatccatagaagatccaaattacctcataacatttcaagcatgctcaatagtaagccctgtcaatacgatctatcaataatgcagtgaagattggagaatgcaaaagcaacttgaacattcaagaaatggcatacagccaacagtagaaacagtgaactctagcattctgtatcaaaataggttatatgttttttgtcccattctgctattgatctcaaaatgcagagatagttctcttctagctccagagcaagtgagcgttgggccaagtaacactaggaaaagtgtgccagaaaactaaccaaatcaaaaaatcataccgtggccacaagctatacagctatagcctgaaaggctaccaaaaagaactatgactggactgaaacaagccaataatagggttgtgacaaaacagccaaaaaggctaccttgaacatttatccgaaacaaaacatcatttgttctagtaattctcaacttaatacatttagcagcaagattcgtcttctatccccgtctcatggaattccacccttgcaatggaaccttttagctatcaaacaactgataaaaacaatgaccattcaacatgcatcaaggtaaaggatctgcctatgtttgagcataaaacttcccgccctccaacgctaatgatgtgaacctcaactccactgataagaccatataggcccacaaggatttattcttaattcctcctagaactaaacgtgctatcggaaaaggagataaaaggacggcatccgaaccaagaacacaaatcaatatcaagaggacgatagttcacaagaagcatggcagctgtggacatgatcaaatgaaggttccgggatccgcacctcttctccaacagaagagagccggtacagcccatcttctggcccgctgaatccaccgccattgccatcaccgccgccatcctccaagcaactgagctcgagtccctccagtggctccttcccgaagaaggcgtactgcccagcatcaaaattacctgcatcgagaagcgtcagatggcacggattaatattaatcggcgtaaaaaaaccataacttctaaccaaattacaagcgagaaccgacaacaacggcaagaaccacacgaaacgccaatcaggccaacaaaagaacatcatttttttttctagttgagaactcaaagagcccgaattcgaacaattctccatcgatactcccaaagattcgcatcagagacgcaacagattaacagtaaggcgccgacttctgcaccaaatcagaccaaaacaacagcaactactggaaacaaccagctcagcggcaaaagccggagcggagaccagatcaaacagcgcgtgaaacccaccggaaggtgggttaccgaattgccaaattcagccgcgagaagcctcacctgcggcggcgggggaggaagaagacgcgccgccgcctccgccacccgactcgacaccccgcatctccgcaagaaccctagcagcagcggcggcggcggcagctgtagcagcaagcggcgtcgcgcatctaggcgagggattcgcgcgatttctccacggctttggatctgagagagctgtgtgcgaggaggaaaaggagaggaaggatagctcggcctcactgcggcttactacttcttccctcttttctctctcctgccttaaataaaaatgatttgggatatgcaaccagaggagaatttatgaatcccaaaaaataagaataagattaaagaaaaaacactggtcttttttttctctttctttaagcagaagacttgcagtagaaaatactagggtttcccttggaaggcacacaaatattaatccagcaagggcaaggtaagaggaggaagatgagaggaaatagaggggattagaagtggtagatgagagatgctaaagagttaggtggtgtttgaatctagtgacttaattgtccctttatttagacactaatttagagtattaaatatagactacttataaaactaattacgtaaataaaagctaattcgcgagacaaattttttaagtctaattaatccacaattagagaatgtttactgtagcatcacatatgctaattatggattaattaggttcaatagattcgtctcacgaattagtccaagattatgaatgggttttattaatagtttatgtttaatatttataattaatgtctaaacatccgatgtgatagtgacttaaaagttttagtctcatctaaacagggtcttaaggacgagaggagaagactttagcttggtttgtttgttactctaccaatatttatttcctttgtgtttgcctttttatctcctttctctctttctatgttgcttttttaggcctgatgatttaaaatttgttctggtgttacaattaatccttaccttgtttctctctcttctatgattatctgtcacaatgatgatggtttagggtggatttggcactcagttagcaattggttgtgatcaataggggaattattaactgccagtggtggtaggtttcaggtactctaggaaatttgagaggaggaccatatgtatgtaatctgttgtaactaagtttcaaatatttacatagataaaacatgaagcatcaagcatataaacctctaatacatttaaattttaatacatgtagatagcatgtgtaaaattcaacgatctttagtatagtctgttttagaaataatgtatcgtatcgtttcaatagaattaataaatcttaggaaactatagctattgttaaagctatatgtctgctaaaattttagcatatcattttattaaaaactaaaaaaatatttatgtgacaggtctaggctggcctgtcaggtagcatacatcacttgcataagtttaggattatgtgtcggagaagaacaatacatgctccgttcctggcaaaattaactttcagagatgaatttggatatatgcttccctagaaattaatttattttaaaactgagagatcagttaaaattatatgtatattaataaaattgtctaatattgttgcagattttttttgactagtcacgggggtggagagctttctcacctgaattttataaataaaagaggtgaagatacaatatcagtttgataccaactgcacagtttgcatgtaaattgcgagacgaatctgttgagcctaaattgcgccatgatttgacaatgtgatgctacaataaatatttgctaatgatagattaattaaacttaataatttcgtctcgtagtttacatacgaaatctataatttgttttgttattagtctatgtttaatacttcaaatgtacgtccgtatacttaaaaaaaattggccaagcccaaaggatatttttgcagatttataaaatgtgtagttaaaattgtagccaatgcatgatttcatgcaatgtattcgtccgcgtatatagtgtcaaaatgcagctacaacaactgagcagaacatcgttttccacagaggacgcaattggcgcgcttcgttcactgtttcatcggtacactttcgcaacttgcaaccgatctgggctccacggtcccgtgtgggtttgacgttgtgtagtcgtgagcatctcgcaccaaacatcatacgctaccagcaaaccagtcgagcaagcagccaagcacagtgaccatttcacttgttcactgcttttttccccccttttcgtttccacttaaaataaacatgccactggccttccaattgtttagccttctcttcttcgtcttctttttgttaacctcaaaagcttccagctaaaacgacaactagaagaagctgtcgccaagtgaagagccggtaccaaacatgatccttcaaaaggagcacgcattttctttttttaataaaggatcaaagctaagatgtgcggatagaagtattcgatcctggtgctttcgttttggacggcactttgcaagagcacttttgttttttgttacgtttctttttcagcttccatgggagatgatagagttattggtgagcggaatattctttttcattgagatggttgggaggaatatgttccaaggagcttggttaatcatcagaggctctggattttagtagaatactcctacatgaaacctcgggctggccaggaatctgtgggatcaataagcgagtgtgatgtgagcttgagctactaacgagtcaacagttgccttctagcagtacactattaatgttgcctttctctagctacacaagtaggattacaaagtgatggtaaaagtgcatggtactgttactgtatctcgaagttacatcaatcatcagagaagatgatgcttagagtgtgtttagtttacgttaaaattgaaaatttaattgaaattggaacagtatgatggaaaagttaaaaatttatgtgtgtagaaaagtttggatgtgatggaaaagttgaaagtttgaaaaaacagtttggaactaaactcggccttacatttaatacgccaagaggattactactttcgctagtttgtcttaagatttatagcaacatgtaatgtactattagaagctagctagtaaggatcgtgctacacgtgacaattccctttgaagtgctaatctgaaatcccttcttcataaatttaattaatatttgacttcaagagaaaaaaaagtttagttaaacccccgaaaaatctcccccagaataataatggcgcgataccttttctacaagtatcgcaacgatttacgcagaattctgtaaatcttttgctacccgatacatacaccaaccaattattcagtgccagcttcagacaaaatatcagcggatgtaaccatattcttatcgggcttgacaccgaccggatcggaagatcaattctaaacccggatacgtcaacgtagaaacacacaagcaggacaccatttttgtgtgcgactctccaaagatttttttttaatcgccgctttcgcttttggacgggtcactactcacgcaccaacgacgacaccgctccacgtacagtcaaaagccggtggacacgtagcgctgcgctagcgacgccgctagctccttcccgcgtccgcgtgcagtgcaggacgatctgcttctgctgcagggtgatctgatctccccgcgtgcttatccgcgggcgtggccggcaaaaaaaacgccgagacgaacgcggctgacgagcgcacgcgcgggtggtggttgcggttccttctcgttttggatcaaaactccatcccccccgtctcgtcggtcctgtctctccgctgtctcggcggcgagagtagtacgatatccggcggttcagccgtgtcgttttcgacaaggctcggctctcatggttgcgtttccttctcattttggacaacacggtgccgcacgagctcgatggcaggcagccaggcaggcagttagtagacgataccccgtctctctctcgccggtggctctgctctgtagcaccgagccaccgacgatgatccggcggtcaggccatcgcgttttcggtgtctatatgtcagtttcatggtccagctgtgattaggaataactggac

SEQ ID NO: 2043 - DNA, 10812 bp, Oryza sativa
aattgaactcagagtaaaaattacctgagtcaacgcacgggtgacacaaccgagaaaattctctatgacgagaagatagtactccacaggagtaccgcctgtaccagggctacttagatggccagctaacctgacggttacgtgcgaagtggctgtgatcacacgcgaattaactggagcagagtaggacatgtgtgattgggcggctaaagccggccaaagaccggtgctaactgctcattatagtcggtataatcgttggggttagttggatctcccgcggtgcacggcacacgcggcctattatactaatccaccgtcccaccaggtgtcgcttgacacataagcaaacgcggcggaaaaggagaccggccctcttcggttaggctagcggcggcctaattaacgtactccgcgtagtagtagcagtagcgctcgtcgcgtcacgcacggcacggcgtgcggcccccccatgccatgcgctgctccgcgggacgtgctggtgtttgacgtccagccagccaggtgctggatcggatcgagcgggacgtgccgtcggcgaagcgcgcggggcggcgcgtcccctggccagcgcacgtgaggcgtgcgagctcggcgcgggggagacggacggcaagacgatctcacagggggggacgcgtgcgcgctggccccgcccgcgcgcggaggcgaggcgccgggggcgtgggcacgtagtaggctgcacgcgtgggcactggccgaaacggaactcgcgcaccgtgcccaccacgggtagtacgcggccgccacaccgttcgggcgcgagcacgtgggcgggggtgggacggtcgctgaccggtgtttctctactcctggctcggcctctgggcggtttttcaatcggcaacaacggtgagtgattcggtgggtaggtaggttggtggtgagagcggcacgacgacatgggccaccctggtctgcgcgtatgttcggttcagggtgggccggcatggacgagtcgtcgtaggatgcgtggatgaccggtgatattggtagcagtagtaacctcgcgtcatgtaacccattaggctagtctgtcgatctcttgaatgtcgcggttcgccccgaaccacgcaattatacagccttccaaggagtgacgccgccgtcggcgatcgaggtctctcgcaggacactactgaaacaagctcgttacagaaaaagaaaaaaacaaccattctacttaattgaaatataattggcagttctcctgccggtttagttaaaaaaaaacaagctcgttactcaacttgacaagttcctttgtgtattgtctacaaaaggatggcttatacttactccgtccttaaaaaacaactcagaacagaatgtaacgttttctattacaataaatctaaacatgtgtactataaaacgttacatcgatagagtattttatactactactttgtaaatctcctcgccaaaggaaaaaggaaagtaagacgctcatttggctgtaggagtgtaggtgaaccgatcaaagtatcacacagttcgagaaatgatgggagcaccttcaaattgtcttatcctaaagaaatcgatgcaaatatattgttttatgaatcattgatcgagatccgaacacaatacaaagcaacggattgttgttatagtaatatgggctgttgagactcaaatttgtaaagatgttgccgttaaaatcacttgccttcataacttgggagtttttttagcctataaattgtgagttacatgacaagttacacgcccagcgcactgggcaaacacttctcttgattctttggtaaatctacctctacagtcggaaacaaaatgagaacgtacgaaggtgatgtcacaaaaatttgaaccaccttcctgcaaaaatcatttgcacagaaaacctcgcccaacccagcgaccacaggtccacaggtgtgaagtaaacccccgagtcagtgtacacttctcaaaaaacagtacgccatgcatgcatgctcttggttcaccaagcacattgatcttggtacaaccaagtttcacttgattggggctacttgaaagaatactcacctataataccagggcatatcagacactcgtggcaatcttagttcacgtgaagaccaaataagaatactcgactataataccagggcatatcagacactcatggcaatgttagttcacgtgaagaccaaataagtccggttaactgaatgactgacaatacttgaactccttgcttcgacacactctgatgttactcagcaatttgaaatccagctgtgtaaacatgatctttccagctgcccagttctgcttgtatatcagctgaaatggttgtgcaaggaacacaattctttccagcatttcacggttctgcatttgaatcttcacacatcaaatcaagaacattggcctcttctgcagaaacattccagcaacaggacatctagtctgcagaacaatccagtcttcaaagcaggtgagcattcaaagcgaatgagcattctcctctatatgggttatcttaagtgtgtcttgttatatcaagatcataccagcaaggaacacccagaaaaccactaggaatttcttcgccagtccataaaaggccaaatcaagaggtaactccaacacagtggttaaaactgactgcctgaattcaccaatatatatgaagtcaactaaagaacgaacaagctatagattgatgctccttgcttaactgacaaaaccattcagagatctgtcttccttgcaaaacatatagatctggtaattgcccagaatgtgcaactattttatcgaatgccaatgggaggaggctaagcaatgccccaatagcagaaagctgaacaggcatgttccttgagtttgaaacttttgttctcattagcactgataagtgattcctcaggtcactaactgctctttgctcataaccaacatcgtcaacaaagaacctataaaagacaaatgagttgtcaacaaagtttagatcatgtgtattaggagcaaattgaccaatagaaagtataatagttatactaggggacaggatacatatatcaaattagaacatcacattagaaccgcacgctcctgtgctagtaaaagagattattgagaacagagcgggtagaagagacgcaatagacaggaataatactggtaatgctaactaccaaattaccagcttagctcttgtgagttctcagaatatgtttttctattaaaaatccttgtgcacacaacaacccaaacagggtataacatatgcacctggagaattctagaatgaagaattgtgcggtaaaccatagcagaagaacaatgaaaaaagagaaaggaagaaatgcttcaatataaaaatgtaatacattaataattgttccttgaaagtatattgaagaaatgagtgacaagtcgggcaaaccttccaagttggctgagaagtattaagagagcagctgaatactcctcacatgtgcatgactccaaaatcttcaggaggcggacaacaacattattgtatgtccattcgcagctctgaaaatgaacacaacagaatcagccaacactggaatagagcatgcttaaaattgaacaataaattcttgaatgggaatagcagacaatgttaataacatgactacattttaggtaagtaatgtcaaataagaaaatttcatggccagaaggaacaatattaagttcttttctgattctggattgacaatagaacagaggcaagaattatgctaactttctattccaacatttcaaatctgttaaaagttaaaactaagggcttaataactgtaaatataaaccctgaaaatgtcttgtgtacatcaaattatgcctgctgatcaatatggctaacatattttgataatttgaaaagaaatatcaaggcaagctaaaccaatataagtatcacaaaaatgcacataccatgtaattcccgaacaactccaacaatgaagttatctccgcaaaatagcataagtcccttcctgcagtatggttatgaccatcctcagaaagttttacttgcttggagatatagcaaggttcaccacagttgacctccaatccacttgatcccaaatgtggactgcatcttgcaattattttatttgtgttagaacaactgttccattgctgagaacacaaatgcagctcatccaacagagaagagataaaaccgtcaactgaaactgaatccaccacatcaaataggcaatgtgcacaagttggaaaaacggctggcctgtttgactgaacatatgatgacaaaaggcacaaagaattgttttttgcctcaagaagcaggacaaccaaccgtatagttgtcatgagaaagttgctactctttgagagaaacttgtcaccacacatggaaccaatgatatgaatagccagcagagtccacgaaagattacttttacccatcagaagaactttgtatgaaacctctaaaacaatgtccattctctccactttaacacatatcgaagccaacaaagcgcaagcagagatgaattgatctatggtggcaggttcagtagacacttgtataccagtctcatcatccaagagactgtatctgtccacgtcagaaatcacatgccccgttttattacagaccacaacttctcttttcacaagaaaatcctcaattaaagagacaggaacatccagctgattgcttttcagaaacgcccatcttgtttccatgtaagatttcactgcaaggaagataatgccttgtaattataaatgaggagcgcaactatataagaatatattcctaaaaaaactatataagaatatgattgacaaatgagtatcccagttcaacaaagattgcacaactgagaacttatcagtaaaatgagtgaagcatacaagtagatttgatgtttaaaatgagaaatggaaaggtcctccaaagtccatttggcactcttgtatattatggtaattatgtttggtataactattttctgatgctttggtgtttggctagctaactttttctaaagcaagttcaagagatttgaaggaatagaatgtatccacagatttggctttggccaggggtgtgtgaacatcgatgatgactgatgaacatgcatgccataaccatgaggtatagacattattttggttagctggctcgatttgagtttcatcactagactctctagcctatcccaacttccttgggactaaagattgttgtcatgttttgattgcataattttctacttgcaatcgtaggggaatatcaattgtacaacaaaaggaagcagctacagcatatgtttttcccaatagaacaatttaaaagtgtaaacctgaattcgtttgtcagccaatctctactattataaaaattgaagatgtttttgccggtattttggtacgtcatccgtgtatgagtcggtttttaagttcgtttgcttttagaaatacatatccgtatttgagtcagtttttaagatcgttcacttttggtaatacagaaggaatcatataagaaatctgtttaaaaataactcgcatgctaacttgagccgatcggactcctaactgcagctcatgattttctaaaaatatatatatccaagcgaactcccacagtgaatttcatcttaactaaatcatataacaataataagatttaaatagacttcacccgttgcaacgcacgggcattttttctagtaaaagaaaaaggagacaagaaatgagccacgaatatatgggaaaaagtccgtcagttgtcttaccagtcaaggcgaaaactgatgaagcgaaatttccatctaaaacaggatctgcagtgatgactctacaaatatcccacaacagtaaggagatgatgagtgctaccttctccctgcaaaacaaaaacaattagatacgatcacaagtgctaatatgaacaaaatgctggaaactgctaatagagaacaggagttaaatgaaatgggaacaaacttactctaaaagtagcaatggttcagatgatattctttcaaataatggagtatcaacaaaagcttcctcagaagtttctctggcttcagcaatcagggtctcccaatatcgaaacattcttattatgttcctttttttcatgcttacaagaccaacaaaacacataggagatcttttgtctccatgacgaagcccaataatactatttaagttcaaatcggttaacccggctgcttttgttttacatccaccaacaatattctgctgtccagaatctgatatggatgagctatgtatctgatttgagctgttttcattagatgcctccttgtgcgaatgctgtaaatccaaagtagaatttggatggctattactagtattgctaggcacatcagtaggagaagctacaacattttgggcctgatcctcatgcaaaatgcagctcaaagagcgcttagttggcacattatccaacttggtgctacaagaaatattgactactgaattagatttatcattatcattcgcacgcagttgcttaacattatcatgacaatctattctattatgtccaagcttgccagtgctctgaatcaacttctgaattgcaggcccctcgactcctaacaaattgggcctcatctccaaatctgtggcattggctccagaggaaggacaatctctctcatattcaaaagcattgggcatcatatcagacaaatggtgggatttttcatgggtaggcgctttagttgcctgtggtagaattatgggcagatctggtgaaagagttctctgcattgcccttctgtatctttcctcatctgcatcattgtccaaatcgagtaatttcaagcagtcccccttgatcatttcctcaaaagagagtagcgaaggaaatttgctaactgcataagcatttcctgcttcagcaaaaggaactttagctggaacactcaagaaaggagttttaccagcaataacatagcatttcctcctacgagtttgcacgtcatcttcattcacaacgggcatgatgctgcttccttgctgcacacgagaacgatcatcactgcataaaatgccatttgaagtggaatcatgggccttcatttccagatgcaaccgcttatgtttagatgaaagacaatcagttgactttagagacattttggtcctttttctcttcttatctcctttgggcattttatctgtaacttctgtagcaccaaacatggatgattgcagtgccttctgttgaaagggatcaccagaaactacaggcaaagctctatcactgggtttccttgtatcattaccatctttactggttaactcgggaaccattgagctttgttttcttctgatatctgttgatgcagggactaacaacctatccttaccctgtgagtccattaactttttatcagatatggatgtgggacatgaagatctgtgtggactttttgacttcgttctgagagagctaccaaaaggaggctctagttcagaactagtacctgagattggtcttgtgcagctttctctgggtaactgatatgaagtgtagtctcttggtacagatgaactgaaaggaactattccagacggcaacccaaaatatggggctgaattatgtggaagtagattttgttcaaagttatgtatctccggatgtcgcttcaactgccaagatgataacattgaaacacattaatattaagatgcatatatagtagaataacaggcctaaattaacacatctaaagcatgtgtagtatagcaattagatttacacattacttaatattgttctggacacatcaattcgtgcacaattctctactactacctccgtcccaaaatgtagctatttctagcacagtactttgtcccaaaatgaagctatttttctacctaccttctcctctcaacccaatcacaaccattctttttcacctactttctcttttcaaccaatcacacaccttcttcaatcattctcacctactttcttaatacccgtgccaacctcaaaaatgcttacattttgggatggaggaagtacttaagaggagctggtaatgatgatggtatgtttgatgctcatcatctgtggatgaatctatgtagacatgggtgcgtcatttctgggatttttttaaagaaaaagtaaatgtattgtgtaacatgtcaatatctcaaattgacattcttttttttagttgcagatctgaaaataattatattgttatttttaggctataatatatttgaaaaccaatggaccaccccagcactgtgctagatagttgcctgggtaactaaactgaagcatatggtaaggagttaggagtgagtcagtgaatcctcttgtctaacaaaagtgtctgccgaatgctttatattttctaaacttcactatgactgttaaattgccaaactagtgaatggtataaaagaaaatgacataatacttgatggactcgatgtcataatcactagcataaaatgaaaacatataatgcgttaaaatgtcaatatagaatggcaaattaaacttgtagattgtgcagtgtctaaatgactgaagtttgtagacagagggtaatgcatttactctcagcactaaaaagtcccacttcttgccactccacttcgaataaatgaagattgagaaaggaatttcttaattttacatttttctgcgcatcctaaccaaacaaactctgtgatgcagacagatttgcaagatatacacaggtggcttaagataaatgatttgcctctactaatatgctaagattattgaccaagatagtttcgagcacattctagttcctactaaagttaccttcataagtacagttgatgatagtataagtagcagatacagacctcggttaagacatgaataccttcaacaccatcagcagcaagatgttcgtcaagcatattaaatcggctcagcagctggatccaatcctgtttaaggcgctgaagctctcttcttaccagcgcattttttgctttatctagctttgacacatttttcgcatgctttaattgttgtttcttcagcttaagtttctctttgagaagccttatatttgcaccttccgtaaccacatcaatgcgttgctgtccatgtttgccaaaagaagttgtatctttaactgcacataatttttcaagcttcctctgcaaattttcacttcgttctttctcttcttccagcttctgggatagatggtctatatggtttttctgatccactgcattctttctttcaacctcaattctaactcgtaaatcttcattcaacttcttctgctcctctaactttgcaaataaacactcagcacgactcttctcttctgtcaactttttcctctcggtttcaatcagatttttgttcttttccgctaacgacttctctgagttggcacatttcttttctctggcagctttctgcttctcttcttcagcccttttatttgcttcctctgttttcttcacctgagcaaccagcctttctctggcttcacttgcttcactcctcaatttttcacacgatgccctcagaccattggctgcttttctttctgtatcagaaagccgtttatactcttcagacttgtgtgtttccatattcagtaacctttgcagttctaaaaccttgcccttttcttcttcggcatttttcttctcggaattactcttcttcttttcttctactaaaacctgtttgagtcttctaatttcttcctccaactcagtgatgcgtataagttcattaccatctttgcaaacactttgtgattgttgcaaagcagagttctgtgccttcaattcaattatctctttctctagcatatctctggcatcagactcagagatcctagctgcttctgccgaatcacctcggagacgctcctcattgcacactgttcatcaacaaggtagagataagaaaacttattaatgcatgataaacataccagaagtttcaagacgcagatgtaaaatcatgaccaaaattccatatgcttcaatagtgacaggcttgcggcagtcttcaagttcttttagtcatgcatgaaatgtcacgataatatgcataagaagtgctacagagaaaataaacatactttcaaaggatcatcctctctgcgttaggcaccttctgttaaattcctgctagcatgctactaacatgctattaaattagaattcagagcattagatacttcagagaaaagtattttttttaataaggcaaatctacaatcctgaataagcataccatattatgctgtcgccaaaatattcatactgctgaattcatcccggcttaaatatgcaaaactgtgtttcaatatttgcgctgcccatttggtcgcagaccactccaggtgattttttttgttccaattagaatcacgatttcacaatgcaggagaaaccaacaaaagcagtgtggtagaaacaggtaggggaactctctagatgggagattaggtacctctgctgagctcggagcgctccttcagcagcttgtcattctcgccctgcaggagcttcaaaccctcgcgcagcgccgcgcggctcgcctccgacttctggtacttcctccagagctgcggggaaaagaaaaggcaatccaaatgcgcacgtcagatgccgtcccgccaaaaaggagacagtagagagattacaacgaattcgaggggctcgagcaggagggaccgggttaccttggcgcagcacgggttggggccacct

SEQ ID NO: 2044 - DNA, 10873 bp, Oryza sativa
  unsure (1)..(10873): unsure at all n locations
ggagagccgggaggcggttgagggcctgaaattttttattttttagatttttttaaaaatatttacagaaataatctatcggctaaaaaaaatttaaaaaaaactctgccgccccagtggtgggccgcaagctggcgaggcagacggcgggtcgaccgcgccgtctaccaccgtcggccaaaattgcatttagccccctgccgtaattttggcaaggggctaaatgcaattttggcagcccataaagagcttggggctcgtactttttgcatttgggccccttgccgccccactagagggtggcaagggacccagatgcaaaaagtaccgccaaatgatttttctatattatgttaataataattaaagaagtatttattagtaaaacttgttaatattgttataaaaatgtattgaagttggttgtttcgcaattttatatgttaagtaaggtattattttgtaacttattcgacgtattagtactcggagaattgatataggcctatcgcagtctcggtcgtagaaacattatatggacttaaacaaggagaattatgtaacatgaagaaataatagtacaatttgaacatgatacaactatttccattgcggttacatagatgatattagattcaaactaggagggaggtagtgcaatagttgaacataacgacgatgtagtaatgggacaaggaagcatgacagtagaaatttcaatatgccaagttgtccaataaaagctaacccctacgtgaggatccctcttctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtgaagcgagcaaagttagtaaatgttgtgagaaaataaggattcatgtaatcaaaatattcttaccatgaaatcgtcgtcaagaatatttggacaaacaaataaccttcgacccaatgttgtaggctttatggaacgaagaacctgacaacgatcaccacacttgcatcttagacgggcttcccatggagggagtgccatagttagcactcgccagtcgcactgttgttcacgacattgtcgttcgtaagccgcttttctctgcaagtattgcacaatacttttggatgcgaaataccatcgaccttcttgtaaacaagtggttaggttgagaacgggattttctgtatcgacccactcgatgtatgcgcaagccgtagtgcgggtctgccgaatagagtagtgttacgaagaataaaatgattgcccatacggaatgaataagcatatgcagataataaaatacctcacggtcatagttagggcacctaaaaaagcgccttcctcgaatatcaggattccttgaagccattagttggcatcgattaccgcataggcagagaggacgctgacactaaggtggtagtaggtatacataagaatcgctacgctagttcggattctcaacgcccaggcgtctagccattgacgaaagccggtaggatttgtaatgaagcaagtggggaagagagtactgaatgtgactgagttctgaaagattgtgaggcctcgctcgttaaggcaacttatataggcaccaaaaatcgagtgatatccctgacatttgaatgtggcggggcatggtgggtacgcctgattggcgccgaaagttacattggtcgtatgcggcaaatggcgggcaaatactcgtatcgcacgcgaataaaggaggctgcatcggtgcggcagaaagtagtcatgcatgcgccgaaaggtatcgtgcatgcgccgaaaggtgtcgtgcacatataacaacaacgtattcattacacaagcatacagtantagcatgtgaagcaaataaacaaagagaagtttgctctattggccttgccccgcgccgcgttcacgcttggtcctccgggcctgtgctcacacgtggtcctgggagtaggtgaaatgatccggtggcacagcacgggtagcacgagtgtctggcggtggagtggcttgcgcctggtcntgcgtctgcaccggcggtgcgcctcccagctgtgaggggccgatgacgtcctctgtcgagcctgaagcgaagtcgaagtcagtgatgtcgaagagtaaggcggaagccaccaagtggtccgacgaggtcccaacatggtccaatggtggaccctgactcgacgtgccggctgcctgtgacgaagtcccggtgtactgctcgacttgcaagcgttcgataaaatgttaggcaccttaccttacgactaaatatgtagtacgcttgtcatctcggtacaaaaacactcacggtgaactgaagcagccacctcttcgtaggtccggtgttgcggtggtgtgccaacggctggagcgggagatgtggtgcgcgctgtactggtgcgaaacatgctgttagatcgtccttccagtccacacccgtggtcactggcccaacagcgtctcccgcgagcggtagccccaacaagtacgatacgtcctgtaggataggggctacttcaccgcacggcaagtgaaaagtgtgcgtctctggcctccatcggtcgaccaaagctgctaggagggaccggtccacattccagcgtctggccgggtccgcgtggccggcgacaacctccaccaaccgacacattggtaggaggccggcctcacgcaacctgcaagaacaaattaatatgtcattataaaaattattacagcgcaactaatttatagtaatacaccgttcgtacctctcgacaaaggagtcgtgaaccgtaagtagcttaccgcacgtccgtgcccggaatgtcccaagctgagccccctgcaccgcaataaggtgagacaggtgtcggtgatctatcgccgggtccaacaactcaggtgtatcctgacgtgccatctctgaaaaatatagtgtttcatgttagaacaattcaaaaggtagtaatgtagaacaaaagataacttgtaaaattatgaaatagtaataaaatcataagaattattatgtacaacaagagtacaggctatttaaatatagcaaacgttactaagggtacataacgatgacgtgcaatttaacatatatgtagagttcgataatataacataacataacataacattacatgccaagtccgacattacatcagcatacctaaagacattaggtgcctaagtctgacgttacatcacgagacctaaagacatgacatgccgaagtctgacattacacgacgaaacataaacacatcgatgataagttcgaaacaaattacaagcaaagccacatgccaacatagaacacaagaactacaccacgtagccagatgtggcacgacgacgcctaggacgtggtcgagttgaggtagtgccttcacccgtagggcgagctccatctgctgcttatcctgatagtcctgcctccgccgcacttggtttctccttgtctttaggacacactacgtcagaactgacattctgtaacactattttgtaacacattcggagatgtgttactggggaatgctatagcaacgaaaccttatgtgttgaaaaaaaggttgtaacacatttccaatatgttacagttggtatacatatagtaacaccaattcattgttactaccacctatagtaactctgtgttgcgctatgtaattaaaacagatttagttttggataatatattggtgccttggtttattataggtttatttaacatagtgatgtaacattatctaatcacataaaaagtactagggttggataatatattggtgccatgggtttatttaacatagtgatttaacattatctaatcgcataaaaagtacttgggttgctttctaaaacaactaacgtgcctaacagaggagttgaactcctaacctcctgtgtaaatacacaagaatcgcaccagactagccaactgggcaagcaaacatttgtgtcattagttgtaaattattgacttgtttttttttgcattaatcaaaatttaagaaatttaattttatacacacatgcgtacactttatttttaggaattgtggtttgatcaatgaaccaagcattcattgggttgaccaatgcccattttatatataaaaaaaggatggctggactcaagttataaaagtaccacaagcacagtgagaaagcatgcagaatttatagatgaggctgtgggcttggttcataactccttggatttattttttaatttagcgagtgagtctgatccatgacatgtgtataaaaatatttaatcacaaaattgctacaatgtagctgaggtatttgcacggaatctttttgtcttacatcatgaacttagaaaaaaaatggaagaataatcatttcggcaatatgaaagaataatcatttcagtaatatggtaaaaaacaagatgctagagagatcacataacccagacatgattacaggactaatcaatatagcaatagaaaaggaaaagctcacacgaacaaatttaaaataatctatacagatagactacattgggaattattattgactactgaagactggcctaaactcatgtttgcttggactagaactgccatatgttgcttagtgacagctgcttgttcactttcgcttgccgaaagaaacagtaacaccccgatgccacctggccatgtaggaaaagaaaccaagttcatcagcaaagacatgacatttcttttgttgttaaagaagacatggagatagcgagctgatcaatagaatctagaaagacagataccttgccaatgtaactgcgtctgcatcaaaataatggacctgaaactaaacaatatagagcaaagaatggacatgaacatgcatgaacatgttttaatcaatcagaaataaatataaacacaacgattattgctatcttttaatagaaagaatagccaaggtaaccacaaattattcatccactacgcttgtaatcatatttctcacaagaacataatgtaagatcatacttaaccagtggacctaatagttgtaccgtacaccaaaaaggcagaaaagttaaattaaaagaccataaatattgttggatttagatgcattcagttggatagagttttcgatagttctaaaactggaagcacctttgctaacaaaaataaatccatcaaaaggttttagatcaggtaattgcatataccttgaagtaatgaaataaatcatgaaagagtaactattttcctctgttatccttcattattcaaagcattattatcaacatctactgttgttccttcaacatctgttctaacccattgcttgtaattgtttgcattactggacattccaccaaggtgtgaaacatggaatggctcaatttctatgtcacctgcccattcatcctcaccaatgtcatatatatctctaggtttgttcttccttaccacagaccactcaggattcattggatcatcaacataataaacttgatctgcttgattggggaaaataaaaggctcatgctcaactttttctccagtatgtatgagatgtgagaagttaactagtgtgtaaccatacttatcttttttaactccttttccagaaacaacatcaacccattcacatttaaacagtactactgaaaattgtccagagtaatttagctcaataatatcgatgactctaccatagtatgttagatcacccaatattggatttgtgtcacttgatttagtataactggatgtttttgcacttaggacaactccgctattctgtgtcactccatccaaatgtttaggcctaaaccggaagccacgggtattgaaagcacgatatctttttgctggaccaatcggaccacgagccagccatctatgatcattcttgacactgcatatgccatttttcctctctagatccattatctgtgtacataggattacttagtcatgattttatttgttgatctaaatgataataacacgaaacttacatgagctctgaaccattcatggaatttttcattttggatacgctcgataatctttggggtgatgcggccttgccgatatgttcttctaatctcatcagcatgagttctgtaaaaggaaaaagtgtcatgaagtatgctttgaagaaaatgattagtgatgaagtgtatgatcttgagctaataccgaaggtatgggttgacatctggacagttgaagagcacatatctatgtgcttgcattttagtcaagcccctaataacataacttctcggcttgccaagtggttttccaacatgaggaaaaagatatggtgtgcattcatcatctgaacatgcaactgactcatcattatcatcatttcgtgtaggctggttatgctttgtctcaaaaccttcaagatatcttgaacaaaatgttatacactcatctgccaaatatgcttctgcaagacatccttcaggatgtgccttattacgcacatatgactttaatacactcaaatacctacataaataaagagaaagattaaaaatgttaaaaattctatactagataacaaatgaaattatatttgtgagagaaatgtacctttccacaaaatacatatatcggtaacacacaggacctcctaattttgcttcagtggctaaatgaacaaccaagtgcaccataatggtaaaaaaacctggtggaaatatcatctccaaacgacataatgtcattttaatttgttcctctaacttgtcaagcacatcaatgtacaggacttttgaactcagttctctaaaatatccacatagatcaaataagacaaaagtgacattgtaaggaagcacaccccgcaaagcaactgggagaagttcttgcattagaatatgacagtcatgacttttaagacctgaaattttcccttgactaacatttatacattttgagatgttttctgcatatccatctggaaccttaatatcatggagaactttgcaaaattgatgtttctcccgtttagacattgtataggaagcaggaggcaaataatacttattattagcttttcttatgggatgcaaatctggccttatattcatttcttgtaggtccaagcgtgcttgtaaattatcctttgatttgccttccagtcctaacaatgtcccatatatgttatcacaaacattcttctcaatatgcattacatcaagattatgatggagtacattcaagtcccagtaaggcaacgaaaataagccactacggcatttccatgtttttgacttctcaaaatcattaattttctctatcttttgtaaaactgatgtttcagaataagcaagaggttctactctatgttcttcagttccatcaaaagaattttcattatatcgtaattcatggtccagaggaagaaatcgacgatgtcccatgaaacaatacttgtgtccatgtttcaaacgtttagagcacgtttcttcacgacacataatacaagcaaattcaccattgacactatatcccgcaaagatcccaatcccaggatagtcactaatagtgaacagtactgtagcacgaagctgaaacatctcattttgagatgcatcatatgtaggagttccaacctcaaataaatcaaataactcttcataaactggttccataaataaatgaaaatcctttccagggtaagatggaccaggaattattagtgcaagcataatagaagatgctttcatgcataaccatggaggaaggttatatggaatcaagacaactggccaacaactataagttgaactcaatgtcccaaaaggattaaatccatcactagccattgcaaacctgatgtttcgagaatccgatgcaaactggggattcctagagtcaatggacttccaagcctctgagtcagctggatgacgcaacacaccatcctttgtacgaccctcatcatgccatcttaatgctatagctgtttccttgtgcataaataacctcttaagccttggcttaattgggaagtaccttaacactttccttggggttgcccttctcctttccttctttgttaaagtagttttatcttctttgtttttccaccttgaagtaccacattttgaacaaaagtcatcgtttgccttagctttcctataaagctggcagttatttggacaaacatgaattttgacataattaagtccaagctttcctattatcttcttagcttcagcaaatgttccaggtaaattcttaccatttggaattgcttgttgcaagattgctagcaaatcatttaatgatttattatttcacttgttaactgattttatgtgaaacaagagaactagaaatgacagccttgtaagttcacacccttcccacaaagggtcatgagcatctcggagcaagtcatagaatgcttttgtttcatggtctggcccactgtttaaagaattttgtacatcatattcattcactggagggtcattgtttgtgttcccaaaagcatcttgcactagttggcgcatgttaccatccattcctctactttgtgactctgttcccctactgttggcagagatgaatgatgtggtttcaccatgacaaccccaaggactataccgaagtaacattccatgacatactaaatgatcatacacttcatcccgcattaataaccacttgttgacacactccttacatggacatcggatcttatcttcaagactcttttccctatatgcaaacagaagaaaaccatctattccagcaaggtactcatcacttggtctagggaaaagcaataacttcttaatattattcaaatccatcaattttctgtgttaaaataagaaatatagttaatacatgagtgttcctaatttgacaacaaccactaaatatttttgattctataattatgccttcaagccaaaagaaatttgtctaccgaacatgtgtaggtgaggttaactgtacctggaagcttaggattaggatccagtagatacagcgtcgatgcagccctgatgcttgcttaattgaaccaaacgaaaacgaccatcttatctactggctagatcagaaaaatagcaaagcagtacatgagtggatcagacattgctgcagatgggattgacaaaagcaatcagaataaagaattaaggactttacatgataattgaggaattaaactgcactatgagccaatatttttggttgtacagattaaattatatggttaatataagagtttctgtgagctagattaaaaattgaaacaataagatgcagggtaaagttttaagatgccatctgcgtacaagaaaaatgacaaacacttggtgtgcatagaaaaacttagtgcttaacaatttgctaacctgccgtcatatgcacttgactgccttagggtcttgaccgtcttgatcaccaagcacagatccaccaacaccaagtgaaaatgtgatggtgaggtcgctattgctgatgtgtggcacgcacaagggacatgtaacggggacgcgcggaggatgctagccacgccgcgcgagtcggaactggacctggattcctagggataggccaccggggcggctagggcacgactgcaccggcgtggaggcgaccggtggccggcgctgcaggggctcgggcctgttttggtggctcccgtcaacgacggagtgctggggaacgagactagattggatgaagattggaagggagcgcacaggcctacacgtaggagatgagcgtgtttctcaatcggtatcacaactgcttctggataaggagaagtgaacccaggaaattgagaaagaaacgtgcaaaaagatgtttctagactcaattgatgagccctggaacttctttttttttcatgtttttcaggaacgatataaatagattagatgcaattcttttctttttaggaatgagagaaacagataagatgcaattctttttttttaggaacgagagaaataaatgattgccatttttttaggaacgagagattttcttttgtaggaacgagtgaaatagatgattatttttgtaggaatgggagataggtgagatgcaatatattagctaactcttctgaatgctagaacacgtgtacacattttaagtgctagaacacgtgtacactattttatctgtgccactgcaaatgtgtctttttagataaatactactccctccgtcccaaaatataaacatttttagcctaatgtaaagtcaaccatttttaactttgactattaatagaaaaaaataaaaatataatcatgtaaaattgaggttactagatttatcattaatcaaactatcttaatatgtaacttttttatttaaaatattttatttttataaatataatgtgaaaatagcatgcatctcgaagactgtgtcggagtacaaaaatacttatattttaggacatgagcattaaaattcgtctattatttgtaagggatgttgtgcgtgaagctccacaaggagatctatgccgctgccctccccggcggctgcaacgacaacaccaacagctgagagcccgagaacaacgcatcaccattagtctttgtgtagcgcccgttccgtcgtggcgcctagcgggaaaattatctcctaaaaaccctaattgcgaaatctgtttctttgcttgttgtctagtgtccgtgccatctcaagatctcaatccccgatctatcgtcgagttcaaatccgaatccaaatccttccaaatcaaattcctccgcaaaagtctattttgcctcccccgggtcgatgggccgaatctcgct

SEQ ID NO: 2045 - DNA, 5856 bp, Oryza sativa
ccgaccgcctggtcaccgctgccgtcaccctgtgccgcgccagcccgcgcctgtcgcccgtgtcgtcgcgccgctccaaaccgccccgccgtcatcgccgtcgtcaccgcctcggtcccgccactcccgcactagcctccaagggacggaggcagagcctccctcctccctctgccgcgacgcccccgctccctcctccttttcccgaagaggcaaggggacaagcccctttcccccccctccttttccccttttcccccgccggcgtcatcctccctgtcgccgctttggccgcgaccgccgagcgccagctcgcgcccttgaccgcgcaagttggttcccaaaccgacattgctgcccatttaaaccccagctccttcccctccaatctccctcgttttcgcctccgtgccattgccgccgcccccgtgctctgttcgccgtcgccgttcgttgttgcgcgtgtcggaggagttggcacgagcaaggacgcggaaggggacttcggccgcgccctctccttcctcttccccggcccgaggccggagagattactcccgcgccgtcggcctctcgtcacagcgccccgtcccgcacggtagtgtctccctccgttcttcctcctcgctccatctcctccccctagctttcggtagtagcccgagtagactccccgtagttagccggcgccgccccgaccgttgtcgtcgctcgccgcgtgctcgccgccgtcgccgctcgagctccatagcacccgctcgtcgccagcctcgctcggcgtagctccgtccaatccgacgctagcatcgagttcccgaagccgcgtagatgctctcaccgccgggaatcgacccctcgtggcctcgtcgccgtttccctcttccctccccgccggttgtcgccgctgcgattcgccgccgtcaagctccctccggcgaatccgagccgttggctcgtctcccctcatcacgaacaaccgcccggtgtgctcgcttttgcccgtatcgccgtggttcgctccgccgctcgccgccgccgcccgccgtccattcgcggccgggtcgtcgtctacctcccgccggcccgcgtggcagccacgtaggcgccacgtcggcgccagctcagcctagaccgggtcgggccgaccccggtcagtccctccccgtgcacgcgttccaccgcgagccgtgaggctgtgcgtgggcccgccgcacccgcgtccaccgcaaaccgcgcgcgtgcaccgtgtccctcccccgcccgcgcgcgtgcgccgcgtgctccctccgcacggtgagccgagccgctgacaagcgggtcccacccgggaccgcgcgtggtgagcccggtccaccggccctctctctcctctcctcccgcgcgcgcgcacttgggccgccttgggccggccggcccatttaggtcggccggtccgctccttttcccttgggccgcgccctagccgtccgaggaaaagtctataatccctccctccttccttttctttttccaaaagggtttaaataaatcctttttccttcagaccaaaaatccaataatcttagaaattcaatatcttcccaactgtaaatccgattgactccgttcaacttccaaaatttcccaaatctcgagatctatctaatggcacgcttagaggtcattaatagggccttattttttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacataatctgttgtcccgtctgcaaggcagattggcagacctacctaatttgttgcatttgatccttcctttgttaattgttataccatgtccccttgtaaccacccagtcgcgcctcgatattcgtgcactctgtgcgagtatcgacggtcgccttcaaacttaaaatctgaaaaacaacttgggtaaaactggagttttacaaaagacttggaaaacccgacacctgggtcggtgcttgcgaactaaatgatttttcaaaaccgcggaccgggaaacgtaccgggtgtacggtttcccgctcttgcacttaaagaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaagaggttcaatgtttgaaaaatctgtagctgacgggatcagctaggcccgggtgcccgtttgaaaagttgttggcccgggtggccgtttgaaaagttgttggcccgggtggccgttgaaaagctgttggccgggtgccaaccttgttttaagatgtaaagactgatacattgcacatactccgaccggacgggacgcactgtctcaaccgtgtcgtttgagaagcactcacttagttgtttcagaaaagagttcaaataaaatcaattgcaaaaataccggcctttctttgaagcctgcattaaacacttatttcccctggcttgctgagtactcctgtactcacccttgctctatataaataacccccccagttgctgaagaagatgaagcggatcctgctgatgaggagttcttccaggaacaagccggttacgatgagttttagggtttcggcctagttcccaagtcgcgcctgtgttgtttggtccaagccctggcttccgtttcccttttgtaatgcagttgtgagctcgggatctgtccgcagcccaacatgactgtactcctactctataataaagagacctctgttgctgtgatattctatcttcctgtgataccggcactatttcctgggactggtatcgattaacaggttaatttggagcgtcacgggctaattccagtcgggactagctcggggcgtgacactttgtctttagaaagccagccaccggcaacaccaacagtagagagcccgagagcgacgcgtcgctgttagttctatctttagaaagccgcactcgacacgttaacactacaaattctcctagcatcggaccctataaatcaagtttgaccaataataaacgttggaccgtacctactaattagaggctcggtgttattaagaaatgtgataaactaaaagcatatttgtccgtacaatgcatggctccccttagttttgtattatatgatatgaaaaaaaaaacaatcgggtaaaaagaataggaaaaaaagaaccattagtttcatattatatgatatagatacccttttaaaataatattattctgctgaataaaaatgaagggagagctagcagagggacacagtcattaggggatcacgttaatcacataaggaatttccttaatttttatcagtaaggtacaaaattactaatgtagtaattaaccaattttgtaaaaaaattgagatgtatcttttttttttcaataaggaaattccttgagttttttcatgcgtagtttgcctccaaatacttcccgccaaactcaattttccctccaagtagtaccgcaacattagataacaaacctgctaatctctctccacatctctctcaacgaataagctccctatataatccccattcaacctggaatcagttagtcagtcttctgctccccattatctctcaccagagcactcctccatcgcctcctctaagatcgcattctcaactgctcagccgcgcagggcctccggccatggctctccccctcatctggccatctctcgagactctctcccctatttcttgagttgtggaatctgcagactcgaagatccaaaccaccccatccttttcgcctgcgcttggtgagggcaggtcacaggaatcgacatttcaaccaaaggattcctctctacagtttgtgtaccttctctctaaaattcctgatgcttatttctgagagttagatcaactagggttaaataaaactggatggcttgctctctgttagagctatatacaccatgtgttcgatgaaaagcaccggtaccaccatctaaattccatgtttatttctgtacaagaaacaaaattagttcccactgatgattattgaagttctgatcaaacatgcagttatttgataaaccgtggtagcatctgctagacaatctgaacaggttaatgacatatgttcagtgacattgattacattattgtgaaatgaattaattggatttatgttgccagatctatgtaattagttgtgtgcaaaatattcctgtttagatatcttgataatgctaagtaccgaatcaaaatgtatgctccgactaataatcaaagtttatgcaaagtacagaagcaggggaagattcttgtgtgaaatagtcaattttaggttactgcattcattctcacttttatctccacctctaccatgtggaactgaaaatttgttatgctcgtatctctggctgtacttccaaacccaaacaagcaggtcatatgtgtgttcttgtctataatgaatatagtgcccctgtcttaactgaaagtttagtagtacttaccgcatttaagctcaattatatgcatccagtttgacggagcgtggggctcctcaccgggagaccgcgctggcccccctttgccggttcggccggggaccctgggtgagactctaagctcccaatctgtggaaggttcgcgagacaggaagcacacaagacgccggcgatgtatacaggttcaggccgctgagaagcgtaataccctactcctgtgttttggtggattcgcgtatgaagaagctacaaagtatgagccagcctctcccttgttctgggttcctaatctggaaaagtccagtcccccccttctctaagtgggcaaggtcctccttttatatcttaaggggataccacatgcaccatttccctcttttttgtgaggacttcccctaccttttcataaatggacggagatttgtatagttgccgtccgagtcaccttctgatgggatggcctacaactacctccactttcgccgggagcagatgcgacgtggaatcgtggctgtctgctgtcgacatgaccggagtcagaccagtcacgtcggtcattcttgtccaccacgtgtcagcttagcaatctacatgttcgcccttcttcacacaacatcttgcctgtaatggttaggatgaagcctgacatatatctgaccaggactaacgtgccatctctgggaggtaacacgctagctccagctggggacgagcgcctagaagccctcgtcctgacgggatggggcgaggcgtgcgccagatcgcctgtcgccacctaacccgcaatctgaccggtctgtgactggtcacagaccggataaatgagtgcactgcactgcgttacatgcggcgtgacacgctcagccaaatcacaataaatgtggttaggtg

SEQ ID NO: 2046 - DNA, 7622 bp, Oryza sativa
accccctcggggggactaagaggagggcgaacacatcaccctcgggcccgacgtcccccgagggtgccaggccacgtgggcgattgtgtctgcctcaaacctctagtcatgatactcctgatcccatgtcaccgacacagttatatcatattaagccatttataatttatagttatctctttgaacaattcataagttttcaatagatgtagttttccaatttctgcaaagcatatgattttcatgtagaggcggtcaacctatagcttttctcttgtagctgccatattacactctgctttagctttaacatttaagagcaattgatgatttatttgctttccagtactgtgggaatggaaggtgctgagaaaaaggaatatttatttgtttggttcttttctggattcttctctagctgaaagtgctacatccattatatttttgtcatgcatatactacacttataattgtatagtcttctaatcttttactccttgtgcagagatagttgtagttggtacaatattcccgtatagtcaagcatacttacacatagattaattcgtgctcttgaaatacagtaagccaattttgcaggcaaaatggctagaaagaaaaggttgaacatagtacatagcagctgtcaccatggaaatggagagggaagtagcagcggacaatcattgccacaagtcgagcctcctctaccatatgaagacgaggtgattcatgttgagcagcaagatgatgagcccctcaacatgcctggtaaaactttaactacctgaatcccaaatagtttgtgattgcatatatatggttaacctaaagttagtgagccttatgtcaattaattttgtagtacaagatgaagaggtgaagaagcgcaaggggacaaccttgcgatatgtttgggatcttccacctgggaaacgtatagttgtaaaatgcaacagattagggcaacctatcggggatgaaggtggattgctaggacagtttttgggcacattagcaagaaatggagcttactgtccattagataagatgacctggagaaagatcaaagcagatgaaggagatttaacaatactacaatttgtccaggtacctcaaacgctaaaatagcataagtataatgctctgtttgtattactagtcattactttttgcctactctcagattgatgcatctgttcatatccatggcaactgaatgttttcgattcaatgtttatatgtattttacagatattcaatgctgagttttcttacttgctgttatcccttgcctaaccattgacgtaatcatgcaaattaaaatacttctactctcattattcctatgtatttcagacaaagttcctataccctccatcatgcgttcaatggatactgaaatcaattggaagagattggaggcgatacaaggctgcactaaaagataaatattttaacccaaagaagaagcgttctgctctgtataagctttgtccagacgatgtagaaaaagaccaatggattccacttatcaaatattggaagtcaaaaaaaggaaaggtaaaaaatctgctccacaatctgtactattgtctcattgacatatattgtactgttgttcctaccgtaaacaacattggaagtgtgaactcaatgagactacattgcttctgtaataggccctcagtgcaaagaacaaaagaagtcgttcaatgttacagaaccctcactcagcagggacaaagagttatgctcgttggtctgaggacttggtgagccaatttgtttcgttcaaaattcatctatacatgttcactttactttcttacattacctttcattttcagagacaagatgatccaaataagaagcagccacatagagcaatggtttacttagcaactcacaaaaaaaggataaagataaaaatcaacacgtggtatgccatatacacataatccttccataaatatctaatatgtatgttatctaccttgtacagtgggcatatattttttcacttgcaggtcacattggagaacctcatcgatgaacaaccagagttggcacaaaatgatcaaggaagagttgcatgggaaggtgatgcgctaaataaagtattgggcaaagaaaaacctggccaagtgcacggaatgggattacttcctgttcctaagcaggtttatggtcgtacatcacatcatctcaagaacataaacatcactacagtgaatgactcatcatcggatgaagagacacatgttagaggggaagtgggggaattaaaaaaattagtcaaaacactgggtcagcgtattgaggagttggaaaacaaaggaacaagcaatgggaatagtgaaccaactatggtaaacgttataaatacctttgtccttaacattgaatttttagctacttctgatttcatttttgtagatgcttgtaaaataaaaaatttatgtgattcacactaaaatcttaccccttcctgatttcattgctgtaggcaacatctcagagaacttttgatgatggtattgaagagggagtagtacggactaatagaaaggtaatgtcaaagtaatgcattctatgtttctcaccatattttgtgcaacaatatttaaatatgtgcacatacagagggttcgatgcagtagacctgatcaagacgactcaatgagtaatcaaataaatatatcaatggtattttgtcgtttctaattgataaattttatttgaacactcaatacacatactggcatgtatagtaaatttttattgtccattccactatagaacaaaagaagatgtgaggaacagcaaaatatgcaccatgacaatattctggatctttgtggcaaaaaggttaggatttgttgttttcattcatatggtgcaatgcaatttatatatggttttacatggattatatatcatggaaccagcaccaggaggctgataacaacataggatcaccatgtcaagatgattcatcatcacagccacaccttgctcatgatcttcggtgggaggtagttcttgaatgcctattaaaattgtacttgtttctcaatgtgttttattcatctcactatgatattagagtgaaatataaacacgttgttgggagaacccctagttaggcaatgctacatctgtgaatgcatcatttgtgtgaaacataaacataatcttttcaaggagtactgctatatttttatagacattaatcaactgaaaattaagtagtagcttctagtgctcaagtttagctttggacccttcatctatgccatttagtgttggcaaccgaatgataaacatgaaaggatattaaaagcaatttgtcatatcttaataaagttggtcttgttcatttgtgctattggtttgtatataccatttacatgatctaaatactgttatatgtcatgtccttccatttttcctaattataagattaatgtgcagagttgggttcaaagtacaaaagttatgtaataatgcaatatgttctgacctctttgtaatgtaacaaaatttcttatgtctcaacatagatgaataaaaagaagcaccgaaatttagagaaatttgcaaagactacagaaaaacaggacactcagaagaagactgcacatcacatggcccaaaatagggtgcattcttcttcagtgaaggtagtaaaaacatacaaagatggtactactaaattattgtttaacaattaattattgtatatttcttaatgaatacattatttctattgtaggttggtaccacaataatcttggtgactgcaaaatatcctaacaaagaaactgtggcatatgctacttatttgagtagtaacccaagagacaaagtggatggtgttgagattggtaacgagttcactaaagtggttgtcaatcatccacttaaggaagatgaagagctcgtaaggccactaaagcactgcaagacaattggtgatgcccattatgaaggaatgtcgattgcttggccttcattttgtgtatgctcataataccttcatgtaatatatatatgatgaatactatatttgcaatgcaaatgctaatatataaatttgttatgtaggttcaaaagatcaatggttaaaattctcatgttttaggatcacatcaagatggaatcaacaagatatggagctgatgaagattacataagattagatatattctatatttttttgctagtagtttgttgctcgaaatatgtatttaccttttcaaaggacatgactctgaatttgtttgttttcaattgggatgatgtaattagagtgctcatcaaaactttcttattgcaaagtaatatcatggttacatcacttcgtttatgattatttgtcctattgtgtgtatgtgcatttactttattacaccattttcttaataaatgtattaatattacaaagtgcactacagttcttttgtaattatgttgcaatatgtaaaaaaggtgttacagaatatgttgctacaagtgaaaaaacaaattacaaacagtgttggtacaactagaaaaatggtgttactatgatgtatggtaacacataaatacgtgttgctatagcactaatgtaacaccttttcttttctacaggaacggtccaatgtgttacaacaaactaaactatagtaacatagtctatagtaacagtttactgatgtgttccaatagaccattgtaacacctttttagggatatagtaacacaaaatcatgttattaaatgcctatcctgacgtagtgacaatgcttgtacgtgtgcccacgttcatcgcatttgctgcaacgcttcaccctgccagcctccgactcgtccatatcgttgcggatgcgacgagtcttcctccttccagtcttacctcggagcttcgatgggtcaggaatattgagtacttcatcgttagtctttgtgaactccccagctatgccgaacccataatctcgccactccatgtatgatatactgcttgcttactgaagtactgtgacacatatactgcatctggtatgccacactccgttgcggcagcaatgacatgggtgcatggcctgtggagcagcttcggctttgcacaagagcaatgacatgtgccatcggctttgagaacacattcctacttcactctcttgcggtagatacccctgcctgccttatcttgacatagtatctcaaacctgtgctgttgggtaccttgcactagagctagatgtttcatggcctttttacgcaactcctctagctttttctgcatgaaagttccgaataaaatgctgttgttcggtatagagggaagaactgcctgaaaccgatccctaaaatacctgcatgtcccatgtaaaatgaactccactatgccaactagtgggagtccacggataccgcgcatcacccagttgtaaacttctgccaaatttgttgtcattattccatatctagcaccacctgtgtcatacgccttggcccatttctcttttggttcatgcagaatccactgagaaaatttccgaatctccactccagttcttctaaccaatgttggactatccgttgggagaggtccaagagcttgaggagggtcagcaacggtggtcgatggagccgctgcatgctgatcactgcatttggctgtcaactcatctaatctcttccaaagctcattgaattttttctcctggttctgattgcatagcctcttgaacatgttcatgagctccttgttcttgaattgcttgaagaaattagctcccatatgacgcatgcaccacctactctgtacatcttcccactcaccagggtatcctcgttccatactcccaaactacaactcttctatcgctcgcagaatgccagcgtgtctgtcatgtatcaggcacacatttagcctcataccaacaacttttgttttaaccaatttcaggaaccagtaccagctgtcggtattctcactttcaacaaaagcaaatgccaagggcaatacctgattgttcccatctacccctattgctgttagtatctagacccgatactttccagtcaagaatgtcccatcaatgcagagaacaggacgacagttcacgaatgccatcttgcatgcatgtagagctaagaacgccctttgcagcacactcttgccaggatgttcagttgaggggaatttcttcactgcgtaagagctcccagggtttctttcttcgataacaccaagcaggcgtggcaaattgtcatacgaggtttcgtaagttccaaatctcatctctattattttctgtttggccctccacaccttggcatagctaatagtatacttgtatgtctcttcgatgtgtcggattattgaccttggttcatatgtgagattatcgatgacatacgcatacatctcagatgcaacaaatgcacatgtaatgttcctgtggtatttctgaacaccaggtagaaaacatgtatgcttggtaacgactgacactgtctaataatccttccattttcccttataagcgtgcactctccagggacaaccatctttttccttaacacaccgaacttcatattgcgaccggttggacttggcaacccaaaactctctatgaagtgacactgcaaaatgttttaccacctccttcatatcttctgctctagtataaatcgctccctgaataacctcattttctttgtactcccatctcacactatcctctttagagacgaccagaccagaaaattcctcactagcccattctgctggattaatatctgactcatcatctgatgaatcaccttcctctacacgcttgttgtcagaatcctccctctccatttcatccacaatggcaccgacagtctccctctcgtcggccactccacctggttgaatgcccactagagctactacgcccccgtcctctcgtgcgttgacctcttccacagaagtctcatttacttcagcacttggtccatcgccatcatccatgttcatctgcacacctggatccttcgggtgaacaaacggaaccatagctagaggccacccgcgttgcaatgcattttccacataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaattctgacagatctaccccagttggcccgtaacggacgtttcctgggccatggtaaacttggaatatttgtttgttcgacatatctgtcaacgaaataactagatcatattattatttcatacaataaacacctacaacgtaatatcttcttgtgtatgccaatgcaacggtaaagtactgattccaaactagcagatctacgtagttaccgatatctacaatacgcacttctagattagtacaactaaaaccttaaaaatataatgcatttattcaaacaaagttgtaaaaaatacacagtatttaactcaataggcacatataggatcta

SEQ ID NO: 2047 - DNA, 20430 bp, Oryza sativa
  unsure (1)..(20430): unsure at all n locations
atagagggcggcaagggttttcctgcaaaaaaccctccctccgtcaccgcccgtccctcccccgtttgctacgtcagcttgccgcccaagtggtgggcggcagggtctatttttgtaatttttttggccgatagattatttctgtaaatatttaaaaaaaaatctaaaaataaaaaatttcgtgagggcatgagggacagaaatagtagtgggccgaaggttgtggacatcgggcccaactggttggagctttcccctttccagtttgtataggccgtgctcgaagctatacgaatttttaggccatcacatgcatcttcgcatccaaagatttcttctagccgagtatttctacgaggatcgagcgtagcccggttggcacgttcgcagtggagcgaacggccggtcgcgggacctcacctcgacgggattttcccatctttcttcgggagtctcgggtacacacacgcgtgcgtgttcagtgggactgtacgtttcccgtgcactgagatctgaaggtctccaatcttattcctagcgtgtgttgtggtgtgagtgtgcgtcctgagttgtaactttcttaaaaaaaccaaatatttctaccttcaaagatatatatttataacactgtcattttgttgaatcattttattcttatgcgattgtaatatatatatacatatacatacacatatatacatatacatacacatatatatatacacatatacatacatatacatacatatatacatatatacatatacatacatatatacatatatacatatacatatatatatatatatatatatatacatatatatatatacatatatatatacatatatatatatatatatatatatatatatatatatatatatacatatatatatatatatatatatacatatatatatatatacatattgaaccactataatttcacttacaaactccacagctataccaaacaccaaataggatgttgatttgtatgagatcttcgtgtcttcctccaagcctacaacatgtacaagaacctgcaaggtctttgggttgtttggctgaggaaacatcgtacactgtttggctccattcttttctagctaattcaccagattatcattgtggatatttgttccactctttaaaaatatattttctcaaaatgctttactctactgtatttcatccttataacatttcgttcttaaactatttgttaatggtatttttaaaaaataattggtttattttatataatcaagtactccatttatttcaggttataagacgttttgactttggtcatagtcaaactattttaagtttaactaagtttacatacaaatatagtactaatactaaattagttccatcaaatcaataattgaatatattttcataataaacttatcttggattaaaaatgttactacttttttctacaaactttgtcaaacttaaagcagtttgactttgactatagtcaaaatgtcttataacctgaagcggagggagtaggcatgatccatggtaataataatccggttaacaatctgtcgagaaacacacaggggtcttccggctagctccataagatgatgggctagacaacctgggttcgaagcctcaccccttctaattatttgatattaagtcgttccctaatattcgcgtccggttaacaatctgtcagcaatgcaacctgcggacctcagaatctagagaattctaattatttgatattaggtcattccctaatattcgcgtccaatctgtcaacaatgcaacccgcggacctcggaatttggagaaaatgtgtggcacttgataggtctgttcgaatgatgacgcgcgcacaggggggcggagctagtatagctagggtgcccaaaaacccggttcaaaaaaaaattacctatagtttatctatttttatcatatatataccccatcaatttaaacttaggcacccgtatcaagctaaatttaattcaaaccagagtagcaagtgagtggaatccccttcattttattatagctccgccactacgtgcatgcccgtacagtctttacagatgttgcttcaggtgaggagcaaatggaacaatacggttttggtttatcttgatcagatagggttgatgtaccttttttctcccctacttctgtcacaaacattacaaaaatagtcgtttgcgagattaaacataatcttaatctgtaccacttcactgtaacgaagaaatatttacagagcaaaatgaccgggcagaaatggaatcagaaaccatgatcgtaaattcataatcgaataggcactagcagtcagtttggctgtttgggctacagatgaggttcgccttgttggccgacgggatggccgtgacgaccctgcggaagaagtcggcgtcgcaggggatgatgaggacgccctcctgcccgtaccccatctcgtcggcggcgagctccagcagcgcctccatgcacgggtcgttcagtagccccaccggcacaagaaacctcgtcgccgcctcgccgccgccgccgccgctcttcccgaccagcaccggcacgtacccggccttcatctcagctactaccccagatgaatgccccgccgccgctctcgtgatgctgccaggcaaggtgtgcttcggtaatgagaattgagaggaggcgctagccatttaaccagccgcccgagccgcgtgaactcgctgcggctgacgacccggtagtgagtctcactggctcacccagctgtaatacgatttctctcgttgaattgctcccgcgacaaggaaaagggagggaagggatcgagggggagagctttagcttgaagatttgcaacgagcacgtacgacgcctacgcgcaccgtgaccaactgaccgaagtgagggtgagaaatttaatcacgttcctaccatggactttgacacttcctgtgactgtgagtgagctcgatcctgacgtgtgattagtcgcgacatggagtcagtcgccgcggcgtgggacccggggggcagagcggctggtctttgacttccggtgagcgtgtttaacgtggagagtattttcgggggatcgaacagtgcttaggttgagattattatctgcgagtgaaaatgattgggcagtggtattgccgactgtcgagctgagctgagttgacgaaagggcaaaacaagcgaactgcgtccacattgtcattgcgtacctgagcctacgacctggtaaaacaacattttatattgagtttggtgcatgactagttctccgaaatcttaaactgataataaacggtgggcattgttctctggcaaaggcggacatggtattctttgtcagttagggtgaatggattcatgctcttgcctctcgagatcccttgaaagctcacattggttctttcacttgaaaaaaagcgctcaatttggtgaaactcaaataatctcttaaggagatatcttctcattttgcatgttacataaaaagtcatcaaaattttttaaagaatttagtatgatagatcaatatgtgatatgtcacttcacaaacatgcaaattcatattcaacttatacaagtagaaacaaaataaacaaatttgactatgaatagaacgcgtaattcacggtcaaatttattatttttgtttcgaattgtataagtcgaattttaactcacatgtttaaaaaagatatgtcatatattgatctatcttgacaaaaaaaatttaaattttttataactttttaaatgacatgcacaaaacgactgatatattgtgtgctagttcatgactctgccataataaaaggaacatcaaatttacataaaaaaaatcaagaagatgatcagaatccattcgccacacgtgcagctgccccgttcccaacacctcgcgcattagaagaagaagtattttttacacctaggtgcacctaggtgtatgcatacaatttaaatagttatataaatatttcataaaatttgataagatagtacatgataatacaagacactatgtaaacatgcaagtctaaatttgatcgatatatgaagaaacaaaaataataaattttatctgcactgtatgggtactattcactgtctgattttattatttttgtttctctagttgtagatcaaatttagtcctgcatgtttgtgtatagacttgtatcatcccaaacgatgttactaaatttttttaattttttctataactatttgagtcgcatgcaaataatagttgccacggtaattaggtgtagaaaatccttgttcgcttggaactgaattctacctgcatgccacatgctcagcaaagcaaagcccactccactccacaatccacattccttccttccttccccgtgcgagccccgagagccttctgctccccgcttcggatctcgccaccagcctccgccgcgcgcggtagcccggcccgaggccgagatcgatgacgcagactcccacccccgctgcggccgcgccggcgccggcggtggcggtgtcggaggcagggctgcccgacgccatcgcggtcgcgctgccggcggacccgtacgagcagctggaggtggcgcgcaagatcacggcggtggccgtggcggcccgggcgtcgcgcctcgagctggaggccgcgcggctccgccagaagctggccgacaaggaccgcctcgccgcggagctcgccgacagggccgcgtcgctcgagcaggcgctccgtgactccgacgcccgcctccgcgccgccctcgacgacaatgtacgttgagctcggctcggctcgatcgtgtgcagagtttggggtgtaatttcttctgttgctcgatcatcgatctcttctctgagctctgcttaattcttcttgcgtggttttttgtgaaggctaagcttgccaaggagagagactcgctcgcgcacacgtccaagaaactggccagggatctcgccaaggtgagagctgagctgagagcctgagatgatcacacagttgctgagctgcagctgcacatttgcacaaatttcctttacactgagataacgaatttcttctttttatggttatcttgattcagttggaaaccttcaagaggcatctaatgcagtcattgggtgatgataatcccccggtgaggccctttagttctctcttcattccttaaccaaattttctgtcccatgaacttattatatattatgggtagtgtaaataaataatccatttttggtctcgatgaactcatgaacagattcaggagacagtggacataagaacctgcgagcaatcggtagcgaaagcaagttcttggaaaggtattttctcttgaaaaatgttgtttcatattattgctctagagctgcactgctattgcacacacatacacactgttcatctgttcatacgaatgcacctctgcaacatttctgaagatggagtggcacatagtcgtcatcatcatcctgtctcctctcttgctgatggatccaccgaaattgaaagcgtaaaccaggaaggtatgatcagaaaaaaaaaatatagcatgtacctccaagttcgagagcaatgtaatgtgagcagctgattcttcttgctcgtgttccttctccaaacaaaacagtggcgagaccgttcgagcagaagctctccgtcacccacatctctccgcggctcacgtctgatcccgcggcgaagacgagaactgctgccacttccccgagaagatactccaccgccgtgtcgcctaagctggcagccagcgccacttcgcctcggttagaaggccacatggcgatgcagccatggctgccctccagcaagatgtcctctgctgccaactcgccgcctcgcgcccactcgatctcaggtccctcttgttccaacttccaagttcatcagcatccatcactaatccagtgacagcgatatcaattgccttacactgaatccgtatgcaataaaccattgaaaattggtttcgaactctgtttcagggcgcacgacgagagtagatggcaaggagttctttcgtcaggcaaggtaaagctagtccaacattctcaaatcgactgtatcaattaaacatgtttcttcatttcatcctgagttcctgacctgcacagtgcacgcacagcatgaattatgcatatttctttttggtgtttctccccaggaatcgtctctcctatgaacaattcgcagcttttcttgccaatatcaaggagctaaacgctcacaggcaatccagagaggttggcatttgcgacaccaagcctcagttttcaactgagtcccaaccggcccgttaatccgttcagatttcagaacatgagttctttaatctctgacaccgtttcttattgctgtgttgcaggagacactccagaaagctgacgagatcttcggttcagagaacaaggatctcttcatgtcgttccagagcttgcttagccgtagcctgtcgtaggttcgtctcgtagcgctgttgatctggacgctgcacgctgttttacagttggatcatgaacgtcagataacggatggtacagcagtgttcgcctgtacagagactaataacagtttgatcatgccaagaaatgctacagatagattattgctttttattggttttgttttactatttgattgaactcacgtcgcgtcgcatgctaaatgttaaaaaatcgaacaaaaaaacaaacaccgcgatagacttgaataccagccatttagtcgttaaattagagattagagagtagagggagcttgagcgggtcaagccacacaaggcgtcacgatcaaatgagcgctctacgcctctactagaccatccaagtcgaaatctcactaaaaatgagattatcattaactgcgccacaacaaatcaacagtcatcaagacttgctaaaacaaaatcaacaagcaaaacggcatacggatattgagcattctcagataaagttcccaaaattggatagaccatagatttgatactgaaattgctcctatctaccacggcttagctagaaatagagatttgataatttgacactttataaaatggggtttgattatttgacattttggtatattttcatcaactcggatggttgtactcacaggtagtatcaattaaagcaaaatgacaacgaaaaaaataaaatcaaaccatcaaatttctcggctgaaaatggaccgcaagggttaggaattttaattacacatgtttaaaaaaaagatttaaaaaaagctgaggaaaatgacaaaatcacccccctccatctctttctctccttcccacacgcaccttcatcttcgctctcgctttcccgtgtaagccggaggaacgggcggccggccttctctccccgcgagtccgcgaccccgcacgcgcggccggcgagcaagcccagaggcgcgtcgccgagcccgacctagcatcctcggttggcgcggcctactcgagcggcgcagggccagcgagagctcaggttcggaggggggctatgcgggaggcatctttccaccgccgacctccacctgggcggatatagatctaagggtagttgcttctcctcgtagatataggaggtggaaataagcgaatacagcttcttcaggatttcgttgatgcgtgaacctgccccccgtgcgacacgttaggtcgtcgtcccctgccgcgctgacgacttgggatgaatgtttgatcgtattgcacacatatgttggtgttcttgattccttgtatacatttttttcttgtgtggctaaaacttttgcagcaagccggagcgtctcccgttgtcggagatgttcctcatgtttattttttttttcgttttgttttgttgaatgctttatcgaacatgcaatcacatatgagtagttgattgtcaaatgcatacccacaccgcctggtgccacacggtgtgtttacagttcgtttcttggattaaagttcatgcatatgcaagtacagttgcttttcatgggttgttctgcattggatctatgctccattatgacccatgttgctttgtctgaattatatagcaacgatagccaaacatatgatcagctccaaacttttcagattcagagtcatctcgcgatgaaggatatcttaggctgtgttcagttcctgaaaaaagttgaaagtttgaggaaagttagtagtttggaaaaaaaatttaaagtttatgtgtgtaggaaagttttggatgtgatgtgatgtaatggaaagttgggaatttgggggtgaactaaacacggccttatctgcttgtctcaaattatgtctctagtacctaccaaactataggactacttcattccccttctgcaatgtgctgttgcgtgtttacaaccttcaacattgtagtttgcattcaatatctgctacatggtactacctgctttttttcaactattgagcattaaatatgaaagtggtcgagaatttatttagcttcaaagtactaattaaaacatctagtaacttgtttaataatctgccaaattatatttttgggctttcattgtttcctaatatacatttaatggtcagttggatgttatatttacccatctcttggttgcttttctttttttgatctctctcttggttgcttttctgagcatgtgggtagctggatgtctctaaattattcttagttttctgtagtactggccatttattgttcttgactctctaatttccatggctgaatctacaatgtcctacttgactcatcccttttcatcaggtcaggagtcaaggtatatcagatgatggatctgtccacgacttcagtagtggctgctaaggcctacaagtacagagcagaatcacttgttaaggactaccttcttgcagattgttatgtttcatacactgctgtgcttggtgggatcctgatgtgcaaaatggtattatttgtccctcttatctgttgatgtttactataagtctacatgtgaattgtcactttgatagttatatttagctgaatggaaaaatcggtgtaggtttgatatattttttctatgttataagcgaggactgtggagcaggtagggcccctttatatgagatgactattattataagcaggtttttctgggatcgaattaatatagccatattctcagtgtaacttggctacttgccacatcaatcttgagatatggacctatagataaaagtaattgagataagctgtgtaagtgcagatatatgtgcaattgttttcagattatttatgacttttgacttgcctgtatgcttgcagatttaaataaattttcaaattaaaattatgaaacaagtctaactgtttctttgaattataactttgtagcgtttaatcttattaggatcttttagagattattcaactcaatctacagtaaattgatctcaataatgcctcatagaaccaatcatcttatggttagtctaacacaaactaacctcagtgtgagctcctcacagaaaatacagtttccatcataagatttatatctgtgctgtaatatgatggatcaggtttagcatcctatatggaaacaaaacagcagagggagggtggggggtgggttagcatatctttacgcttaatgccctattagctgcttgaattattcagtacctagagttgtgttaattcgacctgacatatttccgcttttcctttaaaaaaaacaacattggtcaatagtgaccacagcatgttagtagtaagtatgctgcaatgctatgtaatattcataaatgatcataaactgtgccgttttgtttatttacgtattatgtaaacattaagtagttgcatgggacttgctatgactaatatctatgtaccacctcttttgaaaaatttcttcttggtcttgactacaatttatcacttgtatctcaggtctatgacatcacacacttaatcagttcattgtactacaagggttatggttctcttacgaaaatccaaaagcttgagtggaacaacaggtgaagcagtgtgtttgtagaatttatgtcctatttcacgctatatttgtcttttaacttccaccttctaactgttttaggggcatgtccactgtccatgcaatgtttatcacattaatgtcagtttacctagtattcttctccaacctattctctgatgagctggatggcccagtaacagttcggagttcaaacctctccaattttacactgggggtaacatatgtcactgtttatccgcattgaataataggttatgctgatatatacattttctccttttgccacatgttagctgaattaaatctgtttaggtttctctggggtacttcatcgctgaccttgctatgttatcctgggcttatccttcccttggcggaatggagtatgtaagtgagcatagttgatcattaccatttattttatttcaccatttgtttactttctaggttactgctattcagtgtttattcaattactgtgtgctctgctgttcatattattcatcacttgggttgaccattgtcaggttcttcaccacttgctgtcaattatttctttagtctatgctatttattctgaagaaggacagttgtacacatacatggttctcatctctgaaacaaccacacctggaatcaacctccgatggtatgcttcatgaaaaagatcatgcaccttttctttatacttattttacttcaatctatctgacctgttatgtaccttcttcatcaaaggtttcttgatactgttggaatgaaaagatcgaaagcctatcttgtcaatggtgttacaatgtttgttgcatggctggtaagtgaaagttgctacactgtaattggaggttagaagttaaaaatcatgcattgactgcaggtgatcggatagttatgtactattattagatgtactacatgcatgcacgaattataattgaatctgtatatagcgagattcaaccttgttatttgttgtgtgtacgtaagtatgagagggagggagatttggaatcgtgcttaatcaataatagttgcctaatcagttagacgctgtctctggtgctgtttaggaagttcttatatatctcaaatgtggaccaccatttgcttactacaggtggcaaggataattttgttcatctacttgttttaccacatatactttcacattgatcaggtgctatatccttctgatttgatatatgggtacatgtctacatgacaaaaatcactgaaattaaactgttcttgtttattgacaggttaagcagatgcgcacctttagctgcattctgatattcgctgtgcccacaatactattagtgatgaacacagtgtggtttgtcaaaatcttgagaggtctcaagaagacgctagccaagaggcagtgaagagtggtgaattgctcataggcgcatctacaaccatcctttcgtacagtcacatacaactacatatattttctacgttaagctttatagtgcaactcatagcgcaagcaaaagatcccttgtacacatgttggaaaaatctcctcaacattgccgaaaatttttgtccctgtacggttctacattgtacatatatatatatgcacgtctagttatggctgaggatgcttttatctgtgcactaatgattcatagtttcaattttcaacaactggagatactgccatagtggccatctcatagacatatagagaactccatgattctagatacaacttgaatgtgcaattcgtattgctctcactatgaacgtttttgtagctcgattctaactccagatttgtagttcattcccgtcatttcaagggagctggtaacactcatcatttccgttcttcaaatatcgtatttctgtctagtccagcgtcgccttaattggccttctaagtggtagatgccgtcgtcattgttgtagtagatggtgcggtcgatgccatcgtatctgtcctagatggtacattgttgtcgtagatggtgcggtcgatgccatcgtatctgtcctagatggtatggtcgatgccattgtatctgtagcgtgctgattattcccttttacagttacagaaacctctaaagcaggaacaatagtggagtagtatatatttatacataactattatctgaactagatattttattttaagttgattatatgtgatttagagctagtagcttgctgtaccattaaactactctaaatacgagaagcacagaagaagagtcgttgccacactttgggtaattacgaaggaaagatcgtgagttgcgactgtcacgagcacgcggttcgaacgcgcgcgggtgctgacttggcgttgacctgtgaaattctctcgcttcactcgagtctcttggcccttgctcgaggcagactcatcgagcagcccaaagccccaaacgactgcgcgcgagcgatagaatggcgctgcgcctcgctgccgtaccagagagcgccgccgccgacctgagcgccgccgccaataccctgccgtgcatctcctaccgcgactcgatccggagcgtcgccgccgtcgtctccggcggccgagggcctctcttccagtccgaagattccgcctccacctggtcgtcttcctcctacgcgtccgactgctccggccactcctccggcgtctccgccgccgcggccgctggcttcagggcactcacggcgcacgagctcagggaggtcgcgcgtcgcatggtcgccgacggctacgcccagcgcatggtccaagcgttcgacgacgcggcgacggtcgaggtcctcgagggggaggtggttcttcgagctcgacgtcgactgggtcctccgaatccgcgaggggcaggggttacggcagctggagaagtcggccgcctcctccccgtcgtcgtcgccgctgcaagatctggtggagagtgacagattatgtcttgtttttactatatatttttaacatctatttttgagataatagttggctgccttaggatgtaaggcactagtaattttttgagataatagttggctgccttaggatgtaaggcactagtagttttccttaggatataagccactcctaatttttaggatgtaagccactaatctataccttatggtgtaagccactggcctatatatatatatccaaccagccatagttgattgagtggagaatagaaattaaactagcctcaaaacctgtgttccttttgctaacaattggtatcagagcaaggtttatctgacttccatcgactccccatccaaaaatgtctctccactccattcgttccccctctctctcgtcccatgcctcaagcacttccagcggacgaggcagcaggcggtcggcggccgacgctgagggcgacggcgatgcgactgctgttgcgcaggaggcgcgagcggctgcgcgggaagcgcgcacgacgcatgaggaagtggaggcacggctgcaggcagccacgagggcggcacgtctcgcggcggcagaagctgaagcagcacgcaccgcggaggcggccaggcaggctgcagctgtgttgatagaaaacacgaggcctgggagatctacttaactccggtgcaggtccaaagctcgccttcgaatgtatgagcgtgccagttgatttgatcctgtaatcaacaagaaatagagacaaagaattcgtggttaaatctataaatgatagccgatcggctaggtgccgatgtcatatatgaatcgatcggcggttataaatagaaagtaaggaactaaatctattcgatcggctgtagatattaacgatatatagttcttatattaatatatacttaaatcaagtgattgggatagatcggtcaccatgccgagacagtataaatcacttagatcgaaatatatattaataacaggattatatatgtttatagcatagccgatcagatagatctagcatgtatcggctaatactccgatactactttatataaagatatcaaaacaaatataatttaccaaacaaaagcttaatatacttaaatacaataagatcttgatataaagggcggatttaacatgtcattgaagcatatagatcgaatatggttaaatcagataagatcggctgaaactccgatactaccctaatcggcaaccataggacatgctagagattgatattctaagcacgacttaatagatcaaactcaactgatgcagcattaagtatgaaaagaagaacaatatctagacaatcaagccgctgggtgtttcataaagtggtagatatcttatataatctaggacaacgtcgctatttaacctaatcggctgccttctattaacagatgttagccgattgtaggttagatgacgatattgccaaagattatgtaagatatatgataacttgacgaattatatagacaaaattagagtgtcataatgatggaagcactaatctcgagaacacaagtcgtcataacaagttttacctcttgttgaagatcgaaaccgatgtagctcaacccgaaagtaagaactcgtcgaaacaaaactaaagcaaaaaggtggcgatgcgccaaaattgtattgaacatgtgtgttaaaaattacatagggctcggggtctatttatacccgagaattacaagatatgtccatactggacacgaccgctatctctaacaaactctaagataccataagtctttgcagcagacttttgcccaaacatatatctaaggaagttacataaaacatcctaattaatagatacaattgccttctcaggactctatccatgtgcggcaatcatcttgaagcacctcaattcaacccaatgtcatacaccaaattatactgtcagaatcggctgcatcggctcacctagtccgactcagacccagccgatcctaatcgtagccgatttggaattcagccgattattgctctgttctcggatcaatctccgccttcgactccaccttgatctaatctccttttccgactgttgttgcgcgggttgcgcaggaggcgcgagcggctgtgcgggaagcgcgcgcggcgcgtgaggaagcagaggcgcggctgcaggtagccacgagggcggcacgtctcgtggcagcagaagctgaagcagcacgcaccgcggaggccgccaggcaggctgcagctgctgctgctactttgcgagctgaggaggaggaggagcgacgtgacctggagctgacagacgcggcccgcgtgcgacgcgacgcggaccgggatcgacacataggccgacgtgatcgcgacttcagcccccatcgcagaggatcagatctccaccgcggtgaggaggagcggcgcgatccatggcgcgatcctcgaatcaaccgcgctctggagacccagcgactccgggagcaggcagcggcgattgaggcacaactggacttcgaccgggagcagggtggacgagacgttggcgcacggagccctcgcaggcagcgcgcctccccttccccggaccggcgccgtggtcgccgtggacgctccggctctcctcccgttgtgcagatcgtcgtcaaggatgttggcggcgcatggcccatgctcaccaagactaactacgccgagtgggcgatggtgatgaaggtgaagttgcaggcgcgccacatgtgggacgcggttcgatacggcgacgtcgactacggggaagatcggcgggcgttggaggtgctccttgctgctgttccgacggagatccagtcctccatcgcgagcaagcggaccgccaaggacgcctaggacgccatcgcttcggtacgcattggcagcgaccgcgcccgcaggtccacgcttcagaagctgcgtcaggattgggagaacctggccttcaagccgggttaggacatcgactactttgttctccgcctcaactccttgcaacagcggttggcgcagctcggcgacaccaccatcgatgaggagagagccgtggagaagctcctttgcgtcgtccccgagaagtacacgcagctggctctgtcgatcgagacgctgctggacttcaccgagctcacgaacgaagaggtgacaggtcgcctcaaggccgtcgacaaccgcaagcagctacctccctcagagccgatcaccattggtggcaagcttttcttcaccaaggagaagtggctcgcccgccaacaagagcggaagaagggggaggccacaagctcttcggcttcgggatcgtcgagcagccgcaagcgtcgaccacgcaagtgggagaaggcgcgtagtggcgctcttggcggcgccgatggcgagcgcaagggcagccgcaacgacacctgccacaactgcgggaagaccggccactgggccaaggactgccggcaggcgaagcacggcggtcaagcacacgtcgctcaagcgcaggagggtgatgaggtggctctgtttttcgtacacggaagcatcgagccacacttcactcccacaccggacgctaccgcgcccctccacctcgacgagctgtgggcccacgtcttcctcagcaacggatcctgcgacgacaagatcgacgggtggtgcctcgacactggtgccactcaccacatgaccgggcgacgggaattcttctccaagcttgactccagtgttcaaggctccgtcaagtttgaggacgcctcagccgtggagatcaagggcgtcggctccatcctcttcaccaccaagaccggcgagcaccggctgctcaccggtgtctactacatccccgcgctgaggaactccatcatcagtttgggacaactggatgagaacggcttgctcgtggagatagaggacggggtcttgcgggtttgggatcgccatcgtcgccttctcgtcaaggtgaacaggggtgccaaccgcctctatgttctccatgtacaggtggcgcagcccgtgtgccttgcagcccgccgcgacgatgatgcatggcggtggcacgagcgctttgggcacctcaacttcgaggccttgaagcagctcagcaacaaggagatggtgcagggcatgccacgagtcgagcacgtggagcagttttgcgacacctgcgtcctcaccaagcagcggcgactcccctttccccgccaagcaagtttctgcgccaaggagaagttggagctcgtgcacggcgacctctgcggtcccgtgactccggccacacctggaggccggcgcttcttcctgctgctcgtcgacgacgtgtcctgctacatgtgggtggtcctgctcgactccaaggcagtggctgcagacgccatcaagcaccatcaagttgctgcggagaaggagtgcggccgcaagcttcgggtgctacacaccgacaacggtggcgagttcacgacggctgagttcgcagcgtactgcgccgacgagaggatccagcgccacttctccgcgccatacaccccgcagcagaacggcgttgtggagcgccgcaaccagacagtggtggccactgcccgcgccctcctcaagcaaagagggatgccggcaatctactggggggaggcggtgatgactgccgtccatctcctcaaccgctcgcccaccaaggcccttgatggcaagacgtcgtacgaggcctggcacgggcgcaagccggtggtgagccacctccgcgtctttggctgtctcgccttcgccaaggagctcaaccacgtcggcaagctcaacgaccggagctcgccgggagtcttcatcggctatgcggagggtgtcaaggcctaccgcatcctcgacccttcgacgcagcacgtccgcatttctcgggacgtcgtgttcgacgaagggcgaggttgggcttcgtacaaggcggtggacgacggctcgacttcgactctcagagacttcgtcgtcgactacgtccactttagggcagccgggggagctagcagctcatcttcaccgagctcgtccacctcggcacccggctcgccatcagctccggcgagtcctctaccacctacaccaccagcaactcctccatcaccagctacgccccgctctcctacaccggcgcccacaccaccggtggagttcgccactccgttgtccaacgacgaggatcgtgttgatgcgtaccacgacgacgagcctctgcgctaccgcaccatggacaacatcttcggtgatcagcccgtccctggactggagacgcgcgacttcgaggccgagttgcacctggcgcatgaggacggcgagccctgctccttcgcagaggcgaatggagatgtggcatggcgcactgcgatgcagcacgagatggacgcggtcgagcggaactggacgtgggtgttggcagatcttcctgccagccaccgcgccatcacccttaagtgggtctacaagctcaagaaggatgaggccggggcggtgatcaagcacaaggcacgtctagtggcgcgcggcttcgttcagcaggagggagtcgactttgacgacgccttcgcgcccgttgcgcgaatggagtctgttcgtctgctcctcgcgctggcagcccaggaaggatggcgtgtgcaccacatggatgtcaagtccgccttcctcaacggagacctgaaggaggaggtctacgtccaccagccgccgggattcgtcatccccggcaaggagaacaaggttctccgcctgcgcaaggccctctacggcttgcggcaggccctctacgccaagctggactccactctcaagcaaatggggttccagcagaactctcacgaagctgctgtctaccagcggggcaaggacggcaatgccctgttggtaggcgtctacgtcgacgacttggtgatcaccggcaccaaggaggctgaggtggaggcgtttaaggaggagatgaaggcgactttccagatgagcgatttgggccttctctctttctacctggggatcgaggtccaccaggacagctctggcatctcccttcgccaaaccgcctacgccaagtgcatcgtcgagttgggcgggctcaccggctgcaacccagcgtacactcccatggaggaaaggttaaagctgagccgcgacagcacgctgagggaggtcgacgccacgcagtaccggcatattgtgggcagccttcgctacctcgtccacacgcggccagacttggcatttgctgttggctatgtcagccggttcatgcagcgaccgacgacagagcaccagcaggctgtcacgtcgagggcaccaccgactacggctttcactacccgaggtgtcccggtgcgcagcacttcatcgggtacagcgacagcgacctcgccggcgacagcgacacgagcaagagcaccagtggcacgctgttcttcctcggcaagtgcctgatcagctggcagtcggtcaagcaacaagtggtggccctgtctagttgcgaggcagagtacatcgctaccacaaccgcctcaactcaagctctctggttggctcggctgctgggtgatctcttgggcagaaacactgaagcagtggagctcaggatggacagcaagtccgctttggccttggcaaagaatcccgtcttccatgagcgcagcaagcacatccgcatcaagtatcatttcattcggagctgcttggaggaggggagcatcaaggccagctacattaacacccaggatcagctcgccgatcttctcaccaagtcccttgggcgggtcaagttccaggagtttcgcgccaggattggaatggttcaaattccccaaaaggcgccacacatgacttagggggagaatgacagattaagtcttgtttttactatatgcttttaacatctatttttggaataatagttggctgccttaggatgtaaaccactagtagttttccttaggatgtaagccactcctagtttcttaggatataagccactagcctatatatatatatatatatatatatatatatatatatatatatatatatatatatctgtgtgtgtgtgtatgtatccaaccagccatagttgattgagtggagaatagaaattaaactagccccaaaatctgtgttccttttgctaacaacgagccgacgccgtcgctcgcgcggttcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2048 - DNA, 6473 bp, Oryza sativa
  unsure (1)..(6473): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccaactgccaagcctgtactcctctccgttttttaaaggaaatcgtttagagcaagtactataatatctcatatgttgcccctaaaaatgccacattagattgggtgatgaggtagaggagagaagtggagagagagaagatgagccacccctaaatcaagagataacctccacacaaatttcaagaagtgtgtgagagtattagagatattggtatttgtgtgttagaggtgatacattgtatgtgttgcctcttaattcatgagtgaataaaatagataaatttagaggtgatagtcacatctaccatagcacttgcccttagaacagcgacacggtcttcaaaatataactttgacttcttgattctataaaaaaatatttattaaaaagatataacttttgacttcttgcttctataaaaaaacatttattaaaaagtaatatatgtatatttttatgaaagtatttttcaagacaaatctatttactcaacaacttaagagttatttataatttatatttttcaaggtttgacttgaaaattgtgctataggactttctttgagtagtggagtacgtaagatcgctatcacatttaggaatccgacccgcaagctctcatacggcgagctcatcgtgcataattaatcacgtcgatttgttgtgaaagctagtagcattaacacattctgttggcagttggcggctgtacggtcacgactcatgacacagtactcctagtcaaaccctctgttcaccagtccgtcggttcgatcggcgatcaaactacggttttgcttaaagataatactccgaaaatttatttctcgcctaaaaagatatttccatctttattttaatgaagttctaaagcctattcagatttgtgacattgaaccatatcattttttttaaaaaaaaaatcacaaacacgtggatgcatgatgtttgttaccaaatattaataatacctaacgaattttggtacaacatatttagcttatcctatcaaactttagcagtgtataggcgacttgctaattttaacattggcaaattctaaaaaatatttatattttagcagtaatctgaatatgcccatagtctatcattataaagcctataattcaaacaactaaatattacatattcacaatttgatgcataaaagaaatcaattggagcacgcaaggtatattgtatatttctactctacaataacaaagagctctatttccggcggagacaagatgccgcttcctcatgggagccctgtttttttccccctggttgaaccgtcggccaggtccagtattttcaacacccagtacccacatgaataccctgcactaccaccagaaatgagacggaccgataacgcccagtcccccacatgaataccctgcactaccaccaacacaccactcgtctcatttctggcctatatatcggaacatgtgtttcggtctagctaggcggtggacgcgcgcatgcccatgcaaaaccagctcagctcactacactacactttctctagctagctagcgcgcgacgggcgacgcagttaagccgcggcccacacgagatgaacgcggcgggtgcagacaccgacaccgtcctgcggaagcggcaactcaccgtccgcacgacgagcagcaacggcggcaatgggttccgggtcggcggcggcaagggggcggcggcggcgacgccgccggagcccgtcagcccctccgcgcggctcctggaggactttttcatcgtcgtggtgatcggcattgccacgccggtgaacgaccccgtcgcccgcgccggcatcgccgcccagttcgcgcgctacccacgcttccgcagcatccaggtcggtccgtgcacctgccttgccgcgcgcggcgcgcccatgagctcgccgctggtgcttgagctgacgaacggcacgagtgtgtgtgtgcgcgcgtgtgcaggtgacggatgaggacggcggcaacccgcggtgggtgcggacgacgctgaacgtggacgaccacatcatctacccggagctggacatggacgcggtggcggccgacccggacaaggcggtggaggactacgtggcgtcgctgtccaccaagcccatggacgagtcgcggccgctgtgggagttccacgtgctggacttcccgacgtcggaggcggcggccaccacggcgatccgcgtgcaccactccctcggggacggcatgtcgctgctcacgctcctcatggcatgcacccgcagcgccgccgacccggcgaggctgcccgccatgccgccgcagccgacgcgcaccggcgcgatctacgcgcggcccaggccgccggcgtcggcgggcgcgctggcgttcgctgcgtggctctggtcgttcgtcgcgctggcgtggcacaccgtggtggacgtcgcgagcttcttcgccacgaccatgttcctcaaggacccgcacacgctgttcaagcgggtgaagcacggggagttccagcggaagcgcatcgtgcaccgggggcttagctttgatgacgtcaagctcgtcaagaacgccatgaactgcgtaagcaatgttttctttagttcttagcgagcctgtttgtttgagtatagcggcatataaattgcagaaaactttaaaattaaaatttaagaatttcgtttttggtcactttctagcactactagaaaaatattccatccattccaaaatataaggcataaccacccctaactaaaagaccaagaaataattattatcatcttgtagtttggatcatcctaataaatacaatgcatgaatctaatagaattagggaacatgagagtgcatgattttaaaaaataataatttaatggagaaggggccatagttaattgcctacatgtatgcataccttatattatggaacatttaaaaaaaagtaattgtgctttatattatgaaatggagggagtaatttttagcaacattggtcttttatttttccagacgggtatgaccattggagccaaatagatgcctacaaaaatacaaatcgggcggaaacccactgcccgcctttcacaggcggaccatataagtggtccgcctgcaaaaatatggtccgcctgcgaaaatacatagcgaatacaaatagaggctacataccctagattttttctatgtcctctttccctcacctctcagctctctcccgcacctctccccacccctcacctctcctcctctccctggcgctgacggcggtgtagggcgcgcggcgtctaccattggaggcggcggcggagggcggtggccagcggccggagggcggggtgagggcggtggccacgagtgcggcggcggcggtggcgggaggttggcggcggcgagaggaagggggccgcgacgacgtcagaggaaccgatggcctggtcggcgcgcgcaaggagaggagcagccggcggccgtcggcgcctcgatgcgcgcaaggaggaggcggcggccaagaggagcggcggcggctctgggcaccaacttccttccccccagacgccgacggcggcggcggcgcagacagcaccggccactcccctcccagatctggacggaagaggggagccggccagcagcggcggcaaaggcggcgctcccctcgccctcgggtaacggcaccggacggaggtggagagccatcggccggaggaggatgccggcgccggcgggtagcgccggattttttttgttccctcgctttattttcgcaggcgggccatggacccgcatgcgaaaataacctattttcacaggcgatgggatagccgcggatgactcccccgcctgcgaaaacctttttggccgcctgtgtaaaaactatttttctagtagtgtagccttgatctaagattaggtactccactatattgactaggagtatgatattatctttgaccagtatctttttaaagaaaattacgttgttttgatgaacgtaaatagtatagttatatttagcatctaaaatgctttggtaatacaaatctttttacatatactcttttagaagtcatgtggtcaaagtatcctgctaacaagtgaaaaaagaacaaagggaatgtaaaaatttgagactaatgttttttcgttagtttggtcgagtgtcgctgtcttataaactgtactccgtaggtctttagcagtaaaaatatcttccacataggacctgctctctccgtctctgaaatagatttgtttatatttgtattattagaatatgtatgtcatattgtttattagattttttattttaaaatggataaaatattagtatacaaatatcattaaacacgaattttttttctgtctatcattttcgctccatttctatacttcacctgtttgcaagttgactgtagcaaaggacagagccctcagcaaaagctctggggagatttacgttgtgtttagttccaaaataatagatttacgttgtgtttagttccaaaataatttttcaaatttctaattttttcatcacatcaaaatttttctacacacaaactttcaactttttcatcacatcattctaatttcaattaaactttcaattttagctgcccttatttcattctctttatgtttgcctgcactctcgcagacagtcaatgatgtgctggttgggatcacgtactctgcactgtcacgatattactaacggaagtcaggtgaccaattttggctgatacagcagctgctgattggctgataactttttaagtccctatcacatcggatgtttgaacactaattataaatattaaatgtagactattaataaaacccatccataatcttggactaattcgcgagacgaatctattgagcctaattaatccatgattaacctatatgatgttacagtaaatattctctaattatagattaattaggcttaaaaattttgtctcgcgaattagctttcatttttgtaattagttttgtaagtagtctatatttaatactctaaattagtgtctaaatacagagactaaatttaaatctctggatcaaacaccaccttaaattgcggcctggctgatacagtagtactagttctttactcccatgttgcttgttctcctttgcaccacgttgcttgttctcctttgcaggtgacacggacactgacgaggatatacgtttgagaacgatcctccttgtcaatttgaggccaaccacaagcctgcatgtaataattacacttgggctcaagattggccatttaagctcacaggaccaaacattgttgttgctagtatatttgtagtggtagcaattttggactggtagaatctattatgatttctttcccatttctatggccacaggcatacgtagatatgatcaattctggcagagaggatgaagtgaaatggggaaacgcacttggtttcataatcctcccgttcttcataggcatgcacaaggatccactagactacgttcgtaaagccaagaaggttgttgataggaagaagagctcgttagaagtggtattcactcatttagctgcagaagtgatcctcaaactttttgggctcaaggtaaatttgtcctttatcgtaccatcgcctcatcaggaacttgatccttatattattaacttggcaggcaatgcgataatcactttgtttctattgacaagcactggtttaattcaaaaaacaatcgagaattcaggatactccaagtataactgaatacctgatttagtatttgctgcctaaccatgctaatttagttatcaagaaaatacaattcgtaggtgtacaagattgtgatattcactagaaattgtgtacagtcccagttgttggcagtggctaacttccttgtttcctagaaagagcattacaccgccaaattttgagtcatgcgccaaaaaaacatcccctgtggatttctttgttcctaatatcattgcaacttgtgaatcaaacaggcagcagctgctatcttccatcgtatga

SEQ ID NO: 2049 - DNA, 15226 bp, Oryza sativa
tcctgcagcccgacagggaagggtttttttgccactaaggaatgatgataccttgtttttgctatgagcatctcactgttgtgactagggctaaaaaacaaatgaatgacgaacgtcagaacatgcgatgatccttggcttagtggcaaaaacagtatgaaaaaaaaaaacccaaaaaattcccatgaaatatagcctggtagctgtctaccatatatcattaagtcatcgcgaaaataaggtaatctgactgaaactaattgctttgatccgttgaaaaaagaagtaattaagcccttgtatgacacttttataacaaggataacaagtgcatagtgatgaataatccttcagcgttgtagatggtgaaagtatttttttcactttgtcatggaatctgggtacagatgtgatgagcaagacctaatttacatctaactgtttggtttgcttgtgtaggccttaaccgtgaattttcaaagttacgttaacaccatgatggtaaatcttgccgtggacgaggcacaatttccagattgtcatgagcttttggatgatttttccgaatccctcaggcagataaaggatgcagctttgagcctaggaaagcatcacaccaaggcttaaggcactacttaatcattgcacacatgcatgtattcgtaagaatgattgtaccccctccgtactcgtaaaggaagtcgtttaggataatatttaagtcaaaccttgaaaatataaatcataaataactctcaaattgttgagtttgaaaagtgatataaataactctcaaattgttgagtttgaataaaattatcttgaaaaatactttcataaaagcatacatatatcacttttcaataaatatttttatagaaacaagaagttaaagttgtgctttatagaccgtgtcgctgtcctaaacgacttcctttacgagtacggagggagtaccatccaaatatctaatactactggtaagtggtatctatttgtatgcactgtagcaactaaatctaaagtcaaatgaaaccatcagatgttttatgatcagaagtttccagagaacaagctctggcttttggttaaatattctctgaaaaaataagaataaatggtggtctgctatgctttactttgcttaccatgtgtaacgtacgtgtagcatagtaaagtaaatgcccagatattactcatcttcttcaaagtccataagaaaatcagtcaagttctcagaatctgcaatagcttcttttagtgacagttgatctttcttcgagttttccgtgagttactgagttgtgatcactgacgaatgtatccattacgacagggtacgttacgtgcttggagtgggagttgatacagttacaaactctatgcatgcattagacacttccatgaattttctaaaccatatgcacatgattaggcaagactcatgaataggactggcaagaatgctacacgctcagcatttgttagtgccaaaaggctgcacttttttccattagaacacaactgataataatgaaaaggtacctttggcttttcagaatgtccggcagtctttagaacactccaattacgactgaccttcccttcagcatcctcagcatcatccccatcatcttcatcatcctattggtaaagcagtataatacaaaggaatgacaagctttcaagtaggacaagtatcgataactacgaaagggcatatagcctagtggttacagtgacctgagtagtaccccaaagtcctgagttcaaatctcctatggagcgaatttcagattaggttgtttgcggggctaagttccctatttcaatggccgtatatatccattggatgtagaggccgggtaaaaaaatacccttgagttcaaatctcctatggagcgaaaatttcagattgggtttgcggggctaagttccctgtctcatcaataaatcaactatttccatgtgtactgcaagagaggcattcagcctccaataagcatgtgtatatgaactgaaagatctgttgtcactgccagtaataagaagaaatttgcaaggctaatttgagaaccgcagattgcatgcatttccatcaagtaaacagtacagtattatacctctagtgactcaggctgcgcaacaactttgtcagcatcctcatcatcactatcttcgttgtattatttgaaaagtagagaacatcacagtgaaatgcgcataagtttgtatggagaagcttgtatgtaatctacattactttgcagttatgaacccaaagaaacagactcgttaaacaattctagcatttataagacaaattgggaaggaaggtaaatgatctatacgtcctcgttaaacaaagcagtctttggaagagagagggtggttgagaagtaagatggggagaaatttaaattgacagtagttggagtgagaagtactccctccagtttcaaaaataatcttaacgttttagacatgatctcatatacaaggagggatttatttgggtgcctattctctattatgcccatattaaatacggtagtttgcatattatacttgaaattctaagagcaagtataatagtaggctataagccgactaaatgctgatgttgaggagagaagaagtgggctgtaaacttacaaccgacttggacataagaaccaagaaactctatgagagaatcaagtgagccctatattaattgtaaagagctaactattatatgggtgggtgagagaagaccacaaaaaaccttatagccaaaaggtcggctgtattagagcaggtacaatagcaggctataagccagctataaacatattttaaggagataaataaggagagagaagagcagcggactacagatttatagtcagctgtagcacgaactcgaatgagctattagattgactataaatgaattggagctagtagttggctatactattaaacttaaacttgttcctattagccttgctctaatgtagtctagtggattgagtccaccattgaattttgtgcatgtggggatcgaagcattgccatccctgggaatgtatgtatacatgcaagggctaataagtctttggtgaccaagtaaatctcaaaatgtctaacagttttgaaaccggagggagtagtactttaggatagtatttttaataaaatttaggaaataaagtctatttattccacaaactttttcactagagttcttaacccctgactctttttttgggcttattttatactccctctgtcaaaaaaaacttaacctaggagatgatgtgacagagaagttgtctagattcgttgtactatgagggtcgcatcttctcctaggttgagtatttttgagacggagggagtaagtctcttaaggttcacactttcattgaagggtcaagatgctagtgctaggccagtgatatgacgaatttcataaattttgataaatttcatttgaaattcaattaaaaaaactcaagtggttttggagagctccagatttcgggagacaaatttccaacaaatcccgaggcctccttctaggacgttgagacataagcatgcatggaggccaagcatatagtatgctctgtaaaacacatttgctcttgtactgtactccttgtactcactctagctagtcacaaatatttaatattcagaacaatatttgattaagtttttaaaaattctaatcataaattttaaactagaataaatttataaaaactaataataggtttatgctattagaatagtatttttcaagacaattttttatgacaaattttgctataggacacttcaaattgtgtaatttgttggtagatatcttacccgagaaagaattgaagatgaaatatgatatatgctctagtgatgtatttatggtagtggcagatttagagttccataaattctaaatttttactccaacaccatgtttgaagcaagtgaccctagggggatatattattgtctatttgaagaacttctctctccaatcgagtcagaagtgtcattttcagcaaatcactaattttctaggatgtcttttagccatgacacgtttttacaatatctatcagtaaattatacatatttctgatgtcttgtagcaaaatttgtcgattttcttataccctatttttaaaagctgtaattgagaaattgtagatggctagaatttaaaattaaaatattcaatatttataaccagatggagtacctagtaactccgtatttcgtttgcgcgtagtaacacgaattgtcgttgattctagttgaaaggaacacaatcacaccgcaggcacacgggtgtttgcctgcgaattaattatatatcgttgggccgttcatggatttttcgtgtcccacaatgaagctggcagatatttgcactccaaagatgcactagcaattaattaaggaaacacaagaagcctcacgcctgcggagctacataagccctttagtttagatttataagccaatttataagtcgaaaagtctaaacctaaacaaacaagcagcttttccgtttggcttgtttgaagccacaagccactttaacactattaagccaaaagctaggttggagaagcttttttggcttatgtgaggtagatgtatgactcaaccactaaacttaggacattaaatccattgtcttataaatcatataagccaataagttaacttaaaagtctaggccaataaacctaagcctaaataaagagggccataataaaatctccgtttgccatggcatgaactgtgtacatattaaatcatgtaggtgattggtagcagtatagatcagtctgagagacttgagcatatatggacgatgtacgcgttaattaacattagtacgttcacaaatacgagtacacctggcacacggcacagtggtacatcattcaagtcatttctatactccctctggttctataataagatgttttggaagatcaaacttttataaatttgaccatcaataactttaaaaatatttagtttaaagaaactagaacaacgtatagattgtctttcaaagcaatataataaaagtaaacatgtatttatttattgtgtatattataataggaaaataaggtcaaaaatatattttgtaaaccgtgttattgtctaaaacttcaattaaaatgaaacctgaggagtatatatcacgtcattaataagaaatctcgaaccatctaggcaagttttgaccaactgccattggacaccatcgcctgaatgtaagatcgctatcacatttaggaatccgacccgcaagctcgcatccggcgagctcatcgtgcataattaatcacgtcgatttgtcgtgaaagctagtagcattaacacattccgttggcagttggcggctgtacggtcacgactcatgacacagttctcctagtcaaccctctgtcaccagtccatcggttcgatcggtgatgaaactacggttttgctttaataagataataaaatttatttctcgccgagaaaaatatttccatccttatttcaatgaagttctagagcctattcagatttgtgacattgaaccatatcatttaaaaaaaacacaaacacgtggatgatgaagtttgttaccaaacattaataacgcctaaagaattttgataacaatatatttagcttatcctattaaactttagcaatatagtcaacttgctaattttaacatcggcaaattctaaaaaatatttatattttagcagtaatcggaatatgcccatagtctatcattatagagcatataattcgaacaactaaatattacatattcacaatttgatgcataaaagaaatcaattgggccggtgtttagttacaaatatttttttcaaccttccaacttttcaatcacatcaaaactttcctacacacacaaactttcaacttttctgtcacatcgttctaatttcaaccaaactttcaattttggtgtgaactaaacacagactggatcacgcaatgtatattgtatatctctactctacaacaacaaagagctctatttccggcggagacaagatgccgcttcctcacgggagccctgtttttttttcccctggttgaatcgtcggccctggtcacggacggatgacgcgcgcccagtccccacatgaataccctgcactaccaccaacacaacgctcgtctcatttctggcctatatatcggaacaggtttctcggtctagctaggcggtggacgcgcgcattgcccatgcaaaaccagctcactacactacactttctctagctagcgcgacgcagttaagccgcggcccacacgagatggacgcgggtgcaggcgcagccaccgcccttcggaagcggcaactcaccgtccgcacgacgagcagcaacggcggcaatgggttccgggtcggcgacggcggcggcggcggcagcaagggggctgcggcggcgacgccgccggagcccgtcagcccctccgcgcggctcgtggaggacttcttcatcgtcgtggtgatcggcatcgccacgccggtgaacgaccccgtcgcccgcgccggcatcgccgcccagctcgcgcgctacccacgcttccgcagcatccaggtcggtccgtacacctgccgtaccgcgggcggcgcgcccaggagctcgccactggtgcttgggctgatctgacgaacggtacgtacgtgtgtgtgcgtgtgcaggtgacggatgaggacggcggcaacccgcggtgggtgcggacgacggtgaacctggacgaccacatcatctacccggagttggacatggacgcggtggcggccgacccggacaaggcggtggaggactacgtggcgtcgctgtccaccaagcccatggacgagtcgcggccgctgtgggagttccacgtgctggacttcccgacgtccgaggcggcggccaccacggcgatccgcgtgcaccactccctcggggacggcatgtcgctgctcacgctcctcatggcgtgcacgcgcagcgccgccgacccggcaaggctgcccgccatgccgccgctgccgacgcgcgccggcgcgatctacgcgcggcccaggccgccggcgtcggcgggcgcgctggcgttcgccgcgtggctctggtcgttcgtcgcgctggcgtggcacaccgtggtggacgtcgcgagcttcttcgccacgaccatgttcctcaaggatccgcacacgctgttcaagcgggtgaagcacggggagttccagcggaagcgcatcgtgcaccgggggcttagccttgatgacgtcaagctcgtcaagaacgccatgaactgcgtaagcgatgttttctttagttcttagagagcctgtttgtttgagtatatagcggcatataaattgcagaaaactttaaaattaaaattttagaattgatttacggaatttcgttttttgtcactttctagccttgatctaagattagaagtactccactatattgactagtatgatattatctttgaccagtatctttttaaataaaattacgatgtttttatgaacttaaatagtatagttatatttagcatgcaaaatgctttgataatacaaatttttttacatatactcttttagaagtcatgtagtcaaagtatcctgctaacaagtgaaaaaagaaaaaagagagtataaaatttttaagactaatggtttttcgttagtttggtctagtgttgctgtcttataaactgtcggtctgtagaagtaataatatcttccacataggacctactctctccgtctctataatagatttttttagattcgtattcctagattatgccatatcgattatcagattttttattttaaaatggataaaatattagtatacataatcattaaacacgaatttttttctgtctatcattttccctccatttctatacttcacctgcttgcaaattgaatgtagcaaaggacagaaccctcagcaaaagttctggggagatttatttcctctctttatgtttgcctgcactctcgcagacggtcaatgatgtgctggttgggatcacgtactctgcactgtcgcgctattactaccggaagtcaggtgaccaattgcgtccaataaaatcatgctccagcagctgctgcctggctgatacagtagctcttaaattgcggcctggctgatacagtagttctttactcccacgctgcttgttctcctttgcaggtgacatggacactgacgaggatatacgtttgagatcgatcctccttgtcaatttgaggccaaccacaagcctgcatgtaataattatacttggattcaagattggcaatttaagctcacaggaccgaacattgttgttgctatacttgtagtggtagcaattttggactggtaaaatctattgtgatttctttcccatttcaatggccaggcatacgtagatatgatcaattctggcagagaggatgaagtgaaatggggaaatgcacttggtttcataatcctcccgttcttcataggcgtgcacaaagatccactagactacgttcggaaagcaaagaaggttgttgataggaagaagagctcattagaagtggtattcactcatttagctgcagaagtgatcctcaaactttttgggctcaaggtaaatttgtcctttattgtactatcgcctcatcagcaacttgatccttatattattatcttggcaggcaatgcgataatcactttgtttctattgacaagcactggtttagttcacaaaacaatagatttcaggatactccaagtataactgaatacctgatttagtatttgctgtctaaccatgctaatttagttatcaagaaaatacaatcgtaggtgtacaagattgtgatattcactagaaattgtgtacagtcccagttgttggcagtggttaacttccttgtttcctagaaagagcattacagcgccaaattttgagccatgcgccaaaaaacatcccctgtggatttctttgttcccaatatcattgcaacttgtgaatcaaacaggcagcagctgctatcttccatcgtatgatctctcatactaccatatcattctccaacatgatcggcccagttgaacaggtggagttttgtgggcatccagttgtcttcattgcccctagcggctatggacctccagaagtaagttccctgaaatgtatatttgccctagaattaaataattgcattaacttgttagtatgtcagatcctcaaatctatgacagggaagggtttttttgccactaaggaatgatgataccttgtttttgctatgagcatctcacttttgtcactagggctaaaaaacaaatgaatgacgaacgtcagaacatgcgatgatccttggcttagtggcaaaaacagtatgaaaaaaaaaaacccaaaaaattcccatgaaatatagcctggtagctgtctaccatatatcattaagtcatcgcgaaaataaggtaatctgactgaaactaattgctttgatccgttgaaaaaagaagtaattaagcccttgtatgacacttttataacaaggataacaagtgcatagtgatgaataatccttcagcgttgtagatggtgaaagtatttttttcactttgtcatggaatctcggtacagatgcgattagcaagacgtagtttacatctaaatgtttggtttgcttgtgcaggccttaaccgtgaattttcaaagttacgttaacaccatgatggtaaatcttgccgtggacgaggcacaatttccagattgtcatgagcttttggatgatttttccgaatccctcaggcagataaaggatgcagctttgagcctaggaaagcatcacacgaaggcttaaggcactatttaatcattgcacacaggcatgtattcgtaagaatgattgtaccatccaaatatcaaatactactggcaagtggtatctatttgtatgcactgtagcaactaaacctaaagtcaaatgactagataaaaaccatcagatgctttatgatcagaagtttccagagaacaagctctggcttttggttaaatattctctgaaaaattaagaataaatggtagtctgctatgctttactttgcttaccatgtgtaacgtgcagcatagtaaagtaaatgcccagatattactcatcttcttcgaagtccataagaaaatcagtcaagttctcagaatctgcaatagcttcttttagcgacagttgatctttcttcgacttttcctagaaaaacggaaagaaataagcagtcatccgtgagttactgagttgtgatcactgacgaatgtatcctttacgacagggtacgttacgtgcttggagtgggagttgatacagttacaaactctatgcatgcattagacacttccatgaatttacacaaaattaaaccatatgcacataattaggcaagatagtgaataggactgctggactggcaagaatgctactcgctcagcatttattaatgccaaaaggctgaactttttccattagaacagaactgataataatgaaaaggtacctttggattttcagcctgtccggtagtttttagaacactccaattacgactgaccttcccttcagcatcctcagcatcatcaccatcatcttcatcatcctattggtaaagcagtataatacaaaggaatgacaagctttcaagtaggacaagtatcgataactatctcatcaataaatcaactatttccatgcacagcaagagaggcattcagcttccaataagcatgtatatgaactgaaagatctgttgtcattgccagtaataagaagaaattcgcaaggctacattgagaatcgcagattgcatgcatttccatcaagtaaacagtacagtattatacctctagtgactcaggctgcgcaacaactttgtcagcatcctcctcatcgtcatcactatcttcgttgtactatttgaaaagtagaaaacatcacagtgaaatgcgcgtaagtttgtatggagaagcttttatataatctagcattactttgcagttatgaacccaaagaaacagaatttacattttttttatttctcctgtactgagaggttttggtaaaaaatagaagcatttaggatggatactcacagaatgctccccaatatcaacagcagtagccatgggatctctgacttcaggaagatactgtcaagaaggtaagacaggataagtaaaagaggtatttgtgatgcctattctcaacattcaattaataccaaaccagagttacagttaaacgtataccgtaatgtcctgattgatgtcttccatctcttcatttaaacgggcatatagctcttcctttgttatcattataccatgcttaaaaggggaaaggcgatatatcatgttagagcttcatcagtcctattagcagcttagcgccagttgtcgcatgactggcattgttagtactgtgctatactattgtactgttataaataacaacaggtaacatatacttatgcagccatggctttccaaatcaataaccatacatcgtcatgaatccagtaaattttaggcagcacattgtgaaatactataagttgtgtggaagcactacgacatacctccatcaagtaaggtacaacttcaggtgtaggctcatgaaattctggacccctgtagtccgctacttcgtcaggatcatgaacgtagttaatggttgggtaaacaggatcaccaccccaaactgcatattttaatatggaaagattattcccatgtaaactgcaccagggtatacctgaaatacttgtttgaatatactagttgtaaacatttctaatagaccattttaggtgcatttatacagaaacaatgtagatatcataaaaatacaaacagtcacaacagtgccacgtgaaactggagaaaacatgtcatgttgtgttcaaacccagtgacttccgttccaggatcatgccagtctataagcaggacaggaaacaaagtttggtttgtcatatttatttcaaaaacaaaccatagaagttaacaagtagtttggatgttccaaatatattctcaggtaaatgccaacactacttctgtgctaagttaagatcataatatgtgctcaatttccaggatttatcatacaatatattttaacagaataaatacgattaaagaaagaagctattgtaggatggaccatgtataaattcagcaaaagcggcttgtagatgtcaataatataaaatgatcaggattgagaaaagaagatatactctgtttgatctggtcttcccgcatcctcattgccaaaggatctcgttgtatgcgaacatcagtgcccatcatgatacggaattccccagcagtttggtgttgaaacattgttataagttgagtattctcatcttcgccagtctcctcaaagtgtttctgtacagcttctcgtgaagtgtctttgtttttatacgcttcaacccattccgaatagtatgctattggccctatttcttctagtctcctttgttctgcttctaacctgtgttttcattgtatatccaatataagaatggacggaaggcaagatagaactatataccttaagaatactgtgaaaatatcatgttgaaaggacgttgtgtcaatatttttttctgctgtcataacaagtaacattgaagtacaaaccagcaggtaggcaactagacataataacatccatcaaatatttgttataaatcaacgaggggataccaaaggtcagttaaagagtctacataagcttaaagagtatcattgcacatatggtgaagatattaaaattaaaagcacggttttcacatatggtgaagacccacgaaaagcaaaatcactaaattttgagaaaataatttctagtattcagccaacctttcctctttgaataaatgtcttcttgccttggcaagagcagcttctgttctggtagggtggtccccaaatattttgatctgcccagtttctgccattgcttttgcaaagacctacaataatgaaatgagtgttacaatttaaattataactgacaagacacagagctgtaagttagaagaaacactaatctgaataatgaaaaaggttaaaaacatcaaccaacaatatagattaaattgataagccatgtataggaaatgccacatctgcaagctgtgcacgtgtatctaccaggtggtggatttagtatgggggaataggcgttcaactgagccacacagcttttaggattcgtggaatagagatgaccccagaagatccttataaatgttaccagtctaggctaatgaagaacctaattctgtctgaacccaagatatatggttaagtatttcatctcattttgaactcccagaataaaaataccagctcatcactgtgtacactactctgcttgcatcttttatacactagaagatgcatacgatgatcatgacgacattgtgtggcttctggaaatattagcactacaaacactatactttggttggatattttggcacacacaaaactacatgtactccctccgtcccaaaaatataagaacctagtaccgaatgggatgtgtccaaccaaagtatatagtatcctgcgtcccatccaatactaggttcttatattttgggacagagggagtactaccttagtgtttgtgccttgtgctatcaaaatagggtatacgaagactagcatacaaacaattgaaaccctcaaaattgtggtgtggacatgcagcaggaggagtggagaataagaaccatactgtgtacatcatattcgctactaggttatgttaacaagtgacaataggcagaaaaacttaagtaaaaaagacttataagtcatttattaagttcaaaccaatcaagaactaaccgtgtcaacatctggacgcctcctctgccatcttgaccacatttcattttcctcagacttcctcctccagttccaccacagctcttcactagattttggttcccctacagacattgccttctgcgggtcaacgaacgggtgtggccgtcccatcatcttgtccatctcatattcactcaaattttcttccttgggcatctcataaacgacgtactcatccaatgaatcctttgtctcctccagtgtctcatctgatgaggcctcaatggccacaaccgactctccctcatctccactggtctccgtgcctctccctgccgtcgctgatgctacctgctccttgtaccctttccttctactcccgggcttcttaccaaacgacggtgtcccagctgattccccgaccggtgcaggtgcacgggcagcgcgtacgcgggatgcagtgccctccggccagtactcctgcccaggtatgcttgcccgagcacccgacgccggctcgagctggcccgacgtggagtcgaagtaactggagtacggtggcgcctcgatcttagatggatcaaaatggagcgagtcgtccttgacgctcctgatcctgcctcttcgcgttctgctcgacacaccagaaaacagcacccttctccggtgaggcaatccagcaaacaccttctgcgcacgcaccaaacacaaatcaaaataaaaaaatactcagcacccatgacaactgggagcacgggaacgcggtaaaatttcagcaattttctcgggcattccgatgggggaggagttaccaaggactggagggggcgaggaacagtctgggcggtggcctgcggcgccatgcctgcggagtattggagggaggtgagttcgcttgagccgtgcgaattggcggttggaaatgaggggcgagaggtcacctgggaggagccaagtgcgggagcacgacgccatggctccgcctccgatgctgcggttggaacccgaggtggacgagagagagctaggggagggaagcggatgggttgagctccatggacgcgcaccgaagttcaggtagccggtttggtcttcggaaggggacaggataacaaggagaggttttcgaagaggaacacggggtttatccggtggacttcaaattcgaattttttttatttataattttttttattaaaagttttacaaaaataattttccattttgaaaattgacggaaatagtcgcctacagccctctggga

SEQ ID NO: 2050 - DNA, 1154 bp, Oryza sativa
gggcatggaatttagcagatggcccccttgccgccctgggggagggcgatttttgcctcccccctataaagcccagcccctcccctgtgaaatttcattatattcactaaaaatccaaaaaaacgaaagagagagagaggggagggcagcagaagggaagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttgagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagaac

SEQ ID NO: 2051 - DNA, 746 bp, Oryza sativa
tccacctcctgtgggtgtcgaagtcgcggatccttcggccctctcgagcgccttctcccgcctaggactttggcgtggagggggcgtgggagtacgagctcgacggcgtgggtttggctcccgcgcaccgtcatactggggaagaggtcgggcgcctttgctggctcggccattgggctgaacaagaaaagcttggcgcacacgaaagagtgcgagagctcagaaaatccctcgcagagccccctacctggcgcgccagatgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccactgagaagcgtaataccctactcctgtgttttgggagatctgtgtatgaaggagctacaaagtatcagccagcctctcccttgttctgggtttctaatctggaaaagtccagtcccccctctcagtgggcaagttcctccttttatatcttaaggggacaccacatgcaccatttctctcttttttgtggggacttacccccccttttcataaatggacggagatttgtatagttgccgtccgagtcaccttctgatgagacggcccacaactacctccactttcgccgggagcaggtgcgacggggaattggggctgtctggtgacaaca

SEQ ID NO: 2052 - DNA, 9340 bp, Oryza sativa
gcaaattgcctcttagatcaggagttttatagtgtagagacattttatagaggcattttaaaaaatgtctagaaaacttttactctacagacactttagaaatattttcagcatattttattagattttatattgtagaggtattctttcggcactttaaactgtgcctgatatataaaggcattttcttaagactttgtaaggcacttcttagaataaaagtatgtaataaatgattaaatataagtaactcaagacaacaacatataagtaatgacttggggttgagttggttagtgccttgaagataagaatgaattgtgcaattgatcatgagttcaaggattgtcgaaaaacaagggaaaatattttatttttttacattggtttcatatggttgtgacacaatttaatgtctctataaaatgcctctaccatcttatagacattttgtaaaatgcctcttcgtttgtagagacaattcaccgtaagacacttattatgcattttttaaaatgcctctatagtattataaaggcatttgaaaagtatctctatagtactagaaaaatgcttcgtagaggcatttttgttgtagtgatatactttaatatatacatatagttttacatatttcacaaaaatttttgaataagacgaacggtcaaacatatttaaaaaagttaatggcgtcaaacatataagtaaggagggagtagctattagttagctctactattaaatatatgctccaatgagtcgacatttaaagcatccgcagccactcagttaatgacagagctatatatgtgatgatgtctactttcgatgtttacttccttcattttaaaataaactaatctattacaggttttcttttgataagatttagtataatattaaaatatatcataaattatattaaatttatttattgcggaaaagagagcctatatgactggaggatagacggagagacaagagctagccagcgcacaagtagtcgacggccaactttatctcgccaaaaagatggacagagggagtattaaatatatacttcaatgagtcaacatttagagcatccatagtataataggtcagtcagctaaggacagagctatcaactatgtctacttccgatgatgtttactttctccatttttaaatgaactaacctagtattacatatattaattgtctcgatcagatttagtataatattaagatgtgtcacaaattatattaaatttgtttattttggaacagagagcctctgcgactaggatggacacagaggagctagccggcgcacatgcagtcgacggccaactacatctcggcaaaaaatctaatacaacactttaattatgttggctaacagaattgcccatgtccgtgggcctcctgatgtctcgtgcatctcttccttccacgattcttgaaaaaccagaggtcccagatgattatgattcatgatctgtgacaaaccgagtgttggcaataccaccgaatgactaaaagtggcttttgctagtagaattaagtaggtcgtgctttccgttttttcagatgatcaaaatccctttttacatgtggccaggtatatgcgaaaatcacatttttctacgtggctagtgcaaccgcgggcaaaaacatgcagtcacaaatgccgaccacctcaaaaaaaaaatgaaaaatgaaaataaaaatattccacaaaaccaaatcagccgaaacccccagcgcagcctaccgccagctgaaaccctaactctccaagccgacatcgtcgtcgccactaccaccaccaccgtcattgctgtcatcgtgttcaccgtagtccgccatcatcgtcactgcagcggtcaatgcctcttctgaggccaatggcaataaatctgtagcacccaagtccggcaccgcccgatacaccgtcgtcatcaccgtaattgtagttgtagtcgatagatccatccgtcccgttgtcattggggacagatctggacgccgcaaggtcgctagtggtggatccgcccgccccacggtcacaggcaatagatccacccaacctgcccaagccatgattgtcgtcgtggtcaccgtagtccagcatcgttgttaccgcagctgtcaacgcgccgatggcgacagatccaccactcccgagtccagcgctgccggatccaccgtcaccgtcgtcgatggatccaccagtctcgcagtcgtcggggatggatctagatgccacaaggtcactggcggtggatccgccagcctcgcggtcgctagtgactgatccacccatcccgaggtcgtcggtgatgatccgggcgtcgcgagtcgccgacgccagcactggacgcaggcagtgcatccggctaccccgctcccgtgcccgtgttgaagccgctatcgccactccctttctctcgtgagggaaccattgacgccgctgcctccatgcttgcgtgatggagccgtcgacgcaaccgccgcctttgtcacctcccggagcgcttgcctttgcgggccacgaagtggatcggaggagaggattggtggagtaggaagaggagaggatgagggaggagaggaaaaaaaaaaggataggataagtagaggatgtttttttaaaggtgaagagagtgaggcgtgcgattggctggtggactggtggcaagatggcctcttaacaggctcacatgcgaaaataggtttattttcgcaggtgattcttgaaccttccttggaagccgaatttttgcatacggggacggttatggctcgcctacaccctatattatgtctcgtccagaaaataaattatgtagtagtggaagaaattcagggaaaaaaaggagaaaaatgtgaaaataacttcaacataatcgatttttcaagacgagaaatcctcaaggttggcagaccataattgcccttgtatgcaaaaatcgctcccctaaggacggtttaaggactacatgtgaaaatttcatatttttcggagatgggccttttaacaggcccgcctatggaaataaacctattttcacaagtgggcctgttaagaggcccactgttcagtagccctctaagtcgagctcatccttaaaatatctaagtcctctctctctcctcatcctcatcctctccactccacccctcctttcccccacttcctcttctctccaccttatctccctcaccttatcctagtccctctttctcggtagaagcttgacgtcaatgatagtttaatgtgcggaggcaggtccggtggtgtggcgcacgtcgaagacaagaacgggggcggcaccggcctcggcagttctgccaccaatggtgacaggagggatggatccacctttgttggacttgggagcaactggcctccctctcgcctctcccactccatcatcaacccagcggtggcatcctcaagaggtgtggctcctccgccgtcggactcggaagcagtcgaactctcttgcctcttcctccccgtcgtcaatccggcagcagtgggggcggccttgagaggagaggatccacaaccaccagactcaggagtggctggcctctcttgcctttccttctttatcgtcgatttggcggcaatagcagtagaagggctagatccaccgtcgcgggactcgggagcggcaacgggggctcaggctgggcgtgatgaggacatcactagctcggatatgaccatggttatcttatgtattcatcaagcaaaggtgcatgctttctaggtgggatttacgtgttatatattggaacaaacattattgtattatgagttccgtgtgttctcatttgtagaggtgcttgcttggtgaaagggaaagataccgagaacaaggaatacatggatgatctaagaagttgattgaggaagaaaccaaaaccttcctcaagtctactccaacattaccatgttatttttggttcataaaaggcaagagatgaagttctgcacgttttggattcaaattcgggcctcctgacaatattaactttaaacaaacctagccactgatccagaaggaccctaggggtccatgagttctttttggaaagattatagagtctgctttcagatggttttagtcccacatcaaaattcctattgagctatagggaatatgcaaaacaagtcatgtacctcatacaatcttagtctgatttgggcgttgggacttgtacttgtcgtgggctaagcccaaggggtggaaaaaccctaggatgtctctaatcatatttattccatagccgtcataatttagagtcgggttttgcttgaattatttctggtactatagtttcgatgttcattggtttgtggaacccaaatttcgagttcttaatcattcatctgcatttctattgcaatattttttgttcttgcttgtgtctttgattcacacaccgtgattagccttctcgatgaagtcaattgggtttcggcatggttgataaccagaggaggcgtggtgctaaaattgcatggttcagatcgtattgattggaagccaaatcgtgtgtgtcaagtttccgccaaattaagagttatcaatacctatcagaagattgagacctaattagttaacgggaatccactgccagcgcccacaggagcgacagatccggcccagtcccattggggacaccgggaaaggtggtggcaattttgactgcgacgatgacggccaacaacacgttattgggcagcaaagactagtccctccactccgacgagggaggcagaggagcttgcttgagtctatggcaatattcatggtgacgacgacggcaagagtacagcggcggcatggttggattgggtaggctttctggattttggtttttttgaaattcttattttagttttgccatttttttccatgcagttggcataaggagccacattttcacatgtggttcagctggccgcctggaaaattactctctttcgcagactcctactggtaggcgtgcactttgtcacaccctgaagttcttctcccaagcctaaatcatatttataaatgacctcgagaatttatctgtgtaacagcaaaagagaaaccctaatttaataaatgcaaataataatcagaattggcctgtggaatttttcttggtttctacatgtcaaaataagctaacatgatttttagtggaattttcagagctctataaataattttaaccaattaaaaatgagcataagcaattattaaatccctggaaaatcccttttctttttttcctttttccctttttcttcgaatgagcagtcggcccattctccccttccctccccgtgcgctagctgggccgctgcccgtgccccctcccctctctgggtcaccgacaggtggggcccacctgtcgggcccgtcccctacctccggccggcaccgcccgcgcccgcaaccgtcgccgcccgcctctcccgtgcgcctcgcgcacgtcgtccgctccccgcgccctctcccgtacatcccgcaaccgccgtcccacttctcccgcgcgttcacaccaagaaacggctgggattctaatttcgaatcccgccggccccctctctttccaccttccccacttcgccggcaaatccatgccactcccagccacctctcacctccccagccctatataaagcacaccctcccccttctccacatttttccctctttcgccatctgctccccagctctcctctgccctagcgccgcgcaccacttgccgccgccgctttagccacctccggcccccgctcgccgctgttagagccgccgccgtccggttcacaagcctgagggccacgccgtccaccccttccccgtccaatttcgccactggagcccgccgtcctcacgcgccggtgagcccctccattgccgccgccttcggcaggcatctccgcccgttttgctccccctctccctctctaatccctctcgtttgtttccttaggtcgtcccggagctcgtcccgccgtcgccatcgccctccaccgctcgctgtcgtcgaccgtcgtcggtaaggcctcccctttttccccctctctctctcgcgtcgccgcttagccgcctagctctcgcgccaccgcctagccgcgtcgccgccgctcgtcgcctcgcgctgccgccgcgcgctaggtccgctgggccggcttaagccgcccgcgcgtccgcccggccgcgcgccgcctccgccgtcctatctaccctcgggtagatcggggccgtccgttgctgcctgcgtggcagcccatgtggccgccacatcggcgccacgtgtgcaccacgtggcgctccccttccccggtcccgtggactcggtccaccgtggagcagcggcattgagccgatgagaggtggggcccgcatgtcagcgccgccccccggctgacgtcaccaggattaattggtacatcaccgtctttgggcccgttgggccgtgtatcatattggagtccaatagagatacgtccaggggtccaagattgaccctagaacatatatattcaatagtttcatcactagatcggtttgtggaaccccaagtttgagttcttgattaatcattcatctgcaattgagttgtttgtctttcttgttcttgattgtgttctttgcttcacacgcagggattagccttcttggcaaaatctgtcgagtttcggcacggttgataaccagaggagacgtggtgctgcgattgcagggttcggatcgtgtgtatcatgtttcggccaaatcgatagttatcttcacctaatgaaagattgggcatcccatttccatcaaattcttcatgtggtgatgccgtggcttgatctgatgcgtccagatttgatccaatagctatggagagtctaagtaagggtcaagtttcaagggctctttggggattccgcaagaggtgattcccaaccatttggagcctataaatagggaggtagaggctaaagtttgggtgcccctttgagagagtcacttgtgcctctttgtgagaattttttttggagttttgcatttaggtcttttgaagtgtttaaattcaaacacatgtgaaggtgtatgtttgcttgtctttgagtgttttctttcaacacttctgtaatgaatattttctaagtttgtggaatttaattttagttcttgcctttcgcaatttgaaattttccaatttaaattacgcgatttggatgttttgcccattagctgcattaactaatttctatccacccaaagctaatccataatgaagtccagtctattaaatccatatgtatttaatgcattagcaagcctaattaattattgtagaagattaacatataagtctttaagtattgataaagtcatttaaaaaaatgattgctagataggacatatagatagttgcttattattatgtacattagtaagatatactaatttatacctctcatattcttttaatcgatgtgtatagggaattgggcgacgatatacgcattgattagagtaagtttaatagtaaattaaacttactcttatttatacataaataagagtagaagtcactatcagctattagtcatcttaaaaccaacatatatatataatagattaggtataaggttggcttcaatttttctttccctctctctttctcttatttatacatttaatgtactagcaaaaatgcccgtgcgttgcaacaggtcaaaaatttctaatgataatatacgtttttcatgaataatcatgtcaatgataatgtttgtattttaatgagcggctttttttttataaactgtgtttttttcttacgcgattttctcaaactatttagaaatgacgcttttctttctaaaagttttttagcattttttttgcttttttacttataacgaaaaccatattttctcccctttttccttttttttctcgtgtgtttttttgccgtttttttataattattttctcacgcgtttttttgcttgttttttcttcaaatgtttttttttgcttttttccaatacaggacataggggaaacagaacttttgttgttgctgtttttctttttatgcacctttctgcttttgttctctcttttattattatttttatcaaaaacgacctcaagtactttattataagattatagggactccaatgtaaatataaaaattacagggactcaaatacaaaagtacaaacccaaaaattaaaataatataaaaatggaatgctttcgacatgtaggttctgtttttgtaaacagatcttcaatccggcacatcattttgtttcaccaagatgtgtgatatattatggtacagattgaaaccgagaggagtatggtatctcggactcaaaaggagtggcgccttttatttttcgggggaattgtttatcggatttttttcgccctttttttatcggacaattacggttttttcgcccgttttcttctcgctcgcctggttatttggccagttttgttgacagacgatggaagcatctcttattttcagtagttgagatttgttttggagcctgtgttgttacctctccattccacataaaacattattcattttttgttacctcttccgtccacatataagatccttttactggaaataaaatgtcatatcctataaatagtttgttacctgacattttaactatacggttggtaatctaatccacgttatacttaaacagactatattgagaaatgatccaccaggatcgtggttgcctgcattgtccatcaggtcggataactagtattatacgacttttaagaactggaaggatgtttaatatttttggaaagggtttgaatctttgattccaagatctacaccactagaaattgagtgtagttatggacaaaatagttttggagatttccaaaagcttaaaacacatcgtctaaaccggaaccgttattaaaggacatcaatactttatatttatataatcatgtgtacacgctaaataatatatgtaagagacaatggacaccctgcttctaactataataaaaccttataaatttaagctagtatataaggtagtggacagtggacgagatagtgaagaacatatctacgttaagaaaatcctgatttgaacaaactctccgaacctcaccctttttagggaaaattataaccatgccattataattttgcaaaatttgagatataccatcctggtccacatgtcattgactcatgtggatcctacatgtcattgagataccgatggcatatctcaaactttaaaaaattataatggcatggttccaaatta

SEQ ID NO: 2053 - DNA, 5398 bp, Oryza sativa
gccataatggatttatgcaaagaaagagggaaaagtgggcgtttgtatactgtaggaacgtatatataaaaccttacaaactccatgcacaataaaatagcaaattgagaaagaatcatttgaccaggttgcatggaaatctgacaagtctgaagtttagagattgtatctcatcttgcactttctgttgaataaacaagaatcctttcacaaaagcaatgttgctacctgtccggaacagaaaataggaagtaaagggcagcaaaactgtacagcaatgttgacaaatcctcctcttgatttcacaaaagcaatttatcaaagacaaataaaatggatctctgtaattatgtgcatgatttgcctcacaaaattagtttatgaactgtagcagatatgatgctgccctgggaagtgctatgttcccaatgtatcagtaatacaagaaataaacaatttataggactgagaggcaaacatctgaattgtgatccatatagagactcctgtacagctcttgaatcatggagctgaaaaaacacattattcatttgaaaacaccaaaatacacacaattctctccaatagcaatttactctggtcagtgttcctctgcaactgaagccatataaaaacttgtcaccatgccatgaatcagaggaatgtaaatatcccttatcctaaagctggcatcaatatttacataatgctatacctcacctatatacatggcaaggtcttttgagctgtattttatagctcaacagtacagcaaaaccaaatgctggaaccaaatgcacagaagcttcgggttttttcccttatacaaagcaagttactgaaaatttataaacacattttgaatatatgtgatgatactctttgactttttagatgccttgctagcagacatcttaacagccaggaaaatacccctatgctcacctcacaatcataactttcctatagaacggaaataaaaaataggtacttttacatgaaaaacaaaccgaaattcactctaaaatgcatggcagatttcaggaaaataatgcagtcagtagaaccatcaactcgtaaaactcatgaaatctttggaggtactctccatggttgcgctatgtatgtgtgtgacctaaattagtttcatcttacaccttcagccaaccttgagcttggacaagtccaagttcagctttttaattgccctttttaggataagtcctagatcatatattttttaccctttttaggattcgggtaaaaaatggtttactgaacttatgaaatttagctgcaacttaagaggattgaaaagacattgtgaaggcatctattttcacttatttatttatttattagaaggtagataaggaaactgcaaatatcaaaatacacgagcctaaatattttgatccgaaaatgtataccgatctgaaaccaatcttttcgtaattaaaaaagagtgaattacatattgggctaggttttcttacatgaattgcacaatggactaagtcttagcaaataatttcactttataccggctattgttaccatagcatgcaatttggactataggcccacatgtcagccagatcaagtgttctctcactcttccccttctttcttcttcctccagacccatcattccccaaccccacatcatcaccctctacttccattccctgtctaccaccatatatttttgctcactgctgtttgagtttgatgatgagatcgagcactagcagatcctgccgctactgctgcaagaattagagcacaatacatcacgaggaaaaggagcagctccttgttgggggggggggggggtgctggtgcagcctgagctcgatctcgatctcgtaggttgatgtacacagaccttgagtgttaggaatgtgaaacaaaagcttgagctcgactaggatgctcaatggcaccattctgctgcagcattcaggttagtcgtgttgtgcttgtgccaatccaccagcgtgagccattatcattggcaggcaggtgaatctagctaggtagcacgttgcaggcagtgactgagttggaacaagtaggagacgttgaagatagggttgtctagtatggaactaaaggtaaaaaaccctgtgctaaagtgaaaacatgagatgtgtcatagcccaaagtgaaactttagcaataataactagcccaatatgcaactcactcttaaaaaatatgagagtacaagaaaaccttgagaatacaatcatacgaggtgatgtggatgcgcttggagtagtgcgatatagatctgtttccattattaagaaatcaatttagttttgcaataaccccttaataaaaataaaatataatgcataccaatagattccagctaattagccaacaaccgataacctaagtaggaagttatggtactcgctgatattaattgctgattgaagtaacctgagttccactatccaccaactttgcatatcattgataaccttcttcaaataatctccaaggaagacaggggcaagagtatattattttcccattttatattttctacacagttttaaattgatagcctcaagtcaaaactaaattggtctgatagatcactccatgtagaagtcctctagggagaggagatctgttttgcagcgtatcccctgattatgcttgatcactccataaaaatgaaattacctgtagccttcaaatgtgatgaagccatgtaattttctggtgccatagaattaataactgatatacatggttcagaaacgagcttatatttgaagcatgatgcagagagtatcaagacaaaacatgtaaaatgtgaaaggaaaattagcatccggttgaaatatgaatcaggctgaacatttccaatgaatagcacaaatagaatcgataatacaaacctgaagaagaaatgcctggctgggtgatggcggcgatgtggtcaggcaggcagcgctggcttcggctcggctgtaccggtcggtagtgacgcggggcgacgatgcaggagtcggcgccggtcaacagcggccgcggaggacatcggcgaggcgggagtcggtgccggtcggcagtggccgcggaggagatcggcgaggcgtcgttggtattgtcctcgacggttggtggcggcgcagacgagggagaagtcgatctcagtggagttgaaccgggggatgcggtggcagcggtgcgacggtgagggcgaggtgatggtgacctggtccggcggccattgcagacttcaagcgcgaccgtgagggcgaggcgacgacgatttggcgagagatggaacgcgatgcgaggggacggggttgcggccttgcggggggtttggcgcagatcgcatcgtgggtggacaggaagctcgtggctcgttagttcgctccgcttgtgactggctcggctcggctcgtttgaatttcctaacgagccgagctggcattttagctcgttagatataacgagccagctagctggctcgcgagctgctcgcaagtcttaacgagccaggactccatcagacaacccaaaagcccaatacaataaaaaggcctaagccacaagtagatactgtgcaactgcaaaccctagtcctctcgagactcactcctcaattccccacctggccacccgagacacgatgctgctccgcctctcccccagcggccgacgccaccggtctccgactctcccccagcgcccgccgccaccagtctccacctctcccccagcgtcctccgccgctgggaaatccagctcccgccgccgctggtctccgcctctcccccagcgcccgccgccgtcggccacctcaagcgcccgacgccgctggcaagctcaagctcgtttcctcatggtccaacagtgaaccgttcaagtgccagcggagctacggaggtgagttctccccctccaccgtcgagctcctccccgtggttaacgggttcgcgatcttaacgagctagctcgagcttgttgacgagccaagccgagctaggtttctagctcgttaggataacgagccgagccgagctagctcgttatcctaacgagccagaccgagctgagccgagccagctctacatccacccctagttgtgcgaggggatggggaggagatcgcggcaatactggtggcgcaaatcggcggatgcggtgtgggagagaggaaggtgtgggataggcggatctgggagggaggagaggcgcgcctccggtgccgtcggatgtaagtcatcggatgatttcataccgttcgatgtgtcacacgatgaatgagtaaagagtaaaatcatttatttgaattatagggtagatatagcctttaaaagtaactgaacaaatgttacaaacgaataaattttcttactaacatgcatcatgtactacgaaaacaggactaaactccatcctctgtttctcttctcttacgtttgcacatgttggcctgccagcaattgttagacatacatcatgtactacgaaaacagggctttaacaacaacttgatcaccatcctctgtttctcttctcttacgtttgcacatgctggcagagaaagcaattgataggcagaaaatgcccaagccaagtttaatcgttgcaatatgcggctgacaagaattgttcttgcgttttgctttcgtcatttttccatttctttttcacgtacctatccttcacatagatcttaaatccacaaacttctaaaatcattattcacatgtgtacaaattgtacaatagatcaatctattactgataactcgattcacctatttcaaatttcactttccccaatcaaacgaaggacatgagtgtcaaatgtggcaagcacgtagactaataaccttatatccattgccgaagctaattcacatttcaaaattttcctaatcaaatcaatccacggacaaaaagtcagacatgtaaattaatgaccctcagcccacttccaaaccgtcggccccgttaaggtttgaaattttggttagaaatttcagagtaccaaccccacacacattggcacgaaactgttcgaaaatttttttttcgtgaatttaataaaatttaatcaaatacagtcaaaacttgttcccataccatttttctcattccagaattttgaaaatataaacccaggtctcgatccttcaatgccttgcagtaaacaatctagataaacgtggctggccaaataaacaaatatgccgcctataaatgcgaagctcaagacgaagattgcaagcatttgctcatggaatgctagagggttaggataaatatgattaagagggagtgtaatatacagaagattcatctccaattaattagtatagtggaaaaaggacataagagaactacaatacacatgt

SEQ ID NO: 2054 - DNA, 6783 bp, Oryza sativa
atttgttgatggacactatgagcaataaaataatatatacacctagctgaggagagagaagctatgtgaaatgtcaattttgcccttttctttttttcactgtctttttatttattcctgctgctcgtttagtgtgatgatagtgctcgtgtacgtggaccccttggtcactacgtgcgccggcagcgccgcatggtagagcatcgtgtcccgatgtccttgcactgtcccgcaactccgcatggtacgtggacccctggcgctgtcggggtaggagctgttgtggcagacgctgagcgacttgtcgacggaccagcgggcgctaggcctggtagtgcgaggtcgctgccgttcacggcgtttgtgctgctcttgtcgctggcgctgctcaagctggtgccactgtgcgcgctctaggcggcgctgtgcctcctccgattccccgccgtgcgcgccgatcgagttcaggcaacacatcgccatgaactatctcttcgcgccgtggatctcgtggctgctgctactacactcggcgttgttcctccgccccgacgcgcgctcctaccacacgttgtgatgggcgttctcgctccccaaggtggtgttcttcctcttcttcgccgcgcggagcatggtagctcacctggacgccatctcgaccccctttggcacttgctgcaagatgctcttcttccaccgccttccactgacgctcgccaccggtcaaggccatcgccaccacccttgaacctaagtttggcctcaagggcaatttggtcctttttaattgtttgtccctccatttgttccgaaaataataaaataatagtgaaagtgtccaatggcaaattacatgatttttggagtgtctttcagccgtttcacgattttatggtgtctcttagctaattacatattttttgaatgtcctgtagcaaattttgcctagcatttacgcactcttatatcatacccggacgtggatgaatacaagggacggacaaggctatcaccacctgctgcctacctcactttctgtcggacatacccacatcaaacggtatttatctaacctaagcactatgcttatgctagtaaatagtgatactaactcctcaggacttccaccattcggatggacaagttagagttagagcaactcatcaaggtcatgggatcgttgccgtagcatagatcgactaatctaatcaagtgaaatatataaatgaagtatatcttattaataaggtatataactactaaagcaatatataaattatgaacactttagaagataattctattaattcaactatatagtcttacaataagaataaagtattaaagatataccagaatctcttataagactataggaccgaagatatgctaaacctattaccactagtactatagaaaatataatctctgagaagactataggaccgaagaaggcacacgatcaagaacaaaagaccaaacccaaggctcccgtcctttatttgtcatatctttttaaacaatagaacaaggtttgcactgcctcctgtaaacatgacacatatatggggttgcccattttcattttttatctgaatttctgagataccaaaaatttcatgattttcatacttttttgcaaaagaattgtttgaaattttatcaatttttgactcaaaaatttcgtgcgagatatttgctttccgtagggtgtgaaattacctgcataatagtcccatactcagactaaattaattataaaatggctaggataaactctgatccggactcgtcatcactaccttgaagtatattttagtgagtgtgggcttttctgcgtgctagccgtaggtactctagaagtctagattactcattctattttcaaataattcggtgttgactattaccattctaactttgaccattaattacttttaaatcaaaatgtaacattactatgaacataaatttcatggttatgtttaggataaaagaaaaggttggacccaaagaaggacttggattcaatggttttaagaaggtagaggtacatatattttccctggtgagcgggcttgataagggtcgaacccgggatggtggggtgcatgccagcaacccctgcccctgcgctactagcacatcacgttatgtttaggatacaacacaccttaatatcgagatatatttctttttctatgaaaatgaatggtcaaagtttataaacgaatagcgtccagtgtcaattattttatagatggaaggagtactgttttgatattgacctcaggacgttgtggaagcatcttgacttggctatttatagatgatttgattttccactccatatcgtcagtgagcaccaggatagaaaagtcgatatgtttgagagatgtgatgtgccggatgccaacctctaaactgccatatgttgattgtgccctctctgcaccgaattcaacgctaagccattcgagctttggcatgcctcctttgaataccaaaccaggtccagatctgttgcagaaacgtaggcgtgccaaacattggaatgcaccatggctgatcctgattccatacacgagagcttcccctatgtctaggtgtaggacaataagagcaggcaaatcttcaagaatacgtacatgttctcgttccatttgtttaacgtcgatatccaagtaggtgagacatctagagagtgtgggatgaatccacttcggaaacctggaaaagtaatgtatattgcaactactcttgtaaacaaacttttccaggaaacacggcgaaggacaccaagaatctgcgaaacaatctccacttccattgcagctggtaatatagacttcccggaggttgtttcctccaagcttgcaaagggatggtatcattgcttcttttcctgtttccccttcagacaagaaccttactttgagcaccctcaaatttctcaaaagttgtagatctttctgaaattttaataaatttgtggagcttctacaacaacctaaaaaccctaattcttgaagagattccatgttaccgaacccatccggtaatatgagatgatgtccaacaagacgcatcaaccgtttgagctgaacaatactttcaggcatcactaataatgaagtatggcgtaaatcgagtgtttgcagatactctagcttcccaatttggacaggtaggcagtcaattcttgaccaacggagccccaagtatcttaggtgaaataaacctacaatgcaatcaagataactattcctgagatcacaacgctctagattcaacactcgaagagtaggtaggtttaaaagaggagacatcatatggccatcaacatggtatatgttaattgaacgaaggttagacgaattcatggttccttgtgattttgcccttgtatattcttctttgttcccaactaaaagccggcgaatccgtttacgtgaagatgggtgatcctgacaatccaacttggttaaaaaattttcttcagttgactgatggatgatgaagttcaaaactatatcatggactcgacatccatcttctccatttggcatgatctgtatgtgttggaccaagctcctatttatcagctcgtagaaataactctctgcaacttcctgcaaagtaaagccttgtttttttgttatgaatccttcagctatccatctccataccagcacatccttaccaatcttgtgatcctcaggaaacgtaccgaggtgcagtaaacaacttttcatatgatgtggtagatcattgtaactcataaacagtatcttgttcattacctccaggtcattatccttctcactagtagaaacaatataattcagaactctctcccattcttcccttgttcttggtttatcagctaacaagctagctatagtaataatggctaaaggcaaaccatcacatttataaagtatatcactgataatcccttccagctgactggggcattttttttcagcaccaaaagtccttgtgagaaataaattttcagagtcacttttgttaagaggtttcatctggtagacaaagccctcatctgaagcgccgcagcaagattgagctacacttttgatccgcgttgttgtgattattctacttgcgtgcttgtttataggaaaagcacattgtattgttttccatgctgaccttttccaaatgtcatcaatcacaataaggtacctataagcaagtttgtgaagcagtatgaatcatttgtaggctaataaatgcacccatattcatttttgggaaacagatcccctgactttatgcagtttgcagttgtgccactgacatgtgggcctcactttggtatggtctacatgtcagtggcataaatgcaaactgtacaggggatcctcattctcatttttgcatacgtacatgtgaacaatctatatacatgtaaaactatctctgcatgcaaaagttgtactacattttgtgttggttaatttcagcctgaaataattttgattatttgaaggaatataacttcatcattggtagaaacaaaataaaaacaaaaggctaccaccactatgcagggcatggatataaatcgatgtgtaggagagaccacgatagaaaattccaacaagaaactttaatgaaaattccaaatgaaaagaactttgaatgttctttttatattaatctagctacaggctgagagatgcacgggttgattaatgatgactagaatataagaacccgtatgaaagcacacgatagaaagtaactcaagtaaacttaccgttcatctttcagacatgttcttagtttgtcgataagttgttgatcactatatgattccgttggttcattgctcttaatttgagaaagcaactcccttagaaggttatccatgttgggcttttgcgatacagacacaaaagctgaaaaagagaattgacctttaattttctgatacacctggttagcgagagtagtctttcctaaacctccttgtccaacaatagagacaatcttacgctgccctattggctccacttcctcactaccaaaccaattgatgatttccttcattggaccctggatgcccacgagtttttccttctccacataaagggcaggtagccgaggatcaatctccctacacaatttgctagaagtgccctcttcaatcctatacctcttttgccgttcgtacgcttcatttacaagaacatgaagttcctcgatttccttagcaaacttgtggcgatgatgaaacttcttcaccttgcggagggtcttgtggagaaccctcttgactccattggttgtgtcagctggctcatggtcgatacggtaggtgaagagatctatgctatcctccatgtcgtaggccaactcgcgcatctccgccatccaggccttcacctgcacgtctggactgtccatggccgcgtacttctccagcgcgatgccgatggtcattagctccttcgtgagctgttccagcttcttcctcacgcccttgacctccatgtacttcttctctatgaggttggtgagttttctgagaagagggctcatcgcccccgttagggcgctcaccacgatctgctcgacaacccctcccatctccctcaatcccaggctataatcagtctactttcttgaatcagaatcagtcgatggatcgattatggtgtggcaggatgaatttcgtagaggtgcgatgaaagaatggttggtcaccctccagctagtgtgcctgtggcgtagtagtggcaagagcatcagttctgtccctttcccatctttcaattcaatgggtgattgccgggagcatcaatttcgtgtctgagaagaaatagccaggaacccatccggggctactgactttgtcgttgagatttacaataattacagataattaaacgagtcccacagtatgttgagatcactaacactattaaatggattgcctttagtttacgttggttgggaaccttctccttcagcacacggcaaacagagaaactcattcgcacatgattaattaagtataagctaaaactagcaccggtggagaaatgctttttagtcacggttcgcaaccccctatagtcccggtttttaaactggaactaccaatccgggacgtcccggttcaaatacccgggactaaaaatagatatttagtcctggttagtaacaccaaccagaactaaaaagaggggatctttagtaccggttggtgttaccaaccggggctaaagagagggttgcggcagtgaaatgatcccctttttcttttttctttttttttcttttttattttctcccaaatcaagtgggatacatatcccaaatcaaacccccaatccacaaatcgaagtaacatctcaaatctacatcacaaatcaaagttacttatacacacaaataaatacatcataaatcaaatacatcacaatatcctaagaaattactcaaatacatcacagatccaaacaatgaatcacaaatttgtaacttctcagtcaaatacatctcagtgaatcatcacaaattaaaaaaaaaagaatgctactgccgccgccggtcgccacgaacgactggcacggccccaccggccgccaggcgcggccctgccgcccgccgcccgccgctgggcacgaccccgccgggcgccgccggccgccgcagcgcgcggccccgccgctggccggcccgccgaatgggaaggggaggccggccgggaaggggaggaggaagggggagagaagggggaggggagga

SEQ ID NO: 2055 - DNA, 6739 bp, Oryza sativa
  unsure (1)..(6739): unsure at all n locations
taccaaccgtgattaaagtggtgatctttagttccggttattgacaccaaccgggactaaagatcctcggccccctgacatacatctgacaggggatgaaccgggactaaagatagtcccggttggtatgatcaaaatttttataactggaactaaaaacaatctttactcccagttctttttggatccgagactattatggattttgccggaccgaccaaagatggtttctccaccagtgtagcttaaaaagtatgatttttttgaaaaacaactttcctatagaaataccgtttagcagtttgaaaagtgtgcaggcgaaaaactagaaaggagatgggaacacaaccaaacaaacaaacgtactaaaaatatatataatccatccttgacatgaacatgcctttttggtagctactactacttgcctagtagcttcgtcctcctttttagattaaaaaaaagtactcccaccgtcccaaaatatcagtacttttggactctgatacggttttcgagatgctattttgatcaatgatatctaaaagtaaaatgttttaaataaaagagttacatattgtaatagtttatttaatgataatcaaatctagtaacatcaattttacctagttgatccttttttattttttttgttatctatctatctatctatctatctatcaatctatcaatctatctatcatatactataagtccattaaacttcctacaaacgctctcaagcagccatatggtactcatataaacactcctaagttaccatgtggctctctaataaatcggtagacccgctattttcatctattagatttaattttagaaaaaaaaatcccacaatccatctccctcccctctccccactagcccaccctcctcccctatggtacgtactcacctatccctcctcccctatggtacgtacgtacgtatcctccccccacctatccgatcttctcatctctttctttcttttcaagtttattacaattaaaaatatattttttaaaataatttccgtatagagaaataatcataatctttaaattgcacataaatctttttatcgttattcattatcgtattcatagtgcttaactaaccattcaaattagaagctattaagagcggcgggctgggcggccgctcgcgtgccacgtcggataggtacagtgcgcgggtagaagttttgcgaaaaaatccttctattttttgtaattatatatatgtccttataaacagtacttgaaggggaaaaatcgcggaaagggactgctctgtaaaataaggaaagaatagggtttttttttcaaaaatgacgcccactaatctaaccccccagaccttatccgccgccgcccgcaccctctccctctgcccgctccctctccctctccgccgccgccgcctcggccacctggatttttcacattttgatccttttaaaaaacttatttcgcaaatagacccctgaaaaaacttatcccagaaatggtcttttttggggcgccagagtggctggcgccgtcatccaacgggacagcgccagcctctctggcgccgtcttcctgccaccgtggcgcacgcgaaccgacgtggcaggaggagcatgctagcgccgccgcctccattcctatttctctgtatggagttgcaacggtgtcatttttattttattttttcggatgttttttcacactcaggatcacgatacaaacaaccacaaaaaaaatttaaacttgaactaccacttagctaagtctgaaaatatctagcataccacttagtttactttgcaccttcactcgaattagaccataactcctttagtaaaaccctttgatcagcatgttaaacataatgcactctaccactatataaattacttaatctaattcaaaatataactacatgaaatgacatatataagttaaacagtacatagagatataatttttttatttttatttcattttttgatatttttttcacacttaggagaacataggaaccaaccgtataaaaaataaactcaaacggacaaaatatgtgacatgtagaattttccaaaactctaccgaaacggacaaaatatgccatctattaaaataggcgtaactttctcatacggactcggaatcaggcaaataatatatgaacggacatctacagaaaaagttacatccgattctcccccgctttgccgggttcggcgatattaaaacctccaaattccgcttgcaagattgtgttttcgaggagagaagtttttcggtggagctttggaaaatttcacatgccaaatatttcatccgtttgagtttattttttacgtggttggttcttgtgagttcctaagtgtgaaaaaaatatcaaaaaaataaaataaaaataaaaaagttgcacatctctttcctctgcactagttcggagagaggagaggagaggaaaaattctacatgtcacatattacgtccatttgagttcaatttttctatggttggttcttgtgtgtccctaagcgtgaaaaaaatatcaaacaaataaaacaaaaataaaaaatttcgaggggggggcgccagccactctggcgcactccccctagccacctcagcatcgccccgccacgtcggcggtgggacggcgccaaagaggctggcgccgtcctgttgaacgacggcgccaggcactctggcgccccaaaaaggaccatttttgggataagtttttctggggatctacttgcgaaataagtttttcaaaaggaccaaaatgtgaaaaatcctcggccacccctcgcgccgccgtccccgcctccgcctcacaccgcggcccctcgccaccgtccctgcgtcgcgctcccacctccgtctccgcccctcgccgccgcccagcctcttcctcgcgccgccaccgccgccgcctccgcctcgcacagccgccatccccgcctccgcctcctgccgccggcgtaagaatccagccttgatgtggtcgggggacagggatctgacttcccccgtgcaccgggcggtgccgcagcctccgtcccccgaccacatggaaggggcggcctcgggtggagctggtgtcgttgccgcgacctcattggctaaaggccggctgtccgtcgatctggaggagtgagaggtgacagcagcagtaaagagtgggaaggggctgtcgacggcagtatgggggagaagcgtcggagcccgcttcccctcctctcacaggggccgccgctgtcgaacctgtgttacctgggggcggagttcaggttccagcgggcggagctcggggcggagatgatgaccgacggtggggcagttcgatgagcgccatatctgctcttctacaagggccccaaggtctgttcgtcccaggtcgatgctaaggaatctgaccacctatgttgctttcttgccgctgccatcaagacaccaagtcgagcttcaagaagggcgtgagtgttttccccttttttcctgagataagctgattagttgctttcatgtcatattactgagcttgttggagttcttttttttctatttagttttttgtatagtgcaaactgcttggtggtgtgtcactgaggttcctacagacgtactggatggatgcagatgtggtaacagccttcgagctaagccgggccatcgacgatggagtgctgcagcctttgccctttggttcgctgacatgctgttccttctatgtgaggttgccagtaccacggactcgccgtcagcactgtgcaacgtcatccttctgcgctagactgactccaccctctgctgagtgaggtgatgctaatcactcattgccctacaagtgtttgttgaaatgcatgctctgtgttgtgacttgtgcagttgtgctaatgatggatttttcctggtgacgattgatgcagatcgcgtgctttttccaccgctacaagtccgagcagccaagcacttatcgcaagaatggtccgtgtcttaaaactttcccaaaccgtgcatttgtgttgtgagtttgcaactgtctgcctatctgtatatactactacttgaatgcactgaaaacttcctcctgtatttttttttgttatttactctacaactggtgggatatcttatatgtcatgttgaaatgtaaccttttaaagcaaaattgcatttggtcgaaatgatgctagatggtatgttatttggattacagtgtgaatcaaattaggaggttgaagctaagtggttttgttcaagttaaagtttttctataaaataatctaccaaaaagatatatatttgatttgcagatatgcattgaaaattacacatttgcttggcggttatactgttagtccttatgaattgtttagttatttaagatgaaagggaaaatcattttatatcacaaaatttttttcatggattggcaacatcaaacagagcctgtggtttgctgtagcagtagcatactagaaaagtgtgtggtgttgatgtagtgcccgcatggtttagcttgacattaaaatgatgtgcagtccagatttgaggaacattgttgacaatttgctatcacctatcactgtctgtgttgaccacaataatttcagatgtaccatcccgtcttctaactagatagacgcatgaaagtttgttgcatcaattccagcacttcaattttttgtgaaataccattagaacataaccactttgctgtgatatgaaaaataaatattttatttcttggaaggttgtatgatcatgtattcttatactatattgttcattgattttcttttccatttgatttgattgactaatatctctaaattttagctacccttatggtagcctaaggaaaattgtatgtttgacagacctgttttctgttgtttgatccctccaggaaaaccagctgccattcaatatggcactggttcagttgatgggtttttcaacgaggatagtgttacagtaggtgatctggttgtgaaagatcaggtatgcactatatatctcagtcactgactatctctgatcatatactccaaaatattttagcactgttgcttcaccgctttaggaattcattgaagttataaaggagccaagccatatactttcatggttgcaaaattcgatgacattcttggtctcggatttcagaaaatagctattggagatgaggtacctgtgtgttaagacaacatgatctatagtgctatgatatattggtagtctggtccattcattgcaagctgctctttttcttaaattatttgtgtacttttgggctttttgctcaataagggtcaatcctcgcaaaatataatctaattcatctcactcctttttaactcattagattatcgctatcaccttctatagagttccttgcacagaaacctctgttctgaaaagctgcaaattatttgtagttatggtgtttttcttatgcattccatattggccaaggcaccattggctatgaccaagtagtctgctcatgtgcaagatttgtggggatcagatatgtatcatttctccctactattgtttcctaatgcgccctggtgttgtttcctcattttatttgttccatctgaccgggcatgttggttgctatccagttttccctttagttggattccaaaaataattgatatcccttaccaccttttctttgtgatacctgagtcttttattcaacttgtgtatttcaccattgaccctttgcaggtgaatatttggctttgattggtgaaaaattaatggagcggatataatcgaacttggacttgctacgcgttgtcccatcagtggtgtaagatccttttgattgcactatagatttttcatttttggtggtttaacgcagtaggctgacactccttttaactaacctattgattatttattcttggcttggacaatatggggatattgtgtgtccggataagagtaggcattatttgtaggtaggacatacaagaagtaaatatatttataatttctactctgtgaaggtattattaagtgttttagcatgtcataggcagaagttgctggaatggtagataatcatgccctcttttaaacatagcatcggaattagagtagaatcaagatgctttcctttcctttctatttcagtgtagtaccattattctgaagaaagacacacaagactatcatggaatagataatcctatatttataaggcgtgtaattcttaattcttttaatcaagccgagtgctattttgctgtggctcatgaatctttgcgttatttgtaaagctgtggtttatatattcctttgggagcttgattctcttcgaaattgactcaatcacctgtcattggtggattacctgtcttcatgcacctttttgccatacatgcaaatatgtagtgtgtaggcctcagggataaaaatgtatttaacaatatggtgtatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2056 - DNA, 40553 bp, Oryza sativa
  unsure (1)..(40553): unsure at all n locations
atgagcacaacgagcatggtggttctcttgaacaccaccgctgacatgtaggtgatcacggtgcctagcttgatgattgcggcttcaccaattctagtacaaccgatcacccatgttttgttgatgttttcacctgaacatgatatgttctatctttttagttttacttgtcaaaactgaaaatgtggtctcgagattgtgcaggaagaggttatcaaacaagacaatatatggatttgttggttgattggtttgccttttttttcctattttcatcaaacgtttgaataatttctttttttttcatttacttcccgttgacatttactacatgggttatggtaacagagtttttaagaacaatgttggtccctttcttatctgatgatatgtgaggatgaagaaaattcctgtctatagcaatggttgatgaccagtgattacgatcaaactatccagaacccattttgtaattaagtttagtacaaatcataaaagcgagaggttctatctactgtggaatatgttgtttccattgcaggatcaacctacattaccatgaataatagtagtctgattgttcaatattgccaaaaatgttcttgtatctgatttaaaattctgagcaaatggtgaattagttctaagggatttctagatgataccttgtgcaggtttctgtggctaatttagaattggtcgtatggtgctaaattagcactgctaatagctagggcggttggtaaattttcgaaagaaattgtgttgctttagaacgaaatttggctaattttggtgcataattgacatgcgcgatattcacatgataatagaaattttgtacagagcaagtaccaattctatgtgtggattttatatcttccctggggcctgggcagtttttgttgatgtttccagccatttatgagaaaaattttgtcctttaaactcctgacatgtgcgattaggtatccttggcgattccccccccccctctctctctctctctctcaaaccgagagattcataaatagactattcggttattctgtttttttcaccttgggtgctctgttgtttatctcaaatgggttgaagtctgtttaatcagtacggcaaaaaccagtgtacacagtgatttgagttaattaaaaaaattgtaacggcagtcgtgttttttcagtttttttcatcctataccgccttccaagtcacgtgctattcgactgcttacccacttgcacgaaatatttataattaaaaagtacttcggcccgttctaacacgttccaacaaaataggtgtggtgaaatacttactttgtactttttcttaaatatatttaatgtatggcctaattcaaattaaagctttgattaaactgattattttactaacacaaaatttggtcatttattatgggtcgtagcattagcatgggtatattactggtataaattaagtgtgtcctccgctatataagccatcacatatgatttgatttttatttatttcattcttacatacactacgagaaagtaaaatttattttatggttactgaaaattttcatttcattgattgacgtagactatgttgcgggtgaccacattatttgataatttttttcacatttaccgaaacattgcataataatacaacattaacaatagaggagcaatggttcacatgaatgctaacacatgttactacctctatcacaaaatataaaattctagaaccggatatgaaatatttagtattacgactctggaccgacctactgtctagattagtagtattagaatttgtctcatccaattctaagttgttatattttggaatagatagagtaccatatagaaaatttttatggtcattgaaaaaatatctctaattagctaaaattttataccacgtggtacggaaggtaccaagttttacctcccaatatatcttttcaaggatgataaaattaggccttgtttagttccccaaaaacctttccaaaaacatcacatcgaatctttgacacatgtatggagtattaaatatagataaaaaaaaactaattgcacagtttgcatgtaaatcgcgagacgaatcttttgagcctaattaattagtccatgattagccataagtgctacagtaatctacatgtgctaatgacggtttaattagattcaaaatattcgtctcgcggtttccaggcgagttatataattagttttttcatttgtgtccgaaaacccctttcgacatctggtcaaacgtccgatgtgacactaaaaaggtcttactctaccaaatgaaaaaaaaatgtagctttagttggctctagaaatcctatatatttctaacggtattgctaaatctctgtcgccatattttgggttcgatttcaatcggatagcctgatccgcatgatgcgcatgcgagcgtcgtggtcgactcacgtccgtagatcatagccggcatggtcagagattttcctctcttttcctgttcactaaaaaagtgccaccattagtttcccattaaattagcactagcatcgattctctactaatagctacttacatcaatttaggtatgtaattttagaacttatacagtaaatacactaaaattatatatgtaatttagagacttacatatgtaattttgggacttacattataaatacattaaaattatacgtttagaaacttacaatataaaaatatatgctgactattttttcataaaaagtatggcgccataaatttaggtagttttctaatcaacgctgaaatttcattttgtttatctattctattattatgctattcatcttcttgcattgtcactctgagctgcttgttgggtcaaggacgtggccggcgaagagcaccgcgcccgacgtctcctccaccacgaagaacgcgaacggatggtccgcgacgaagtcctccgggtagctcatgctcaagagcctgatcgtgcaggccgtggacgccgccgcctccgtgccttcctcgttcacctccacgaccgccctgtggaacacctcctccaccaccagcccgccgccccgctgatccacgccctccgccatgccggacaggtcggcctcgccggcgtcgaaggcggccgtcacccccatcccctgcagaaccccgttgatctggctgtagaacgacaccttgaacctcggcaccctgaggtcgccgacctcgcgacgccgcgtcggccggtggtcgcgcaggaaggaggacgacgacgacgacgccgccatcttgtcgacgagcgccggcaggccgtcgcgctcgtccggaaggaagatgtacatcgacagccctacgttctcgccgccgtagtgctcgaggatggcccgagtgatgctactgttggtgatagtgtcgccaccatcgccatggttcttcatggtccggtggtggtacggcagcttgagcaccgtgaagccgtcgtggaagccgatgtactgatcctcccggctgctcatgaacgggacgtcgacggagctgccgtcgaggcggtggaacttgccggtggtggtgctcgacctggggaagggattggaccatttgcccttgaagtagatggcgttcacgagcacgagggcggtgtcgacatgaactgatccatctgggaggatctcggggatgagcttgttcgtcgccttggacacccacttgttgatcttctttcttgatctctttggctgcatatgaaagttttacataccaagattgatcgaatttactacatatgttggtcgaaatttcacaaatcgtcatattgaaaccctggactgactgacctgtctttggaagttggcggcgcgcgtcacggccttgtaggtgccggcggcggcggcgcggtaggccggcttaagctcgagcgtctcgtcgtgccagacgccgcaggcgtcggagacgcgcggcccgccggacgcggactcgtcggcgaggccgacctccacggcgcggcgtacggactcctcgaggtcgtcgagcgacgcggcgccgagcagcgcgaggagctcgtccagggtggtgccccgtgccccggccgccaccagcgccagcgcggcgtacagggacgccggcgagaagacgaggttcttgttgctgctgacgccgacgtcggcgagacgcttcgccaggcggagcgcgaaggccgtcatgccgccgcagtcgccggcgttgtcttccatggtgatgggtgatgatgagatcgatacttcttgattggatcgcaatgcaaccagggtacgtagatcgtgctagacgtacgccgcaagggtcgttaaacgtacgtacaaattattactgtatataagtcggtgcgcatatatggcagatggaagttaattaagatatgtttacccttaaatttgcaggagaatatggagaagataaaactaccacattaaccatgaataatttccttttatacggatggggattttcatccctcgaggggacatcacctcacctcgttgcaaaatagttatcaaaacatttgaaaaaaaaaatgacaacgtagattaatacgaaatatatcactccacaaaaatacaagaccaaattcaacttctataagttgcaacaaaaattacaaattaaactgaaaatagttatcgcacattcgcaactatatttgttatttttgttacaacttatagaagttaaatttaaacttgcatgtttgtggagtgatatatttcatattaatatatgtttctaatttttttttcatatttttttatgactatttaggtgacatgcacgaaacgagaggatatcccctcgagggatgatttcactttccccttttataccattgtaggcagccgcgcgccgcatcaggctagatttaatgctgcgcttcgaagcacacgacacacaggtcgagtcgagaagaaagccgtcatcaccgacggctactagtattatgccagtgttactactacacaacaccatattggtgccggctagtgccagattaattcccggccagcaccatgaaagaggcactgatgagagagggttctcacttatcggtgccgattgagaacgtcatgaactgcatgattttttatttaaaaaatcagagaggcttagctcaattagatctgatgctttaaatccatcaaagataataaatctaacaaaaaaagagtcacaaaatcaacggcattccatcccgaatcattggaatcaacaatactcaacttggtgcataactgaattcattcgaatgagcaacaaaaaggaagaagtccacaaattttgggcagtcaagaatgcaattcacaatggtgcaggagctaatatacatgttggatatagcacaggaagtaaggaccttgtcggcacaggagcaccgttttagaaaagatctcaaataaagccagaattttggggtggcggcagtggaaaaggcaaggaaaaaacaagcctcgcgagttagatggctcaaagaaggggatgcaaacacaaaactttttcacatcaaagtcaatgctcgcagaagaaagaattttatccactgtctgcagcgtggcagcaacaccattcacactcatgaggacaaagcagaacacctccatgcgcatctcacctcaattaatctgggagcaagggaacggaggaactgcacaataaactgggaggccctagccctggaaaaactacaagatgaagatacagatgacatggatggccccttctcagaagaagagatttgggcggcaatgtccgaaggaaaaggcggcagggccagacggttacactggggctttctataagaactgatggcatataatcaagcgagagattctagaggtctttcaatgcttctataacttatcggggggaaattttggaagcattagccgagccatgatagccgtgctgccaaagaaagattcaccttctctggtccatgatttcaggcctattagtctgatccacttagtggcgaagctcatttctaagacactggccatgaggttggcacaacgcctagatgggctgatctcacatgcgcagagtgcgtttatcaagaaacgatgcatccaagacaacttcctttatgtcagaaacatggtctgctccatgcatatgcagaggaagccatgcctcttctttaaattggatatagcaaaggccttcgattcggtatcctgggaatatctttcggaaatgttgcaataccaaaggtttagccacaggtggtgtaactagatcacactactattgtcgacggcatcatcaaaagtgttgctcaatgggatcgcaagagagcaaattgcacacaagagaggcctttgacaaggagatcccttatccccatacctattcattttggccatcgaccctatctagagattactcagcagggctaccagccaaggactattgtcaccactagccaacaggacggcacgggatttatttcggaccggcaaccaatttactcatgatagggacaataagagaccggaaatcaatccactagttaagaggtgtggaactaatccggatgttttgttgtacctatcatgagtaaattggttcccagcccgaaataaatcccagtctctacttgagccgctactgagcccatttcgaaaaaaaaaatcccctcctcccaaaaatccctaattccctaaccctaaatttgcaagagacagccagacaggccagtggcggcgtgcgttgcggcgcgggagcggcgtgcgttgcgggttgcggccacgtgcggcggcggcctcgcggcgagccagcgaccatggggcagcgcaagcaagccaggcaggggcggccgccggctgggcgcacaggcgcagccgcggcgcagcgccgacaacggccatgcggcgcatgcgtcggcgtcaccggcttgagcgaccgtggccagccttccccttgacctcttccgccgaggcgccaacgaccgtggccagcctgccaggcaccactcgctgagaacccgagaccgcgaagacgccgacgggccatgccgcatagtgagtcaaaagcacaaattttaaataattgtaatgaagattttaggattgggaattgcaattgattgatgtagtatacttgcttgcttgcttagtttgtagaattgtagttgcctagtttgttgaattgtagttgcaattcattgtttaattttcagaattgaaacatgaagaggaagaagggtcctgctattgattcgaagtcttttttgagaaatctgctgcaaagaaggaaaatcgaagccaagcgtcgaaaagttaatctctaaattgtaagatttcttcccaatttatcattttctatcatttttgtattccatatggtggcactttgatatgtttatcaattagtatttctatatgttaaaacgtgatgatcaattctatcaatgtgtgaacttatgctcaattttatgttatatacgctatatattatataattattagtgtgtgatactatatatacaagctaattattaggtttttaggtgtatgaacaaatttttttcctctccccatttcgaatacacaagttcaaaatcctgggcccgccactgccactgacctacacgctgataaatttatatggtgttaggtagtgttaatgttctttaccatcactgtgaaatgggttgttgtttcacttaggggtgaaaatggatcggataatatccgctccgaatctgtccgaaacaacgatatggtatgggcttttagaaatccggcggatacggatgcggatgcggttagtatgaggcggatgcggatatggtatctctaaaatccgacggatgcggattatccgatatttttgtcggattatctgataagccgtttgtcggataatccgaaattatcaacatatataaccactctatctattgcatataatataagttggtacatccaattccctaattcatcaattaacatagattttttagtctaaggcttttatcgtctcatgtcacactcacgtaactatatttttcatactatggacatcatgtattcatattgtttagcgcttaatcatgtaattattacgataggtcatttactgattattgtattatttttccttggattgctaactcgatgttgcattgattgcatatacacgtaacatccgataaatttaatccgcttccgaaccgattccgcaccgactccgcaccatttccgacatccgaaacaatccgctctgtatccgcatccgtacactatccacacccgttctgaatccgcttaaaaaatatggtttaggatatggtataaccactatccgtccgaatccgcttcgttttcatccctagtttcactcgtgttcctgctaatttattactatatgaaattttataggtaaatcaattttaaagaatctgtgcgattgattttattattatttttacatttaaacctttaaatatattagatatattgggctcattttttatcatcgctaaaaatacagaaaagaagatgaattactctcactgtatatgctttatttgctacatgcaaacattctaatttatcatgtaattttctgaagacgttaaatatgcaattgaaaagaagccaagggattattttgtgaaattgtactgtttggacagggtatggacgataagtagccagttttttttttctcacacgcactttctcttccatctctcttgggtactctgcttcaggaatcatacgaccagtatttcaccacgtgtcagtaaattaattggtgaatgtgggagccgatcagctggcgtcaacacggccagctttagatatacagaaagataagactaaaaaactaaacagactgtgcgttgcaacgagaagaaaagatacaaaattgagaaaaaaaaaggtgagaaagatttgcattatataattaattaaaaatacaacattttcagaatacttggtatttctacgtaggttggtgtagaattaaattaatttgtaaagtaagtgtgagaaataaaattatatggctggatttaatttttataaaatattatccatgactagttacactctctagaattttctcataatttttagaggtcaattgctaattttaatggcaaaatttgctacgggatatcaaaaaccacgtaactagctggtggacatcgcaagaaacgcgaatttgctaaaggacaccgtaaaaaaccagtaattagctgctggacacccgtcggattattttattatatctgatggaatttgagagagaaacacccatgtaagtacggttttacctttcattttttttctttattctttattcttccttatcttctctctctttctctcctctttcttcaaccgagagcggcagcacggcgaggcgcagtccggtgcggcacctcggctggggaagcgctacgcggtcgtgcgcaagggtcggggctggctcaacgcggcggaggtggtgctagagtaggacgggaggtggtgccggctcggttgggcgtcgtcggcgcgcaggcaagcggtgctcaatgggacaaaggcggagctcaacggggttgtccacatccatgtcggtcacactaatgctggacatcctcatgctgcaacactcgtcctattaaagcccccgcagaacgccgtgagctcgtccagcggcgccgcgaccaccaccttggctggggctcacgacgacagcgagagcttgctcggcccgatgctggggcagctgccactgcgagggagctgcttcggcctggcgggaattggtaccatgccggctgcgtcttcctgtggcgcgggatgtgccgcgccgagctgctggccagcgatgccgctgcgtctaggcatgacgcgtcgtaagagctactcggcggcgccgacgtcttgtttggctgggttgccggccaccgtagggctgccatgccacctccatagccacacatctcgcgaacgtcgtgctacctccgccggtctaccagcgtcgctgcaccgtgctgtgctatcctagccccaccgcgcttggtgccaacacccggccaagctcttcctccgctcgtccgttccctcgttgcaccggcgctgctgccgccaggccgcgccctgccacacgggtatgccgccgccactcgccacgcccctctggccaaccactctttcatcgtcaccatcctaatagagattttttttttgtgtggtgacgcacggggcaatctgggcatttggaaaaaaatctcaccacttttaaccaggaaatgataaattaatgcgtctggtgtcctactatgactttcacagttgttgtagtgtcctggggtagtgtcatattttcgcggtgtctctcagctaattacacaatttttacgtgtcttatagcaaattttgccaattttaataatacaaacaccatttcaatattcacttaaataaaaatctaaatacaaaccatcttttctctctggaccattttcatcccatgttcttcctcagccagcagccgagctagcccactttcctcccttgtcctttgtcggcaaacgcacgttcggcccagatagcaaccgaaagtctaattagcctcccaaataccagcccactttcctcccttcttttcacctccgcctcagccctcagcccgcaagcgcacgttcggcccagcaagcaaccgaaagtctaattggtgtcccctgctcttcctctcactgtcacgtgggcccatcgctatataacctccgtccggactcacttggttgcccaaaatccggttgtattcttgaagaatgaggataatccaaaattgattaaggggtttctatcctcgtcgcctctttccatttttccaagaatcggagcaaatcttaaggggtttctatcctcgtcgcctctttccattttcccaagaatcggagcatatccgctttgtatagagcttggaattgagccctatcatcgcctctttccgtttccccaagaatcggagcaaatccgcttcgtattgagcttggaatcgagccctatcatagacaagcgaacctagctagaaacatagggtttcgtccgtttcgcttggaaaaaaaatcgtgtagcggatgttgacaatgacggagaaaaaatcatccggaaaccatacgtattttttaattaggtatagataggcttgtttaaaggaaaaactattcagcctagctcggtccaaaaaaggactgcaccaggcccatcctgaccattttcatttcattgatcgatgaattttctttttttaccaaaacattcatgaaataaaggagcaatgctgcaatatggttcacatgtatgctgatacatgttaccaaacaaacaaaatgtagcttactttatttggctttagagatattctacgtatttctagtaaacactgaaatatcactatgtttatctacttcattctactccatccgtttctatcttatataggagtataagatagagggagtactcatcttcttgcgttgttactccaagcttgttgggtcaaggacgtggccagcaaagagcaccgcatccgacttctcctccaccacgaagaacgcgaacggatggtccgcgacgaagtccacaggagaggttaaagttaaacacaagaacttcatcgtgcaggccgtggccgccgccgcctccgtgccttcctcgttcacctccacgaccgccctgtgcatcaccttctccaccaccaccagctcgccgtcgatcatgccggataggtcgaccttgccgacgtcgaaggcggccccaatccccatccccttcagaacctcgttcatctcgctgtagaacgacaccttgaacctcggcaccctcaggtcgccgaccttgatccgccgtcgccccggccggtggtcacgcaggaaggaggaggaggccgtgccggacgacgccactgccatcttgtcgacgagcgccggcaggccgtcgcgcgcgtccggcaggaagatgtacatcgacaaccccacgttctcgccgtagtgtttgaggatggccggagtgatgtcaccaccatcgccatggttcttcatggtccggtggtacggcagcttgagcaccttgaagccgtcgtagaagccgatgtactgatcctcccggctgctcatgaacggagcgtcgacggagctgccgtcgaggcggtggaacttgccggtggtggttctctccctggggaagggattggaccatttgcccttgaagtagatggcgttgacgagcacgagggcggtgccgccatgaactgatccatctgggaggatctcgcggatgagcttgttcgtcgccttggacacccacttgttgatcttctttcttgaactctttggctgcatgtcaaatttacacaccccagatcgatcgaatttactacgaaatttcagaaatcgtcaaaccgaaataatatatatcgaaacctggactgacctgtctttggaagtcggcggcgcggtaggccggcttcagcgcgagcctctcgtcgtgccagacgccgcaggcgtaggagacgcgcggcccgccggactcggactcgtcggcgaggccgacctccacggcgcggcgtactgactcctcgaggtcgtcgagcgacgcggcgccgagcagcgcgacgagctcgtccagggtggtgccccgtgccccggacgccaccagcgccagcgcggcgtacagggacaccggcgagaagacgacgttcctgttgctgttgtcgccgtcgtcggcgagacgcttcgccaggcggagcgcgaacgccgtcaggccgccgcagttgccggcgtcgtcttccatggcgatgggatggcaatgcaaccgaaggtagatcgtgcaggacgtaaagccccaagggtcgttgtgaaacgtacgtacgtacaagttattactgtatataagtcggtgcgcatatatggcagatggaagttaattaagatatattttccccttaaatttgcagaatatggagaagataaaactaccaaattaaccacgcataatttcccttttactattgtagccgcgcgcctcatcaaaggatacaggctagatttaatgctgcgcttcgaagcacacgggccgagagtcgaaaagaaagccatcgtcatcgcggacggcaccaatatgatattgtgtcaccactgcacaacatcatattggtgccggctagaaatctcgtgtaggtgccagattcccaaccagcatcatgaaagaggtactgatgagaggggattttctgtgccgattgagaacaaaagcgctcaacttaattagatctgatgctttaaatccaccaaaggtaataaaatcgcaaaaaaaaagagtcacaaaatcaacggcattccatcctaaatcattggaatcaacagtagtcaacttggtgcatgactgaattcattcgtgtatgagcaacaaaaaggaagaagtccgacgtggagaagtcctctgcctgctgtaagtggagaagtttgttcgctcgccggatccaaggagagagggacagaaccgctacgtccgaaagaaggggagagagccgtgccgtcgagtggaccgaatcgataggatcggaccgccaccgagatcgtggaggccagaccccgacaccccgtaccactaacatccaagtgaccggatctgacaatccacgagctgacccaagtcaattaatacaattgcgcaacataaaaagtgttaaattatcaaattcattgctcggattcggacaaagagaggaagagggaggcgacttattgcattccccgcctattgcattccctctgccagtatgtaggcctggtaatgggtagtggcccaccccgaaccccacccctgcccatttctatttatatattgcacccaaaccccaccctaacccactaacatgcatatttagcacagaccaaccccaacctgtaaccttcttagtgcttgttgaaccctaaccctttgtgaacccttggacaacccataaacaatgaagggactaacccattgggctcagcacgacagcacgtcaaccgtacaacaactgtagagccttcgcacatacatgaaaatgaagctttgtatacatgcatagcacagctatagggagtaagacaaataattttcagataagttaaatagagattaccacaaactaagccaggtttaagtatatgactgaactttcttaagacatacacaatagtttagcaaaattaggccacaaataggcacgcattgaaactaataaacatctatgaatcatatcagaattttttcattcaaaagtactagcaagatctattgatgcttaatctcagccttcctcttatgccacagcttgtccagtgcaatgtttccatctccctgtagaaacaaaatgaggttagaagttagaacctattgaaggaggcatcagtacaataatccatgttcctatacttaagcaatggaaattcagaattgctttactcctaccagttgcttaatcattcaccaattcatagtctatcaagttacaaacagaattagaagttgcaaaatcaagttgaacacaggggttaaaaacatttatcaccagtttaggtctatgttgaggacagaacaatccggtgcaacaataaatatatagtgcagatcaagctacatctgaatagatatgtaactctaagtatattacttagaaacaaattgaaaatttatactagttgacatcaagtaagttttattacagtataaattaaattacctatatagcacaagaattcacttaggccaaaaggacatgcagtaacttgtagccacacaacctctaacaaatagcatgcatttagcatcagcctaagtatattcagcacaatgcgccatctacctaagtggcatgaaaaaaatgtatattcagcactcaaaggcagaatatcagatccttgtatcctcaaattcagatcaacacatggccaccaactttcagttaatctcaaacagaagagcagctagttcgaccaacacagtttcagattatatatgtgtgtttatttaaaatccaagatatatacaacttaatgtattacaagttgcagaagtacaaatcattatatgcccagaattttctctattatagattcctaaaattcaatatgagttacagttaacttctcggaataatcatcacaaagaactaataatctaaaacatgatattcgttagaaaaatcatttcagtgtcagtagtacaactgaaagtggcaaagaaggcttttgacacaaagagggactagcaagaataacaatgccttgaaacaatattcgttcctctgcatatacttcttatttaagagaatcctatgatctctctatacaagcttatacattatattcaatgtctaatctaatcctaatagctttttacaagtttgtactgtgaatcggcaaacaaataagcaatccctagctggatcaacaatttcaacatgtgataaagatttgcttcattcagatgttagcagagcaatctaatctgctgcaccgaaaccaagaacaaaaatagcaatgcctgtagcaaagaaaacaaaccttggttgcagaaaccgacttgcagagaaagggttgcacggtgctgtggatctcgaacaggaggcggaggcgacggaggacggcggcgcggtgctggatcttgaccgggaggcggaggaccgacagctgatggaggcgtacgacgcgccggcggacggggtggcgcgatctggatgggaaggacggagcgtcggcgctcgcggacagggatcgggacagcgacggaggatcgcgacggggagggagaggaggaggcggaagcggagggggagagggcggcgcaaggcggcggcgggcggtggccgccgatccagtcgccgagctcctaccgctgtgggttctcccacaaagaagacccttttttactgcccatgggctgaaccccattctgagctacagtgtccagcccatcgtaaccctcattttatatggcccaacccaaccctgcccttatccttcctataacccatacaagacacaccattttcaacccattattgtttcaacctgtacaacccatgggttggccagcccattaccaggcttaccagtatgtgcaaatgaagtagagaagcagaggatggagatcaagttgctggttagccacgatctcgtagtacatgatgcctgtaagaaaatctattatatgttctagcatgttgttcgtttgacgtttacttattcggatttgctaactagctgtcgacagatttccgtggtctgcatcatgcgattttttggtcgttagatattctttgagatgtgtgcttggatcggcccacatgtggcaaggtgacatgggctctgtagagcagagtcaattgggccctgcaaggctgttcaattttgatttttgtgctgctcgcaagaccatctatacatttatcgataaattttcttcaaaaaaattgacagatgtaattatagtataatcgtagtgtaattacactgtaacttatatgtaattacactgtgacttgcatataactacagtgtaatttgtatgtaagtttcacgtaattttgaatcgttagatctattataagatttgttgtggtgagaaagaaaaaatcgcagcacacacatatgtgaaaggatttgtttcaacaacctccattttaccgaaataacatcttacagagagatttttgaaagttacatataagttacattgtagttacagtgtaattacatgcaagttacaatgtaattacactataattatactgtaattacatctatcaaatttttgggagaaaatttatcgataaatatatagcaaaattgtttgttcaatgtggctaagatgatttttgggcctgttaatgggtcttggtaaaagtttggttgtttaatctggctttagacaatttttggatctgttaatgggcctcgggtagttggcctcggtaaagggcaggcttgctatcccctttttttctttttatatatatttttgtaattgtttttctgctgaaacatctgagccgtttggtgttgatcccgtggctcaaaaatctgcatgatacaaccccttattttctgtcgaatcataaatagacagtcattcttactgacactaccggaaagtaaagcatattttatggttactgaaaacattcattccattgatcgacgtagacggggtgaccacaatatttgacgatttttttttttacaaaaacattcgtggactaatatcttgacttgagctctaatcttgcgcccattatgtttttacttctaattgtttatttcgagcattgtcgaatgtagatgcaccggaattcagttggtggattttgagttagaagaagtagtggccgtgtttcagttctttgaccgagctggagacgtttcgtgggatagcacaaattcaggatctagctgcttaatcggtcacagaataaatagaagaaaaacagaaaagctgcaagcatatgaaacatcagttttcgttagatactgttcaccatctgaaatccatcagttttcccgtgagcgagagggagtgatcaaatgcattttgcacttcagatgtagatgaaataaaggagcaatggttctcgtgtgtatgcctgtacatgttaccaaatagttaaaaaaaagtaggttaaattcgctctagattagaattttttttattttcggcgtgtcgctgactctatcattgaacatgccataacagctctattattctatagactattccattcgagatttgctccggcccaacaaaatcattttcaattgttagatctaataatcataacccgccgttgtacggcagcttgagcacgttgaagccgtcgtagaagccgatgtactgatcctcccggctgcgcatgaaccggacgttgacggagctgccgtcgaggcggtggaacttgccggtggtggtgctctccctggggaagggatcggaccacttgcccttgaagtagatggcgttcacgagcaccagggtggtgaggcgatgaactgatccatctgggaggatctcagggatgagcttgttcgtcgccttggacacccactcgttgatcttctttcttgatttctttggctgcatatgaaaattttacataccaaggttgatcaaatttcagaaatcgtcaaaccgaaaaattgggagccgcttgaactgactgacctgtcttcggaagtttgcggcgcgcgtcacggccttgtaggtgccgccgtgccggcggcggcggcgcggtaggccggcttcagcgcgagcgtctcgtcgtgcaagacgccgcaggcgtaggagacgcgcggcccgccggacgcggacgactcgttggcgaggccgacctccacggcgcggtagacggactccgcgaggtcgtcgagcgacgatgcgccgagcagcgcgaggagctcgtggagggtggtgccctgtcccccggccgccaccagcgccagcgcggcgtacagggacaccagcgagaacacgaggtttctgttgttgttgacgtcgtcgccgttgtcggcgagacgcttcgccagacggagcgcgaaggccgtcatgccgtcgcagttgccggcggcgtcatccatggttcttgattggatggcaacgcaggcaaggtcaccgtacgtgaaactcaaactacaataacggtgcgcatatatatggcagatggaaattaagatatgttcccttgaatttgcacactatagagaagatcaaataatcaattacccaattaattaaccacacaaatttaaggataataaaatggttgggcccagcttaagacctaggttttcctttcacctgtgcagccgccgcatgcaagctacttcgaggttcgagctatatatatgcccaaatgggtccaggcacgaccaggccttggccgatatcagtcaggccggtacggtctgacctacatgccaggccgggctgggcccacccacgggctgcaccgatggtccaggcatgctgaattagactcgggccattgccgagccggcccgaaggcaccacagtctattgtacttctttatggataagtctattttcaatcatcaatctctttgggccgtgtattatacagctggactaagtctattttgtatcccttttatctttgggtgtcttttttgagtccctcaaccatttttcttccgtgctcattgaaccgtgctttgccaagctggcccaccgtgctgaggcatcgatctaggcatgacccaactgtcggactgggtcggcatgggctcgacaccagtcatgccgtgttgtgcttggggcgggctgtcgggcctcaagctttacggccatctatacttggagcttcgtcgagaagaaagccaccattatcgctgaaggcccacacatgcatgccatgtttgactctcctgttcttcaacatatttggttagggaaatttgaaatggtgaattagtcgctctgttccatacaagtcaaatataagatgcttccattgcctcgaatccaaattcaaatctccaaatccaaattagatcaccatcaagatcgattgatatcatagaattgtgaacatacacaaaatcaacaacaaaaacatccacaaatcaacaaacccgtgggtagtgcacttgacgacgtcgagtgaaggccaccgcccgccatcgccgccactattgaggtcatcgagagcatatctggtggagggctccacgcgggggctagatccagaggccctcgagctcaggcccgttcgatctggcatcggtgccaccaccctcgccgttgccgatgaatccggcacagtaggctggagagaggcggggcactggccatcgggtgccgggtgatggccatcgggcactgaggagagatgccggcgaagaaggagagcaggagaagtggggatggggagagggagaagttaagtgggagagggaggagctgaggataaggataaggtatagagaggagctatagatatttggctcccacgcaattttttttaaggtccggttgtgtcaaattttttttaaaaaaatgatacgataacggtttttatctaaaaccggcactatatgtgcttaaaggtgccggtttttttatcccgtgaaagattttgtagcagtgaattcagggttgaacctatggaagaggaagatttacgtgtttgcctacctttattgtcctacgcctacccgtaaagcgagttcctgaagataatatatttttttcaactatccagagtttagagccatacaaaacattaatgtttatttagtatattttacctgtttaccatcttctatataattgataatgaaataatcttatttaccatgttttcatattcaaattataatttataaatcttttaaatttccaatgtcttgtggatttatgtctaaaattttaatctcaatatccataattagattagatcctcactgtattcaaatttcaaatcgctacgtataacggtattcatgctaggatttgagcttttattactctcttttgatagtgtagatctgagaggactatgaaaaaaatatcagtaccacagcgtacgtttttttacatatatatactacttttaaatatttcaaaaattacatttgtgaataaattacttttgatgaattaaattatacactcctgaattgaaatttttacatactttcatttatgacttaagctaaataatcaaacaaaataatcataattaacatatgaatgtgcctaacaagtttagaaattttaaaacattcctgaagatgggacttatgataagcgagctgagaaatcctccgtcatcagaattcatgttcataaattaaatatctcattgcatcaatcaatccacatcagccgttttcatcatccgttcacgaaatcaccaacttaatcaacactactcatacatctcataccaaacatagcaaaagtaatactaatatataattatcgtccacattaatttaactatttcttacttaatcactcaagcaaaccacacctaaacctcgaaaaaattacatcaccaagagactatacactgcactgcttatcatagacacacgctaacccagccaaacaagtcggcgccaccgccacgcacgccacgtcgacgctgacacgcggacgaacaccttgctgctccgtggcccggtcactcgctgccaccgccgctggcagcggctgcggcggcggcgctctcggcgacgaactcggcgatgcgtatcatgaggtcgcggccgtcgtcgaacgccgggaagacgtagaaggcgtggatggcgttggggtactcgaacaccctcacgtccttgcccttgccccgcagcatctcggcgtaccgcctctgccagtcctggagcgggtcgtagccgccgatggcgaggagcaccggcgggaacgccggggagtcgacgccgggggcggcggacggggcggcgaagttggccgcctcgtgggtgcggtcgcagccgtcggggaggaacgcgcgccacatccagtcggtgcgggagacggtcacgatgggcgcgccgtcgaggcggagctccgagtccgtcctctcctcgccgccgaagaagggctggatggcgacgaggccggcgacgcggacgttctcgaaggcggcggcgtcgcaggcgtagcggcgggcgacgtggtgcgcgatgttcccccccgcgctgtcgccgccgaggtagcatcgggcggcgtcgagcggcgggacgcctccgccgccgccgccgtggtgattcttggggtcgtcgaggtagcgcagcgcggcgatcccgtcgtcgtacgccgccgggcagcggtgctccggcgcgcggcggtagtcgacggacagcaccgcggcggacgcgtaccgcgcgatacgcctgcacgcggcgtcgtacgccgcggacgccgcggagaggaacgcgaacccgccgccgtggaagaagacgatgacggggagagggcgaggaggaggaggccgctcgtccttgccggcggcggcggaggggtagaagaggcgcgcgcggaggcgggtgggcgggtggacgaggacgtcgcgggaggcgacgccgcggcacggggaggagaaggccgggacgcgcgggtcgaggacggacagcgcgaggcggttgagcgtgccgtcggcgcggcgcgtggcgtcggtggcccagtcgacggccttgagggacagccgcatcaggcgggacatcggcggcttcggcttcgtcctccgccccagcggcgtcggcgtcgtgtcgtccgacgacatggccgccgctgccgtcgccgtcgtacgtgtcgcgggcgcgatcggtggagagaccgagtcggggcacacacgtatttatgggggattggacgtaggagatgggggtgagtgtggtgtcgcgtcggttgatagctacggatggttttcgtgtgccgtattgccaattgggtctattggctattgggtttcgtgttgaatttttgggtaggcacaaaggcagctcgcaacaaccgtggatggctattaataaaaaagtatacggaactgctaaaattgtggaattaaattttaaaatatacattatttttctcgattttgtatatatatacatgtgtttgaaaattgtgaatatggtttagtccaattgtgaatatggtttagatttagagacgaggaaaattacaatgtaaattttaaaatttacatgtaagatttgaaaattacaatgtaaatatataagagtttcatggtaagtacggtgtaattgcaatgtaagagtgaatgtaatttagtgtaaaaatgatttaactattttttttatgaaaaatatgacgccataaatatagctactcctgtatacatcagggttatcatcgtttggagaacattagttatactattggtcgaagccagtgatgaggacacgactagcttagatataaccatgactaccttatgtattaatcaaccaaatgtgcatatgttctatattagatttacttattatatatttgaacaaatgttgctacacaatgagttttgtgtgttttcgtttgcagaggtacttgcttgggcgaaggaaaagaagttgattggggactaaatcaagaccttctccaagtttacttctacctcaccatgtcacttttggtccatagaagacaagggataaaattctacatattttggattcggattcgggccttctgacagcatcaacttcaaacagacctagccgctgatttagaaggaattttggggctcatgtgtacttgttggaaagcttatggaatctactatcaaatggttttggtcccatgtcaaaattcctaccaagctgccaggaatctacaaaacaagccacgtatctcatccagtccgaatctgatttaggttttgggccttttagttgtgtcgtgggcttagcccaaggggttgtgcaccctaggccaaccctaggacgtccctaatcatacttaatcagtagccatcattgtttagagtcgggtttcgcttagattattctgtcgagaacagtttcgccgctagatcggtttgtaagaccccaacttgtaagcttaatctttcacctgcaattttggttgtattctaccttgttcttgtttgtgttcttcgattggtaaatagggattagtcttctcggtgaggtcatccgcgtttcgacacgggtgataaccagaggagacgtggtgctgcgattgcggggctcaagagcatgtttgttcaagaagccggatcaatttgtgtcgcgactccgctcaaatcgttggttatcagaacctttcagaagattgggaaccctagtacacatcagccagtgttgcttttatatatcaatatctcacgagtataatatttgaaatgacctaatctagtctttgtaagcttaacagtatggagctctcacatgtgatcgacgtcttaatagaagtgcaacattacacagatgtaatatgttccataactactaatccgataagcttatctaaattacatatatgcactagattgcatctatattgggacggaggaagtacagtaagaaaatggccatgaccgttgcaaatatccctattttgatccagtaacagtcacagctatgcccgctcaattgacgaagtctattgtggttttcttgtagaggcaaggtttgaagagtggtgaatttagaggtgatttacacaatcgtcgcgtgtgtggatttgtttacgttgaggtattattggaacaaaattaaaggatcggggaaaacgaatttgaagaacaataatttatagaaagggagggaacaaccttgatggagctcccatgacgcaagtaggaaagcaaatgggtagttgttcgtgcagctgaacaagacctgagctgcaaagcctgcgaaaccaagcaacacttcgtttcatgtcttcttaaaaatttaatagcacttgccaaatgaacagccccgtcattacgcttatacttacgtttatccatatcacttattaccaactaaaatataatttattaataaaatttttatatacaaacaaatatcgtaacttaaactacgatgaaaaaccacaaaatcaacttcataactaggttataaactttaaattttgacttatatacataaacataaacaaaatagtggcgcacaaaaagaaatgaaattgtatatgctctaaaacctattgatactaggctgaaatttttacaaaagaaatgttcaagctaaaaccgctaaaaaatgaattgtgtaaatcttattgaaactctgtaatattcttttttttctcaggaaagaaaaagaaaaacaatttgccggtacttcctctttatgggcatccatactgatactccaaccatgtttggtgaccgacctttcctgctaacacattgaatgaccgggaattttgttgaggaataagttcaccagccgtccctcaactttacgtcgagtctgtataacatcctaaacctcaaaatcagatatgttcacccctaaattatacaaaaccgtgcaatctcggtcctatgacagtatagatctctggttttgctgacgtggcatactagtcagcaaaataaaaaaataaaaaatgatgggaccctcatgtaagtctcttatttcttctctttttctcctctcctctcttctcttctgttttcttcttctcttcacttctcttcagcgatggcggcagaggcagagaggggacaggcggccggcgacctccgtcgcctcgagcgcctcgcgacgggagggaaagggggagaggggaggcggccggcagaagatggcggaggggagaggcgcggcgacggcgccatggccagcctcaccacttgtgggtcccaccgcggaagggcgcagccaccgctgcctccggatgatgacttggaccgccttgtaacaccctgaaaattcgacaaataaaacgaaacctgaaattaaagtactttcaaaaacttttaaataaattgcatcatgccgatgttattggttcttttgttgtgcatcatggtggatgttatggttgttattgcttgccaaactataaaatatcacaaatgaaaattaagctaaagctatataactacgtaaaaattataaagttatgatatttattatgaaccctacaaatatttatgcacaacacaacaaagcaatacaaagagaaggttaattactaaatcaatttataagtcaaatattaaatgctacacatgaaataatcgccactacgatgattctatatataaaaggagcgttccactagaatatttacattaatatttataatgttcattgagtctctcatggaatagaattcactcacataaagtaaatggtaatgcaaataaattgagctttatatatataatatgtttatgtgaatgtctaattaaacatttagatcaatatggtaccaagtctcaatttacttttgtgaaataaatagattaaacctatccatgtgtaaatacattgttatccaaattaactcgaccaatgtgccattgtattaataaggtgatattagtatattctaattaataaatgtccaagcctacaagttatataataattatgttaaaccaatacatggtgaaaacgaataaataccgaaatcccaaaagtataggaaatcataaaaggtatagtacaatttaaaatttttggacaatattaattttgaacaaaattcacatttgaatactgcatattgtcgttaaaatgcattggtgaaaatataaattgaaatagccctctttcctcaatttataaaatcaatcaaaaccctaaatttacagcctggcactgttcattgtgcgccaggtgttcgactcgggtctaacccggccaaacacccagcgcagcatccgcctccccgtgcacgcgcgcgcgccctccttgcccgtgcaccgcgtaaccacgcgccgcaccgcgccacactcgcgcgtgggccccgccgccgaccgagccgccggaaacccgcgccaaagccgcgccgccacgggagcgcgcgtcaacaacgtcacgtcgcccatcgtctcggagccgataggtaacggccgtgacgccaccccacatcacccctaaaccctatccaaccgccctacagccggaaatccccctctcaccgagccgccactctgccgtcgcccatgtgcgcgcgtcattgccgtcgcatccgtgacgccgcgccacgccaggcgggcccgcgatcggaccccggtcaagacgccatcctcacgaaccttccactccaagggttggggagcgaaccgagtggataggcgcgctgccgtggccacgtccgccgcctcatccacaactaatgattactagcgcccttccttgtgtacgatgggtaaaacggagccttcctctctagctagagctagaacacacagtataggggtcatagatgcaatgatctactacagaactttaatggaaaaggagcaggaaacatagccgcgtcaacctccctaatctaggccgtatagacagccattgagtgcaccagctgccgatcttatcctccacgccatcctggcttatccccaagccaagccccctaaaaactccatccttatctgccttttcctcgaatacatttcatcgaacaccttgtgagcatgtttcatcatcactggttggagccgaagccggcgtagctgactgcgggaaccgtggctcgggacgcctctactgctgctgctgccttggatcaacgccgggtgctgctggaactcgaggacctgctgacgaacggctgcgcgctcgccgccgtcggcatcctctgcttccttaccgcctccccaccgcgacgccgcgtttcgccgactcgccatcccacggtgagccctcgcgtccgtagcgtcctctaccctactattagctagcctcggttcctattttagcgattagcacccatggccgtgccggcccggctgctgttccgccgccggcgaggtccccgtggacatgctatcccggaggctttcccttccatcttgttaggaaaaatggaatcaccatacactgtagaagctttcgcacccatcaatttggttggaacctagccctaccgccctatccccttgcaccccggagctcggccatggcggccatgccgcgccgctcgcccccgcgccgtcgtgcgccgtggctgccggcgggaggtcaccggagattcgcctcatcctccccggccgcctctgtgccggcctcgcgccgtcccggcgtgcgcgctaggcgcatggcgcggctgcctctgcctggcgagaggtagaagacgacggggaaaaaaagaaaggaacgagagagagagaaaccgtgtggggcccacatgtaattagcacacagtaatgctctccctaatggttattagcccactcaatgacatgtggggtccctgttattaaaatctaagaaaacttaattatagattttgtgtccatgacagaggggacccaccggcaattatatgaccggcttgacctcagtcaacagggggccggacccacctgtcagtagcacatcacatttcccttagtagaataaagataaagaaaagaaaataagagtggacctacctgtcagtcactaccacttactgttaacgctgcaataaaaataaatcaattatgaacagtactgtttcacaattattggaattaattcaaatttgaatctttaaactagcataactcactcattttaactcggattcgaatgaaacttgaacctaaatttatctaaaatcaagatctaactattggtaccactttatcaatttaatttgtactgtttgaatttttggtgattttatttgaattctaattgaattcaaatcaaatctttcgcacgtaaatttagattccgaaggagttgctgagttaatcaaagatccgggtcagcaaatctgtgagcaaggcaagtcatcactaatctttgagcatgttggacctattgcgaacttattttgatttaaataaagtttgcatgctatttatatgtgaatatcctactttgttatatgccatacctttgatattgattatccatatgtcggtgacatgggatcaggagtatcatgactagaggtttgaggcagacacaatcgcacacgtggcctggtacccccgagggacgtcgggcccgagggtgatgcgttcgccctcctcttagtccccccgagggggtggggccgcacccccctcggccccgagggccgaggcgcnccgacccctcgtgggtttttgctccgcgtatgggttaggtgagnacagtggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcctgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgtcgtgactggtctgataccggtcatgttgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaagagagaaatggtgcatgtggtgtccccttaagatataaaaggaggaacttgcccactgagaggggggactggacttttccagattagaaacccagaacaagggagaggctggctgatactttgtagctccttcatacacagatctcccaaaacacaggagtagggtattacgcttctcagtggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcttgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacgtcacccgcccatcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcgaccgccactccttcgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcttcggaatgtccgtcaccacggacgcggggatcagccctccgtgcccccggttggtggtgtcggctgtagagcctttgtggcgagccttcggaatgtccgttggcccccaaggtgccggcccaccatcgccgaaaaatatgacgggagcgtcaaccccaccgagtttctccaggtctacacgaccgggatcgaggccgccgggggtgacgacagggtcatggcgaatttctttcgcatggccctgaaaggacaagcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaaccccttcggttccggtgtggcagcttcggccacccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccaccgtcgatgggggagggtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgccgctacatccaagcccgagggtggcgaagagaggcttggcgcttccgcccccgccaccccgaggcaacggatgatcacaggcgacgaggtcccggtcaaggaggttgccctgggcgacggcccgtccaagaccacatggatcggtggtcttctggacggcaaataggaagacgcgctcgtctccttcctgcgggcaaacgctgacgtcttcgcatggagaccgacggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaagccggattcatccgtgaggtcatccatccggagtggctggcgaacccggtggttgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctacgggcaagcttctagggttcttggtctctgcccgaggcattgaggccaaccctgagaagatacgggctatagagcggatgcgccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcgacattggttgtggagcgcgatgagaacaattctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggaacccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaagatcggccccaccgaaaggtgcagcggcccgtctactttgttagtgaggccctccgggacgccaaaacccgataccctcaggcccagaagatgctttacgctattctgatggcctcgaggaaactgcaccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctattggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccagcccaggccctgcagaccataccactttcgtggccatttgctgtctggggactcgatatcctaggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgtgctaccagcagagcctgcggcgctaaaatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggggtcgggtgtcaggtttcgggctcgcgccaaccccgcacccccctcgggcgtgcagggttggccgggggctacaacatatgcatattcttatttctcttatatctgaatttctataaaagcagtttcaatttcctaaaggctgtatctgtgctgttttttcattttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcagtccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggaggtaactcatccagcgccatccatggagagaaattggggtccctggcctggtaactcgccaggacgagctccaccgctccttgggcgaggttcctcgaagatgacttaattgtcttctcgagctcctcggggagccgttggagagccccggccatcttcgagaggcgctgggcgaggcctccctggttggcggcgtactttacggtcctccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgtgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtgcgccgccagcgttgctcgcggcctcgcggtccgccagatccctctccacgacgcaggcgcgctcttccagcgccatggcgcgcgcctcaagggcctctttgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgctggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccacatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcatcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggttcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatacgggaaggcggcagcacgctaccatcgagcagagcggaaccccgtgccatggcgccggaggaagagaagattaagagcgagcgcgtgtggcgaaggtagggcacaggaaagaaggagttagggcgcaagacaaggggaataatggcgaaaggaaggaaacagatcccttcctcagtgcctttatactcttgccaacgctgtgcccggctcctcgcttctcgcgcccactatttcgccccctcgtttctcgcgcccacgctcccactaatcccattcgcccgcttgcggcgcatgaggtggatatgcggttgtggcagtcgagatagatcatatcgtgcgcgcgttaattacgctcgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggg

SEQ ID NO: 2057 - DNA, 17741 bp, Oryza sativa
  unsure (1)..(17741): unsure at all n locations
agctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggggtaagtccccacaaaaaagagagaaatggtgcatgtggtgtccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccatcaccatataatctttgtaatccatgatatcgtgtgtctttagtcaatatttgacaaatgcttagcccatgctaatttagattcatgcatattcatatttatcaaaatgctttatgcttgggcaattaccttagggaaggtaattgacatacggcatgtggagacatgagcgccacattgctatgataatgatgagatgatttgtgaaagaaaattaaactaaacaaatgttttcgactgaggcggctggaggacttgggtggtgtccggtaaaggctagtgccgtccctggtcagttaaggaccgagccatgaagttaagcatgaatcgaccccagtacatccgtatttctcgaatgggtatagacctagcggagtagatagccgagcggaggcagtatccctgcatacccgaaacaagcagatgtggacgaacaagcagtctactggcggatacccgaaacggatggccaaatggcggatacccgatacggatggccagagactgacttgtcaagactacaagactacaaggagataaccaaaagaggacagcatggattgggttcaactacaggaagcaacgtaggaatgcatgtgtttttcccatcccgggagcgccagaactcctctcgctgctagaaaccgtatacgcctagagtgcatgaggactcaagttcatggagcgggtactgccaaagtgaggttgttgaaaggctttgccgtggcaagtctcattcgttgggacgtaggctcatgtgttaggcaagtcgcggagtacgggtaaagtgtacatccactgaagtatgagtaaaccaatctattcgaatagccgtgctcgcggttattgagcaccgggacatgtattacacttggctagactctaatttcttaatatgatagggaagggatatgcatgatgattttgtaattgtggatcaacttctcaagaggcgagaaggggtagaccccagaaaaccattacgaccagtggcgggaagctatccttgggacacaatggatggtagacagaaccgtcgctgtttaatgaacaatggagttaaaacttgatcagtttatgctaggtcttaggcttatgaaaagaattgcaaaattggctttatgcaaataaaccattagcctttcattgaatatcctctatcatatgcatcgttgttatggtggcttgctgagtacggttggtactcactcttgctatttacaaattccatcagaagccggtgatgaagtctcggatgacccatatgcttactaccaggagggtgaagaagatggcgacgcttagtaggtcttagttacggtcgttgcctgtggcaatggtgtcaccgctgccttgattccgctgcttatctatttctgcttttggatgtattccggaccatttggtcctatgttctaagactgcctgcgggcctatgatgtaataattcgcgctagacaatctatgtatgcgcacttgatatttcagcaatgtaatcgtgagtaccagactacttgatccagggaaatggtactattaacacgagtgattcctgttataaaaatgggggtctacacgccttgacgaggtgtctcccgacgccctcgccttcctcgcgacgggccggcgctgtccgtcactgtgcacgacgcggcggcggcggcggcggcggggcggtccaagtcgtcatccggaggcgcctctgtaacgtgaacacggcggcgcagccgcggatgatggtggtgttggcggcgcgagcagcggcacaaaccaaatgaggatctcttcctccgccatgttgcagggctcctgaccgacgaacaaccgcaccctcttgactacaagttaattaatcgatgagtaataccaagatcttgatctcgagtagcagtaaatgtgatcgaatcaaaagcagcgcagcattggcacctccgccttaccgtccagtgcgacgacaatgtcgtgctcagcgccggactccagcaaccacgccctcgtggaccagcacccgcacccaacgaaccgctccctttcctcctgtgcaggtgcctcgacgtggccgcagagtcatgcatggcgatggacagtgccgtcctgtcgagaggaagacgacggcgtcgggagacacctcatcagggtggtcgaagtcgtcatccagaggcggcggcggctgcgccccctctatgacgggacccacaggcggtgaggcttgccatggcgccatcgccgcgcctctcccctcccctctcccccttcccctcctgtcgcgaggcgctcaaggcggcggagcttggcggccacctgtctgtcacactcggattttcccttcccttaggtttcaaatcactaataaatggcttcaagaatttgctttagttaaccagaagaaaaccccagttagcaatgcatttaataatcggaattgttaggaagaatttttttcgaattctctttgctctgaaaatcactaacagaacttaaaggataaacatcttcctcatttgcctttggtcgtgaattatgcccaattcactctcttctcagtccgcggtttcgttttgcatgacgaaccgtatctgttcgcgggaccgttttctttccttttctaaaacggcaccgcattgtttttccttgttgggaaagtctcccctctctgccaacattgttgaagaaaagcgaagagaagaagaaaagagaagagaagataggagagaagaaggaagagacttacatgtgggtcccacaattttttatttttttattttgctgagtaggatgccacgtcagcaaaccagatatccatactgccatgggaccgaaattgcatggttttgtaaagtttaagggtgaacatttctggttttggggtttagggatgtcatacaaactcaacgtaaagttaagggaaggatggtgaacttattccaatttgttgagacggctgagcagctacgcttatggcccagcttcaggccgaaactctaccccaggccagcccaacaggaaggattcatgtagccattagctagcccatcaccgactggaggtttttttttttaacacattatagatttggtttcgactatttgatatctggttcattttatcataggcattgtcatgaagtgctaacacaatcaaaatgacaacgaatgtatggctcattttatcataggcattggtgtaaaactggatgtcccatttcgaatttgatttctcagcttcattgtagttagacattattaggcatgtaaaaaaaattgtgactgaaatctagcctttgccaaatgttctgttttgtcttttgatgttcaacatggccatatgtaatagagaagtgaagccataaaatatgtttgtttaggaggcaaggcataaaagattgtattaatcagatgacctatattgccctcgaaaactgcatgccaacccaggaaaactgtagcctatattctgatgattcttgatctgaattgtgcatatacaaatttgtggatctgtagctatgtcatcatggattgatgctttctgactatctgttcaagctagaattctggttatcaatctttctacgtttttcattgaagatgtgtattggttcatgcatatacataaaaaaatctgcacgatatgcatgtctcaggtggttaatattcctgtttactaaaacccatttcataacgtaccgttctcttgcattaatcatgaactggagaaaccttttccgctcgaacaattatcactcaaacaattttttttttatgctgtgaacctccaaaaactagatatgtgagcaagtcatgtttgattcgtttaaaaactcatgttcaatagtcttttttttttgaattttggttatttaaaaattttattcctagttgaactcttatttttcgttttcaaatttcggaatttattttactttgtatctcgaattttaattaatctcatattatgttttatatggactattctttcaatatttattttttattctaaattttggttgtttgtaaattacttgaactcttattttattttttccaatctccaattttatttaattttttattccgaatttcaattaatctctaattgtgttctacatggactattcttttaattttttttcattttgaatttcaattatttctaaatgtgtttctatcagaattcttctttcccttttttctatttaatgtggttatttctaatttccacagcgaacgtggtgtcttattttaaaattgttttaataatacaatagacagcggttagagttgtttttaaccttgtttttttaattttatttacaagtattaccaccccgatggagtaaaaagtaaaacatgtaatggagggaagttctttatataatggttacaatcgaaactcaaacttaaatcactacctcatctgtcacaactcacaaacaataaatcatatttattggcaacctctactttttaacaaattattcatacacacgaggtatacggggtactactatgcaacaaagactactccacgcgtcatcttgctattggcgtcatcttgctattggctttaggtcgttagtgcctagtgacacacgtggctggcatgctgcctaatcattccacgtcatcacccactcccacatcacgcagcaccaatcaatcaccacttcacccccaaccacaggagctcgtcctcgtgcaccgcgacgccgacaagtcagtgctcgccgccgctgccgctgccgccggcggcgacgatgtccttaatccggagcatgaggtcgagcgactcgtcgaactccgggaagatgtagaaggcgtggatggcgtcgggtaatccagcacgcgcaccgccttccccttgccacggagcgtctcgcagtagcggcgctgccagtcctggagcgggtcgtagccgccgatcaccaccgtggccggagggaacgccggggagtcaatgccggcggcgccggcgggggaggcggcgtgcgcggcctcgtgggtgcggtcggcgccgggcgggaggaacgcgcgccagagccagtcggtgcgcgggacggagacgatgggcgcgccgacgaggcggagctcggcgggggtgcgctcctcgccgccgaagaatggctggatggcgatgaggccggcgaggcggaggttggcgaaggtgtgcgcggcgagggcgtagcggcgggcgacgtggtgcgcgatattggcccccgcgctgtccccggcgacgaagcggcgggcgacgtcgagcggcgggacgtcgccgtcgtcggcggcgagggggtggttgttggggtcgtcgaggaagcggagcgcggcgaggccgtcgtcgtagggtgtcgggtagcggtgctccggcgagcggcggtagtcgacggacagcacggccgcgccggcgtacctggcgatgcgtcggcacgcggcgtcgtaggcccgcgacgccgcggacaggaacgcgaacccgccgccgtggaagaacaccacgacgggcagcggcttcgtcgcaccggcttcgccaccgccaccgccggcttcgcctccggtggggcggcaggggtagaagaggcgggcacggagcgggatcgccgggtcgacgacgacgtcccgcgtcgcgacaccctccctgggcgcggcggagggcggcacgggcgggtcgaggaggtcgaggaggcggcagctgatgatgccgtcgacgcggcaggtggcgtcggcgccgcagccgacggcgaggacgaacaggcgcgtcggccacgtcatcggcggcgccaccctcttcgtcttgtccgaatccgaatgcatggcctcgtttcggaattcgggacagcgcgctgagctgaatttttttgagaattaatattatttttatgaaaaatcgcaaaagtagtggtcaaccggggaaaatcgcgaaaataggtccctgtcgaacgggtgcagttcgatagggcgcctatcgaacggccagagcgcgactggcgacgagatcggaaggctgccgttcgacaggacctgtcgaacagcccccgttcgacaggcagggctgtcgaacagcccccgttcgacaggctgggctgtcgaactgccgcagttcgacaggatgtccgtcgaactgccacagttcgacagggtcgcgttctccatttatttgtaataagttattttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaatagataagtcaaggacgatcagtgcccttcgcacgcttgctaggtcctcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcactccgtgatgcgtcgacgccgaaccgtactcatcgtctgtttgtacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtctgttcaacacgttgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggacactcgtcacgtcgtcagacctgacgactggaggtctcgcctctagtctttgcagcagggtgtcggactccacgtgaacgtgctcaacaaattccgcctgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactaggtgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaaatgtaggattaaacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtgacaagtcgtcctccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactgcggctgtaacaagtagtagttttcattagtcatataaggaaagtttgtgaactagtattcataatgataacataaacgaatttaacaaaaattacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagttcggcatatgtcgccgcaagtaccgccgacccccaactgtactgtggaatctccgcgataggtaactctgcaatctgctccgcaaagtggatgaagtgcttgtccacggagtcagcgtgagttcccgtgaacatcacccatccaaacaaccacaacaggtaagcgactaagtgccgctgcacgatccactcctcctggtcatcagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagctatcggcagccccaacaaataagacacatcctgcagagtgggcaccatctctccaactgtgtggtggaaagtgtgggtctcaggcctccatctatcgacaagagcactcataagcgccgcgtcaatgtggattcgttcggaccttgcacgtgaaggctcgaccaaccgtgcaaatgtcaacaacccagctgctctcagcctacaacatgacagagcgcaagttattaatacatgaaaatataaacaccttgtattagtaaaaacaatatattttcacacaccttggaacccaacgaggatcaatacgccaatattgatccggtcctcgcatctttagcacattgcagaaagttcctgtactaagacgtcgcgatcgatggttcctatcgatctccttgtctatcagctgcccatcattttgatcagccatacctgcagatcaaaaaccacattagtacaatgcacgtatggtaacagtacaataaatgtatgcaacataattcaattaacaaatttgcatgccatttcaatttaaaattacagtaccagcacacatagatacagataagaatagttcagtacatttcaatttanaattacaagcccacgacacatatattacgatattacaagtgcagtgcagttcgaaatttanattagtccaccaatacaaatacatgacgatattaaaagtgcagtgcagttcaaaatgaaaattacaaggccattacaaatagattcgggtaataaaagtgcaagaaagttcaaattaaaattacagacgcactaaacataaattgaacgataacgatcttcaaagtagggagtccaccaaggataatagcgaactaaggattatttttcttcttcgacttcccctttggaacgcgacgaacatcagcgcctgtggcatcttgccctacattgtacatgctgcaatctttacgggaatggttctccccgcaaagaatgcaagctttcttacgacgagaacgatctttcacttcagcttcatccataaggttcttgatcctgcgtgactggcgacgacccttagtatcaactaataaatttgagtcaggaacccaattggcttgccctggaggaggacgagtgaaatcacacacggcacgccaaccacgcaattcaccacgccaagttgcctcccacgattcctttctaaagtagggagaaacaaaaatgtttccatcaacaccccctttgcggaagcagcaagaacatgggaacatggccgatgtaacaggtaaggcttgttgcaattgcatttgcaagcgtgatactctggccacaacgtgcattccaatgtgatgtcagtagtcccaatgccgacaccactcttgtcacgaagtcgtatctcaaataacaactctctattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccaattatacacttcagcaagatttgttgtcatcacaccatacctcaatccatctgtatcgtacaacaacgaccatttctcccttggctcaaattctacccactccgtgaagcacttcgtggcccttccacgcttcctgcgccgagtaatacttggtgcttcattaggaatgggttcaagtccctccggctcctcctgtctggcaactatgggttttttcctaacctcttccatgtgtgtagtggtcaaatgatccagttgctcccatatggcatcaaactttctttgttgattctgcttgcataacttcttgaacaggtccatcaatctcttactcctgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagttgatgtgttctcgctttcaacaaatgcaaaagcaacaggaacgacatggctatccgcgtcgactccgatcgcggttagaattgttcctctgtacttgcttgtcatgaaagtgctatcaacacagagcaaaggaatgcaatttttaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaattatcgggtatgtaagtttcgttgtcccacagtgttgtatcttctccttccactacaagcgcaatgtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacattttgtcttctgcaccactattgccaggctatagcctttctcccttactttactaacaaacttcctccaactcccagttgacgcaacctccactactctccactgccatccatgttgacccctcactggccacacggcatttatgacaaatttatcatgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacatattttaacacacaacatatcaataatatgtactaactaagaactaatttaaccgtacaattacttaaatacctctaccaacatttagcaataacaaatatgtgctaaccatacatactaacattgaacaatgcgaaacaattaacaactcttaaaccaattttttattaaactttcatatgcattgtacttagggattactaatgtataccttaacttcactgctggagggcgtcgccaaccctttcctcccggccggcgcctcctctccggcctgctatcccctcccctcgctccctccggtgctcacggcgacgatgtggcgactctcgacggcggctggcgatgtggtcctcaaataaatcgaacaagcatcgcgggctggggagacggggctttaaaccggcctgtcgaacgcccattgttcgacagggtcggtggagggacctgtcgaacgcccccggttcgacaggcctggcggcgcggggtggtgggccctgtcgaactccctccgttcgacaggcgagcgtgtcgaacgccagccgttcgacagggctctgtcgactgcccgtcgttcgatagatgccctatcgaattgcacccgttcgacagggacctactttcacgattttccccggttggccactacttttgcgattttccataaaaataatattaatcctcaaaaaaattccgctgagctcgctttgtcggatgcggaagcgtgtgggttatttataggaggcgaccggtggctgacgggtggggccacagccgccgctctagtagtctagttagtcgccgtcgccggccatatgtatgcaactgggggtaattacggtgacgacgctattaactgcgatgttacccatgggtgcaattagtgcaactactcgtgtatgtagccgtcatttggggagatgcaagtgtacctgcagcgggggcgtgtcggccgtagggcatttcacatttgaccaacgcaacagcacacggtttcgatatatggcgtgtgacgagctgacagtgtttcaatgtgtgcccttatcttgcaacaagtgtctttcaaactgataagcgatatagaaatatcaacaaataataataaaaagataatttataggtacagtatttatatataaatataaatgtattgttcgtggtttacaaggcaaagggttaaaaaaatactacctcagtttgttaatagatgacgccgttgattttttatcatgcgtttgactattcgtcttattcaaaaaaatttatgtaattataatttattatgttgtgagttgttttatcactcaaagtattttaagcatgattcatatcttatacatttgtataaaatttttgaataagacgaatggtcagacatatgtttaaaagtcaacggcgtcatctattaaaaaatagaggaagtataacactgcgatgaaaaaaattcatagaaacataagtcttaagtagaaacaactataattaagtttatttactccctccattttaggttataagacgttttgactttggtcaaagtcaaactgtttaaagtttgacttagtttatagacaaatatagtatatttataatagtaaattagtttcattaaataattaattaaatatattttcataataaatttatcttgggttggaaatattaatacttttttatacaaacttcgtcgacttacgtcttataacctgaaacggatggagtaatttatttttttaggctgacatgtgaacgaacaaatgataataggctactaattatattaccgtgcaaaacttttatctatcttctcttccctcctctagttgacattgtgccgactgtcaccggctaattactacgtacgggatgtttcgttgcgctagttcgctacgaggataacaacataggacgagtagttcaaaaaatcggctaacttttctgtaaacaaagaaggaagtcgtcaaaacctatacgcactaaatgctctacttgataggaattttatctacagaagaaaacggggagaacgttaaactttaattacgtagggtttccctattggccttatccttgcgtacattgattgcagcaaatgcatctactactgaataaccgaaaccacgaccatgattaatgctagcgaaagccgctctgtctttgatcgaaggtgcccacactcatcttgttcgttgtcctcgagtattattcttctaagagcaagttagtacagtccactactaactccaattcatctatagctaatctaatagtcaattcatacaatagttgattactatactattaagaaaaaagtatgaattaccccctaaacaattgcggtcgaccgaattacctcccgtaaactcaaataccagacattttacaccctaaactatttataccggactaatgaccaacaccgttctgagcggttttgatttgagctagtacacgtggcgccacctgtcagcaaaaataaaaaagttaaataacccctaggcccacctgtcatccctctcttcgcccaacctctctcccagccccccgctctctttctatcgccggcgaggagatgggcttaggcttgatgcggttgagatggatgtagaggcagccgaggcactggacgaggcggtcggcgctctggacgaggaagcgcacgacgtaggcgtcggtgaggagttggagcggcggggcgacgtaggcggcgcggaagcacacccacgaggaagggaacgagtcgacggaggcgacgaggacgtggccacggccgttggcgttggcggcgagctcgacggcgaggaggaagacggacaacaggagcgatgccctgatgaacgcgtagagccgggaacgcggcgacggtgtctcggcgtcggcatcatccgtccgcccggcggcgacgcggcggcggaggcgaggcaccccgcggcgcggtgcgcctgagcagctgcaccaggtgatctgcttggcgttcttgcccctgcctcgccgtcgtccgccggccaagaactccccgtcgtcgtcgtcggcgtcggcgtcgatgtcgatctcgcagatggaccagttgggattgtccatcttgacgacgaccggcgtctcgccggcgccggcgagggcgggcttgctgccggcccagaagccgctccacggcgccatgcacgcggcgggagcgagaagaacactcgacgacatgacacgacactcccgccactcgctgagctcccaaaatagcaagctttcactgacacacaaatgcacactattcctggggctccccttctttcgagctgctgccaatgcccatcaaccggagccgcctcaagtcaccacacctccctactctccgcaatgcgatgcgagcagcgagctccactgccgccgttgcaatggcagaaaagctttagaagaagaaggtgctccatcccgtgcggcttcaccgcgctcctcgccggcgacctcccggcgtgcgcgccgccgctgaccgtgctcttgcacttcttcgcagcgctcgggtgcctgcccgagactaggtactccttccgtgccgccccatgagagagagagagggagagagtgtgaagagagagagaggaggggaaggggagatatgacaggtgggtcccacaacttttttttttaaagaaaatactgattgggttgtcacgtgtagtcacgtaggacaaaactgctctgaattaagttgagggggctaattcatccggtattgaaagtttagggtgagcaatgtctggtttttgggtttagggggtaattcggtcgaccacgatagttaatggggtaattcatactttttcctactattaatatatggtcccacctgtcatacatacattgcgccttgaagcctatgctgcagctggctacagatctatagcccgctgctcttctctcttatcttttatcttattaaaatatgtttatagccagcactgttaatgttaatagtgctattgtacatgctctaattcatccctataaaagctgaattctaaacggcacctttaaaattcacgtgctggaaaaataagtcttgacccgactcagtttgtgccggctctgccaaattcaataaagatcaatacatagttcattattattagaactagaagatagcgtgggcatgcatgataggatgcgttgtttggataagtttttaacctatttgttagctttatgccatataatatttaatcatcctttaaaaaatgagtaaatttcacaaaaatatacgtatagttttgtggtccaagttacagagaaccacacactttaacatttggcacttaagtatatatattttggtagtgt

SEQ ID NO: 2058 - DNA, 3605 bp, Oryza sativa
actaaactaccaaaatatatgtacttaactgccaagtgtcaaaatatatctgtaacttgaaccataaaacatgtagttttgtaaaatttactcttaaaaaattatctataatcttcttcctcatctaaaataaggcagaattagtctgttagaaaacatatctaacaaattaaatgtaaattaaaaggtaggtgttatttttttgaattgaatgtttagaagctatctttttttctaccaaatcttaaaagactataattgctaacaaatatgttttatttgtatcatctagttagccctccttttatttagtttatagtgatgcaatttatattacttacatatgaataaaacagaggagatatacatgcaccctaggtcttgtttctctataatatgtgtgatctagtgtactttctaaaagaaaaatataatcaacttgacccttaaaaataaatttaatagtaagaaatataacttatacactctatgtgctgtaacgttatggtccctttgtatggaatgaaaaaacagaggaataaaaaatagacaggattcagataggaatgaaaaacagagaagtgcaaaacgtaggaaaaatatagaaataaccgtttgattggaccgcaggaaaaacacaagaattggacgagagagatagactcaaaggaacattttcaaaaggttggaactcttgctaaattttcaccaaaatctctatataattgttcatcccataaaaatttcaaaaggatagggtatgattaaatcctttgttttaaagtcctttatatgaatttttttctagagatgaaatcctccaaaattcatatatttttccttcaaatcaaagattttattagtattttgcttatatttacaataatatgtggagaaattcataatatagtggcatacgatagagaaaaaaatttgctacaggacaaaaaaccgtgtaattaactgtagaacatctaaaaaaaattgatttagctcacatacactccaaaagaaaaggtgtaatttgctagaggacactaaagctattatttttattattttcaggtcaaatgaaggaagaaacaacatagaaaagatgagtttgccctttagatccgctccctttggtttgggtattaacattcttgtcttctctcccacgagttagcagctcaagcgttcagccatggcgactccccaaatctaattcaaagccctcgccttcctcctcctcctcctcgccaccgccacggtctccacggtgtctgctgactatgtggtggccctcaccgagtactgcgccgccctcatcaagttctacgcgccatggtaataagcgatgatggctcgcctcgccgggtttcgtctcctcccgtggccgctgtgtctcgctgggatgtgtgtttgggtcggatccgtgggtgttctgggctgagggtgctcggatctctgtggatgagatgggttcggatcacgctagatcggtggaaatggtggcggcgtaacttgcattctcgaatttgtagtcgatttttgtgacattccacagccaattacatgttttttttcctgtagcaaattttgctaaaaatcattaatatctaagcacttaattaaaaaaatgatgtaatgattatggtaatggttgtttcaatttaagtgaaaagtatgaagaaaaagaagttataagattttctccaattagtttcaattaatgtatttcatattggcatttttttctattttctgttttgttttatgcaagtcttattttaagtttaaaatttgtgatatgttaaatagagatgaagcgttacaccttttatgtcaactttcttgaaaaagaaaacaaccaccttttttataagcatgtaagaccgatgtaggttttcactgtttactaaatgcatgatttgtagagtccaatattattgcatagtgtgggaaacatcccatctatgaacatttatgtagagcgtgtgaggttccgtatagcctagcgtaaatacaatcagagggctaaatttagttgtgcacgcattattattatttttggaatgtgatttattatgaatacatgcttgaataaatatgtgtgatataccaaaaatgcattaaacaccacctaaaatctattagatggtacctaaaaaaatctgttagatggtaacgtaatatagtttagagcaattacatgaaagatcatttggcttactcagattatttgactatattaatttcaaaaaaacatgaaaaaattggattattttcgttaattaaagccactatattttttagagtaaatttcacaaaactacaggtattttgcacaatttatcacaaaactacagatttaaaagcttgtttcacaaaactacagatttagggtcaccgtttatcacacaactacaggtgctttgtacaatctatcacaaaactacatatttaagaacttgtttcacaaaactatagatttagtgtattcgtttatcaaagaactacacatttagtgtcttcatttatcacaaaactacagatttaatttctccattatcacaaaactacatatttaaccatgctaaaacctgtagttttgtgataaatgaagacactgaatctgtagttttgtgaaacaagttcttaaatctttagttttgtaatagatcatgcaaagtatctgtagttttatgaatttttctctattttttatgtagtgacttggactatttatatttgagttaaatttgttttcttaatttggctatacatgtttgcataacaatctatggtgatgcgacttgtattattgaattatttcataattatttgtggtaatttggatgacatgacaaaggccaatggtatatgtcccaccgatttttatttgttacttcctccgtttcacaatgtaagtcattctagcattttccacattctattgatgttaatgaatcgagatagacatttttcacattctatctagattcattaacatcaatatgaatgtggaaaatgctagaataacttatattgtgaaacggagggagtatgttcttttctcatgtacagtatatttaatttagttttcatgtttacaaaataatatatgatggtgaatcctatgttgttgaattatttcacagctattttattatttcaaagacatataaaagggcaggtgttgtccataaaaaatattgttttatacttggatttatatttttttatactattgattgaatttagctatgcatgtttgtagactaatatataatgatgtaatctatgttcacaattttttacagtattttgttgctatttggatgacctgcaaagtgcatgggtcgattgttcccaaatttcatgtttcttatataacaaaatataggaatatgcatcttactttttttttattataatagagcaaagttagattagacattgcaggtgcaaatattgattgtttctctttcactttgatagcttatgactagtgaagagcatagagctagagccagagaggaagtggtgggtaatgctatgtgcatatgagggagggaggtggaggcgactttctttttctatctttcctaaatgatataatg

SEQ ID NO: 2059 - DNA, 994 bp, Oryza sativa
tctaacatattgccaggataggtataacaatcctcatacaaaaaatactgatttgcatttcaacagctcagtagaaaataatcatatatggaaaattaataggagatatggttgctgatttgcatttcatggtaggaatttaaaggaattgtagaatttatagatttggttatccacttgactatttaaataaaaaccaactatgttttttatactaagttatctaaatatccttctgtagaacatgcaaccatttcaaattattaaggttgccacatcctctccttagtgtaagaagaaacttcccaattgaaggtcactggacctggacagaaaataggcaattgcaccatgcatagaaatatagtatgaaaatatattcatctattggacttgcaaacaaaaactgaagtctgctattccatattgggatccagataattacctcattgtgcaggaaggtactgcaaaacattttcatcagaaagtaacaattgcttttgttccccatattgcattgagtcgtagatgtcaactaataatctattatgaatggttgcaaacctgaaattaggaataaatattttaatatcagaatgcccgctatcactatcagtaagttccaaaatgcttgaatgaatcacacaatagtattgggtaagaaagaccatagatattatagccttctatcataatgaagaaataaacacggatggaaaatcaataaaaagatccaaggccataaagaattgttgatctatgggcctagaataagcttactatgtaaaaaagcatatagagattaataaattaagtcaatcaaaatggagatataaaataatgtacctttggagtggctaaaatcaaaagttggttgtggacttgtggtaatatgccaagattgttaggtttacatataagctttgatgacgttcattaacattgccaatataagattgttcataataaacatcatctatctattctatactat

SEQ ID NO: 2060 - DNA, 7567 bp, Oryza sativa
ccagaacctgcgtcacattaacagatgatgaagtgaaaaaataggactcagtaaagagaggaaatggggaggggatggcactgagcgaggtgctcatggagagggagaggataggagggtgtggcgatggctgctgactccgtccgggcgatcggatccagtggagggggaggccaaggccgatgaatcaaatggtcggagagggtgagggaggcagtggcgtggcagggatgaaagaggagaaagggcggcagcggcggctctcgttcctctctagggcactggatccgccggcgaggagaatggggtcatcggatccggtggccccagcctcctcattgggagatccggcgggaaagaagcggcaatggcggcacggcgagatggctggttgagggagtagtggcgccgatggcggcacggcgagatggctgagggagtggaggggttgagggaatggaggaggagggagttgcggcggcgacgacgcacgcgaggaaggaggagggctaggatgcggcgcgatgggaggaggagggagaggcggcgcgcgtggggaggagaggacgggtggctagggtttgtacgagttggggaaatccacaccgtccgttagagatccaacgatcccacgggtgcggaagggccgccacaggggggagcatggacggccaaatcaaccctatctcaagatcggacggtggacattgcgaggaccagcgcttaattaaccaaaagtatggggtatattttgtaaaagacggctgaggtggcacgctaatcttcagccattcccacggcgtttaagtaaactaatatgttgcttcagaatgcttacaatcaaaactcaaactagcttcaatcactgcctcaaacatgtaaaaacaataagatttaatatataaaaatggtatcagtatattaacttagcattacaaatactactctctaaatgaaagttttgctgttgtggaccactttttgataaaatggatctaaacaccagtagcaaaaagtaggcaagttggcatttgtcatttgggagtccatcgcagcaaatttggacaaaaaagcgtcgggccccatgcatgagagaggcagcagcaattaatggtaaaactttaccattcatctaaacaccaactagcaaaactttaatgccaaatcttttgccaccaaaacttttgccaaaaaattttgccacaacaaattgatctaaacatgcccatagttgttgagaaacgtccgagggtctccggctagcttcacaaattggtgtgctagtcggtctgggttcgaagccttacatcttctatttatttgatattagatcattccataatattccttgtacattagagattgtattgatgtgctaacgccatgtttagttccaaagtttttctttaaacttccaactttttcatcacatcaaaactttcctatacacgcaaagttctaacatttccgtcacatcattccaatttcaaccaaactttcaattttagtatgaactaaacacagcctaaaacaaagtaaattagaaaagccactttcagttatctaaaaccataaatcccattttattggtggcctctactttttactcctaacaaattattgacgacctcatcctacaccatgcagtataacatatgcgaccaacacaagtcccacgtgtcatcttactactggataagctcactagtgcctagtgatagctacaatacgtggcatctcgcctaatcagtccacgtcatcactcaccacccccatcacgcaaccccaccccaatcactcactcaccaccaccaaccaaccacagtactgctcgtgctcgtgtcgtgcactgcgacgccgaccagtcagtgctcgccgccgccgccggcgacgatgtccttgatccggagcatgaggtcgcgcgcctcggcgaactccgggaagatgtagaaggcgtggatggcgtcggggtagtccagcacgcgcaccgccttccccttcccgcggagcgtctcgcagtagcggcgctgccagtcctggagcgggtcgtagccgccgatcaccaccgtggccggagggaacgccggggagtcaatgccggcggcgccggcgggggaggcggcttgcgcggcctcttgggtgcggtcggcgccgggcgggaggaacgcgcgccagagccagtcggtgcgcgggacggagacgatgggcgcgccgacaaggcggagctcggcgggggtgcgctcctcgccgccgaagaatggctggatggcgatgaggccggcgaggcggaggttggcgaaggtggtggaggcgagggcgtagcggcgggcgacgtggtgcgcgatgttggcgcccgcgctgtccccggcgacgaagcagcgggtgacgtcgagtggtggaacgtcgccgtcgtcggcggcgagggggtggttgttggggtcgtcgaggaagcggagcgcggcgaggccgtcgtcgtagggcgtcgggtagcggtgctccggcgagcggcggtagtcgacggacagcacggccgcgccggcgtacctggcgatgcgtcggcacgcggcgtcgtaggcgcgcgacgccgcggacaggtacgcgaacccgccgccgtggaagaacaccacgacgggcagcggcttcgtcgcgtcgccggtgccgccgtctcctccggaggggcaggggtagaagaggcgggcgcggagcgggatcgccgggtcgacgacgacgtcgcgcgacgcgacgccgttgcgcggcgcggcggagggcgggacgtgcgggtcgaggaagtttaggaggcggcggttgatggtgccgtcggcgcggcacgtggcgtcggtgaggcaccccgcggcgaggatggagaggcgcgtccgccacgccatcggcggcgccacccccttcttcgtcggcttctccatggccgtgcctctcgattcggacagccgaggtgagctgtgctactgagctaactgaggtagtgagaggtttgtctgatgcggaagcggaagcgtgggagactgggatatttatgggaggagagaggtggctgacgggtgggaccatagccacgctgccggccggggagctctactggcctgtgactgtggtcgtttggtggttctgagagttaattcctcccgcccgcaaaacgaattgatttattagtacacaaattactatgaaggtgccccgcttatgagtggacacttatattatattattgaaagataagtttttttttcagaaattttgtcttataggttataggcaaactaaagtttagataatattattttataataatttaagggttctatttttttttcttaaggtatctttaaaaaccattcagaaacttttgagtaggagatggattaagtacttacgacttttgaattatgttttttctctctagttaataagaaactattgctagttaattatcatacattccatctatatacataccgtgtagtatggccgcaaatgaaaaatacgagtgcaagatactcaaaattcttgtgattaaatcgtctcacgaaggcgcatgatgtagtaataaagggaggaaagcatatgcatggaaaaaagaagaaaggggaaaatgaaaaaagggaggggaagcatacgtacccacgtacgtaggtgcatacctatgccgcgggaggagaggtgggacctcgtagtatttagtttgttctaatatcaatttaatctaacggtttataatattggacgtaccgatttaagtgaaaatcaagtaatagatactttgatttttttttcttagaatttataatatttgccataatttattagagcgccacgtggcagcttgagagtattttaaggaattttaaaggacttaacacatgtaattagaatattaaccgtgcaatatatataggggacatatgtaaaatttgttccagcttcgtttatgtttatatacatgtagagagaaaataattttgtggctagcaagccattagatgtctaattaatagcaattaattttgacacctatttacaattattcagagtagatcttacatattcatcttacgactttgatgattcgttgatcaccaatttactgattaccatgactcgcatgaaaaaaaatatgtacaacttaaggtttagaggtttaggatagctgaaattgatgaactatctaatttatgagatagctatttgagggtataaacgaatgaattgacttctaaaaagttaaaatgttgtctaaagaagacaccatttaaaaacttggaaagcgtgcgaacaaaaatctaaaatatgaaatgggaaaaaaaagagagggccttaaactccctttatcacccttgccatcgttagagttctatttatattcatcaatattgcgctcacatttataacataatgattcctttcacatgtacgaacaaatagtacaaaatccaaatacgacataacacaaatacaatataattattatgtaataaactctcagtttcagcttaaacagaactaagtgttgggaaaaacacaacccatggtgcttaattattcccttgcttcatcacacatttaattttcttctcatgttattaaaaaaattaatcatcttcatatatgatttgatatgtggaaaagcggtagctagcactacagcggttatgatcaccttagatgtttcacacactacgttttgtcacgcgtgcgaaaagtaaaggtgtagacgtgcattgtgcagcgggcaaaaagagaatttcagacgctttatttattagaaaaaaatacatccgatgattataataataggtccgccggttacaatgtaagtgtaaattagttagatttttaaattgttaatttaatgggtacataataaaatggtgtagtccttattttgatacagtacattgcttgagaataatagaccaatgtaataaaaaatagatccgaggatttacataatggggccatcagtttaagtgcacatataaattagttaatatagatcttaaattgtttatttaataggtacacaatataattatgtaaaatttattttaaaatagtgcattatttgaaaataatagtacaatgtaaagagtacaccggtttaagttatatgatggcagattttttgtttataaaattatgattatttagaaaaatatccattatatatatagatggaaaaaaaaggaaaaaagaaaaagggaaggaagtgcacgtatgtacatacgtacatatacctgccaatgtgtggaaggaggatatgcaggaccccatggtatttagtttgttttaagatcgattttatctaacggtgtataatattggaccaatcaatttaagtgaaaatcaaggggtaaatgttttgtttttttcttagaatttctaggattttctctaatttattagagcgccacgtggtggcttgagagcgtttgtaggaagtttaaaggacttttagtatataatagataatagattaattaattaactaattattactcccctccgttttaggttataagatgttttaactttgatcaaagttaaattgtttcaagttttataagatgttttaactttgatcaaagttaaattgtttcaagtttgactaaatttatagacaaatatagtgatattcataataccaaattagttttattaaagtaataactaaatatatttttataataaatttatcttggggcgaaaatattactatttttttctataaacttggtcacatttaaagtagtttgactttgaccaaagtcaaaacatcttataacctgaaacggagggagtaggtaaatttttgaagaaatagattaatacgattttatttataacttttctatacgaaatttttctgaaaagtacaccattttggcagattgagaaacgtgcatacacaaaacaagagataaggccttgtttagattataactattttctttcaatttccaacttttccatcacattgaactttctacacacacaaacttccaacttttccgtcaaatcattctaattttttcaaacttccaattttaacgtggaactaaacacggcctaagtagggaacaattctcaccgaacacagcagctactccctccgtcccattttaaacacagttatgactttccgtattcaattttgatcgtgtgtcgtatttgaaactttttataattaataattttattcttatttgataaatagtattttatacgtgatttatgtttttaatttaaaaatatttttaaataagatggaacattaaaattggacaatggataggtgtcggtcggtgtggccgccggcggcggcggcaaatggttaattacagcgaggtggccattaactgctatctacttctactgaccagctatatggcgcatatggggagagttaatgggagcaactactggtgtgtgtaatgagttcgcagatgcacgcactgtgcgtctacctgctggctgcgggcggccgtgggtgggagcgcgagaccagcgcaacggcaggcagcacacgggttccgccttccgcgcgcggcgccgatggtgtgatgcgccagcgacgcatgtgggtcgcctccagtaccgtccgctaacatgtgggcccttcaaatgactgattctgtaaatcttttgggcaagctccatctccactttcatctctcttggagttggagctcagccaaatagtttcagctccacctaaaatagaagaggagttgggtggagctatctcacagagaggtgtggttgggtttagacagctctacaactccactacagacccaacttgtaaagctaaatttagaagttggagctctatcaaacaggccatctatctagcggttccacgtatccgtgatgcacatcagataacagtgttgtagaggggatatccggatcgaagcacagcacatgatcattctatcatcttgtagtttggatcatttaaatataaggtataaccacccctaacccaaacactaagaaaataattattatcatcttgtagtttggatcatcctaataaatacgatgcatatatccaatagaattagataacatgagagtagaggattttaaaagtaataatttaatggagaatgagtcatagttaattacttacatgtatgtatattctatagtattatggaatattaagaaaagtggttgtgtcataattatattatcgaacgaatggaggacatcctgcaatctcttcctccatctacttgtacgcatgcactgatacaccgcgtggtagagtttgctagaattatctggagtctgtagtctgtacaggtttaacaagaagtgaaggatttcacaccactggcagagaaaccatttttagtcggtccaccagatttcacaatagtttcgattgtattaaaaattaagactaaaaatatttttagtcccggtttgaaagctctgaggaattttttgatcactaaagatctatttatagtctcggttggtaacaccaaccggaaaaaaagatagatataagctttactcccggttgatgtcaccaaccggg

SEQ ID NO: 2061 - DNA, 4386 bp, Oryza sativa
tccgatgaattggtcacaaatttctcatagcaaacacttgatatatataggactaaaaaggaagtaactaatgacacctagatagatgagaactagcatgatttaggactaattagtaaatactattatattattttgatgtataaagtgacagttgtttgtagctggtaataatttggatgatcctacagatttaggaaacatgaatgtagtcaattaatgactatagctacaacattcaaacccttcctaaattgaatcttttcaaatcccaccagatatttcatcaaaatcaaaattaagagactaacaagtttatcaagatgtgtgcacatagttagtgccagtatgcttaactttgaatggaacctctctacaaatagaatgaaaaagcagagcaaggactcgaagatgcatttatatttattttatctttgctcttgagtctaagaaaatcaaactatcaaagggatctaaatggttgcctgtgtcaatctgaagtgctatgagttcatatttttagaagagagaaatattttcacaacacttgcatgaactcaggtgtcaatggtaaggtttgcccggaacttcatggcattttggctcgaacttcgggcgactatttttctagccaggtgttaagtgttagcatgacctttaaaatagttaatagcccattctaacttaatatcccattgcaaagcacgagtaactaaaagaaaaacccacatattatcccatttgaaagtgagaaaaaaccacgggctttgaaagtgataaaaccatgtgtggatccaccatccatcaaccttgagcggtcactctcatacgatagaaattgaatgttttccgatgaattggttatacatttttcatagcaaacacttgatatatataagactaaaaaggaagtaactaatgacaccttagataggtgagaactagcatgatttaggactaattagtaaatactattatattattttgacgtataaaatgacagttgtttgtagctggtactaatttggatgatcctacagatttagtgaaacataaatgtagtcatttaatgactacagctacaacattcaaaccattcctaaacagaatcttttcaaatcccaccagatatttcatcaaatcaaaattaaatcaaaccggccaaaattcaaccaaatcgcctgcttccgcccgtccaaattttcaaattccagatcggttaaaacccaataaatcaatccatccccttgctaagccccgttcacactccacaccccatccaacccccaccaccatgtctcccaagaaggacgccggcctctcgccgccggtggcggcgccgccgccgctgtcgctcgccggcgtgcccgtgctgacggggagcctacgccccgcggagtgcgccgacctgctcggcctggtcgccggcgtgaagcgcccgctcgaggacgtcgtggcggacttcctcgcccgcatccagcccgagcgccgcctccgcttcggcgccgccataaacttcgtcctcaaggtaacccgcccctccctggattggattccccccctcgctcccgcccgcccgcgtcgtctgcttgatgcctcctggttcgaggcgagcgcccgctcggcttaggcccccccccccctccgcgtggtggtggggcgcttaggttttcgaggggttcttggggacgtgttggtaggtgggctggtttggagcgcgggtggattcaggaatggatagattctgaatcaatcgcttttgttggtaggggaattttaaggtttttgctgggttctagtggtgcgtggatagcgatgtttagcggataatttctgcttgtagtgttgctctatagtctatgtgcgatctcctatttcgagaaagattgagtttttgattggggactggttgtttccatttcttgacaaccagctaagctttctaatggtgggttttgtattttcagtggaacagtagatatgttggttgcttgatgaggtttttagtgttgcacagcttgattacctgtctattttatcttttgaggtgcagttgcaagcccaatcgactgctgtcttgctaatttttgcgttttccttagtcacgcgataggttgcggtcaaaattggtgacggtctatgtgttgaaatggattttgttagtgggtaaatttgtacagcatgtgttcttctgttgctcaggccactgttgttacagggcaaataattgctgctagctgcattgttttttttactgttttaactgtcttgagtccatatgagttttgtgttctgactttaggctttgaagcgattagcagatttgttatgttctgtgtagaaactaatattgttatttgatttaacaagagcgtagtgttctacatgttttagctgggcatgagtaaggggtccaagttatcagtgtgttgtttgatgagatttgcgtcgttgaaatgaatttgcaaaccattatacttgaggtttaaaatcaatgatctctttccccctttatctttttccatttcttaaattctaaaagaaattctttacatgggtgagtctttctgtacactatccacaatggatgaaacctcctggaattatgctaacatctcattcttccaacctaccatacgaaattcttccctttttgcccatatgctctgcctcttatgccttacgttgccccttctacccaacctgtcaaattgttttagaatgtactagctattagcttttcaaggttttagtcacttggaataaattaagcagtgaataatatgattaaaaagtcacacagttaccacttttagctcatggtagaaatcaatgtttcttctagtgatcataatttttgtgccgctgttgttttaatggaatataattgaatatgtggatggttgcttccttgactgcttatgggcgttgctactgttcgtgctacattactaacgcccacaacattgacatatttgcttcctttttttattgttgttcagtgtcagaaggactcaacatcatcgtctgttttcatttcccctttagggaatggtactagtagttgtagggggtctgtcttcaatgcatttagttttcacatcttctattggagttgacatgatatgttatagatgatttgttggatttggttgtttctgcacatcactagttttttcctgagtgatgatagccgcgtaaattgttatgttgatggtgatatatatgatttttgtgtgatgttattattgatatgatttgagaaaaacttattcacctccatatcaaaatctaagtcattgtgggatctgtgtggttaattatttctgacatttctctcagaaacattttgaaagtctgagcactgatatattcaattgtacatagatggagtaacaaaaataattccattggatctatcttgcaaaatacttctgtaatgtgtgattattatttcacttatacaaaggtagagcaatcaatgggttgatttgcaggcctgttatcctgttttgatcatttttcttgaaattatacccttcttttctaaattatattttcttaatgcacaatccatggaaactctgcaaatctgcacatttttttctccctctgtaagtagatggtagtgaaatgcttggcttagacttacatactgcaatgtgctgtcaaaaggtttagatgtttttgtactgtttacatagctctatggattcttgatggtagactcccatctttcaaaaggttttgatgtttagagaatgatataccgaaaggaaagagtttttctccaattattcttctgttaaggtcctttttgtctattccttgtaaatacaggacggtttttggcagcttgtttttcatttcatttaatgtgcctcctgtttctgggatttcttctctaggtataggagaatgaaaataacactttgactttatactactttgtttttttcaggacaagatgatgcttcgaccagctgagcgtttagttgcattcacaattcttcatcaaggttattcctcacagttggaaaatccctttgttcctctaataatacatgtaagttgcaaccttttttctttttctttttttgggggcataaatattttacaggcttcattaatgtgtgctgatagtctgaattggtcatgtttatccttttaatttcatcgaataaactaatttattgtaaaaacatatttgtcaaaaggataaatgtaccagaaattgtgatttctgtctgcactattttatttttgttgtcaatttctctcaaatagttccacttgcctgtccaatttctatgtttgagttccatgtcacaattgaaccagggcacattcctttcacttccaaggtttatcaactactattaggtg

SEQ ID NO: 2062 - DNA, 1612 bp, Oryza sativa
  unsure (1)..(1612): unsure at all n locations
ttatcacagcagcagtatgattctatccttttcagagtctgtttttttaaatagtgcactatttctcggtaatgctttgtgacttccgctacctgtttttttaaattttttgacaggctgcttgtgatgaaacctctgataaaccagaacagttgtttctccaacttcttttaaattcaactaatggggacaacgatagggaggtattttatcgctctatgatttcttgtttaactatatgatttatataggcaaaattggttatatgattttgccatttatatataaatttcacatgcatggaggttactgagccctgaggtatggagtacccagttttttttctggtcttatgccttcatggagcatgttacgaggtggaatcaacaatttgtaaaacaggaattggttgatgcatgataaatgataaattgctgtatattagcaagtttgagtaccatgatcagttctccagggatctaatacattacggttctttgcaaccatttcatcacaaatagtaattctcaccatgtgatgctaggattgaaaccctattaananaacccaaaaaaaaaaacctgtncccccccccccccttttccctaattggaaaaatttccctaatactatcttgttagaagtctcatggtattctttttaaggtcatagtttttcctgtcactttacttgtattgatcaacagacattaactcacctttactatgtatgtgagcacatgctctgtttgtatatttgttatggagatcatttggcatcgatatgatgattattttgtgttcagattctgaagcattctgctgcagattacttggaggaatctgcttatgcatctcaggttagatgattgttctgtcatataattatgaaattgactggacactttctctaggatgtaggatcttatttgtttcgagtggtgtctattatgtaggtcttgctcaccagagagcagcttgaaagacaatatacctgcaatgaggtgcaccccagcctagcactggtagtttcagagaagctactgttagaagtgttattccttgatccagatatttctcaaagctgcactgattcatcagagtacgtatactccaactttgttcttggaatgtgatgatggatatccataggggtggttcatttttctctcttggtcattgttaattaagtttgctcattatttctataggatatcaataaccaaatcaaatagagataatttggtcacttgtttacttcaacaaacatcacttgatggaattggtcctcagtggatacggcctcctcctccaagacttgaaatacttgatggagaggtaaggttgttggctaaaagtttttgtttagtagtacctttatttctgaatctaaggtgtacttcttgatgaatgggcagttgcagtggctgaacctagacaacaaccacgagctattgtgggacagtagtatgtgtgctgatactagtcgaggtgctgcgatccgagatttagttggaaaagcttgtaaaggaccactttcacctgcccaacaggaggttctattctattctttttctcaaatgaatatcttgatattgagtttttaattaagc

SEQ ID NO: 2063 - DNA, 2677 bp, Oryza sativa
  unsure (1)..(2677): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgctggtcatccgagccagattcggtggtgttcttgtcgaaggatgtgctttggagatcatgaaaatgatttccgcaagcccagtacctgagatgtcctggttttccgaaattgattggaataatctgttgtcagtgtataactttggaaacacggtgattattcactagtcttgtgtttctgtttcgcctgacaaaacccggacaaaacagctaatctggtgttgttgctccatagtccacataaaacacaaaccttggcatgttcagagtatttcttgccacttcagtctcgagaaatactattcccatcttgatacacacatcctcaatagtacatgatattttggatttgcatcaaagccaacagctctatactactattgtcactaatgatgatgaattcggctttgcttgaaatatgaactccaataagtacaactcaaacagcaagacttccagctgatattcatatgaacagagcaggtacaggctatatactctacaattgctgccttcgctaagtaagttctgcccatcatcttcaagtagatcttaggttgaacctatctaccaggaactgcatttgacataagatatgcgcttatttatcagccgtagctcaaacaatcagagaaactattacacaggaccctacggtgattgagttcacttttgaaagcccctttttttttaaccatcatgctgcagatttgtcataatattgatcataacaactcatgcttaaaaaaccagatggtagtatggtactgcagagaacgaacggatcctgaaatcttttttgggttatttttttctttttgagatgaggggtaaagttcaatgatgacaactagtacatgacagagctatattctatgaagtcgacagctatcaagatctagcggtaaagtacaacatgaaaaactatggatgtacaccatggaaaatttttgtttaaaccatacatccttcttcactctaacgattttaaaagcctgaacaaaccagccgcttctcttattcgggaaaacgcaatgcagaacgcctgtacctcgatgaagagatcttgcactgcaaaatacagaacagtcaacaaaaatgtaaaagggacttcaatgtataaatgttacactattaatcaagacaggcctcgtgcattccacaagccatgataaatgagaaaaattggtatttcaaaatcagcattctaaattaggaaaacgaacataagatgtctatatctatgcacaaaattagggtacttcaatgcaaaatttattaaatcagcatctcttttgctgaaaactggtgggaatggtgcattagcattttgctattcctagatggcatagtaaaaatgctacttcttagatatggttcaataatcacgtcttggaaaatcatgacattttttcttaaaggaagaacagagagttaacaaaaagccaagatacaagcttgtcaggaaaatgattttggaccaggttctagtgattatacccaacatgtagtacttggcaaagtttgtcacaagaaaagaactgaaaattcgatatctggaatgtgaggactaaatataaattcataattcttcttaaaccattttatatgtctggcaactggcaaccaccataagacaccttactgaactcaagttttcagcaattggttgagttaatacaatatgaaggaaatttttgaagattaatccaatcaatatataaatgcaagatcacagttgtgtatgactggagaagtattcaagaatcacaatctatgtaggcccaaccaaacagaatacagaatgtaaatagaattgcacgcagatctaccaaatacatgacggtattttggtaaaaaaaaattacatgatggtacactcaccatttattatcttgtttcgaatgagactctgtaggaaaacacatactagccttactagcctgttttgcatgtatttatcctgtaaagaacgttaaacaaaaaaacaaaatctcagaattttctacacaataaacaatattgtcaatcacacgatcaagaggtagaactgatggtatcaagagtgtaaaaattaaaaaaaatacatatttgattggatgtaaaattgtaataaagttaaccggttatctaaaattttggattcagttctgtaagtgatttccattttcatacagtttatcgctggtcccatcaaagaatagaattggcatagggcagtttttctcctaaaacagtttcctaatcccctgataagaagatgtttgcaaatacaaaaaacacaaagaatggctgctggatccacattatcaaatgatttgatggagataagccaaccagaacttgatttggtaaaaggtacatcgactagggataagctggaaaaacaattcagctaaccatatagaatatgagaagaccaatgtatccaacccactcaaatacttttgtgtttaaagaaaaaaaatgcatttctttttatggtttgactttgttataaacatataatatgagtcatgtcactaa

SEQ ID NO: 2064 - DNA, 650 bp, Oryza sativa
taactctgcaagtaaagtctgcacccacattatttttgcaggggcattggcaatagctttgtattctgactctgtgctagatctaaacacaggggcttgttttctagcattccaggagaccagatttgaacccagaaatattgcaaatcctcctgttgatcttctgtcatctaaacagcctgcccagtctgcatcagagaagccactaactaaagtagatcctgacttatgaatttcaagtcctaaccgagtgcattgctttaagtacctaagaatccttttcacagcaatccaatgtacagttgtgggagcatgcaagaattggcaaactttattaacagagaaagctatgtcaggtctagtaagagtcaaatattgcaaagcaccaacaacactgcgatagtgacttgcatcttcaggccctaacaatgagccttcatgaagagagagtttctcacttactgaaagaggtgtattagcaggtttacaatctatcatgcccactttcttcaataaatcattggcatacttgtcttgattcagtacaatgccattctgaaccttgcttacctctattccgagaaaataatgcagctcaccaagatctttgagtgcaaattccccttttagatcctgaagtaaagctgcag

SEQ ID NO: 2065 - DNA, 1259 bp, Oryza sativa
tgtttaacgggcccaacgcgcataaacccttttttcccgaatcgttcctttcttttccctttgcacgctcgaatcgattccttttcctgcatttcgttccgccgcccctttcgtataaatctcgccgtgatcctctccatctcccgcatcgtgctcgcccgtaccggcgctggcatgtcatccgcctcccgtgccacacggaggcaggatgagggtgtggcgcttcccctcccgtcgcccccatggcggctcgtgcgctgcttcccccttcctctcccatgctaaaggttgttcgcccctttaggttgccatgattaatgaaaaccgtcgacaaccaccgaggaaaacacttcacggctgttatcaagtaaatccattaatggcttaatgcgttttcttctcctcttatccctttatcagttctgcatctatatccaatttatcatctcgcttattcgtcgatctaccacactctaccaggctggtggcgttttactaccgttcttgcaactctgcttgctggattcatatgcagccctcacctggtcgatcctctccaattacttcaatgatctaacacaagttacctaccgatttcccctttctttatgttcaataaatctgatacccaacagagaattttattgttgctgtatcctctttttccaggtttcaggttcttggctactgatttagttgattcatattctttatttatcctgaattatagaccacttctcattcttaagtggttgaagacgtggcaaatatgcatctattggttgatttgtcgtcacccgatcagatctaagaactcatcgagctaagtaacaatcatatgggctgctaagcggatggagctttcttcttttggtattttaattatggtctttaactggtgaagctatatatatctcggtacatctatgtcgttgatgtgcttttcacttttgataaggtcctcatcaagaatgatgtcagattctccacacacagacacacaggtttgctcttaaatagataaggttgtcttccgtctcaaagttcattttattttctgatcatgtatactctagatatgtttttaagtatcttttgtcactcttgaattagcttggtgatataaatatttttggagttttctgaaagctaaaatcactccaaagagttaatcaaggatgagtacttaattatatatacgaggtaataatccttttcccaacttcccatatcttactcaagcatgaaaattttctacc

SEQ ID NO: 2066 - DNA, 651 bp, Oryza sativa
tagggttccgtgttcatcctctgtgaaaccagcggctttaccctgtttcatgttcttgaggagcccatgcatatccggatcattcttctgagcctcgcggatttgatcgagcaaggtaggcttggcttccaacgtagccaagaatccacgaccaactatgcttaggttcagggcttccaactgttgattaagttccggtggaatgccacggacgccaagagtgttgcaatggctttttcgacttagagcgtcggcgactacgttggccttgccaagatgatagtggatccccacatcataatccttgatgagttctaaccatctcctctgccgaagattcagatccgactgagtgaagatgtatttcaaactcttatgatcagtatatatttcacagcgattcccaatgagatagtgccgccagatctttaaagcatgaaccacagcggtcaattccaaatcatgggtagggtagttgccttcatgaggccgtagctggcgtgaggcataggctaccacatgaccttcctgcattaatacgcaccccaatccttggcgcgaagcgtcacagtacaccaggaagtccttgcgagtatccggtaagattaacactggcgaggaaaccagcttttctttgagagtttggaatgc

SEQ ID NO: 2067 - DNA, 685 bp, Oryza sativa
ttgaccaggctgcacagctggcgcaggaggacggggtgcacgggtcccttgctgaccctgctgttgctgcggctgtgggacgcgcaccacgaattggggtcggggcgcggagcgaggttgctgctgctgctgctgcgaggaggattgtcacgccctgaaaattttaaaatttataaattgttgtttaaatggaatttctagaaataatttaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaaagtctcttttggctttgggccgaaagtcggcccaaatctcttctctctctcctcggcccagccggcccagtccgccgcgcgcgcgcgccctcgctgtcgctgacaggtgggtcccgcctgtcaggtccttcatccttctccggccgccgccgccgaaaccctagtttcgcgccgccgccgtttcctttccaaatccggccgttcctttccttctccggccgaattgaaagaggggaaatgatccttgggatctcctctaccttttctcctttggaatctttgg

SEQ ID NO: 2068 - DNA, 388 bp, Oryza sativa
taagatctttcactacgctttccgttattgcattaaaatctacctgttcacaataatttgtaacatctctcgattcacactaatattacacattaattcgcaggtactcgcgcaagggtcagcagtcagctggcgactggcccgccaagttggcgacttttgttgaggactggttgctcgcaaccgaggaggtcgtggaccacgagggagagccccacactgaggaggcgtacaggcctacctacgctggtaccagccacgcacccgtactagggtcaccttcgctcccttggaggagcagccccacgttgcgagcactagagacctctacgccaggcaccgcgaccaggacttcgctcgttgtgtgagtaccctgcatcgcaccatt

SEQ ID NO: 2069 - DNA, 1137 bp, Oryza sativa
atacctttcggcgcatgcacgattactttttgccgcaccgatgcagcctcctttattcgcgtgcgatacgagtatttgcccgccatttgccgcatacgaccaatgtaactttcggcgccgatcaggcatgcaacttcggcgtacccaccatgccccaccacgttcacatgtcaaggatatcactcgattttttgcgcctatataagtcgccttaacgagtgaggcctcacgaactcagtcacattcagtactctcttccctacttgcttcattacaaatcctaccggctttcgtcaatggctagacgccggagtgttgaggatccaaactggcgcagcgatccttatgtatacctactaccaccttggtgccagcgtcctctctgcctatgcggtgatcgatgccaactaatggcttcgaggaatcctgatattcgaggaaggcgcttttttaggtgccctaactatgaccgtgaagtattttattatctgcatatgcttattcattccgtatgggtaatcgctttattcttcgtaacactactctattcggcagacccgcactatggcttgcacatacatcgagtgggtcgatacagaaaatcccgttctcgacctaaccacttgtttacaagaaggtcgctggtatttcgcatccgaaagtaccgagcaatacttacagagaaaagcggtttatgaacgacaatatcgtgaacaacagagcgactggcgggtgctaactacggcactccctccatgggaagcccgtccaagatgcaggtgtggtgatcgttgtcaggttcttcgttctataaatcctacaacattgggtcgaaggttctttgtttgtccaaatattcttgacgacgatttcatggtaagaatattttgattacatgaatccttattttctcacaacatttactaactttgctcgctttacatctattctttcctcccaggaaccaccaaggagatgtcaatacagagaatggatagacaccagaagggttctaactccacctagccgtgttgtgcagcttgaactaccagagcaatacagggttactaaagcgcggtttgagaaaggagagggatcctcacgtaggggttagctattatcggacaacttggcata

SEQ ID NO: 2070 - DNA, 281 bp, Oryza sativa
caaattgacgttctaccatgacttgaaactcctgaaacttgtcaaacacttgagacttatgctgtatgagataaatccaagtaaatttactaaaatcatcaataaaactaacataatattttttctcccacaagactctggagcaggtcccccaacctcaaaaaaagacagttttaaggggtgtttggaaacactggaaaaaaataggaaaaggtaattgatgactctttgctggttgacaagcattacaaactgactcactagacaaatctgaacagggg

SEQ ID NO: 2071 - DNA, 2109 bp, Oryza sativa
  unsure (1)..(2109): unsure at all n locations
caaaccctagcccgctgacgcaataattctcttttccttttcaaaaataattctttattgcgtcataattcaattaaaatccatataaatgttttaatccggtttaatctttaaaaattcataactaattcatattagctcggttttagttggttcaagtctctaaagttgtataaaataaagatctacatattaaaattatccataaattgaattaaatttatttaatcctttttaaataggctttaattagattaaatcttgtaaaattcgtaattatttcatatgaagtcagaatgagcccgttcaagtctcataattcatctaaaatcatgatctacacatttgtttactttatatgtattgtttatttggagtttcttagtctttttccttgttttgcgttttagcttgtcgtttccgtcgtttcgaaggttcgcgagtgcgccggaagtattcaagaagattaattgaagacccgttattgcaaggcagtcacacagatcccaaacacagttcctttgagcatgctgatcctatatttaaattctctatttatttcaactgtgcatttattttttaatgtcatcgggctctgtagacccccgtttttataacaggaatcaatcgtgtaaacagtaccatttccctggatcaagtagtctggtacacacgagttcatagccgagataccaaatgcacatacacgagagtctagtgcgaattattacaacataagtctgcaggcgtagtcttaaatcatcagaccgatgtcacatcctgatttttgtttcaggatttataaattatttaataaattattattagaatttatattaaatgttcattaatttacaagtgaagttaatgtgggaaataaaatttcctaatataaagcatggatggatttaattttgattaaattctccatgattaattacactctctgaaattttctcagatgtttcggagctcaattcttaacttttaatcatacaaagagcatttcagtaattacccacatattaaattaatcattaaatggtctgtttttaatattgttaaatactttgggtctccaagtatgttcaagatttttcttggaattatttgagcataggaattatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgatttcagccagcccaagacgaaagtctaatntgcctccctccacactgtttatcttctaccttctacagccgaactgagaccgattggctcgggtttcttctcaaatctgacctttccccctgtgtttttctaaaattagtggagggaaaatattcctcctatcctcctctatcttactccccaaacatcggagctaatcgttgagtatcttatccgaatggaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtagtcgccggccgagctccatccgcgtcgcgccgccgcctccgccgtcgccgccggtctccgtcaccaccgttaggtgcgcgggagggtggagaagcccggccgctatctccccgaagccgccgaccaccgcagccccgtcgccgccgtcgaccgaagccgcgccgccgctagacctcgtcgccggccgtcgtcgttcgtcgttggttcgagggtgggtaccgttgggttcgtctcgtcgtcctctacgtgttcttgtcctccaaagtcgcagccgaccatccaatctccggcgaggtcgccatcttggttcggccattgatgaggtcatctgacgtcatcatcgtttttttctttttcctgtttttcccatagattaaatcttcggaaattcataactaaatca

SEQ ID NO: 2072 - DNA, 558 bp, Oryza sativa
atagttgtagggtatctcaaactacctaaatagttgaggagtaatttagatttttcttttaaaaaaagagtgaagccaaatcctaagtgtgaatgctataacagaacaaaagtctgaataagttatcaagtactcaagattccgaaattccataaacagtcgatgtgcacggtttatatattattatatctctcattttgcaaatttaagttgtaagtccgtatttcgagctacagtcccagaattagggccccttttttttttgaaacacagtacaaacgcaggcgctcacaacgtgcgcacactcacccctatgaacgcacacacgcacactctacccctatgagcacctccggaagactgggccggcatatcttgagattgacgaagtcaccacaggcgcctcgctgtcgacgggtacgtcgcctaccactgaaagaataattagccgtaaatgcgagcacccgtgtcaaatctaggatttaaacccgggtgggctggttccaccacaaggaacctaaccagttgagctatgctcacttcacagaattaggcccc

SEQ ID NO: 2073 - DNA, 938 bp, Oryza sativa
aattagaaatattaatcatagactaatgacaaacatattccataaccctggactaattcgcgagatgtatctgttgagcctaattaatccatgattagcctatgtgatgttacggtaagcatgtactaattatggattaattaggcttaaaatgtctcgcgaattagctcttatttatgcaattatagttttattataagtttacgtttaatacttctaattagtctcaaacattgatgttacaggcctaaaatttaggtggtgtttggattcagggattaaactgtagtccctgtcacgtcggatgtttggacactaatttgaagtattaaacatagattacttataaaactaattacataaatgagagataattcatgagataaattttttaaacctaattaatccataattagagaatgtttacggtagcatcagataagctaatcatgtattaattaggctcaatagatttgtcttgtgaattagttcgggttatgaaatactagtaggttttatcattagtatatatatatattttgagcgaatcattagtacatattcaatacttctaattagtgtcagggaatttttttttttagcacctcccgtctcctcattcctcaatggtcatcctcctcccaacccacacggtccagtcctcctcctcgcgtagacgcggcggccgaggaacaagtccgtcacgcgaaccttccagaacctcacacgtcacgcaacctcctcctctttattacgactactaccaccccctctctcctctccgttccaccgccggattcagattcggagagagctactcctcgtcgttagccatggcgtccaagcggatcctcaaggagctcaaggacctgcagaaggatccccccacctcctgcagcgccggtgagatgcatatccctctcatcacctttttttgc

SEQ ID NO: 2074 - DNA, 718 bp, Oryza sativa
tcaaaagattcgcctcgcaatttacacgcaaactgggcaatgggttttttttcatatttaatgtcctatacatgtgtttaaagaatttgatatgatgtttttgaccaaaattttttggatctaaacaaggtcttattatacttgtgtttcaaactttcaataatgttttatgtacgtattgaaagctggatgagtacacaaggaattatacttgttctggtagcccggcgcccgggcctgcttctactgcgatataaatgattccggttaaatgacaacgatcgtttcatcgaaggattgacaacgctattgatggatgtgatttcctaagactactctgcgctgaaacgatcgacgacttgccagtcgtcacaaatgggggcaacgtcactgtccctgtagtgacagatcatctgcatctactggtgcaggtgcataatagtaaccgtgctatcccaaatttccaatgtgagctcattaagcccaacaatttcatagcaaaactgtgtgaaatggacgagtgaaaatttgggtaggaaaattgtccatgttatataggcacttataggtaacaataaggtggaagtgtttctaaataaataagcaagaataatcagcaataactatattaatacttactccctccgtattttaataagacgagtggtcaaaatgtcggttaaaaagtcaacggcgtcatacattaaaatacggaggg

SEQ ID NO: 2075 - DNA, 643 bp, Oryza sativa
tgaggatggggttggtgtctggtggtggtggtggtggcgggggagaaggtaaaggtgggccaccttggatgttggggttgctaccttcgggttggttgccatcaccagtagcagcagttctcctggttgtcaccatctgaaataccccaaaacaaaccagccaacagagagaacagactattaaaactaaccacccacgactaccaaaattattgaacttattactgatataaaatgggttcattaaggttcaggatgcttaagccaataaaataaagacaggctccgacacaatcataccacacaccggtacaaccatgccccacacgacttcaacaggaagacaaagagaaagaacacactcgcaagcctactaactgctcgtctacttctgcgacgggccagggcggaaggtgagcagcagcgcatcctccgtgctaccaatgccggaggtttccccctcctgaggaaccacgggcgcgggctcggcacgaggggtttccacgaagcaggtccacgccagggactaacgaacaagctcaggcctggaggtgctcttgcgggcagtgatcttctggctgcggcagacgcggcggcgcttgggacggcagacctctccctgggcgaccttgagctgacacag

SEQ ID NO: 2076 - DNA, 109 bp, Oryza sativa
ttcatgattgggaatttgtagttgggactcagagttccactaccttttcttgctcttttctgtcttaagtttaattatttttgttctacagaacaattacaatcagtag

SEQ ID NO: 2077 - DNA, 1109 bp, Oryza sativa
atatgtctattttagtccctatactttatgtgccgggcctagcctgccggcccatcgtgccgggccggccggtcgggccagcgtgccggtggggaggcccaaacacggcccggcagtcgggccatgccgtgccgtgcttgggccgggccaaaaagccgtgccatgggccgggccttcggcctcgggccttatggccatctataattgagagcgattttttttttctgtggaaatctaccaatccagaagcttatccacaaatcatcaatttaacatgcatcatatatggttcggcaccattcagattcgccagtggaaactgattctatgtacgcctactaacttcaaaatcttcttattttcataggcaacctgtccagctgttttcgataacagaggtacatggcgatgtggttatgtttgtagctttcttgggagttctgaacaaaccatttgtaacacattagcaggtgattacatggcttgttttcccacagaaattacagttttgttgttaaggggcaatacccgaattcttggaggatcattgtttccatttcatttcgttcaaaagaaatttgtttccatttcatcatctggtagactggtatgttcatagtgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacatggtatcagagcgttgatcaattccctaatagatcaatactcatggcctcgtcgtccagtacggctgccacaaatccgttccaaggccacccaatctcagagaagcttgggaaggcaaatcatgcgctctggagaaaattgacatttagccattgtcaaaacggg

SEQ ID NO: 2078 - DNA, 481 bp, Oryza sativa
ggatccccttttttttttcccctgcaaagtcaacaaaatgactaggggcaaatatgccagagaatgatggaaaacatttggaaatcagttaaaatggttgaaatggcattatagtaagttggcttcatttgacaatggtattataacgaagccatattcggaagtggcattccagcgaaaccccatcctgaagatggctaaatgtcaatttttttgcgctctggaaggtgcaagtaagcgccgcagtcagaggagcgcggcttcaggggcatctcaccggcgcaaccaagcggccgccggcagagatcgctgtcacaaaagatggcgccaccaagaaggagccgaacccagcccatgaagactgggaagccaccgaccagcaagttctggggtaccttctctcgtcgctgacaagagaggtgctgatgcaggtcgctacaggcgacaccgcggctgaagtgtggagcgccatcgagcagat

SEQ ID NO: 2079 - DNA, 452 bp, Oryza sativa
aagcccttgcaggccagggttgctcttgtccctcctgtcccgggcatgatggagcagcccttgcataaacatgagatcgctcttgatctgctccatgttgaggccgagctcggtgctggctacgtaagccgccaccagctcgtcggacagctgtgtcaccaccttgtcgacgagccagctcgctgcgccgatggctgcctccatcgatctacccttctgctataggggcaatgttttctctcgtggtttaggattgcgagtatcacaagcggctagagaacatgccacagtttagtgagagggagtgaatgttgtaagcttttataagcgcaacgacacttgaatctgcaacaggtaggcccctacacaatactttgaatttgcattcagacaagcagtcaggtgtgtacccaagggttgctcctgaacaagtcaatgttttttgccctctt

SEQ ID NO: 2080 - DNA, 832 bp, Oryza sativa
aaatatacaaaaatcctccaagcccaatttgactttcaactttgcacattttatttttgaaggctttcacaagcattttaattattctaggcataatttagaggatgtattttagggtcgatttgggaccccacaattatgcaattgatgtctgaattgtatggaggggctaggaatgtaccctacactaaaaaagacataagcaatttcaagtcaaagttggggagcgagtataggagtataggtgtagagatattcctgaaacaattgctcacttcgaggaaatcaaaaaggatgacccaaatttcttctacaagattcaacttgatagggaagacagggtgcagaacatattttgggttgatggagcagcaagaaatgcctacaatgacttcaaagattgcatctcgtttgactgcacatatatgacaaacatgtataacatgccttgtgcaccattcattgggataaacagacatgggcaatcaatacaggtactccttttttttgcaaaaaagtaattctaaaaaatctgtaataactttggaaattatagtacatcataagttacttgttgcattcattgagttacatcaagtcctgataaaagttacttccagtagaatgtgaagttacatttttttaaaaaaaaaaggtaaaaaagtaactaagtttacaagttacatttttagtgtttgttctatagttcaaaattgtactgatttacttccagcaaacacaaactgtacaaactacgcaaaaatgtagtaacttacttgcttcaaaactgtactgactcccttatgtgtattatttttgatattcagctggg

SEQ ID NO: 2081 - DNA, 398 bp, Oryza sativa
cagtgacctcccaagcagcatgcgactctgcatcgtcaccctcctgctccgggagctgcttgccttggtagtccactccatgcggataccccaggacaacgcacatgccccgcagctccagaacaaagccggtcaggtccaggccacgacggttgatgctgccggccatctacaagcaaggacaaaaaagagagaaaatattttagagatcagcttttgatgacaaatgaagcagcaagacagagagagactaaaggattttcacaaataagagaggatttttatttcgaaaatattgctaaggcttgggatctaaggctcgtcctagggtcaaggaggctctgataccaacttgtcacgaccggaaataacccaacgggcgttccttacgtgcgtgt

SEQ ID NO: 2082 - DNA, 2278 bp, Oryza sativa
  unsure (1)..(2278): unsure at all n locations
cggcggtcggccttagagattggacaaaaggcatctgctcagaagctaaattgcaattccatatggcactcaatgtcatccaaagactcgacgtggcacaagagcacagagaactctccccccccccgaaacgcgactgagggcggctctcaagcggaaagtcctaggactcgcttctatagaaagggcaaggaaaaagcaagcctccagggtaactcacatccgtgaaggagatgcgaacacgaagttcttccacctcaaggttaatgcgcgaaggagaaggaatacaatccaaagattgaaaaaggacagtggttgggcggtgacgcacggtgaaaaggaatcgacgattcatgatcacttcgcaagcttcatggggaggccagggccgaggccaaacgagctaaactgggagacgttggacatcacaccgattgatctagccacgctgggggaacccttcactgaggaggaagtgcatagggcaattaaggaaatgccagccgacaaagcaccgggaccagacggcttcactggggccttcttcaaagtttgctgggaaatcatcaaggatgacattctgctagtcttcagctccatctataacctgagatgtgcgcacctgaatttgctcaactcagcaaacatcgtcctaatcccaaaaaaggatggggctgaaagcgtttcggactataggccaattagtctaattcatagcatcgccaagatcttcgctaagatgctagcgctgtggttaaggccccacatgcatgagttgatctcggtcaatcaaagcgctttcataaaggggagaagtattcatgacaactacctcttcgtaagaaacatgaccagaagataccaccgcctaagacgggcaatgttgctcttcaagttggatataacaaaagccttcgactctgtgcgatgggattacctcctagccttgctgcagcgcaagggcttctcgacaagatggatagactggctaggggctttactgtcgtcttcgacatcccaagtcctccttaatggctcgccagggcaacggatcaaacatggaagaggantacggcaaggggaccccctctcgccgcttctcttcatcttggcgattgatcctctacagcgtatcctttccaaggcaacagagctgggtgcaatttcaaaattacgaggaagaacaactcggctgcagatctcaatgtatgcggatgatgctgtgatcttcattaatcccacccggaatgatgttgcgactttcgcgaacatcctacatcgttttggcacagccacaggactctcaccaaccttcagaaatcccaggttgcggctataagatgcggcaatatagacctggaagaggtcctccaaggcgttccggcgaagcgggcaaatttcccactaaaatacttgggcctcccgcttgttctgggaaggctgcgaaaaacggacttgcaaccggtctttgacaaaatatcagggagagttgcaagttggagggggaaaaacatggcagtagccgggagaaccacgcttgtaaagtctgtgctttcagcgcagccaatttatctcctcactgccttgaaggtgacgaaggaatccctggagcagcttgacaagcagagacatcgcttcctttgggctggtacgggggatatcaccggggggaaatgcaaggtcaactgggcaaagacatgcttgccgaccagccaggggggccttggtgtcctaagcttggacaagttcacaagagctctgagattgcgatggttgtggaacgaatggagagatccaagcaagccttgggtgggtttggaaacgccttgtgatggtgtggatagggacctcttcgccgcctcaacaaagataactgtgggcgatgggaatacaacgcgcttctgggactccgcatggattaacggccaaagaccaaaagacctaatgccgttggtctatgagatctccaaaaataggaagaaatccctacggcaagggaaagaagacgactcctaggtgcatgacctgaccctcgatgcgggttcatctatcacaatcaaccttctcgatcagctagtccgcctgtgggaggcggtacggaatgtgcacttagacagcgaggagccggatcagattgtttggaaattcacaagcagcggccactatacagcttcctcggctaatcatgcccaatgtttgggggcgccaaacacaaacttcaactccctaatctggaaagtttgggcgccagggaaatgtaaatttcatgcctggctca

SEQ ID NO: 2083 - DNA, 3942 bp, Oryza sativa
cgacatgatttacacgaaccttggatgctggtacagcagagttattctgggcagggacaaccttcacgcgtcggggcttcggacacttgtcagcataatgtcctgggtctccacagttgaaacacaccacgggcttgctgccttgctctctcttggcaggttgttgctgtgctggagctgcaacaggacgtggagcttgattacggatgttgttgccagcattgttgttgaagaactgacgctgcggacgaacaacagacgaagaacctccctgtggcatggactggggtcctaaagtaagacgcggcttctgattatttccctgttgtgccttgaagtgagcaatccgacgtttcttctgctccatgtgattgtacttgtcctcctgacgtatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgggtaagcgacctgaactccttcttcttgagagacactactcctgatggtatatgcgtcttccggaaagcagcggtgaattcaagccaagtgataggttcagcagtagtcctgttaaggcggaaatgatcccaccattcagaggcagggccatgcaactgatgtgatgcaaatgagaaccttctcctgatcagtacactgaagcaaatccaacttcttctctatggcatgcagccaatcactagcttcaacaggattagtggtactagagaaaacaggcggcctcacacaaaaaaattctgctaacttgttctggggaggtgcatgattatttccttggttttgctgattctgaaattgctgcatcatcatgttcataagctgtgtctgttgagcaagaacttgagcaagagtgggattctctccattgttggtgttattggggttgttgggaccattcccattgctgtgagtgttcaccatttggcatgggcagggcacaaaaagaaaaaccgggggaaactacttaagatagagaattactttaacttttattgatcttaactgagttttattattacaaactaaagactctcacaccactaaactcaccaacttcctaactctcaaaagcaaacaaacgcatgcacttacatcccaccactgatgtaaatcacatgcaagacccacacacacaagcaaacttaaaacaagcaaactaacacatcgatctaagacaacggcttaacaagtcactctagttcttccaagcatcggaggtcgattgaaggctcgtctttatcaacttgggttgctacccactcaatcttggaattgttgcgcttggattcttcttcttcatcactacttatgatgatgaccggaggatccgcttgagctggggcaacttctttctccaccacacgaacctttggcgccaattgatagcgaggaacaaatagagctctcttccttgcggtaagacaaatcctggccttctgcggcggtgcttctccctttaatgcggctaattccttctccaaacgatccaccttgtcttctaacttgcaaatcttaccacgattccaatcttcacgatcttgggctgctaacacagtctccgcacgactttcatccatagcccacaacatctcaaccaaatgctttgtggtaacatcattctcaattccttcagtctcaaggtaactgccacggtcacttccctgtggttggcgaggatggtagcgatactcagtgtcggccaattgatcactgtagcgatcacggagctctcctatggcgatccttgccacctcctgacatgcatggatgtagtttcttcctccagcttcaaacatcactgaggggatatcttcactattactgttcaaggtgactttgactcggcacttctcttcatgacgatcatgagcaatctgggcataaaaaggggcagttccaaatccaatgacaaaggacatcgtacgcaactcctggacaaaaccctcaacaccaaacaggtactcaggcttgtaacgcggcatctaaagacaggtgaaaggagggagttaagacatctatccaattaatagcacaagtttttggattaatttgaataaagtttgaaaatcaaagtaaaaaggtaagtaaataaagtaaaccaagcttgcgagataagttaaaacagttggaaacgaggtcacaaattttgtaattttgaataactggtttcaaaagaaatgaaagaaaattataaaatcaacatgctaaatttattttattgcagcaagattaaataaaacagtattgtaaaacttttgctggtaaatgagccattagtacagtaatagatgtacagtactaataacactggaataaattttgaatgagaaccattaaaagagattatgaaatgcatgtgccattagtttggtttaattaaaagagaaagggaggagaacagttctacttttccaatatttttagagggcttctatggataaccatttggcataacctaagggtcaagggagctctgataccaacttgtcacgcccggaatttctatccaaaattccaaacgcttacatgtgtgtgaaccttcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaataaaacagttaagtaattaaacaatattaatccaacgctatacaacataccctgttgtataggcccaaccattttgaacaaccatcccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccaccgcagcgcaccttcctagatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgagtcattagttatcccgaatgtgtactaatgtttctaagcagggctaagcaattatatctaatatctagttgaaccaatataaataaagctcaactagtcaaattgtaataacccaaggtatcaaggaataaggtaatcaagtacgaaagggccataacaaagaataggtca

SEQ ID NO: 2084 - DNA, 645 bp, Oryza sativa
gtcaatgcactcttgtgacgaaatatttcgtgctagatcatgtaataagtcgtgcattacataatatggcctactatcatcaccttccttcatgagaaaaccattacctactagttcgttcaaatactttaatcctacatggtcagctttattattttgatctccataagctatgatgcctaatgcttcccaaaaataagtaatctctaaattaccaaaccggtagtcctcagggtaaagggaacaataagaaaaacactttttcagaggaaaggtaggtagtcatagcttatttgtagtgctggcattatgccatcaccatcttgctgatttttccactcatttctttcatgaacttccatccaactttcctgggaaaggttattcttcaataatcgaccaacggttttggctgctagtgggaaacccttaaatttcttggaaatttttcttgcaatatcaatcaattcatcttcataacacgcaggtttttcctgaccaaatatacattcttcaaagaatgtgaagaattcatcatcctctagaccttgcagttctattggcttggttgtttttaccatttgtgctatagatggaaaacgagtggtgacaataaccatacttcctttggcttctcctgttttc

SEQ ID NO: 2085 - DNA, 961 bp, Oryza sativa
ggccagaacccccggacaggcaggcagaattgagcccctagcagcaggacaccagccctgtgctatgacatctcgactaccgggccgcagcccgtgtagccttcatttgtcctaaagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggggctactatcaaaaccatgcaccccaagcctagcctaaaaccattttgagagttttgaatagagggggaggtgtgcatccaattccacaataatccaaccattccaatatgtccaggtgatatgaatattcccaaagtctagagttataaaaccacctaatgttgcctaattaatcagcgaagcatctacctaaattcttgctagtggaaccatgaatagagtgcccactagttggggttttgtttattctagggtgaacaaggtaataataacaataacaacaataataaggtcataacaaaggtaaataggcatggctaaataaaacagtgataacgcgggaatttaaataaagcgataatgcaataatttaaatcaaagtaatttcacaaagtgggatccaatatgttcaaagaatgatgtgacttgcctttctcgctttcccaaacgtcggcttcaacctccacgaagagcggatcttccaaagctgcagcgtctacacgaccaacggaaaagaaaagggcttttactctaataaactccatataacaagcaggaacaaagcacaaaaatgggttcttgacttcttaaggaaaaattagagacttgaacggtccaattccgagttcaaatggccaagttatggccatttgaagtttatatgcactttaaatgaatatttacgaattt

SEQ ID NO: 2086 - DNA, 684 bp, Oryza sativa
ctaactaatatagcattgattcagatagcagataaagaaaacagctcaaccatatggactaaactaaaagcagctgcctgaacttagaaagaaaccacaaaatgaaggactgccttggttttccatgaactgaccttttagattgctggccttcatgtaatcttgtgtagctcgcattaatttactaagttggttagcgatgaaaccactactccacatgaggtaaatcattaatagcaaaacaggcaaaaattagttaaatatgaaaatttacagatttaataagggacaaatacaggaattaggagaggacatgctttaccacgtaaacctggcgttgatgcttttagtttcttgagttgatcctttagatcaacactgatgccctcgtatgcaaatacatatctcagtgatgcggggaacccttccttgggaagcgctctgatttcaggacatttatggataattagttcacgaagtgaagaaaggcgatgtaacccttctgggagggactgcagacgggaacacacatagaatcctaggcattggagggaggtgaggagctgaagcgcctcctcctgcgtttcggtgaagctttccatccacatgtcatacgggaattccatcttacagagggtgctagccaggaggttgcaaatgggggcaacaagcactgctgagatg

SEQ ID NO: 2087 - DNA, 317 bp, Oryza sativa
tttgatgaatcttgttgtgtttttatcggatggaatttgctgggattgcttctaattcgttgacgacgccgtcgatctcgatgaggctgcagccggggaccttgtcgatctcgttcctcctcatctgcctcctcaccttcaccgcctcgccgtgccggccattcgacgcgtaagtgttcgacatcagcacgtagtcccggcgtccgcatcggcgtcgggggtgcgccgccgcatcacccgctcggcgcgctcaactttgccatgcgcgcggcatgcggcgagcagcgagccccagatgagcgcgtcagggtgtattg

SEQ ID NO: 2088 - DNA, 593 bp, Oryza sativa
ttttgatgaagtggagaagcttggtaaagggtttacatcggccaatccattggaggaagtagacataggtgatggaattaagccaaggccgacatttataaataaaaattgagagccgattataaggttaaaataatcgagctacttaaggagtatgtggattgctttgcatgggagtatcatgagatcccgggtcttagccgtgagcttgttgagcatcggcttccaatcaaaccaggttttaggccttataaacaaccacctcgtcgttttaatcctttgctatatgaccgagtcaaagaggagattgatcggttgttgaaggatgggtttattaggccacgttgttatgcggaatgggtttctagcatagtcccggtggagaaaaaggggagttgtaagattagagtttgcaaagactttagagatttaaataaagctactcccaaagatgaatatcctatgcctatagccgacatgatgatcaatggtgtctcgggtcataaggtgattagctttttggatgggaatgccggctacaatcaaatctttatgggggaggaggatatgtacaagaacgcttttaggtgccc

SEQ ID NO: 2089 - DNA, 645 bp, Oryza sativa
ggaaattgattataaaactctttagcatttagttgtttcaccttccactccccatttagcccaacaaatagatgcttcagctctgcaaccacttttcccacagaagcttcaggaagaatcacagttagtatacctttcacagggagctctagccaactctatatcagaaatctcaacttgcaagctgtaaaaaccttgccagggaacccaaacccacacagcttaatacccttctttcccaaaagcaatggacagtgagaagagatatggccagtattgtgacaggagtagtagaggtgagggttagggcacgttgcctgatggtgaccttcacgcccacactcgaagcattttatcctcacctcgatccgccgctctcgcaccacgatctgcctcgccaccttgacgcccttgagatcttgcacctagattccccgttggattttgagcgagaagttggcgtcgaagctcatcctcttcgcgcgcatcacggttcccctaatctccacctctaatcggatccgtcacccttcgcttgttgacttgccactccggccgaatttggagggcgcttgtccatcaccacctctgtgtatgaacgatggtcgcgcttgcgctctggaactctcagatacggcgagcacc

SEQ ID NO: 2090 - DNA, 578 bp, Oryza sativa
atgtgacttgccttgctccgggagaacggccttccgaaccttcggcgacgaccacgaaccacgtttcgggaacctcctgaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttgcggattattgtaatgaggttttgcaactataaaacatgtggaagcgctagcctggaaaagacaggaagctgcgctgttgacatgcggaccccacatgtcaacctaaaggaccacggtagaccgagtacacagagacggtccacgggtcgacggaagcggaccccgtgtgtcaaccgaggcgagtggccaacaaacggactccactagacaccacacgggctgcacacgtggaaaccacgctgctactgagcggacacactaacacggacaccacacggtcaccacccgcacacatgaaccactaccgaca

SEQ ID NO: 2091 - DNA, 265 bp, Oryza sativa
tggaatctccatcctccgttctatcgttttaacctcatcccgagtctccccgtggtcgtatcacctctccccgccgtcctcctctctctcccgtgccgccggccgcctccagccgcctctccctcctcgccggagcgccgtccggtcgcgccgtcgcctcctccagcgtcgcaaccggctcctcttcgccggcctaccctctgttttccgcggagacctccggaagtgcctccccgctggcaaccgtggtgttgccgccacgatt

SEQ ID NO: 2092 - DNA, 477 bp, Oryza sativa
caaccccatctggcacctgcgccttcctgaagctacggcagaactctacccaagtgacttcagtacctggtgggcgggtggccatgtgattgtcccaccaagctgacgcgggaccttgaagctggtgtgtggcgaaagcaaccttctcctgatcattgcatgcaggagattcagcttcttcttatggcatggagccagtcattcgcctccatagggttggtggtgctggagaaggtgggtggcctgacacgtagaaactctggcaacttggactgagggggagggggaccaaactgttgatgctgctgttcggcgtgctgcagcatccgctggtgcatctgctggtgctggtgctgcatcatggctgccatcatctgggtctgatgtgccattacttggactagcgtcggattctcgggaagtggtggcggaccattgccggaatcgctgtggggatgcgccccatcagtgcgctct

SEQ ID NO: 2093 - DNA, 752 bp, Oryza sativa
gtgagttgtgttgtacaaagggtattgtcacagcctctattcgggtactttccagtatcgcgacgcatggtagacatgatgttgaggttgtgtcttgtgggtacagtggtacacctctggccagagtaaaactattcgaatagccgtgcccgcggttatggacgagttgagcaatgtttttcgtgattagtctcacacctctcacaataattatggatgttataactggtaataatttgcttagctccggtttggaatggataattcctggtttggagattagatctgtacagccgggtatggttgtttcagaatggttgggcctgagcagcataggcatgttgttcagtgttgattaaaatttttgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgcaataatcaatcaacctcagttgaagacaagttgcgaaggagaagacgtttggctcataccccagttgagctgcctgtgggagtggagccggagcttcgctagattttattttccgctgcagttttcttcttggtgaggacttagtgcctcttaagtaagtaattatcgtttagttaatttgatgaatctgtatatccaattgtcagtttgtgtacctcggctgattcctggacgagg

SEQ ID NO: 2094 - DNA, 679 bp, Oryza sativa
ctgaccaaccaactgatatctggggactacgctgacgttgagaggctggttgacaaggcaatccgtcaggaggatcaacgcaacaagatggacaggaagaggaaagccgcacagttcagggcacctcagggaagtcaccagaggccgcgcttcgctcccaggcagcagggtggacctaccaccatgatcgttcgtcagcaccgcccgttcaaccctagcaactttccccagggcgccagtggcagtcagaaccaccatggaggtcagtccaaccgcggtgcagctccacgcccaccaatggcaccggcacagtcaggcccgcccgcgcaagccaagaaggagactggagcaaaaccagggtcctgcttcaactgtggtgagcttggccacttcgctgacaaatgcccgaagcctaggcgtgccgggccaaggtttatccaggctcgtgtcaaccacgcatctgcggaggaggcacaagcagcaccagaggttgtactgggtacgttttctattaactcaatccctgcaacagtactttttgattctggtgcaacgcattcgttcatttcaaagaagtttgttgggatgcatgggttaataagagaggaacttacacaccgatgcgggttcataccccagggaatagctccacttcggttcaattcagcccttctataac

SEQ ID NO: 2095 - DNA, 568 bp, Oryza sativa
tttctgcttttgggatgtattccggaccgctcggtccgatgatttaagactacgcctgcgggcttatgttgtaataatttgcactagactctcgtgtatgtgcgtttggtatctcggctatgaactcgtgtgtaccagactacttgatccaaggaaatggtactgtttacacgattgattcctgttataaaaacgggggtctacagagctggtatcagagccatacgactgtaggaaaagaccaaaaggcgccccacccccttttctaagttggccaagggagaaattcccatttagtaatactttcaaaaataaaaatgctatgttcacaaaactctatacgattttcatcttactcttaactattttcttcacaaaacaagttttactctcagctgactttgggtttttcttaaacttagatggcagatcaggattcacccgctacctgggatgatgggcgtaccccgctcagagggatacgtcattgagctgcatcggttgatgaggcgtctacggtaccccagatttccgatctaccgagtgagacagtgtggatccgtttggg

SEQ ID NO: 2096 - DNA, 754 bp, Oryza sativa
agcgggcaacgggcagtcccctctcgtgcctaggtgaatccggaaacgacagaggccgtcgcagggcccgccccgctccatcacgcccacctttgcctggatgcgtcgactagatgagagctacactacaagcccagccgttgcccacgctggcttgtggtaagtacgataagttctttcgggcatcccgcgaaccggtccttaactgccatgggtgcgaccagcaaaaccatgcacccacagcccaccatgtgatttattttaattaaccaacaccaaagcggtggcactaatccaacaaaaccattagaaccaacagtctaaacattaataggattttccccattgtgaactagttgaactaagcatggctaagcaattcctagtccaaactctaatcatgttgtaaccccaagctaacaaaggagcatggtatccaaaaagcatagctgtaacaataggtaaccatcccatagtaatattataaaacaatgcaatatttgaaagaaaacaatagagcatttgcaatataggatcaacatgttcaagtgacaagcatgacttgccttgctctgctgctggaggaacctcggcgactatttcgaagtacaccggagcgtcggaggagtggaatctagcgacatacaaagcaaacaatgcaaacaggctataagactactgaaacagggaacaaaaccatttttaatggattctacacattactcttgatttactgagacttgaatgggcttaa

SEQ ID NO: 2097 - DNA, 3959 bp, Oryza sativa
  unsure (1)..(3959): unsure at all n locations
gtttgccaatttcttttcgaattttaatttattctattattccttttagggaatgatttttatttcgggatgaatttatcaggacatgacaaatccaccccccttacaagaatctcgtccccgagattcgaggtggctagcaagaagataggttgcgcggtcttctcttcttgtctgacttcttccgtcgcgtcttctataacaaacttgcctagcaaaacttctccactctggactgcttggctcgatctcctgttatagatggaatcttctcttcacctgacttttccctggttgcactctagctgacttcgactgggctgcggcattggaagatggggcttcagttccaaaacttcttataactcatatctttggagtcaacctcatacaagttacacttcatgtcatgcgtcaacactagcttgtcattactaggataccatgtttgccatcataagaatatcatacttgtcatttacttctaacttgccaccaactacctcatattagctttcctggtctccaggtgctagctacttctgctatttgatgcaagggtcaataactttgcctttgaattatgtttctcaacagaaccaacttatcccactattatcttcatgttgtcattatttagcattcaacgtattcctttacaccttcgaccttgatgagttccttcccattggatcatctcccaagacatggcattgcctggtaaccggtgcttgcacttttcactccgtgtagcatctgataccgagttaaagatttcattccttgccttcaaagaaacacttttacctaggtcgtattgcttactcacgatttttttttctacctcaatgacaaggtgactgttgcagggtgattgctatcaggagtcttccttgagtgatgcagagcatgtttctgtttatcctttatcaatcatctttcggcctacttccttcctgctagagaacatatttgccaatatcttttatcaatcatctttcggcctatctctaacaggtggtactctttaatgtgggttgcggacacttctggtggcaatgaggtcctttggcctactgcctttcagtgaaaccttgaagtagttcatcaaaagctgtactgactgtcgttgcctttgatccgaaaaagacaaatctgaaactcttagtccaaacaaatgtctctctggttactcgcttgattttcttttccatcagcaggttggttattaactcgaggttagaacatggttcctctgaaatgagaccctaggtctcctttgacagtaaacacataatcccatatcagcatcttccgaaagagtcctcatagaacttgtttttgttacacatttctcccttattacatgaatacaaggccctaccttaaacaaaaagggaaggtgcttaacatcggtacattgcatcctcaacatgaatcatccataaacatagcaaactcactgtttataaacatgaatatatttatttattacatgattgctgcaaactcccgattacagtgataagtagcgaactgaaaatcacaaacatggatactcattctgattctggagagatatagctggcattgttctagtgactgcatccttgattggttctgtgatgatgtgataggactgcatattgctatcattcacaggagaagcttccttctgattgctgtttgaagcggatgacggtcttctgcttggtatcgccctccggaggttgattgccctttgctcggcctggagtaggtcggggagagacacaacttcttccatcgacgacaattctttgctgaggctgtcggtgcagagaatggttggtgctgaaggtattattgctatgatttattgcagagttaggtggagcaggaggaacattggtgctatggatgatatcgtcgatgttgctgttggagctgactagctgatgagacaatcgtagggttgttcgttggatttctacggtcttggtcaacaacacactgagttggcaatccttgggcacatggtttgtaccttcgcacagaaaacatgtcatcttgcgggtgggacactcccctggtggatggtcttcttcacaatgagggcagagtgtgagacacatgctagcaacgtgtccaatttctccacaacaggtgcatgcctttgattccatctcttcctcgccgagatgtcggggagactcatcttcatcatccgaggagacttgatctgacccttcactatcagatactctgccaccatggcttaggaggtgctgggtcaactgtcgtgcacctcgaaaggtatttcctctttgacgtctaggaatagttatccctactggaggccattcggtgttggtaatagtcatcttacgtacttcttcttcagttcgcatcggtgcttttctcttctgattcttactcttcttgcctttggcttgcttagtatgtgaccccacgtggtacgaaaggctaggaggaaagcatttcccgggattcaatggattctctccattgggctctctactttgcacactaggctgcaagcttgacttggtgcgaggaggctggtttagcgatgtctgccctgctaaaccaaaggaagaggcttgtttggcatatacccatggacaattcagggcatagtgtccttgttctctacaatcatgacaaaaggggacatgctcttctggcattggaagctcattgacctgggtggcaaatgctcgatcaaacacatactgattttggtcttgacttccaaccaatggtagctgtgaactcagcagcatgcttggaatggaccaagggtgtgcccttgttaactctcttgaggacagtggtggattgagttgaaaacttgagttagttgaggcatacccgctgacattctttcctttttctctgttaaacatctgttacagggattgaggtgagagaggaaacaagccaggaaagaatagaccagaactagagacaggaccttaaaggaactaactcttcttgttgatgtgttgtttgtttcacttattctgcaagttgattaagcaaacaacctagcatggttacatcacaacccaccgatgcaaaccacgcgctacacacacaagcaaggaaacacacgacaaacgagtctgccctagagggtggcttgggttctgcgacgggttctctaagatcttcactgcttcttcacagctagcttcactgcttcctccacttcgctagcggatcctgcagtcttccggagcttcggcagacaattgacgatatcttcttctccgcaaagctgaccatctagtactagttgaaatttgaagaaggaagaaagagtaaacattttgcaaatagcacaggggaaaggaggaaaaaggaactttcgcaaatagtttcatttataaaatatgtccttaggtattatccacttggcttatcctacagacgagatggctctgataccagcttgtcgcgaccgagaaaaatacattttcccgaacgctagtgtattaatccccgtcccagaaaaagccggggtacaccacacaaacatgatataaaagacacatctttattatatcgataatatttacattattacaaaggcacttaaggcctgacaataaaaaaataaccagcagcggactagcgggcctacggctgcatcttcacaggcgctcaactggggtataagccaggactccacctaagacttcttctccaaagcttctcttactgaagggggggggggaagattgagcaagaatgagtacaaccacagtactcagcaagccacaccggcagatgcatgattaatgcaagagggtacaaggggtaataatataggggttaagttttgtagaaaacagcatttaaaagtcacttagttacccaaagccattttataaagacgatcctagagttacacagtgnnnnnnnnnnnnnnnnnnnnnnnnnnnnnnnnnnnn

SEQ ID NO: 2098 - DNA, 6956 bp, Oryza sativa
actatagggcgaattcgagctcggtacccatttataaaatatgtccttagggattatccacttggcttatcctacagacgagatggctctgataccagcttgtcgcgaccgagaaaaatacattttcccgaacgctagtgtattaatccccgtcccagaaaaagccggggtacaccacacaaacatgatataaaagacacatctttattatatcgataatatttacattattacaaaggcacttaaggcctgacaataaaaaaataaccagcagcggactagcgggcctacggctgcatcttcacaggcgctcaactggggtataagccaggactccacctaagacttcttctccaaagcttctcttactgaagggggggggggaagattgagcaagaatgagtacaaccacagtactcagcaagccacaccggcagatgcatgattaatgcaagagggtacaaggggtaataatataggggttaagttttgtagaaaacagcatttaaaagtcacttagttacccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcacattttaagaattaaaacactaacttgggtacattgctaggcttgcccataaccgagggcgcggctattcgaataggttatactctgatcagaggtgtacatctttacccacaagatacatcttcctcacgtgtaaccacgtgccacataccaccacggtatacggacggaagacgtgacatagttcccaacccatcctagccataaacaagagtaccgacccaaccccacctacggccggaacctctgggacaggcaggcaggattgagcccctagcagcaggacaccagccctgtgccatgacatctcgactaccgggccacagctcgtgtagccttcatttgtcctagagatgtccatcgacccccgacttcgtccatctccatccgtgtacttttgtttataaccagactgagccacaaactaagccttacccgctagacatgtggaagtacggtagtgctttgcaacagaggcctgagcttaatccttatagtacccgaggaacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaagctaataataacaatagcaataataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcagagataacggccttccgaaccttcggcgacgaccgcaaaccacgcttcgggaacctccggaacgacgaagactacgcgaagcacacaagcaaagctacaagcctataaagaagcaataacaatacataaaaagaaagcacagggttctttaggttataacaaacattaggagacttgaacggatcgattcggagctcgtatgaccaagatatgatcatccgaagtttaatgctgttacatggagatttgcggattattataattaggttttgcaactataaaacatgtgtaagcgctagcctggaaaagacaggaaggctgtgccgttgacatgcggaccccacatgttaacctaaaggaccacggtagaccgagtacacagagacggtccacgggtcgacagaagcagatcccgtgtgtcaactgaggcgagtggccgacaaacggactccactagacaccacacgggctgcacacgtggaaaccacgcggctaccgagcgggcacactaacacggtcaccacacgcacaagcgaacgactaccgacaccggtacacgggtaccggggtcgacaaccgcacaacgggcacgggcaacaccgaaaggacgaggacggggcagcgaaggagagatccttaccaccacgcgacgaggcgagggaacgacaacgacgaacgggcgcggcggagacggccaggaatgacggagatgaaaggcgaggggacgacttcggcggcgatccttggacgaaggcgagacgcggccggcgcaacgcttggcgacgcggaggcgaggacgaagacgacgacggggctgcagaggcacacttgacggacgcggacgacagacgagaatggcttgacggagggacgaacaccacgacgaccgggaacgacgagaggacgacgacaggaaccggcgaggaggtgatgagggcagacggcagcagctgcacagagacgaggacggcgcggaacacgccggtacgatgacgacgagggtggcggcgcagcgagacgacgagccggcgaggactaacgaccgaccggaggagtcgtcaacgaggatgaacggagacgacgacgatggagcgcggaggggttcggtcgaaggggaggcgaggccgagggcgaccttgccgctgcgatgccggaggtggagacggcgacgtcggccggtgcactggcacggcgaaaaggggctgccggagtgggtgccgacgagaccgagggagaggcggcgcgcgcaacggcgttccgacgaaatacggggaacgccgtggcttgccggggaagaggatggcgttccggtgccgggaaaggtggtggcaactcggccggcgcacaggggacgcgccaaagcggcggaagcggaacagtggtggcaacccactgttgccggcgggaatgcacttccggaggtcttcgcgggaaacagagggcaggccggcgaagaggaggcggctgcgacgctggaggaggcgacggcacggccggccggcgtgctaacgcggcggcaggggcggctgaagacggccggtggcacgggagagaggggacgacggcggggaggtggctagggaccacgggagatcgctggagggggctaaaacgatagaacggagcgaggggattccgttttatagcggagggaagcgagccgagcacaggaggagtggggaacggcggcggaaatggcggccggcagccatggaaagcggccggagttggcgcgtccgttcccggcgattgggggcgccattcaagggggaattgagggggaaagagagacgagggaaaggggattaattccccctaatcaattttggaattcccggtttgaatcgcgcggatttgagggaggaaatggctagggttcacggaggagagaggaggaggctgggcgggaggaggaaaacgacctggcgcgtgggccccacgcgggcgcgcggtcagcgctcgcacgtgctcggcacgggcgggagggcgcctctcggcttgggcccggaggcggcccaggaagaaaagagggaaaagcaaccccggaaggaaaaggaggaggagggagtgggccaggagggggagggaaaaaaaaagggaggagggaaggacttcggccgcgggccgggggagagagagggaggctttgggctagacttggcccaaaggaaaaggaggattatttttaggttttctttttattaaactttgataattgtttttgttgcttaataaatatttccggtgctctgaaaattcaagtaaaatttgagggctcattttagagcaaggagaatttaacaaaaattctccgggccacattcgaatttttcttgtacgtattttagtgtttgccaatttcttttcgaattttaatttattctattattccttttagggaatgatttttatttcgggatgaatttatcaggacgtgacagtgacatggattgctgtccttttcaaactaattttgttatgtattgtaagctattgttttacaaatgcactttacatgtcaagggcgcgtggaactttaatgatatatctagacatatatttgtatgtgtaaagtgagttatgacaaatatattagttatcaataactgcatacgttcaaatgagatatgtagtaaagtgcctttacaacaatatgtctaatactacaacagtttagacattccgtgacaaaaatcttatgatagcctttaagaacgtcatcaattttatgaccactttggtgaaaaatctgaaagattagcttgcgtttattttgcagaggagttaaaaaaacacgttagaaacaaaaaatcacgaaagggaacgaaatcgtgacttagaaggcattgcttctcacaacagttcggctagcacgtattggcaacgatttgcctatagaactagctagatttttctcacggtactagatgtaagaacgaaaggacatttaggaggcagaacataagtgaaaatagccccttgctagcatcaaaccatggtccgattgtatcacagcggtcatcaacgataccagtaaagaacaaaatgcctacctattcactctcaggatagagcaacagctatattttgtgactttaggttaaaacaaatgaaactgatatgcatgggaattaacgtggactattacgcatatatgaattttattgaggcagcaatgcttaatgtttttaacttataaattgatatttccgcgaccaggccttcaaatatgaaaattttaacttcaagttacgcggagcgtcttgtttcggtgacaagataagattgaattaacattgatatggcaaatggttcaatcgatacttacattttgaaaagtggatttataaccgcttgtcgaaacaagatttcggtaatactaaaagggggtggctatcaagctgcaaaagtggatgggtttaaagacaaggaattttatacaggttcaggccttcttaatcaagaagtaataccctactcctgtccgaggattgatccgccgagtatattattgatcgtgtgatctgggaaaaaaatcgtgcccctagaggcacccggacccctccttatataggggaaggggtccgtattacaaactacagtccatatccctaacggaatatgtagttacagataaaatacaatcgtaaccgactaggatctctgatatttccttgacatacaagtttagaatttaacccgagtccttctaaagatattctatctacacgtggcaccccattcccagtcggactatacatgccgtgtaggtagggggtatccataatctccacagtagcccctgagacctttacagtcgacgaaatagccttctgtcggagcgcaaaatgataatccaagtgcttcactttcttctgcattgatctccagagtaccaaaatcaaagactgtgaagggctaaaaataaataattaggtgcatcgaatagataaacctaattaggtgtagcccccgactaggtgagtagctaaaggctaaacacatagtcaaagtgcaaataacatccatccgagtggttttacaaccgaatcatccaaaatattatacaactaagcatatgcgacgtttaataaaacatccagccgactactttagctttaatataccaaaaatggaaatataaagaggcccgagtaaaaaatactctaaaggtccataaatcagcacatatgacaagaatctgagtaaaaactctcaaagatccatcaaatgtggtataaatatggcagcacggcaattaatgagtcgaaatagcctaggctatgactcatgccataatcaaaataagcatataacatgctgagagaatgactgttcaaaaaccaatcatctcaacgaaacccaaacagcctttgcagcctaaaaagacttacaagaagaagtataacacctttctgtcgggtacctttttatttgcatcgtagtaattccaaggaattatctaactgcatcaaaaaggattttaacagcattgggccatactattgtgagcgaaaattgccgaagcaaaaatgcctaagtccttacggatcacaacttagccacgccgataacaaaagggggttgaagtactgttttaggcccaggcccattagtactcccgataccctaataacaccaaaaaaccaaacgccgtttcgttttccccaccgaaactttcgccattttcccattcctcgctacagtgccaaaccactccggcggaactagggttctccgattcgctcaaatcccccttccaaaactccacagaaaccatccgcgcatccaccgcatcaatcccccatccatccccagccatttcgaaagcaaattgcatcatccaattcacatccatggtagaggagagagaaagcttcaagagccaatgggcgccctccgacgtcacggtggaaagcttgaaggaaatggtagcacatggtgttcttccagcgaaggagatcattggatggcgttcggcgtacgacgaagcattcccgaccccggacacacacgaggtcatggtgttctcctatttctttaacggtgggttctctcttccaacctcaagattcttccggtggattttggatttctatgggattagtttgcatcacctaaacccgaattccatagttcatattgccaacttcatacatgcctgcgaagcttttatgggcgtcaggccacattttgccctattctgctatatcttcttcctcaaaccccaaaccgaacaagagcaagccatgcgtagttgggggtgctggatttcaactgaggggaactctgagccaa

SEQ ID NO: 2099 - DNA, 4383 bp, Oryza sativa
tcaagagctgactggccccaatcaaagaaagatctcgcacggcctttgaattcgacggcaagcatgaccctaaccgtgaagatcctgaatctcttgaatttaaggttatgaaggagagaatgtataaactcttctcaaatgcagtcgtagttagctattcacacttgctgccagtggtgccatacaatgccttcaacccccctccagcggtatgtatttaaaatttcagcctttctcgaaagcatgcttttatcatctacaaagttgattgaaaacgtgaatcatcatgcccaggaattcgccttgatgaagttagaccctccaactgctcaacgccgctcaccccgtcgtcaaactggtcaagctggcggaggaccaaatatccggtctgattctcaacccagcaccactcaatcagccaaccaatcagacttctgcaagaggaaattggttctgagcgacgacaaaaatgatgactctgaaaaagttggcagcaagggggtgactggaaaaccaagaaggcaagctaacccaaagaagaaaacatccagtcgtcccatgccgaaaatcaggaagtcctccaagtacaaatcatttagccctcttccttgtattgctgctcactaactatcgaaatagcactgatagcataactcaaatttgtaggaagccatctgacatagatccttctggaaaagactctgagccgactgacatggagacgggcccttcaaaagaaaccgagccgaccgccgaagatcgcccgagtgataatcaaccagcaactgacaacgtagagaccagcgacaagcccccgactggaaatcagtcggccgaagcaggagttggtgctaatcaggagccctcgactggaaatcagtcgggtacagagcaaaataatgacatctcggaggtagagacccagcctgatagccctcccaaggcgagcgctggcgccaactctggaactaattcccctgttagggtgcaaggacctgctcgtccccgaccagaaatcataacaggtaagcaaatcctccaaatctattttgatccgacagactttcttcaattgtttcaccattattcatgaatgcctaaggcccgatggtcggcgacgaagaagaggtcctccggatacaatcggctgaagattctcgcccacccatattagtcaagtggtgggatgacgacatgcagccctaggggatcgtaataaataaacaaaaagaggacaaggaagtatgtctgctgaaaaagacactcggccaagctactcgcctcgtaaatgtaagtcttcttatactcagcttcaatcatcctgtcagccactttgctcaaatacggataaatttgcattgcagagaatccatctcaggaacgaggcgaagactgcgactcttgagaaattagttccccatcttggaacccttgaggccactagaaaccagctacacgaagctaaggagcttgctaggaagactgagcatgacctaagagaccgaatcgccgagctccaagactccaactttgaactgagcggatcgtcaaaaggtaaatacaatatttgtctgatttatttatgctaccatccatgtgatatcaaccaacaagaagcaatacagtgcaagctgccaagatatccgagctggaaaagcggatccaagctctggagaaagacaaggccgaattggcaagacagagggacttggctctgaaagatgttgaaggtactggtaactaatacttcaaaaaccattcctttctttatgcccactcgttgatataaatctatttatgttgatataaggagcttgccaggaagactgagcatgacctgagagaccgaatcgctgagctccaagactccaactttgaactgagcggatcgtcaaaaggtaaatacaatatttgtctgacttatttatgctaccatccatgtgatatcaaccaacaagaagaaatacagtgcaagctgccaagatatccgagctggaaaagcggatccaagctctggagaaagacaatgccgaattggcaagacagagggacttggctctgaaagatgttgaaggtactggtaactaatacttcaaaaaccattcctttctttatgcccactcgttgatataaatctatttatgtagatcgcaagatcaaatctcaggctcaattcgatgtcttggtcaacaaaattaagaggcttgagggagctagagatgaagtcgccaacgccgctacaccactcgtccaagccatgttcttcaataacaatggtccgagtacattcgatgcttccgaaatcttcgacaagctgagaattgctctggatacatattttaagaatatcaaggaagctggaagtatgggagcgagcttagcgttggcaatgaccaagtctttgtacccgaagattgacattgacgccgttgatggctttgcagacgggacaagcgaagaagccgcccttgaccttatcaatgatgcgcagaaagccgccgataagatagtcgttgatgtagttgagagattccaggacaacgacctccggccgactggatctaataattccgatgatgaaaaaactgatactgattgatgttgtattataacaatgatgatgatgatgataatgatgatggaggcacaatttgtacaatactgatgaatttatgctatgcttgatgatttaaactcagctcctgatttcttaaaagtttttgtcaaaccttattgagcctagaacccgcaaaagttcttaaaaactttcagtcttcattgactgagccaaaaaaccaaacaaggcaatgataaatcaagtaagcaaattgaattgataaaaatcacactccattattattatagtagcccccgactgataactcaaggaaaaacttgatgttagtagtcaaagagggaaatacaaaagtaatgcctaagcataaaaatgacgaagatgttcgatattccaagagttgtcgataggagtaccgtcttcacgcttgtgtcggtaagaacctggccgagtgacttcagaaattatgaatggtccttcccacaagggagataacttgtgccgatcccatgtagtttgaattgttctcaaaaccaggtcgccgactaaaaaagctcgtgatcgaacattgcgattatgataacggcgcatcccttgcaagtaccgagccaactgaattaaggctgcttcgcgggcttcttccagtcgggtgagatcatctactcggtcttctccgtagcgctcctcgctgaagttacgaaaacgtagagattcatattccacctcactgggcaacattgcttccactccatatactaggaaaaacggtgattggcccgtagcccaactgggagtggtgcgcaaggaccaaaatatagacggcagctgtcctacccacttgccggcatagggatgcagtctgtcgaaaactcgtgcttttattccttggagtaccatgccattggcgcgtttgacttgtccattgctcataggatgcgctacggaggcataacaaattttgatgccgaagtcctcagagaaatctttaaataccccacccgtgaattgagtaccgttatccgtaatgatcctgttgggtaccccaaaccggtgcataatgttgatgaagaaatctctaaccttgtctgccgtgattgtgatgaccggtttggcttcaatccacttggaaaatttgttaacagccacaaagaggtgagtataaccaccgactgcctttttaaatgggccgaccatgtcgagcccccaaaccgcaaacggccaagacaattggatggtttgcaactcctgagctggtagatgagtttgtcgggcaaaaaattgacaaccctcacatgttcgcacaattttgtcagtgttggacacggctgtgggccagaaaaaaccttgccggtaagccttacgaaccaaggatggttcgtgcggcagtgtgattgccacagatgcctgaatgtatatctcttagcaattgtcttccctcctccaaagaaacgcagcgttgcaggactcccgatggactcttcttgtccagttcagtctcatgaatgacataaagtctgctgcacctggagatccgctcgacttcatctttatcttgagggagttcttgttttgttaaaaatattatgaggggctctctccagtcggattcaatcatgtttacgtcttgagtgtccgtggcctcgaatggtttttttccttggcacggtgggttcatagagatgttcaataaacacgtggaaggagctgcttttcgttttgacccaaaattagccattctgtcggctgcttcattgttgtgtcgaagaacatgggtgagcacaagtccatcgaatttgtcctctaactta

SEQ ID NO: 2100 - DNA, 12344 bp, Oryza sativa
ctccggtgaggactccctccccctcccttttctccccttcccgcgtgcgccgccgcctttggccgtgccaccgcctttggccgtgtcgccgctccggccgtccgccgcagcctttcgcgccgtccgccgccgcctttcgcgccgtccgccgccgcctccctccgccagtcgtcgccatcggcaaccgcgcgcaccgccgccgctcgccatggccggtcggtcggctttgtgccgagccaagccgtgcctagccgccgcccgcgctgtccgatcggcctcgggtcgatccggaccgtcggtcccgtggaccggcggtggaccacctgcgtggtcccggtccacggtagaccagccaccttgtgccgctgccagtggggcccacttgcccgagccccctcttcctccccttgtgcgctgacaagcggggcccacctgtcggggcagccgcccccccccccttggatgacgtcagccctgggatttattgcgcaataaattgattaaggacattttctttattagtaaaaacacagtttatcttctaaaattcataagtaattcatccgagcttcgtttaagtctattcaagtctcagtaaattcataaaaatgcaaagaatccattaaaaatggttttgtttcctgtttcagtagtcttatagcatgttttgcttgtgtgctttgtttgtcgcgtagatttcggccatttcatcgatccgcagtttctcaaagacgttgctgaggtctcatcagtgcgagagcaaggcaagttatcctttacatttgatcatattgtacccaatttacaaacaccctgcatttctattaaatgttgcactcttttacaatgtcatgtgggatgggtcctattactcagccatatatcatttaccatatgccattgataactggggtatcaaaatgattagatgttggtttaggaaatgctcagccatgcttagttattacatagactttgactatgagcatagttctggattggtgccaccgcaatggtgttagttatttaaaatacaccgaatggtgggttgtgggtgcatggttttgctggtcgcacccatggcaattaaggaccggttcataggaaaccctgggagacttaccgtgcttaccacaagcgggagtgggtaactgcttgatctgaggtatagctcaaccctttcctaggcaccggtggcgagggtgggcgtgatggagttgggtcggccggggtgtccggttgtccagctgccttttgaggggtgggggtgaaacctgtcacaccctaaaaatccaaaatgtataaattgttgtttaattggaatttttagaaatgattttaaaagcctagaagagaagatctaattttaattaataaattccaatataaaatggggccagataaaatttcattaaatactttgcttaattctataattcctagattcttctgggatttatttgagctaaggaagtatttttaataaatggaattgcatttcatgaataatttaaattgaaaaaggattttaaaagtctcttttggctttgggccgaaagtcggcccaaaaccttctctctctctccccagcccaagtcggcccagtccgtagccgagccgcctgcgcgagcgctcactgccgctgacaggtgggtcccgcctgtcggggtcgtcgtcaacctccagccgccaccggccgaaaccctagcgccgcaccgccgtcgtctccttccaaattcggccgcccctttccttctccggtgaaatcaatagaggggaaatgatctccgggatctcctccaccttttctcttttggaatcatcgtttaaatcgctttggaagttcgtggattcgagttcgattcggatcggcctctctccttcgaaccctaaccttccatcgcgtcgccggtcgccgtgggccttcgccgccgccctccaacccctataaaaggatccccaagcccgtcgctacccgccgccacccttgctttcgcctctcgccgtcggtagcgtcctagcaccgtgagacctcgcgccgccgtcgttgccgccgctccagccgtgcgtcgccgtcgctccagtcgtcgccgtcgctcgggaaggctgccgtcgtggtcgccgtcgcgtcgccgtccttgtccaccccttcgccgtcgctgaagaccgccggagcaccgtcgccgtcgtcaagccgaagagtgccgccgctttttcctcgacgccgtcgccgtccgttgatcttccgccgccgttttggtcaccggtgagttcgccgcgtcgccctctacgtgctggtgccctccgttcgcgtcgtcgcgccgtcgttcgccggcgagtttgcaagcccgagcccccgtcggtggtgacgtcaccgctgacgtcatcatcgtcgtctctcgtggtccggccgtggaccggtcgatctcggccgtccgttttggatggaaagatctcggccgttcgtttccgtgagccgccaccgtgcgcccggtccaccgcaaccctagccgctgacgcaataattccctttttccttttcaaaaataattcattattgcgtcataattcaattaaaatccatataagtgatttaaatcgatttaatctttgaaaattcataactaattcatcttagctcggatttagttggttcaagtctctaaatttttctaaaattgagatctacatgttaaaaatatccacatgtactgttcatgcttgtttatatgctgttttggtgattttggtcttttctgtttagattccgacgtttccggaaagtccgttttcgcaggggaagattttgaagagttccagggccagcaaggcaagtcacacagatcccaaacaaccctttgagcatgttgatcccgtttaaagctattgtttctattcaactattgcatttattttcgaatgtcattgggtggaattaacctattgtttgttataatccttttgttcttgattactttattccttgataccttgggtttttataacttgactagttgggctatatatatattggttcagctagatattagatatgattgcttagccatgcttagaaacattagcacactattgggataacttatgattcactattatttaatgatggcttaatgatagctcacgatggccaatcgtgattggttaattaattacttgccaactaaaacttgataatggtgggttgtgagcacatggttttgagagacatgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataacggggtgattatgatccaggaaaggtgccctgtggtggattgtgttgtgcgaggggtattgtcacagctcctttccgaggtaccgtggtggtattgaggcacatggtgacatgttgtggggctgtcttgtgggtacagtggtacacctgtggccagagtaaaactattcgaatagccgtgcccgcggtatgggcgggtctaacaatgtctttcgtgattagtctcacacctctcatcatgataacagatgctataaatggtaataatttgtttagctcctggtttggaatggtatattcctggtttggagatagatctgtacagccgggtatggttgttcagaatggttgggcctatacaacagggtatgttgtatagcgttggattaatagtgtttaattattacttaaccgttttattaaattctgaaatgtttattaaatgttgtttatgcaaatgaaaccctactatgccatcctttggtatcctgtgcacttgcatatttgctgcgtgacttgttgagtatgtcatatactcaccttgcaatcattcatcagaggaagagttctacaatgatgctgatggtgtggaggattaggtgtagccctggtcaagctgcctgtggagtggagccgtctgcgccgtttatcttctttccgctgcttagatctttattgattgagaggaactatctacctctggaatgacattttattcgcttattaattagagtaataattgtactctattatcaatttgttattgtgtgcctcggctgattcctggacgagggttcacacacatgtaagcgtttggaattttggatagaaattccgggcgtgacaaaaccttagcgtggtgtggatggttagggaagggttatgcggagggtcttgtcacgatttccccctttgcagtatcatggtgatacttcggggcatggcgacatgtgtggaatcgtgtcttgtgggtacagttgtacacttctggccagagtaaaactattcgaatagccatgcccgcggttatgggcgatcaaccagattcaccgtgattagtctcacccctagtttagcttaataaactggtgtagttcagatggttggttgggcctgttgcaacgtggtgtagcgttggacagtgtttggttaatattgattaattactataactgttttactgctttcaactactgtttttaaatgcctactttgtgcaaagagcctttagcctccttaggttatatcctgcatcatacctcctcttccggtataacttgctgagtacagtgggtagtactcagtcttgctatcttttcccccacaccagagctgaagatcttcctagtgggaggtgtcttaccgaagttggtttcgtcgctggcatcaaggattgcctgtggagtggagtcgccccgctgcagaagtcaagtttccaagtctagctcgtttttcttttgcgctgcatttgtaatcttttccatttttgtaagacgtggatctgtatgtcaacaattgtcgtttgtgtaccctggctggtcctggacagggatttaatgcacattcagcttcgaaattctggttcgtgaatttctgggcatgacaagttggtatcagagccgagactgaccgtaggacaagccaactggaaacctaagagccctctgaaccccttttcatatgcatatgcctttttcacttggatttgtttcgggaaaattttgggttttgcctctttggtttgtgggaaaaatcttggtccttcattcggatcggatctttaaaattagctcagtctagggttttagtaaaattttatttggagtttatttgacagtcagtcgggaatctatcaggtgatatgcattaggtcgtgtctatgttcgatggggcaattttatgcgcattattttctatgcatctaatttatgcattaatttattgtttagtcagttgcattagtgtctttatctgggttcatgaaaaacgttctatgcataaaaatcagtcatgctaggttatttatttgagtcatttgttgctttgtttaatttggaatttagcatgaattggttcttatcccttgtctactttagatgtcagtcctatccctcgattgcaatcgccgctccgagcttcagagtcgccgcccttagttttatcgtcttcttagttttgtttgcttgctagtttccgtgcttaggtttgttgcttgtgggttagttggcggtcgatatcatgtgtgagtggtatggctgacttaattaagagttgcgtgcctctttttcagtgttttaatcaagattaagataattgcacctaaatttataagaaatattagtttctgagccccctgtttttcttccttttctcatatttctacctatcccccttcagatggtgaagacaaggaatggttcacgtgactctagcaatgtcagtggcagcgaagagcagattagtggagcacgtgccaacagtgcatctgacaacagtccatctccaccgcccgagaacccaacgatcgctcaggtgttggacaatcagactcagatgatgtcaatgatgatgcaacagatgcaacaacagtaccatcaggtgttgcagcaggtgcagcagcaagcacaacagcagcagcagaacctgcagtttggtcttccacctcctcaatccaaactgttagaatttctccatgtcaaactgcccactttctcaagtaccaccaacccaatcgagaccaacgactggcttcatgctattgagaagaagctgaaccttttgcaatgcaacgaccaagagaaggttgcttttgctacacactagctgcaaggtcccgcttctgtttggtgggacaactacgtggggacccgtccagctaggacagaggttacctgggcagagttttgtcagagtttcaataaagcacaggttcccgagggaattgtggcaccaaagaagagagagttccgttccttgcaacaaggaaccagaacagttatagagtatttgcatgagttcaatcgcctcgcgcgctacgctcctgaggacgtgcgcactgatgccgagaggcaggagaagtttttgtcgggtcttgatgatgaattgaccaaccagttgatctcccgagattatgaggactttcagaagttggtagacaaagctatccgtcaggaggagcagggtaacaaaggggaaccgacggcgaaaggaaggcatgcaagttcaagacttcccagggaacaggcagaagcctcgcttcacgatgggacatcagggtggaccttccaccatgattatccggcaccatcgtccttaccacccggacaatttcaacagcatcaacaacagtggcagtcacagaaatagtgagcagcacagcctcaaccctactccaagtccactaatgattccagctcagtcagttcagtcagctcagcaagaacagcccaaaaagtttggagaaaagcccgaactctgcttcaattgtaacgagcctagacacatggtacgtatgtgcccgaagccaagacgtgccagactcaagttcgttcaggcccgtgtcaatcatgcatctgcagaggaggcgcagtcagcaccagaggttatattgggcacattccccgtcaactcgacaccggcagtaatattgtttgattctggtgcaactcattccttcatttccaagcgttttgctggtgcgcatgggttatctttagtgaagcttaagataccaatgcgagttcatactcctggaggtggcatgaccacaactcactactggccatcaatgacagttgaaattcaagggttgatttttccagccaacctcattcttcttgagtccaaggaccttgatgtcattcttggaatggattggttgacacggtacagaggagtgattgattgtgctagccgcaccatcaagttaaccaatgcgaaaggagaagtggtaaccttccagtctccagtgccgcagaagccagggatcagtttaaaccaggctgctggtgaagaacaagaggtagcagtggagaaaaccactaagaagttggaggatattcctatagtcagagagtatccagaggtttttccggatgatctgacaacaatgccaccaaaaagggatatcgagttccggattgacttggtacctagaactgcaccgatccacaagaggccttacagaatgagagccaacgagttggcggaagtcaagaaccaagttgatgaacagttacagaagggatacattcgcccgagcacgtcgccttggggtgctctagttatctttgtggaaaagaaagataaaaccaaaaggatgtgcgtcgactaccgcgcactcaatgaggtcactattaagaacaagtatccgttgccaagaattgatgatctgtttgatcagttgaaaggagctactgtgttctctaagatagacctacgatcaggctatcaccagttgaggatccgcgaagaggatattccaaagacagcattcatcgctcggtaagggttgttcgaatgcacagttatgtctttcggactcactaatgcacctgctttcttcatgaatttgatgaacaaggtgtttatggaatttctagacaagtttgtcgtggttttcatcgatgacatacttatctactccaagtccgaggaagagcatgagcagcatctccgactagtacttgaaaagttaaaagagcaccagctatatgccaagttcagcaagtgtgacttttggcttaaggaagttcagtttctcggtcacatcgtgaatgctcaaggagtagctgtggatccagcaaatgtggagtcagttaccaaatggaccccaccaaggacagtcactcaggttcagagtttcttatgacttgcgggctattaccgccgtttcattgagaacttctctaaaattgctaagccaatgacacagctattgaagaaggaagaaaaatttatctggtctgctgaatgcaataggagttttgaagaactcaaacgacggttggtgtctgcaccagtcttaatcctgcctgatcagacgaaagttttacaggtctattgtgatgcatctcgtcaggggctaggatgtgtgttgatgcaggatggcaaagtggtttcttatgcttcatggcagttgcgtcctcatgaaggcaactacccgacgcatgatctggaattggccgcagttgttcatgctttaaagatttggtggcactatctcatcggtaaccgttgtgaggtatatacagatcacaaaagtctaaagtacatcttcactcaacctgatttgaatctcagacagcgaagatggttagagctaatcaacgattatgatatgggaatacattatcatcccggcaaggctaatgtggttgcagatgccttgagcaggaaaagctactgcaatgttgcatgggtagagcaactatgttgtgaggttcaatgtgatttgaacatctgaaccttggtatagttgagcacgattcgtggctgccctagaggcacaacccacactggtggagcaggttcgcatagctcaagcaagtgaccctaaaatagcagagctcaaaaagaacatgagagttggaaaagcccgaggttttgttgaggatgaacaaggaacaatctggatgggggaaagattgtgtgtacctgaaaacaaggagttaaaggacttgataatgacagaagctcatcaaactcagtattccattcatcctggcagtaccaagatgtaccaagacctcaaagaaaaattctggtgggtcaacatgagaagggaaatagctgaattcgtcgcactctgtgacgtttgccagcgagtaaaggcagaacaccaaaggccagcaggtttgctacagccacttcagattccagaatggaagtgggaagaaatcggaatggatttcattacgggtttgcccaggacgtcatcggggcatgattctatttgggtagttgttgatcgactcactaaagtggctcactgcattccggtgcatactacctactcagggaagaggttagcagaactttatctgacaagaatcatgtgtttacatgggggaacctaaaaagatagtgtctgatcgagggagccaattcacttcaaagttctagcagaaattacaagaggaattgggaacccttctgaacttcagcactgcttaccatccacaaacagatggctagaccgagcgagtcaatcaatgtcacgcccggaatttctatccaaaattccaaacgcttacatgtgtgtaaaccctcgtccaggaatcagccgaggcacacaataacaaattgataatagagtaccattattactctaattaataagcgaataaaatgtcattacagaggtagatagttcctctcaatcaataaagatctaagcagcggaaaataagataaacggcgcagacgactccactccacaggcagcttgactagggctacacctaatcctccacaccatcagcatcattgtagaactcttcctctgatgaatgattgcaaggtgagtatacgacatatgaatttttgaagatttaatcggattaaaacacttatatagattttaattgaattatgacgcaataatgaattatttttgaaaaggaaaaagggaattattgcgtcagcggctagggtttgcggtggaccgggcgcacggcagcggttcacgggaacggacggccgagattgatccatccaaaacggacggccgagatcgagcggatctacggcggctcacggcagacggccacgatgacgtcggcgatgacgtcatcaccggcggcgactcgggcggctcgggcgcgcatgctcgccggcgaacgacggcacgacgacgcgaacggagggcaccaggacgatgcgggcatcgcggcgaactcaccggtgaccaaagcaacggcggaggatgaacggacggcggcggcgttgaggaaaaggcggcggagtccttcggcttgacgacgacggcgatgctccggcggtctaccgcgacggcgaaggggcggacgaggacggcggcgacttggcgaccacaatggcgatcttcccgagcgacgacgacgaccggaacggcggcggcgcacggctgaagcgacggcggcgacggcggctcgaggttacacggcgctagggcgctacggacgacgagagacgaaggcgagggtggcgacgggtagcggcgacaccggggatccttttaaaggggttggagagcggcggcgaaggcccacggctgccggcgaagagaaggaaaggtcggggttcggaggaaagagaccgatccgattcgacctcgaatccacgaatttccaaagcgatttagaggatgattccaaaagagaaaaggtagaggagatcccgaagatcatttcccttctatcgatttcaccggatcgggaaagacgcgaccgaatttggaaggagacgacggcggcgcggcgctagggtttcgggcggcggccgacgcgaggaagacgacgactccgacaggcgggccccacctgtcagcggcagcgaactcgcgcgggcggctgcggctgcgaactgggccgacttgggccggggagagagagagagggtttttgggctgactttcggcccaaagacaaaagagacttttaaaaacctttttcaatttaaattattcatgaaatacaattccatttattaaaaatacttccttagctcaaataaatcccagaaaaatctaggaattatagaattaagcaaagtatttaatgaaattttatctggccccattttatattggaatttattaattaaaattagatcttctcttctaggctttttttaaaatcatttctaaaaattctaattaaacaacaatttatatattttgaatttttagggtgtgacaatcaaatactagaggatatgttgagagcctgtacgcttgactttggtggagcatgggacaaaagcttgccgtatgctgaattctcttacaataacagttaccaagctagtctgcagatggcaccgtttgaagcactgtatggatggaggtgtcgtactctgctcttctgggatcagacaggggaacgccagttgtttggtacataagttttaaatgaggcagaagagaaagtcagagctgtcagggaaagattgagaatcgcacaatgtcgacaaaaaagctatgtagacaaccgccgaagagagctcattttcgaaacagaggattatgtgtatctccgtgtcactccgctcaggggagtacatcacttccaaaccaaaggaaagttggcaccacgctttgtgggaccatacaggatcttggaacgtagaggtgaagttgcttaccagcttgagcttccctccaacatgcttggcatccacaatgtgttccacgtctctcagttgaagaaatgtttgagagttcctgaggaacaggcaagtccggatcaaatcgaaatccaaaaagacttgacgtatgtggagaagccgactcgtatcctcgaaactagcgagagaaggaccagaaacaaagtaatcagattctgcaaggttcagtggagtcatcactcagaagaagaggccacctaggaaagagaaaatgagttaaagaccgcccatccgcacctcttcaccaattcttccgaatctcggggtcgagattccgtttaagggggggtaggtttgtcacaccctgaagtttcccccccttttcttgctttaaaaaaattggttaaataaattgcccgaagaaattatcttaattaacctagagctaaatccctaattaataaatgcatttaataatcgaattcggcgtggtggaatttttcttgagttccccatgctccaatacattaacatgatttttagtggaattttcagagccttggaaataattttaaccaattaaaattgagcaagtgcaatatttttag

SEQ ID NO: 2101 - DNA, 8782 bp, Oryza sativa
ccctcgctcgccggtgagctctcctttttcatccatctccggccggccacattggtcgttgcggtcgtcctctccacccctaatccctctcctcctttcctataggtgtcgcctccgcccgtccacccctcctcgtcgccgggtcaccgccgcctttcatcctccgctctggtcgccgtgctcgccggtgaggctcccctctgctcccctttttccctctctcccgtgtgcgccgccatccttcgcgcgtgcgccgtcgccttcggccgctgctgccgcttttcgcgccgcccgccgccgcctcccacgccgccggttgccgtcgccagcgaccgcatgccgccgccgttcgccatgcttgccggccgacttgaagccgaggccgagcccggtggctgctccctgcatcgtccgatcggcttgggccgatccggacccttggtcccgtggaccggccgccttgagccgctgacatgcgggccccgcttgccggcgccgccccctcctttgatgacgtcagccctgggtattattgcgcaataaattgattaaggacttttctttattagtaaaaacacagtttatcttctaaaattcataagtaattcatccgagctctgtttaagtccattcaagtctcagtaaattcataaaaatgcaaagaatccattaaaaatggttttgtttcctgtttcagtagtcttatagcatgttttgcttgtgtgctttgtttgtcacgtagatttcggccgtttcgtcgatccgcggtttctcaaagacgttgctgaggtctcatcagttcgagagacaggcaagtcatgctttacatttgatcatattgtacccaatttacaaataccttgcatttctattaattgttgcactcttttacaatgtcatgtgggatgggtcctattactcagccatatatcgtttaccatatgccattgataactggggtatcaaaatgattagatgttggtttaggaaatgcttagccatgcttagttcaactagtacacaaaaggggatcacattattacatgagcatagttcaattttgactatgagcatagttctggttggtgccaccgcaatggtgttagttatttaaaatacactgaatggtgggttgtgcgtgcatggttttgctggtcgcacccatggcaattaaggaccggttcacgggaaacactgggagacttaccgtgcttaccacaagcgggagtgggtaactgcttgatctgaggtatagctcaaccctttcctaggcaccggtggcgagggtgggcgtgatggagttgggtcggccggggtgtccggttgtctagctgccggattcaccgcggcacaagaggggaccgcccactaccttttgaggggtgggggtgaaaccttagcatggtgtggatggttagggaagggttatgaggagggtcttgtcacgatttccccctttgcagtgtcatggtgatacttcggggcatggcgacatgtgtggaatcgtgtcttgtgggtacagttgtacacctctgccagagtaaaactattcgaatagccgtgcccgcggttatgggcgatcaaccagatttaccgtgattagtctcacccctagtttagcttaatgaactggtgtagttcaggtggttggttgggcctattgcaatgtggtgtagcgttggacaatgtttggttaatattgattaattactacaactgttttactgctttcaactactgtttttaaatgcctgctttgtgcaaagagcctttagcctccttcggttatatcctgcatcatacctcctcttccggtatgacttgctgaatacagttggtagtactcagtcttgctctcttttcccccacaccagagctgaagatcttcctagtgggaagtgtcttaccgaagttgatttcgtcgctgtcgtcaaggattacctgtggagtggagtcaccccgctgcagaagtcaagtttccaagtctagctcgtttttcttttctgctgcatttgtaatcatctccatttttgtaagacgtggatctgtatgtcaaaaattgtcgtttgtgtaccctggctggtcctagacagggatttaatgcacattcagcttcgaaattctggttcgtgaatttctgggcatgacacatgtcttcttggcactcagtccactcagtgacgaagtcggctaaagcttgggacttgatcgaagttcgcggcatgaaggatatatccagggacatcaattctaaggcccactttgctatccgcccatttgcttcacgattatgaagtatatccccgagtggaaacgatgtgaccaccgtgaccgagtgaccttggaagtagtgaggtaatttgctgacggtcattaaaacaccatataacagcttttgaacctgaggatatcttgtcttggagtcagccaaaaccttgctaacgaagtagattggtcgttggactttttgaacatggccttcttcttcacgctcaacaactaggactgtgcttacaacctgggaagttgccgacacgtataacaacagcggctcttgcggatgtggtgaagctaagactggtggagtagtgagaagttttttgaagtcttcaaaggctttttgtgcttcgggtccccactagaaattgtctgttttcttcaacagcttgaaaaagggcatccccggctcgccgagtcgtgaaacaaaccggttgagcgccgccatgcaaccggtcagcttttgaacatctttctaggagctcggcggtttcatgttgaggatggcattgattttctccgggttggcttgtatgcctctacgggacaccataaatccaagcagcttccctgacggtactccgaagatgcacttttgagggtttagtttcatcctgaaagcgcggatgcttgcaaaggtctgttctagatccgtaatcaaatcatccttctgcttggtcttgacgactagatcatccacataagctccaacgttgcggtcgatttgagttgaaaaacatctttggatcatgcgtggataagtggctcctgcgttctttattccaaacggcttggtgatgtattattaggccccgaagggcgtgatgaacgaagtctttaaccagcggatctgatgatatcctgagtaccaatccactgagtagctcgcagccggccgttgagtcaactacctggtcaatgcgaggtaacgcaaagggatctttggggcaagacttgttgaggtcggtgtaatcaacacacatgcgccattgtcccgtcttcttccgaactaggactgggttggccagccagtcgggatgaaggacttccttgatgaagcctgctgctaacagcttggtcaattcctccttgatcgcatccttcctatcctgtgcaaaacggcggagtcgttgcttgattggtttagcgtcttccttaacaagtaaagagtgctcaatcaccactctaggaataccaggcatatcagatagtttccacgcaaataaatctttattattttgaagaaagatgatgagcgcgctttcctatttacaatctaactcagcgcctattacagcagtcttagtaggatcagaggaatctaggggaatcttcttggtcttggcgtcgccttctccgctctttggcatcttggttgcgggcacttctccttcgcttgctgtggacgtagccagtcggatttcttctcgggcgagcgtgatctcgcgggtctgggccatctcacagctttccttgtcgcatgtgacggcttgcttgatgtcactccgcagggatatgtctcctcgaggaccaggcatcttcatcatcatgtaggtatagtgcgggacagccatgaacttggctaacgccgggcgtccgagtatgacatgatgttctctgtacggaaattctcccgagtgctgaaagtaataggaagagtgtggccgagtggtgtaacaaatagccccgggatgactctgtgaaagggcgcattactcggctttaattccgtgcgagggatctgcatgtcgtccagggtcttggcgaaaaggaggttgagtgcactgccaccattgatgagggatctgcgaagcttgacgttgtgaaccaccgggtctagtaccagggggtaccgtcccgggtggaccactcggtctggatgatccgagcggtcaaacttaatcgttgtctctgaccaccgaagatattggggcgtgtcaggttgagcagcgttgatctccgttcggtcagcttttgctttctcttggattcataagccaggggtcaaccaaagatgtggttgagctccttgcgatggtcttggaaaccagtcagtgcatcatcttcaccatccttcttctttgacgtgctttgatctccgtcggaggctttatgtgcgttcttggcgtattgttctgcaaactgtttgtagacgaagcaatctttggccgcgtgattggaattgggatgatgcggacattgggagttcataatcttgtcaaaggtgttgacgtgcgaacgttgtcgggaggatggtgtagtagttgccacaagttcctcgggcttacgcttgcgatccttgtgattggtacttccactcccccctgtagtcggtgtatctttcttcggcttccaagtggtgcccgactgcttggacgtggtaatggcatcttcggctttggcatactcattggctttttcgaacatctgcttgaccgtcctgggaggcttgcgcccgaacttgccgactaggtctgtgtggcgaacgcccttggtgaaggcggcgatgatgacgtcgtcggtgatgtcggagatcttgttgcgttgctcggaaaagcgtcggatgtaatctcgaagggattctctagacttctgaatgacgttgtagagatcaaactgtgtaccagggcgttcaaaggtaccctggaagttggcgatgaagtggtcgcgaagttccgcccatgatccaattgtgccacagggtaacccgtgaagccaggaccgggcagaatccgctagggccacaggcaaataattcgccaattgcgagaccgtagacggtgagccaagactccgggttagtggtgccgtcatacttctcgattccaatcggcttgaagccggctggccaatccactcgacgcaggtcgcttgtgaaggcagcaactccatccacgtcgtcgtcgtagcgatctggagaatggtggggagcgtagcctcttgccgcgcggcgctggttgatagtatcgcgaagatcgacggggcgcctgcgatgtggggagtgtggtcattcaactcgatgctccctgtgtcgtttgggtggcgagtggatagatcgctcgtcgtgacccctactcctgcgagtagatcccgcgccgacgacgctgaggcttggttggtgatagtcttgagatcgaagatggggaactcggctgccagtcggcgtgtggacgcttgcggagttaatcgggaccaaggcggcgatcatggtcttggtctggttcaagatgttgacgacgtgattggcttgattgagcgcgtcttccttgaggaggatgtcgaggagggtgatcgctgcaaccgcgttctgttgggggggcggaaaaccgctgtcccctcgacgtcttgttgcccaataagttcctatgcttgtcgcccggcatccagggcacgttgtcgccagtcctcagcctcttttgcagcccgttcgcgttcctgtggctcacattgtagccgttctcgctcttatgcttggcgctcctcttccagtcggcgtcgttcggcttcctgttgtacacgtagttcttctgcttctcgggctttacgctcttcttccgtctcattgtcagccatgaaaatgccgaataaaggggtgtgtagttgtctttcaaacccttcgtcgaagtcgtcgaggtggcgtagtcgtagcggtagccgaagtcgtcgtactccacgatctccgatggtcgcgagtcgatgccgggggagctgaggtagccatccagttgttcgtcgaaaccgtgccgagaggctggagtatgacaccgacttccctggagctaggccgggccggggctaaagccggatcccacctaggcctacggggagaagacgcccttgtggtgaatacagcagccaaatcatcgggagtttcatcaggattggcggataggccccatcgtcttgatcgggtcgtgttgaagtagattggatcccgtccgagtggtttgaagccaactcggtggagatgatcttggggtagacctcggccgagttcgggataccgaactaggtggagatctggcctcttcccgactggtttgaatccgagtcgaggagagaaatcttgccgaagtcgttggtgatgaagtcgaggctgccgaattggaacgcctgcccgggagggaagacaaagtcgtcgatgccggaaacgaaacccatcgcactagtcggcgaagaacttgacgcttcccatacctggcgtgccaactgttgaaacaagatttcgacaatactaaaagggggtggctatcaggctggaaaagtggatgggtttaaagacaaggaattttatacaggttcaggccttcttaatcaagaagtaataccctactcctgtccggggattgatccaccaagtatattattgatcatatgatctgggaaaaaatcgtgcccctagaggcacccgtacctctccttatataggggaaggggtccgtattacaaaatacagtccatatccctaacggaatatgtagttacagataaaatacaatcgtaaccgactaggaactcggatgtatccttgacatacaagtttagaatttaacccgagtccttctaaagatattctatctagacatggcaccccatatccagtcggactataaatgccttgtaggcatggggtatccataatctccacacagctataggttgggcatgttttatatggtgtaggattacattatagggtatatactgtttgccacaagcgttttgactttgttctgatcgaaatgaaaagattgacctgctgaacacactccgttcacgtcgagtagccatagtagcttagaaccgaatgtaggcacacatcgtaaagttgtaaatgcaaccatagtagacggtgacgataattaatttcaacaatgtactaggatttatccttacagaggcattatgtttaaacttgcatgacatttttattcagatttgtatcaccccgatgtttcaacttgtcacacacgatgatgcatgactttatttttctctcctgtactactatactgctacaattcaataccagataccaccgacggtgggaatgctacagggagcagtgttgtagcttgggtagataccgcatattgacggcatgtttagggccaacatagcttgggcttgagcttgactctgatcgaagtagacgctagcaaactgttgtagctgtagctgctgcacaatagcctgaacactgctaatggcctggcagtgagactgttgtgcgatcatcctgagctgttggcagcactgctgctgcatgacttggcagtttctcagttgaaacacgggtgattggaagaagggggttgccactgtgctgcactgctgccttacgaactcaccgcatgggctaagcatctgttgctgcagcatgagatgcggctgcagctgatattgcctgtaaacttgagtaacagcatcaaactgcgcagaggcactgcatgcagcaatagcaaggagagcaaagaagaaaatgatcttcattgtggtgggtttctagttcttatgcttttgctgtaatgtttgagttgtgagaagaatgaagggggtttacattgtgcttgtctatttatagatgcgatggatgggttttctttgaattccttatcggttgctctagagtgtttgtttttgttggatattctattgggatcagagtgagtcatgtcatttggaagttacgtgatgtgcctccacagatgtccttgtataccatcgtcaaagtaactttattgcccatcacagatacttgatggttggcaagatagataatgttatgactcctcactcactttatatctcagtgtgacatggtgtcacacccagaaattctcgaacccgaatttctaagctgaatgtgcattaaatccctgtccaggaccagccagggtacacaaacaacaattgttgacatacagacccacgccttacaaaaatataaaagattacaaatacagcgggaaagataaaagcgagctaaaccgggaagcttgacttcagcagcgggcgactccactccacaggcaaaccttgacggcagcgacgaaaccaacctctctgagacggctccaactgagaagaacttcaactctggtgcgagggaaaagagagcaagactgagtactactgtcacgcccgaaaattcactagtaatttccgaacttatttgtgcataaaatcctcgtccaggaatcagccgaggtacacaaactgacaatttaatatacaaattcatcaaattaactaaaacgataaatacttacttaagatgcacttagtcctcaccatgaagaaaactgcagcggaaaataaaatctagcgaagctccggctccactcccacaggcagctcaactggggtataagccaaacgtcttctcctcctagatcttttttcttcaactgaggttgattgattattgcaagaatgagcatatgacatactcaaccagccacacagcaaatatgcaagtgcacaaggataccaaaggatggca

SEQ ID NO: 2102 - DNA, 3196 bp, Oryza sativa
cccacgctggcttgtggttggcatggttaatgtttcacaacagtagctcgcgaaccggtctttaattgtcatgagcgcgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagaaaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaagctaacacgcaaaatgaagaaaaagactaataaaaaccaaataaacaatacataaaaagtaaacaaacatgtagatcataattttagatgaattatgagacttgaacggcctcattgtgacttcatatgaatttattatgaattttacaagattaaatcggattaaaacacttatatggattttaattgaattatgacgcaataatgaattatttttgaaaaggaaaagggaattattgcgtcatcaaaggcggtccgggagcacgggacggtctaaggaaacgaacggccgagatcgattctatccaaaacgggcggccgagatcaacttgatctaccgcggttcacgggacaaggcgacgatgacgtcagcggtgacgtcatcaccggcgacggttcggcctcgcgcgctcgccggcgaatgacggcgcaacgacgcaaacagaggacaccaacgggtagaggacaacacagcgaactcaccggtgaccaaaaccacggcggaagagcaacggacggcgccggtgacgaggaagaagaggcgacggtcttcgggtcgacggtgacggcggtgctccggcggtcttctgcggcggcgaagaggtggacggggacggcgacgacctcgcgatcccgatggtggcgacggcgaccgacgacggtggctgcaacggcggcgcggcgcggctgaaccgacggcaacgacagcgacggctagggctacgcggaggcggcgctagacgggacggcgggctaaggcaaaggtggcggcggataaaggagagctcgggggtgcttataaaggggctagcgagcggcgacggaggcccacagcgaccggcggcgagaaggaaagctagggttggagggagaaaagtcgatccgaatcgagctcaaatccgtcgatttccaaacgaaattgaccgaagtttctataagagaaaaggaagaggagatcgaggagattatttcccctcaaacgatttcaccggaaacagaaaggatcgaccggattggaaagcggcggcggctagggtttcggccggcagcggcgcgaggaggaagacgggcccgacaggtggggcccacctgtcagcgggagagagagaggagagcggcggctcggttgcggactgggccgacttgggccggggagagagagagaaagagagaggttttgggccggctttcggcccaaagccaaaaggaggatttaaaaacattttctatttaaattattcatgaaatgatattccattgattaaaaatacttccttggctcaaataaatcccagaaaaatctaggaactatagaatcaagtaaagtatttaataaaattttatctaacccaattttatattgagatttagcaaattaaaattagatcttctcttttaagatcatttctaattattccttttaaacaacaatttataatttaaggatttttaaacaagaaaagctcttaacaattataattagatcattattgatcaaataattactgaactgttctttgtatcatttatgaattgagctctgaaaaatccgagaaaatttcagagagttgactttatcatggagaatttaataaaaattaaatccatccatgctttatatttaggaaattttatttcccacatttaacttcacttgtaaattgatgaacatttaatataaattctaataataatttattaaataatttataaatcctgaaacaaaaaatcaggatatgacaactacccactgtactcagcaagtcataccggaagaggaggtatgatgcaggatataaccaaaggaagctaggggttcttttgcataaagcagtcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacagtgaatctggttgatcgcccataaccgcgggcacggctattcgaatagttttactctggccagaggtgtacaactgtacccacaagacacgattccacacatgtcgccatgccccaaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaactgaacacctcggccgacccaactccattacgcccacccttgccaccggtgcctaggaaagggtcgagctatacttcagatcaagcagttacccactcccgcttgtggtaagcacggtaagtctcccagggtttcccgtgaaccggtccttaactgctatgggtgcgaccagcaaaaccatgcactcacagcccgccattcagaatattttaattaactgacacccttcgggtggcaccaatctaaagctatgccagtagtcagagtctatgaaataatgtgatcccccatttgtgtactagttgaactaagcagggctaagcatttcctaagccaacatctagtcattttgatacccaagttatcaatggcataagg

SEQ ID NO: 2103 - DNA, 492 bp, Oryza sativa
cgggaagaacgaaaaaggcggcggcgcggacggtttcggcggcggttgccgtcgtggggcgggcggctggaggaaggggacgacctgataggtgggccccacctgtcagcgtcccggagagaggggaggaagggaggacttcggggaggggaaaggggaatgggccggcccaaaggaaggaggccgagcgcgggagggagtgggccgatggcccaaaagaggaaaaagaaggaaaagaaaaaagaaaaagaagaaaggatttttcctgggattttaaaaatattgcgcttgttcatttttaattggttaaaattatttccaaggctctgaaaattccactaaaaatcttgttaatgcattgtagcatggggaactcaagaaaaattccaccacgctatttccgattattaattgcatttattaaatagggatttagctttaggttaattaagataattttttcgggcaatttatttaaccaatttttaaagc

SEQ ID NO: 2104 - DNA, 484 bp, Oryza sativa
acgggtggaccccacccgtcagcgagggtgccgggcgggcccgcccgtcagcggcacgcgcgcggggaggaggccgaatgggccgcggaggagaggagagagagggagagagatgggccgagccggcccaagagggggagggagggaaaggggacttttagggtttttctttttataaagtcattttaactttgtttatttcttaataattattatttgtgctctgaaaattccactaaaatttatttacgcattttaggcttttaggaaatatacaaaaatcctgcaagccttatttgacttttaactttgcacattttaattgttggaggctttcacatggattttaattattgtaggcagaatttagaggatgtattttagagtcgttttgggacgcgacaataaccagactgagccacaaactaagccttacccactagacatgtggaattacggtagtgctttacaacagaggcccgag

SEQ ID NO: 2105 - DNA, 3497 bp, Oryza sativa
taattgtcaggccttaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacagtcacactgagatataaaggagtgacgagtcataacattatctatcttgctaaccatcaagtatctgtgatgggcaataaacttactttgacgatggtatgcagggacatctgtggaggcacatcacgtaacatccaaacgacatgactcactctgatcctaatagaatatcaaccaaaacaaacactctaaagcaaccgataaggaattcaaagaaaacccatccatcgcatctataaatagacaagcacaatgtaaacccccttcatccttctcacaactcaaacattacagcgaaagcataacaactagaatcccaccacaacgaagatcattttcttctttgctctccttgctattgctgcatgcagcgcctctgcgcagtttgatgctgttactcaagtttacaggcaatatcagctgcagccgcgtctcatgtgtcacgaccggaaataacccaacgggcgttccttacgtgagtgcttttttcctggtcccagaaggcaaggtcccccaaaagttgatccagttaaaagttaaccaaccggaaccgtaaatagttaattattaccttggccaccaaaggcccaccccacccaaagacaaccgaaaaccagcggaagactagggcaacgaccacaggcgcttgacggtaggcacgagctatacaccaaaaccttcatcttccagagactcctcttctgggtttgggaaaaaaattgagcaagactgagtacaaccaccgtactcaacaagacacacccacaagtggcataataaatgcaagggagtacaagggagttataatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccgaaccggcaacccgaccctgggtccaagctcgttccaagccaacccaggccaaccattccacattttaattgttaagcaggttttaagaattaaaacactaacttgggtacattgctcggcttgcccataaccgagggcgcggctattcgaatagattatactctgatcaaaggtgtacatttttacccacaagacacatcttcctcacgtgcaaccacgtggcacataccaccacggtatacagacggaaaacgtgacatagtttccaacccatcctacccataaacaagagtacgaacccaatcccacctacggccggaacccccgggacaggtaggcaggattgagcccttagcagcaggacaccggccttgtgccatgcatctcgataccgggccgcagctcgtgtagcattcatttgccctggagatgtccatcgacccccgacttcgtccatctccatccgtgtacttttgtttataaccagactgagccacaaactaagccttacccactagacatgtggaagtacgctagtactttgcaacagaggcccgaagaccggtccttatatggccgaggtgctactatcaaaaccatgcaccccgagcccagcctaaaaccattgttggggattttgaatagagggggcggtgtgaatccaattccacaatactccaacaattccaaagtgtccaggtgatatgaatatcccaaagtctagagttgtaaaaccgcctaatgttacctaattaaatagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataattttaaagcaacataattttataaactgggattcaatatgttcaaggatgatgtgacttgccttgctcgctttcccaaacgccggcttcaacttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatggatttattgcgtcagccgaggggaggggcgcgcggaccgggtccacgggggtggggcccacgcggcagccccacggtccacggtggaccgggcgcacccgggctcacaccggccggcgccgtgggtcccacgcgtcagccgcacccgaggacgcgggcggctgacagccgggccccacgcggcagccgcacggtgcgcccgaaggcggccacgccggcgcagcggcgggaggcggcgcgccctcacccctatggtcgccggcggcggccataggcacggcggagcggcggccgaaagaggggaagggaagggggaaaagaagcggcggtccacggctcaccccgggtcgacggcgacgacggaaacggcgaccggagcggaggaaggcggcggcgcggctcgggtggacggggtcgacggtgctccggcggtcggcgagcgaaacggaggggtggacgaggtcgccggggatgcggtggagccgaaggtggcgacgccgaggcgggaggtggtccggggcgacgacggcggcggaccggagctcggcggtgacggcggaaaaaaaaaacaacggcccgagctcaattccaacgggaaaaaaggccggcaaatgccggaaccggtggagggaggcacggggaaggtttatataggattggaagggggagggagctgccggacgagggggaaacggccgcggaagatccggtcgccattgatggcgccggcgaggttaggggagaggtttccaaacgaatccgagggagagagggagggaaaaatggggggaaagagggagggaatcacggggaatatttccccccactttattgcgcgcgtggatggcgggaggcggcgggattcgcggcggcggcggcgctagggcacgggcgaggcggcggaagcggcgggaggaaggggatgacgggtgggccccacccgtcagcgagggtggcgggcgggcccgcccgtcagcggcacgcgcgcggggaggaggccgaatgggccgcggaggagaggagagagagggagagagatgggccgagccggcccaagagggggaggagggggaaaaggactttttttagggtttttctt

SEQ ID NO: 2106 - DNA, 4073 bp, Oryza sativa
cctatagcattcccaccgtcggtagtatctggtactgaattgtagcagtatagtagtacaggagagaaaaataaagtcatgcatcatcgtgtgtgacaagttgaaacatcggggcgatacaaatcttaataaaaatgtcatgcaaatttaaacataatgcctctgtaaggataaatcctagtacattgttgaaattaattatcatcaccgcctactatggttgcatttacaactttacgatgtgttcctacatttggttctaagctactatggctactcgacgtgaacggagtgtgttaagcaggtcaatcttttcatttcgatcagaacaaagtcaaaacgcatgtggcaaatagtatataccctacaacgtaatcctacaccataggcaaatcattgccaatacgtgctagccgaactgttgtgagaagcaatgcctcctaagtcacgattccgttccctttcgtgattttttctttctaacgtgttttttaactcctcggcaaaataaacgcaagctaatctttcagatttttctccaaagtggtcataaaatcaatgacggcaaaataaacattgttgaaattaattatcatcaccatctactatggttgcatttacaactttacgatgtgtgcctgcattcggttctaagctactatggctacttgtcgcgcccggaaaaataccttttccagaacgctagtgtgttaatccccgtcccaggaaaagccggggtacaccacacaaacatgatataaaagacacatctttatatatcgataatatttacattatcacaaaggcgcttcaggcctgacaatcaaaaataaacagcagcggactagcgggcctacggttccatcttcacaggcgctcaactggggtataagccaggactccaccaaggacatcttctccaaagcttatcttactgaaggagggaaagatagagtaagaatgagtacaaccacagtactcagcaagccacactgggagatgcatgattaatgcaagggggtacaaggggataataataatatggttggattttgcactaaagagcatttaaaagacacttagtcgctcaaagctattttgtaaacacgatcctagagctacacaatattattaatcaagactgtgaaccctcacgaacctgccttaacccaaagcctacgatgattcggaccgaactggcaacccgacctcggtcccagctcgtcccaagccaacccaggccaaccattccatattttagttgttaagaaaattttaagaatgaaaccactaacttgggtacattgccaggcttgcccatatccgagggcacggctgttcgaatagattatactctgatcagaggtgtacatctttacccacaagacacgcctttactctgcattccattgcaattggaacccataaaaaaaacgtgacataaccctttacccatcctagccgtgaacaaaagcaccgacccaaccctgcctacggccgatatcccgggacaggcaggccaggattgagcccctagcaacaggatctagaccgggtgcgccacacgcataggggtgagaccacccgtgtactagtccagtgccatggcatttcgactaacagacaccagcccatgtagccttcatttgcctaaacatctcgattaccgatccgcagctcgcgtagccttcatttgcctcagagatatccatcgtcgcaacgacttcatccatctctatccgtgtccttttgttcaggactagactgagcaccgagttaagccttacccattaaacatgtggttagtacagtagtgctttgcaacaaaggcccgaccttaatccttatattggccggggtgctacttcccacaactggcatgcacccaaaccccaccggaaaacaggtttaaggggttttgaaaaaggaaaagaggggtatgtcatattccaccataagccaaccgttccatagtatccaagtgatataagaattcccaaagtctaaagttataataccacctattgttgcctaattaatcagcgaagcatctacctaaattcatactagtggaaccataaatatagtacccactagttgaggttttatttgcctagggtaagcaaggtgataataacaattgcaataataaggctataacaaggattaataggtaatgctaaataaaacagtggtaacgcgggaatttaaataaagcagtaatgcaataattcaaatcaaaataattttataaattgggattcaatatgctgaaggatgatgcgacttgccttgctcagagagaacggccttccgaaccttcggcgacgaccgcgaaccacgcttcgggaacctccggaacgacaggagctacgcgaagcacacaagcagagctaaaccctataaagaagcaacaacaatacataaaaagaaagcacagggttctttaggttataacaaacattaggagatttgaatggttccattcaaagttcgtatgaccaagatatgatcatccgaagtttaatgttgttgcatggagatttacggattattgtaattaggttttgcaactaaaatatgtgtaagctctagcctggaaaagacaggaaggctgcgctgttgacatccggaccccacatgtcaacctaagagaccacagtggaccgggtacacaaagacggtccacgggtcgacggaagcggaccccatgtgtcaaccgaggcgagtggccatcaaacggactccaccagacaccacgcgggctgcacacgtggaaaccatgcggctaccgagcgggcacacaaacacggtcaccacacgcaccacgaacgactaccgacactggtacacgggtaccggggttgacaaccgcacaacgggcacggggcgacaccgaaaggacgaggacgaggcagcgagaggaggcacccttaccaccacgcgatgaggcgtgggaacaacgatggcgaatgggcacggcggagacggctcggggacgatggaggcgaaaggggagggaacgacttcagcggcaatccttggacgaaggcgagacgcggccggcgcaacgcttgacgacgcggagccgaggacgaagacgacgacggggctgcagcaaccttgacgaaacgcgggcggtgaacacgatcggctcgacggagggacgaacgccacgacgaccgggaacgacgagaggacgacgatgggaaccggcgaggaggcgacgacgaatgccggcgggttcggccgaaggggaggcgatgccgaggacgacgtggaacacgccactgcgataccggaggaggagacggcgacgtcggccggcgcacgggcgacgaatagcagtcggccagagacggggaggtactggacgccgatgaggaggccactccggcgagcttcgggcgaggaggaggtgatgccggagatgaggacggcgtcgcagaggcgagggaggtggtggcgacgtcggccggtgcaaaggcgaggcggcacaggcggttggaggcggagcagtggcggcaacaccaccgttgccggcggggacgcacctctaggggtttccgcgtgaaacggaggcgacgccggtggaggggaggcagctgcgacgccgagggaggagacggcgcggccgaccagcacgcgggcgaggcggtaggggcggctggagatggccggcggcacgggagagtgaggaggacggcggggagaggtggtgaagccacgggagagcgcgggagggggtaaaaattagagaacggatctagggggttccattttataggataggggagggagccgggcacgagagaggtgggaacggcggcggaatttgtggccggcggccggggaagacgcgtccgttcccgacgattgagggcgccattcaagggggaaaatgggggaaaccaaagaggattgattagggaataaaagcccccaatcaatttggagttaaagcccttgattcgagcggatttggaggaggatgagggaaatagatttgaacgggagagatgagaggagaccgacggctggaggtgggagacgggtccgacaggtgggaccca

SEQ ID NO: 2107 - DNA, 1432 bp, Oryza sativa
acgtgaacggagtgtgttaagaaggtcattcttttcattttggattagaacaaagtcaaaacgcatgtggcaattagtatatacctaccaaggtaatcttacaccatataaaccatgcccaacctatagcggttataatccactattcaaaatgtaaggatcgatggacaatttgtcatatcattgttaattcaatctaaccttgtcacgaaaacaatacgctctgcgtaacatgaagttaaaattttcatatttgaaggccgggtcagggaaatatcaattattaagttaaaaacattaagcattcctgcctcaatgaaattcatatatgcttaatagtccacgttaaatcccagcatatcggtttcatttgttttcacctaaagtcacaaaatatagttgttggccctaaacttgccgttaatatgcagtatctacccaagctacaacactgctccctgtagcattcccacggtcggtggtatctggtactgaattgtagcagtatagtagtacaggagagaaaaataaagtcatacatcatcgtgtgtgacaagttgaaacatcggggcgatacaaatctgaatgaaaatgtcatgcaagtttaaacataatgcctctgtaaggataaatcctagtacattgttgaaattaattatcatcaccgtctactatggttgcatttacaactttacgatgtgtgcctacattcagttctaagctactatggctactcgacgtgaacggagtgtgttaagcaggtcaatcttttcatttcgatcagaacaaagtcaaaacgcatttggcaaatagtatataccctataacgtaatcctacaccatataaaacacgcccaacctatagcggttataaatccactattcaaaatgtaagtatcgatgggaccatttgccatatcattgttaattcaatcttaccttgtcaccggagcaagacgctccgcgtaacatgaagttaaaattttcatatttgaaggcctggtcgcggaaatatcaatttagaagttaaaaacattaagcattgctgcctcaataaaattcatatatgcgtaatagtccacgttaattcccatgcatatcggtttcatttgttttcacccaaagtcacaaaatatagctgctgctctatcctgagagtgagtaggtaggcattttgttctttactgttatcgttgatcaccgccgtgatacaatcggtcaatggtttgatgctagcaaggggctattttcatttatgttctgcctcctaaatgttctttcattcttacacctagtaccgtgagaaaaatctagctagttctataggcaaatcgttgtcaatacgtgctagctgaactgttatgagaaccaaggtttcttaagtcacgatttggttccctttcgtgattttttctttctaacgtgtttttta

SEQ ID NO: 2108 - DNA, 1131 bp, Oryza sativa
  unsure (1)..(1131): unsure at all n locations
tccattagttaagacattccgtgacaaaaatcttattatagcctttaagaacgtcatcgattttatgaccactttggagaaaaatctgaaagattagcttgcatttattttgtcgaggagttaaaaaacacgttagaaagataaaatcacaaaagaaaatgaaatcgtgacttagaagacattgtttctcataacagttcagctaacacgtattggcaacaatttgcctatagaactagctagatttttctcacggtcctagatgtaagaatgaaatgtcatttaggaggcagaacataaatgaaaatagccccttgctagcatcaaaccatggaccgattgtatcacggcggtcatcaacgataccagtaaaaaacgaaatgcctacctattcactctcaggatagagcagcagctatattttgtgactttaggtgaaaacaaatgaaaccgatatgcatgggatttaatgtggactattaagcatatatgaattttatttaggcagcaatgcttaatgtttttaacttataaattgatatttccgcgacccagccttcaaatatgaaaatttaacttcatgttacgcggagcgtcttgtttcggtgacaaggtaagattgaattaacaatgatatggcaaatggtcccatcgatacttacattttgaatagtggatttataaccgctataggttgggcatgttttatatggtgtaggattacgttatagggtatatactatttgccaaatgcgttttgactctgttctgatcgaaatgaaaagattgacctgcttaacacactccgttcacgtcgtgtagccatagtagcttagaaccgaatgtagggacacattgtaaagttgtaaatacaaccatagtagacggtgatcataattaatttcaacaatgtactaggatttatccttacagaggtattatgtttaaatgagatatgtagtaagtgcctttacgacgacatgtctaatactacaatagtttagactttctgtgacaaaaatcttattatagcctttaagaacgtcatcgattttatgaccactttggagaaaaatctgaaagattnnnnnnnnnnnnnnnnnnnnnnnnnnnnnnnnnnnacgttagaaa

SEQ ID NO: 2109 - DNA, 1320 bp, Oryza sativa
aaatatttattaagcaacaacaacaattaagaaagtttactaaaaagaaaaactaaaaataaatcttccttcctcctttgggccaagtctggcccaaagtcctccctctctctctccctcggcccacggccaaagtcctctcttcctccctctctttctctccctctccttctctccctccttctcttgggcctccccttcccctcccggcccactccctcctcttctcctcctgggccgcctcggcttcgcccggcccaagccgagccgcgcctcccacccgttgccgcgcgttgaccgcgcgcctcccacgtgggtcccgcctgtcaggcgcgtccccgacctccagccgtcggcctcttctctctcccgtgcaaaccctagtgccaatcctccccaaaatccacgcgattcaaaccggggtttccgaaattgattagggggttttaatccccattgattcctctttgatttcccccgttttcccctttgaatggcgcccccaatcgccgggaacggacgcgccaacaccggccgccttccgttgctgccggccgccattcccgcctccgttccgacctctctcgttgccggctccctccccgcgcctataaaatggaaccccctccttgcgttctctcatttttgcctcctcctgagtcttcccgaggtccctagccaccttcccgccgtcctcctctctctcccgtgccgtcggccgcctccagctgcctctccctcctcgccggaacgccgtccagtcgtgccgtcacccccagcggcctcgcagctgcctcctcttccccggcgtcgctccgtttcacgggaaaatcatcggagccgcgtcctggccgacgaccagtggtgtcgccaccactcaccgactccagctgcccctgccgcaccgctcaggtgcgggccggccgcgccatctactccctcggcgtcgccgcgtcgacctccaccccggcctgccctctgattcatctggagaccgccgtcactgccgcgccggcttctccatcctcctcgtcgactcctccgattggccgttcctcctcgccggctcgtcgtctcgctgcgccgccaccgtcgtcgacatcgcagcggcgtgttccacgccgtccttgcctccgtgcagctgctgccggctgccctcgtcgcctcctcgccggttccgggcgtcgtcctttcgtcgctcctggtcgtcatggcgttcgtccctccgtgaagccgatcgcgttcgccgcccgtggttcgtcaagcgagctgctgcagccccgtcatcgtcttcatcctcgcctccgcgtcatcaagcct

SEQ ID NO: 2110 - DNA, 664 bp, Oryza sativa
ctcgctttcccaaacgtcggcttcaacctccacgaagagcggatcttccgaagctgcagcgtctacacgaccaacggaaaagaaaaggcttttactctaataaactccatataacaagcaggaacaaagcacaaaaattagagacttgaacggtccaattccgagttcatatggccaagttatggtcatttgaagtttatatgctctttaaatgaatatttgcgaatttcttcatttaaattttaattttaaaagggtttattgcgtcagccgaggggagggggcgcgcggaccgggtccacgggagtggggcccacgtggaagcctcatggtccacggtggaccgggcgcaccagggctcgcaccggccggcgccgtgggtcccacgcgtcagctgcacctaaaggcgcgggcggctgacggtcgggccccacgcggcagccactcggcgcgcccgagggcggccaagcaagcgcaaccggtgggaggcggcgccctggcccctatggtcgctggcggcggccataggcacgtcggaatggtggcccaaagaggggaaaggaagggggaaaagaggcggcggtccacggctcaccctaggtcgacggcgacgacgaaaaaagcggcttgaacggaagaaggcggcggcgcggctcgggtcgac

SEQ ID NO: 2111 - DNA, 240 bp, Oryza sativa
  unsure (1)..(240): unsure at all n locations
nnnnnnnnnnnnnnnnnnnnnnnnnnnnnnnnnnnatggtcaatgcaaattggccataacaaatgaataggttcacaccacccggtgacattcgaaaataaatgcacagttgaaataaatagagaatttaaattaggatcaacatgctcaaaggattggtttggaatctgtgtgacttgccttgcaacaatgggttttaaaatagttttttaaaccatttttgacgctctcacggacttt

SEQ ID NO: 2112 - DNA, 475 bp, Oryza sativa
tgccgcgtcccctgtgcgccggccgacgtcgccaccacctctcccggcaccggaacgccatcctcttccccggccaagccacggcgtcgcccgtatttcgtcggatcgccgtcgcgcgcaccgcctctccctcggtctcgtcggcacccactccggcagccccttttgccgtgccagtgcgccggccgacgtcgccgtctccacctccggcatcgcagcggcaaggtcgccctcggccttgcctccccttcgaccgaacccctccgcggtccatcgtcgtcgtctccgttcgtccttgttgacgactcctccggtcggtcgttcgtcctcgccggcttgttgtctcgctgagccgccacccttgttgtcattgtagcagcgtgttccgcaccgtccttgtctctgtgcaagatgctgccggctgccctcatcgcctcctcgccggttcctgtcgtcgtcctctcgcggttcccgg

SEQ ID NO: 2113 - DNA, 4285 bp, Oryza sativa
aagtgagtgaggagtcataacattatctatcttgccaaccatcaagtatctgtgatgggcaataaagttactttgacgatggtatacaaggacatctgtggaggcacatcacgtaacttccaaatgacatgactcactctgatcccaatagaatatccacaaaaacaaacactctagagcaaccgataaggaattcaaagaaaacccatccatcgcatctataaatagacaagcacaatgtaaacccacttcatcattctcacaactcaaacattacagcaaaagcataagaactagaaacccaccacaatgaagatcattttcttctttgctctccttgctattgctgcatgcagcgcctctacgcagtttgatgctgttactcatgtttacaggcaatatcagctgcagccgcatctcatgctgcagcaacagatgcttagcccatgcggtgagttcgtaaggcagcagtgcagcacagtggaaatccccttcttccaatcacccgtgtttcagctgagaaactgccaagtcatgcagcagcagtgctgccaacagctcaggatgatcgcgcaacagtctcactgccaggccgttagcagtgttcaggtgattgtgcagcagctacagctacaacagtttactggcatcaacttcgatcagactcaagctctagcccaagctatgttggccctaaacttgccgttaatatgcagtatctacccaagctacaacactgctccctgtagcattcccaccatcggtggtatctggtactgaattgtagcagtatagtagtacaggagagaaaaataaagtcatgcatcatcgtgtgtgacaagttgaaacatcagggtgatacaaatcttaataaaaatgtcatgcaagtttaaacataatgcctctgtaaggataaatcctagtacattgttgaaattaattatcatcaccgtctactatggttgcatttacaactttacgatgcatgcctacattcggttctaagctactatggctactcgacgtgaacggagtgtgttaagcaggtcaatcttttcatttcgatgagaacaaagtcaaaacgcatgtggcaaatagtatataccctacaacgtaatcctacaccatataaaacatgcccaacctatagcgattataaatccactattcaaaatataagtatcgatgggaccattttccatatcattgttaattcaatcttaccttgtcaccgaaacaagacgctccgcgtaacatgaagttaaaatttccatatttgaaggcttggtcgcggaaatatcaatttataatttaaaaacattaagctaatcatgtagagagaactcaactagtaatttatatattatttgtgataatcatattctaagcaggggttaagataatccaagggtagagtgacacacaagcattaattactcatcctcataatatatcatctaagctaagtggaaagaaaagagaaagagaatctattcctatacttctaatatacatagtatacatacattctagttaactgatatactagctaataccctctatccgatgccctcctggtacttcgagaagccacccctgactgccgagttccttacgacagcctgtcatgaccaaataatgatatcccataatctagacaccacgtctaaactaccagatactactctaatatcatcgtcacgacatagagtaaatgcataagcaaacattatacccgcaccaaagcatcttctagataagctagccgtatattcagtataacatgaacataatgtaaagtaggtactcatatactcgaaaagtatttcagtaccataaatgtatatagaagagtattctaataaaagtacaaagcttacaaaagaggaaaggaaagctgctagagccatacccgaactcttccaaaggcttccggactcctgattcctattctaattctattccaccaactagatactactaaactaaacttgagaggaatgagagaactattgcttgaggtgtgtgagtgaagtgggaaggtgaggggtttatatagcctcccaatgacggttgtgacggttggaatggtcggaaataccgtccaaccgtaattgggagctaatccacaccgtccagaaaaaaccctgcatccagcggcgatgagggaggttcggtcgaaccccctagttcggccgaacctggggccagcccaaccagcccatggctcggctgctggcctcctctattgttcttctccgcagacttgtgaattttggcccaattcatcgtgtcaattctgaattcttggcctattcacacacaagtctggttctcgacatcgtccgattgatttatcgtctgagttaatatcgattttcctccactttagtgtctttccctgcaaaaggttagtatccctaatactagtggaagtttattattctaccagatatatgcattgcaagcatcactagttctctcctattttagtaatattgacggtcgaaactgatcgataatgaccgtcaacaaaaccccccaagcttgaacctttgctcgtcccgagtgaaggacgaaaggaaacaaagacttggttattgatcaggaggtgctactatgctgcatatctcaaagatacaggtggaaggtatatgtactctctcttagattaaataatctttggcacggtggcttacccttacccctgattcccacaagacactgtttctccttgccttgggcggttgaaggacagaacattaattagagcaccaatcacccgatctttattcaactcttgttccggaagttttcaaatgattttgaaaaagaaagccaagttcctcaattgattcacatagtctctctaagtgtatcaatttgaattcctcaccaaacattgcattgttgattcctactctaaggtttatatgtggagcttggtagggatcaaacatggcacacttacattcacatttattaccaagtcaaaattttagactagagcagataactaaacatactaaagatcaagatcgtgcataatgtgtgtatggtatatagtcgaaaaataaaggaaaatgcttctcctttggtaggaaaatgcttcttttatttataaggagagggcatggctatattttttttcaacatcatgctcatgcttgatggagcataactttattattattattattattgttattgttattattattattattattattattattattattattattattattttataaccatgcctttacctcctcttttttttcttttttgtcaaaaggatttttttctttttaggacaagaaagtacatgaaaacatggagaatttattttgatggtaatgtgaaaatagaatggaatattgcttaactcccagtgtaggagtttagcatgtgcatatatgtgggtgtatgatcttgatcatagagcatgagaagtatctacacaagtcacaagagtttgacaaagttcaatggaatggtaagcaaccaaaatgtatatggtttaatcatgatagcacatttttggctctggtagaaatttacatcaaatgaggaacttcaatgttatcattttgaaaaacaaaacatccggaattcaagtcaaactagtatcaggatcatagctactcatatttactatctcatatctcacaacaacttagacttagattagcaactgcagcccatttacctcaggttcccggataattgttggctacttatatttaacctttgagagagtatttaccaagaactcatatataagagatataaaacagagcaactattcatcatttcaacaaagagaactagcttgtcttacctaccatgactcaaacctatcctatctttttggtattttctattttgcaattttttatgttgttttcaagttttgtaggatgcaattggaaagcaaacatacaattggaaagggaaatatgcaatgtgatacaagttacctcagtgggtgtcacgtcctgataaattcatcccaaaataaaaatcattctctaaaaggaataatagaattaattaaaattcaaaaagaaattggcaaacactaaaatacatacaagaaaaatttgaatgttgcccggagaatttttgttaaattctccttggtctaaaaggagacctcaaattttacttgaattttcagagcaccagaaatatttattaagcaacaacaacaattaagaaagtttactaaaaagaaaaactaaaaataaatcttccttcctcctttgggccaagt

SEQ ID NO: 2114 - DNA, 1553 bp, Oryza sativa
  unsure (1)..(1553): unsure at all n locations
gcagccccgtcattgttttcatcctcgcctccgggtcatcaagccttgtgccggtcgcgtctcgccttcgtctaaggatcgccgccgaaatcgtcccctcgccgttcgtctccgctgcccattcgtcgtcatcgttcccatgcctcgtcgcgtggtggtaaggatccgtcctctcgctgcccccgtcctcgtcctttcggtgtcacccgtgcccattgtgcggttgtcgaccccggtacccgtgtaccggtgtcggtagtcattcgcttgtgcgtgtggtgaccgtgttagtgtgcccgctcggtagccacgtggtttccacgtgtgcagcccgcgtggtgtctagtggagtccgtttgtcggccactcgcctcggttgacacacggggtccgcttctgtcgacccgtggaccgtctctatgtacccggtctgccgtggtcttttaggttgacatgtggggtccgcatgtcaacagcgcagccttcctgtcttttccaggctagcgcttacacatgttttatagttgcaaaacctaattataataatccgcaaatctccatataacagcatttaacttcggatgaccatgtcttggtcatacgaactccgaatcgatccgttcaagtctcctaatgtttgttataacctaaagaagattgtgctttctttttatgtattgttattgcttctttataggcttgtagttttgcttgtgtgcttcgcgtagcttctgtcgttccggaggttctcgaagcgtgggtcgcggtcatcgccgaaggttcggaaggccgttgtctctgagcaaggcaagtcacatcatcctttagcatattgaatcccagtttataaaattattttgatttaaattaatgcattattgctttatttaaattcccgcgttatcactgttttatttagccagcctatttacctttgttatgaccttattatgattgctattgttattattaccttgttcaccctaggaaaatagaaccccaactagtgggtactctatttatggttccactagtatgaacttaggtagatgcttcgctggttaattatgcagcattaggtggttttataactttagactttaggaattctcatatcacttggacactatggaatggttggattatggtggaattggacatacacctctcttcctctttcaaaacccctaaaacctgttttccggtggggtttgggtgcatgccagttgtgggaagtagcaccccggccaatataaggattaagctcgggcctttgttgtaaagcactaccgtaattccacatgtctagtgggtaaggcttagtttgtgggtcagtctggttattgttgcgtcccaaaacgactctaaaatacatcctctaaattctgcctacaataattaaaaatcccatgtgannaagctctcccaaactaatttaaaatgggtgcaaagtnntaaanagtcaaataaggcttgcaggatttccgtatatttcctaaaannnnnnnnnnnnnnnnnnnnnnnnnnnnnnnnnnnnnnnnnnnnnnnnnnng

SEQ ID NO: 2115 - DNA, 1543 bp, Oryza sativa
atccgctcttcgtggaggttgaagccgacgtttgggaaagcgagcaaggcaagtcacatcatccttgaacatattgaatcctagtttataaaattattttgatttaaattatcgcattatcgcttatttaaattcccgcgttatcactgttttatctagccatgcctatgtacctttgttatgaccttattattgttattgttattatttccttgttcaccctagaataaacaaaaccccaactagtggacactctactcatggtaccactagtatgattttaggtagatttggattcacacctccccctctattcaaaaccctcaaaatggttttaggctgggctcggggtgcatggttttgatagtagcaccttggccatataaggaccggtcttcgggcctctgttgcaaagcactaccgtacttccacatgtttagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccgatgtcctgctgctaggggctcagtcctgcctacctgtcccgggggtcccggccgtaggtggggttgggtcggtactcttgtctatggctaggatgggttggaaactatgtcacgtatttcgtccgtataccgtggtggtatgtggcacgtggctacacgtgaggaagatgtgtcttgtgggtaaagatgtacacctctgatcagagtataatctattcgaatagccgtgccctcggttatgggcaagccgagcaatgtacccaagttagtgttttaaattcttaaaacctgcttaacaactaaaatgtggaatggttggcttgggacgagctgggacccagggtcgggttgccagttcggtctgaatcatcgtaggccttgggttaaggcaggttcgtgtgggttcacggccttgtttaataatattgtatagctctggaatcgtgtttacaaaatagctttgagcaactaagtgtcttttaatgctgtttactgcgaaccctaaccctttatatcttaacccccttgtactcccttgcatttatcctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgttgtttctcgtttgtctttgtgtgtgctgggccttcgctgcccatgtaataattaactatttacgcttccgcttgataaactctgaaatgtatcaacttttggtgtatcttgcctcctgggacaaggaataatacacacacgtaaggaacgcccgttgggttaattccggtcgtgacaataatgtaaagtaagtactcatatactcagaaagtatttcataccataaatgtatatagaagagtattctaata

SEQ ID NO: 2116 - DNA, 7143 bp, Oryza sativa
cccagtataacatgaacataatgtaaagtaggtactcatatactcgaaaagtatttcagtaccataaatgtatatagaagagtattctaataaaagtacaaagcttacaaaagaggaaaggaaagctgctagagccatacccgaactcttccgaaggcttccggactcctgattcctattctaattctattccaccagctagatactactaaactaaacttgagagaaatgagagagctattgcttgaggtgtgtgagtgaagtgagaaggtgagaggtttatatagcatcccaatgacggttgtgatggttggaatggtcggaaataccgtccaaccctcattgggagctaatccacaccgtccagaaaaaaccctgcatccagcggcgttgagggaggttcggctgaaccccttggttcggccgaacctggggccggcccaaccagcccatggtttggcttgtggcctcctctgttgttcttcttcgcagacttgtgaattttggcccaatttatcgtgtcaattctgagttcttggcctattcacacacaagtctggttctcgacatcatccgattgatttatcgtctgagttaatatcgattctcctccactttagtgtcattccctgcaagaggttagtatacctaatactagtggaagtttattattctaacagatatatgcattgcaagcatcactagttctctcctagtttagtaatattgacggtcgaaactgatcgataacgaccgtcaacacaggatatcatttgtacaactgccataaactaaccattcccctgcagaccatagaagaatctcgtgcaggtggagcaaacagggagacgcgtaacatggcaaagaatgaacaagaaagttcatcatccttaacacccgtgcagatgtatgagaaaggttgggcaccaactagggatgcacccagagggacccaagctccacgccacagcatcggagtctaaaactgggcgagtgccagtgaggaccgatggcatgcgtctcatgacatacattgggggataaccaacctcccagatcaagtggtgtgcctccatctccttgtgaatggtgctcgagttcctcttgttgggacttaggtgaaatcactaggagaatggatacccttgatgtgcagacgggggagatccagtacaacctcacggaacacatatctcaaacgctagaattgcaacaatctgctaatgctcagttcgccaacttcaacaaaatgatgcagcaacagcacgatgaccttcaagcgtacttcctcttccaggggttcaatcattatcaaggaccctaagcgaaagccaagcttgaggtggggagacatctctccccccactgaggtaacttgtatcacattgcatatttccctttccaattgcatatttgctttacaattgcatcttataaactgaaaacaacataaaaatttgcaaactagaaaatactaaaaagataggataggtttgagtcatgataggtaagataagctagttctctttgttgaaatgatgaatagttgctctgttttatatctcttatatatgggttcgtggtaagtgctctctcaaaggttaaatataagtagccaacaattatctgggagtctgaggtaaatgagctgcacttgctgttcagagtctaagttgttgtaagatatgagatagtaaataagagttgctatgaccctgatactagtttgacttgaattccggatgttttgtttttcaaaatgataaaattgagagttgctcatttaatataaattcctaccaaagccaaaattgtgccatcatgattaaaccatatacattttggtttcttgccattccattgaactttgtcaaactcttgagacttgtgtagatacttctcatgctctatgatcaagatcatacacccacatatatgcacatgctaaactcctacactgggagccaagcaaatattccattccactccatttccatattaccacctaaataaattatccatgctttcatgagctttcttctcctaaaaagaaaagtcctttcgaaaaaaaaaagagaaggagggaaaggcatggttatgaaaagagaaaaaataaagttacgctctcacaagcatgagcatgatgttgaaaaaaaatgtagccgtgccctctcctaatcaataaaagaaggattttttgggagaagaaagtaagcacaaaggagaagcattttctttatttttcctcatgtgccatttccaccatataccacacacactttgcacaatcttgatcttaagtatgtttagttatctgctttagtctaagtttttgatttagtaataaatgagaatgcaagtatgccatgtttgatccctaccgagctccacatatcaaaccttagagtaggaatcaaaaaggcaacatttggtgaggaattcaaagtgatacacttagagagattgagtgaatcatttgaggaacttgagtttcttttgcaaaaatcatttgaaaacttccggaattagagttggataaatatcgggtgattggtgctttatttgttgttctgtctttcaaccgcctaaggcaaggagaagcagtgtctcgtgggaatcaggggtaagggtaagccaccgtgccaaagattatttaatctgagagagagtacatataccttgcacatgtatctttgagatatacagcatagtagcaactcctgatcaacaaccaagtttttgtttcctttcgtccttcactcgagacgagcaaaggttcaagcttggggggttttgttgacggtcgttatttaccaatttcgaccgtcaatattaccaaaataaaggagagctagtgatgcttgaaatgcataaacatgttagaataataatattccactagtattaggtatactaaccttttacagagaataacaataaagtggaggagaatcgacatcaacacatatgataaatcaatcggacgatgtcgagaatcaggccaaaattcacaagtctacgaagtgaagcagcggaggaggccaccagccaaaatgtgggctggttgggccggcccaccctggttcggccgaacctgccgtgaagccgctggatgcagggtttggatggacggtgtggattgcttccctatggcggttgggggtattaccgacctttccaaccgccataaccgtcattacctgcctatttaaggagttcactctcttcacttcaacacacacctcaagcaagagctctctcatttctctcaagtttagtttagtagtatctagctggtggaataggaatatagtagtaatcaggagtccggaagcctttggaatagttcgggtatggctctagtagctttcctttcctcttttgtaagctttgtactttatttagaatactcttctttatacatttgtggtattaaaatactttccgagtatatgaatgcctactttacattatgttcttgttatactgaatatacggctagcttatctgggagatgctttggtgcgggtataatatttgcttatgaaattactctatgtcatgatgatgatattacactacaagaaatatgaccttctatgaagaattcctcgtgacatcggagctattcgtcattagcacattccattttatgacgattagtatgagatggggtggcttagtgacgaaaaaaatgtgttcgtcgttaatgccaactagaaatcgtcataaattatttcaatgggacgtcgtgacgaatattaacttgtcataaggggcacaaagcaaacgtcataaatatatataatgcatttctagaaaaatatactccatctatcccataatataaggcgtggttactataagatttgtagcaacaaaattataaccatatgaaagtaaatttaaatgtcaatctaatgatataatttttaacaattaaaattcatttcatattatactaagtgttggtcaaatgtttaaaagttaaatcttaaaatgcgtgcacgtcttatattatgagatggagggagtattaaaagttaaagcaatttaatcaagtgaataaatgaggaaaacaaaattttcctgcaaaaattatggccggaaatattttttttaatattctacgtggtctaaattattctctgaaaatttctgtgaattttcagagctcaataactaattttaatagtgagtgagcaaatttgagttatgctatcagtgctatttcaatagtgagtgagcagcaatacaaggaagatggctaaatgatttgtacctggaggacttcttgattttcgacatgggacaacgggatgttttcttcttcgggttagcttgccttgctggttttccagtcatccccttgctgccagctttttcagagtcatcattttcatcatcgctcagaactaatttcctcttgcggaagtctgattggttggccaattgagtggtgctgggttgagagtcagaccagatttttggtcctctgccagcttgaccagtttgccgacggggtgagcggcgttgagcagttggagggtctgacttcatcaaggcgaattcctaggcatgatgattcaagttttccatcaactttgtagatgataaaagcatgcttttgagaaaggttgaaattttaaatacataccggtggagggtggttgaaggcactgtatggcaccactggcagcaagtgcgaatagcttactacgattgcatttgagaagatcttatacattctctccttcataaccttgaattcaagagattcaggatcttcacggttggggtcatgcttgccgtcgaattcaaaggtcgtgcgagatctttctttgattggggctagctggctcttgataaaatgccgggtgatctgttctccttgcagaccttgctcctttagtttcagcatacggtccatcagggcaagtgcctgagcggcttcctctcccattggaagtgagttccaagtgtcctgataaactggaggaagacaggagtactcggggagtgcaggctcggggttttgtacatagaaccaattttcatgccagcctttgtttgaggttttgaagggcatggagaaatacttttggctcagagttccccttagttgaaatccagccccccctactacgcatggcttgttcttgttcggttggggtttgaggaagaagatgcggcgaaatagtgcaaaatgtggtctgacgcccaaaaaagcatcgcaggcatgtatgaagttggcgatatgaactatggaattcgggtttaggtgatgcaaactaatcccataaaactctaatatcccccggaagaatcttgaggttggaagagaaaatccgccatagaagaaatgagaaaataccatgacttcatttgtgtcaggggtcgggaatgcttcgccgaacgccggacgccatccaatgatctccttcgccggaagaacaccatgtgctaccatttccttcaagctttctccgtgatgtcggagggcgcccattggctctcgaagctttctctctcctccgccatggatgcgaattgggtgatgcgatttgctttggaaatggctgagaatggatgggggatcgatgcggtggatgcgcggatggtttatgtggaattttggaaggtggatttgagcgaattggagaaccctagttccgccggagtggttttgcactgtagtgggaaatggggaaaatggcgagagtctcggcggggaagacgaaacgacgctctgacttcggcgtttatttctctagggtatcgggagtgctaatgggcctaggcctatacagtacttcagcccaattctgttatcggcgtggctaagttgtgatccgtagggacttaggcatttttgcttcggcaatttttcctcacaacagtatggcctaatgctgttaaaatcctttgtgatgcagttagatgattccttggaattactatgatgcaaataaaaaaaggtacccgacaaaaggtgttatacttcttttgtaagcctttttaggctgcaaaggctgtttgggttttgttgagatgattggtttttgaacagtcattctctcggcatgttatatgcttattttttattatggcgtgagtatagcctaggctattttgactcattaattgtcgtgatatcatatttataccacatttgatggatctttgagagtttttactcagattcttgtcatatgtgctgatttatggacctttggagtattttttactcgggcctctttacgtcttcatttttggtatattaaagctaaagcagtcggctcgatgttttattaagcgctgcatatgcttagctatatgatactctggatgatacggttgtaaaaccactcggatggatgttatttgcactttgactatatgtttagcttttagctactcacatagtcgggggctacacctaattaggtgcatctattcgatgcacctgattatttatttttagcccttcacagtctttgattttggtactcgggagatcaatgcagaagaaattgaagcactcggattatcattttgtgctacaagaaaagactatttcatcgactgtaaaggtctcagaggctactgtggagattatggataccccatacctacacggcatgtatagtccgactgggtatgaggtgccatgtatagatagaatatctttaagaggactcgggttaaattctaaacttgtatgtcaaggaagtacctgagatcctagtcggttacgattgtattttatctgtaattacatattccgttagggatatgaactgtattttataatatggaccccttcccctatatatggaggggtccgggtgtctctaggggcacgatttttcacctagatcatacgatcaataatactctcggcggatcaatccccagacaggagtagggtattacttcttgattaagaaggcctgaacctgtacaaaattccttgtctctaaacccatccacttttccagcttgatagccacccccttttagtattgcggaaatcttgtttcgacactgaaccacttcgcccgagcttcatcaacctctgtagatcaagaatcccgaaggaaccgacgcgaggtggaccacggaggaagatcctcttcttct

SEQ ID NO: 2117 - DNA, 6062 bp, Oryza sativa
  unsure (1)..(6062): unsure at all n locations
acgattagatcgagcctcaaaacccacatgcatatgcaagctgtgctttgccgccgcttctaacactctaatagccgctatagagcacgaaagcttgcactaaagccaccaataggttcgcacggtcgttctctacacttttagttttgggagcttgagctgaatcgccgccgttcgccgccggtgatgctgtgaagctcgcggctgtgctgctgctctgctctgctctgcccagagcaagggcatgtctcgtgaaatttaaagactcccagggatgaaatggcaactcaaccaaaaacttacatgtaggaccagtactaattcgtaaataaattaaaactcgagagtctttttgcataaaatcctaaacaccgtactaggggctgcgggatctatttcccgagaacccaggggcttatgcgcaaaaccgtagtcgctgactggtggacccgagagagtaaatgatttgagaaaattggagaaaatacaaaccttgtttcttatcaactgaaaaatgacagaactttagaaatttgtagaaaattcatcctaactctaaaatttgcaaactaaattttgttggaataatattttcatgctttgcatcaaaaaaatgggtagcttaacagaatcataaagatttatgtctcaaaaatccgaaatgcatgtaggtctatatttaacatgtagacactttaaaaatttgtaactttaaacgaaaattattaaaattaaaattctttcactaaaaatcaaattaacacagatcacaccaactccataaaaagcattcattttagagcatgttggatttttatgtatgttttaatttcgattttgcatatgtatgtttagacgattcgcagccgagtcacgaggaaacctacctttaagctgagcaaggagtggaagagcaaggcaagccacctcccctctttgatcacattgaacctatgatttggaggtttttgaaaagattgcaaaatatgcatgtctattgtacactaatctattaaaatcttgtaaaatttgttagatcaactccttaacttgcattatcacctaaactccacaaaagaccttaaccattattccaaatcttaggaaaaattcattgtgtcacattaagaatgatgtttgaggtcacaagtctataaaaatgcttagccatgcttagtgatgagtttacttaccgtttgggctcaattacatatatagaatgatttattttatgatctgaattaaaatgttaaaatgtgttatttgtcaaataaaatgatggaaaatatggatttttaggtttgggcctcatgtggtacacatatggtgtttagttgtgttctgatagggggagagtgtgtccagaccgacctaaggacttcacccagcgtcagttcatttcgtatacagtacaaccacatgtgctagtatgggatagcccaagcttagtaaattatttacggtttagccttacattctggtaggccggtgtgtatgagttagtcaataattctgaggaattagtcgttgattcagaggaacttcctatttaccccgacgtggtagtttaggtgactaagtctgtccaatacaacggtatagtgccacgtggtgggttcccgttgtgtccgccaccacggcgttaagtttaaggcgtgggcctgccacctaacggttctaagtcatatatcgagtatggcttaggatggaataacacatatcatactggtgtaaggctaaatcatgaatcttggaagggctttgttgtgagtaataaatcgggtacttatgtatcgcatgccatgctctttcatgattattatttcgcatcatgtgggtaaagtgtacgtactctgcagagttaaaactaatcaattagctgtgctcatggtcaagagaggcgtatgaatatgtcatgagtatagacctgtattttattcttctaaagctgaatttgaacttcaaaatgtgatctgatttatggatttttgtccttgctgccatggaaggcaataaggagctatgttctatgtggttaacatctattttgatgcccatttgctaagtgtatgcttgctgaaatttaattgaaaataaatctgaatttgaaatgttctttgcaaactaaatttgctttatgctaaaattatcccatgtaagctttactttgaatatgccatgcatgtagagtactaggcttgcttggtgcttgccattacaatttatttgtactgactcttgcttgtattgttgtattgttgcatgtttagatttggttgcagctgagatcactcctgaggaggatgatttcaatggggatgtctctttcttccaggatggttcttactagggtctaccctagtcggttgtatgaaaagtcttttgggtagaaaatgcttccacaaacctaacttttcggccaatcggccatatgtatctaagttataagttgtatgaacctaactaaaacttagaacttagaactctctatgttgagatatcatgtgcttggataaaagtgtttagtgtgttccttttgttagggacatattaaacatgagtatgagttaaagatatttgagatgtcgtagatctttagccatttttgtcaagtctcctgaatgtgtaacacatctggtcgccgtcttcgagtggtttgacaggcacatctcaggctgaagttgactggctggctaaaggcccagcaatgtctcacatatctttctcttggagcgtcgaatgtcttaatatgtttgatggaagaattgtgtttagctattcatccttcaaatatacaaaggggttcggagtgcttccgacagctgagggagaggaagggagggggattgggccgagcccaaaggagggaggacttgggccaaaaatggcccaaggcaaaggagaaggattttaatttgtttttctttttatttaattaattaatttaactttgtgactttaaaattatttcttgagctcctaaaattcacggaaaaatcctgagagtattttagggcacaaagaatattacaaaatattctcggccaatgatttttaaaggaaattttaatttcctctataatttcacttgattaaattgatttattttttatttaatttctagaaaatgcattatttaatggtttttaattccgaacgaaaatcagggcgttacagtttgtagctcagtctgggaatgaacaaaaggacacggatagggatggatgaagtcaggttcgatggatatctctagggcaaatgaaggctacacgggcggttgtctggtagtcgagatgtcatggcataggacaggcattgggaggtcactcccgagggatgttctgatgctaggggctcaaccatagcctacctgtcccgggttttccggccgtaggcgggcgttgggtcagtattcttgttcatggataggatgggttaggaactatgtcacatttttatgatgggttccaaggccatggaatgcggcgcaaagatgtgtcttctgggtaaagatatacacctctgatcaaagtataatccattctaatagccgcgcgctcggttatgggcaaacctagcaatgtacccaagttagtggtttcacacttaaaaattggttaatcaactaaaacctggaatagttggcctgggttcgcttgggacgggctgggacctggtttaggttgccagttcggtccaactcatcgtaaaccttgggttgaggcaggtttatgtgggttcacggccttaattaataatactgtttagctctagaatcgtgtttgcaaaatagctttaggcaactaagtcacttttaaatgctgtttaccgcaaaacctagccctatattattactcctttgtaaccccttgcattaatcatgcatgtcccgatgtgtcttgctgagtagtgtggttgaactcattcttgctcaatctttcctcccttcagtaagagaagctttggagaagtcctaggtggagtcttggcttataccccagttgagcgccttttaaaaatggagccgtaggcccgttagtccactgctatttatttttggttgtcaggcctgaagtgcctttgtaataatgtaaatattatcattataataaagatgtgtcttttgtatcatgattgttgaagttaccttggcttttcttgggacagggatcaatgcactagtgttcaggagaggcatatttcccgggagcgacatgaggggataactctcgctttgatcgagtgcgacgtttacgatatggcaaccaaccagaacaagtccaggacgccatgtaatcgctacactataaacgatgtcgtatcaaccgtgacgcgctgttgatgatccctgtaatgcaaatgagagaacactgcaagaacaagataagatgcaatctaaatattatgaataggtgattaagaacaaagaaatagttacgattgaagtggtagatctaatcgacccgactaatcaacacaccaactattgggggctctgaatatatagtcaccaactaatcgagcgaggactagggacaagctgaatggcacttagcaaaattcaactaaacaaaagccaaatgtttttgagggtgtacaaaactatttatagaggaaaatgtatctacggttaagtgctaattcgtggaggtggagggagacacttccaacatggccctattctattacaaggcccaaggcccaagttcggtttcagcaatagcattgtcttgttttggcgattcccgttgactcgagataaatttagatatgagattagatgagattgaaaagtgacgaaataagctttccatcaagtccaagttcaccaaaatcagagttggcatgaaggcgctaggtcagtttgaattcagtgctctctctagaggccgaactggattccaaaactcattggacttgaatatcctatagatcctccattcatccgatgtattctttggcaatgttttatatttatcatgcttggttttatgtctatacttgacggtcacatcatctgctctgccctgagaatgaataggtaggcatttcattctttactggtatctttgatgaccgccgtgatacaatcagtccatggtctgatgctagtgaaatggtcaattaagcctagagggtgatgaataggctaattcaaaaactcaagtaaatgcggaagcaggaatttttagaatttccgaaaataacagagtatgcacaatacaaagaaaattctagagctagctgcctacaacaaagaaatactagcacaaacagcaactagacctatagcggcaccaaacaagcaaaaagtagaggagtgagaaaagggatatcaccaaagatgttgcaagatgagatgttcacggagtttgaataattgagaggattctactctcctttgaagctcacaaagagtcaggtcttcgctaaacctttcctcaagaggttgcacaaagcactgctccttccattagtggtatttctttcctttcggaggtgagatccgaccttcacaaacttctcccggccaaccacatattgatcggtgccttgagagtaatacctagccgtttaggagtcctcaaccttcaagagtaacaaatgatgccaagatctcctggagatgaagcaagtgctcacaaatgttcatgaagccaacaacaggcgttacacaaacttggaatccacaactgtcacacatacaccaaatccgaatcaaaccacaggtggagaggggaaacaagaaagcaagggtcaaaagtgaatctccagatgaacaagccaagggccgaaaatatccgatcagaccagcaacccacacaagtagagagagtgggttattatataccacagctctagatctacccgttatgcacaataattacaatttccgtaattccaaaaattaatttcggacatatcaaaaaatttccagaacaacaaaatagtaaagtcaactgatgtttttcggagattccgaaaacttttcggacaagttcgannnnnnnnnnnnnnnnnnnnnnnnnnnnnnnnnnnnnnnnnnnnnnnnnnnnnnnnnt

SEQ ID NO: 2118 - DNA, 14126 bp, Oryza sativa
gaaaatatccagaaccaaaatctccccctagacattttcaaaaattccaaaaattactttcggacatgtccgaaaatttctagaagcgtttttggctgcatacacattttcggaaattccaaaatatgattgtagacaactccaaaaatttacagaaacacttttgccttcactgcaatattcggaaattccaaaaaccagtatcggacaagtccgaaaatttacagaactgattttggcttctcggtcattttcggaaattccgtaaatcaattttggacgactccgaaaatttccagaagcgaaattcagttatgtctattttcgaaaattccaaaaatctgttccagacaagtccgaaaatttctagaatacagaaactgaggagaaacactttcaaaaatagatttggagcacacacatcactcatcatatgtgaatgcatcatcccccttaatagtacggctttcctaatgacgcaaagaaatgaaaatatacaatataacctttgctcattgccgcaactcatgatttagtcacattcgtcgagatatgcattgcactacaaatcgtcacggactaacaatctttcacattgacttaaattaaattgttagtcctctctaatcgcattgttattaatccacaaaatcattaggggcctagatgcactatgagctagcaatgggagattttcatttatgttctgcctcctacatttccttttgtgcttacatctaggaccttgagaaaaatctagctagttctatagacaaatctttgtcaatacgtgctagccgaactgttatgagaaacaatatctccttagtcacgatttcgtttcctttcgtgatttttttctaacgtgttttttaactcctaggcaaaataaacgcaagctaatctttcaaattattctcaaacgtggtcataaatgaatgacgttcttaaaggctatcgtaagatttttttgtcacggaatgtctaaaccgttcaggcgattgttcgatcgagaggagcttcttcttccaactaattaaccatgtcttgatttggtcaattaagtattagaggtggacctttcgaagtctgcttactttgagtggcatccctagctattgcatggggaaggttccacatggaccagtgaaattgtgtaggacttcatcgaggtcaattgcaccacaacttattggaatcattgagcctttttgaaggttgacctggagtccggtggcacccccgaaactgttcaggatcgagattaggctgtccacgtcttggcatgatggcttgatgaagattgccgcgtcgtcagcatacagggagcatctgaagcgcacgctgcggtccgcgaactcgcttaggtggccctcgacggttataatcttgagaaatctgtgtagggggtccattgcaaggatgaaaaggtacggagatagggcgtccccttaccttagacccctaggatggtctatcctttctccctcaattccgtttagtgagacactggaggaggaggttgacagaatcagggccacccagtcgtgccatttggcgctgaacctcatcttgtcaagtagcgttaataggtattcccatgagaccaaattgaaggccttggcgatatcaagcttgaaaaagagggtgggcttcttggatctgtgcatcttctttgccaagttggagacgtagaggaagttgtcctggatgcaactcattttgatgaatgcactctaggcttgcgagatcagtatgttgatttgtctggacaagcagattgccagatttttgtcagcatcttcgccaggagtgaattaagctaattggtctgtaatcacccactgtacatgcgtcattctttttgggaatgagaatcagtgttgccctatttatgcttccaaaactcccccctgataatgagtgtaaattatcaaggagctccatgatgtctaaattgatgatctcccagtagcttctgaaaaaggtgcctgtgaaaccatctggcccaagcgctttttcaataggcttttgtttgatagcagcccaaacttcatcttcggagaaaggagagtctaaatcttccgatgtcacttgggggaggtggagttcttaccaattcagggtacaagagcgttgtaaccaatgccccatcatggtggagaaatgttcatacaaggctcactctttagcttcatgagtctccagaatggcattaccgtgatggagtctgtggatgaaattcttcccatgttgttggttgactcttaggtggaaaaacttggtatttgcattgccctctttcagccatgttagctttgaacattgtcttttcctagccttttcaactacggcaaggccgaggatccgcagttttagatctttcttgagggagagctccaagggtgagagcggtatgttttcctaggcgatgtccaatttgagaataagctcgatgacaaggtgaaattggacacgactgtcacttagaatgcggttactccaggatcttagtgccttggccatcatttttagctttgtgctcaggcgcttgaccgggtgtgaagcgctaaccggctgggaccaggccgtttggacaacttcgaggaagcccaatagtcttggccagaaattctcaaacctgaaagttggcttgcgcaggagctgctttgttggtgagagcaacagggggcagtggttcgagaagagcatgtctggagcatgatgaagagagtgcttggaggttgtggtttgagaagagcatgtctgcatcagagttgcatcttccatcgggccgtaaacattggtgaggaggaaggtcgtatttgaggacttctgagtgagacagattgagagggagaaggttctgatatcaagatcgctttgttggagggcttcatcatcccaaaatgtggctattcctccccggctcccatcagcagaaactcggacaagattatcaactaataattgagctccaaaacaatcattgacgtgtaaagtgaatggcaacttcagtgttaaaacttagaaagcttatgtcaaaacaatacttcgcatccaaagcatagtgaaggcaacaacttactcaacattaaaaatttagttccaaaaaaggatataatccaattaactagctttatcaatatttgacatgcaaagctcagggtgaattatagctcataacagttatcaagctttgcaaaacatcagatttgccgtgcaagatattagcgtttatgaatagtgcacttgcactgccaccttgacgttcttcaaatgattaaccttaaagtcactcaaacaccaacccgccctatgactcatgccccagcaatgctgccagcagctcaggcagatagcacagtagcgttgccacttaccaagccatctgcagcagcagcacctgctgcagcttgagtttaatggtggctatcttgatcagacccaagcttgaactctagctcatgaggagttgaacttgccgtcaatatgtggcatctacactacccttcgatcttttactcgcttcctttcatttattcttctgagtttggctcattctctatatatcatgagtctctctttttacccttcacctatccatcctgttcatagaccagtagactttataaaaatgcctatattgccctatgttgtaataataattgataagatttcctcgaaaactaaaaccttcacaacaaaatgattcagttgatgtgtttttaagtgaaattacccaaatcaccagattccaaaattcaaacaaactttaaaatcaagattagaactttattatcgatatcaaccaaattttaagggaaacaaatttggttcgaattcactgagaaataaaaaactgattttgtttttcatattctaggtgaaaatatctgaacatctggtgatttgtgtaacatcacctccgtcagtaatttcttcaattttccataatgttgattaaaaaaaatcagatatcggtttcatatgaggcaaaacaaatactaaaattatgccccttgattttttgcataactgataatatttttatttgaaggattatggttttgttgaagctagcatttcttgttatggagaggggcagtatggtaaattctaaaaaaattctaatagtcgactaataaaacgggtaagtacaaaatcatgatattttgttaagtataaaatcatgatatacttaggggtaaagaaaggattgagcgataacttagaggaacatgaggacttctcctcgtgatgaggcacaatgagtgaaaactagcttgccaaatgacaatttaaaacagtatttgaaatttgccatttaaatctagcacaaactatcagcacagacacaacatttcattcaaaggtgatcattttaaaaaaaaatacttagcacaagtagcacacagaattaggtctatgaactgagattcatgaggcagtagtcgaaactattgaatagtgacagacacatcaaaagcacaaaaatgtttaggagcatgcactgccaatttcaataaatgcttagatttaacgtacatagtaggcctggaaaaatactacgaaatcaagagatacaactgaagctctcaattcagttcagttcaaaaaattgttgccccaaatatttttccatctacaccaggaaaataaatcctaaaaactataaccaagtactgaaacaatcatccctaagaaaacaaaaattaattcatcgtcaatagtttatccaatgcacccaaaactgccatacaaaaagcaaacagtaaacttgttgtatgcttgtatgaacaaaaataaataaacaaatagcaacaatctactagatttaactcatatgtatgaaatgaactgataataagagaatgcagagaaatatatacacgaagggaggagtgatatggagtcatggatatagttaaacaaaataagaacatactagataaccatctatttgcatttatgcaaatggtgtaacagttctctctcaaccaatatgagtttcagtttgcactgacttgaacagaaatgctaagcattttagcgattagctaatatctacctggaaaactaagatcagactagatagttaccagtatggtcagatgaaagtaataaaatgaaaaagatcgataccgatgtaaagaaagtgtagccttgttatggtgaaataattccaaatgcaagtgaaatcaactcattggacaacaaaaaaccatctgggtcactcagacggatgaaggcaactctgcttccattctcaccatcatgttgcaagtccaactcaaattcacttggttgcaaagctcgccgttccatatccatggcaattacaagcccactctccacaaaaggcctaaatgtgttgcacaatgactctgtcagactccttccgaaggttttactgaaactttgcacatctaggccccatgctgttctcagtgatagcatcaccacgtccattgccatgtcctttatcccagaattgccagactcatggctccacactccattttccaatttctgaacccactctgcatattccttcattcttctgggcctgaagaacctgataccattgatgtagctagcggatccaagaccaaatgcatagaatgaccggttttgccaatatgttacattgtgcttgcactcatacccagtcttgcaatagctactgatttcataatggttatatcctgcttcagaaagacgtttcgaagctatcttatagaagtttgcagaatctttctcatttggaagcggataaacaccaggtgtatatctgcaagcattaattatgaaaaaggattgctgtaaattgatcattcaatcaactcatccatgtacatggagctgaattcctactggttggaatgacagctagaattagaggaatatgagtaaaatttcgcaaaagaacacaactatattgtcaattatcggcttgttatagcattagctggacaattcagaaaactacaaaaacagttgatgatgttatcaaaagttgctactttgtcaagaacagggtttagggtatgtttgataggttggacacacctgtcacacacacatatgggatcaagttacaactttcaatgtcaaaaggaagtttacagttttttttatataaaatcatgttgtattgttgaagttcaatgaattgtcctgctaatgttgtagcaaggtgaaaatttacttttacttgaggaatattgttttagtgatgtgcaagattttaaataccctagtttttgtatacttaaaaatcataaatgagattttgcctcaatctgtagtcatgtaaaggcaaaggctgacccagggtttcaaatctaacataagagaatcagtaccttcccataaaatgatcagtgcaaattaacatatcacaaattagtgagtcatttttttcccataattagatgagacatgcctgagacgaccataacaatttcatgcttgaactcttttaccttttagcatattgcagttatatctaactacaataattgtttaccatcatagtgagttctgagcagagcattgaacttaaaaacaacccaaacaagtgcaaaatagtaatacgaacttctgcccaatagaatgataatgattctagttatttattcttcattctctagttcatagcccatatggccataccaaccaaaccccataataactgaatcagaaaatgaagtgattaacacaaatgtggcatgtggccataatatatcccaaatctccaatcggttactgaaaaacataggatgtgattcatgatttggcaataaacacttacagttgctactttgtcaagaacagggtttagggtaagtctgataggttcgacccacctgtcaggcacatatacaggatgaagttacagctttaaacttcaaaataagttacagtcttttaataatatcatgctgcattatttaagttcaatgaattgtcctgccaatgctatagcatggtgaaaatgtacttgaggaatattgttttagtgatgtgaaggattttaactttcacagttgttgtttaaataaaaatcataaatgagggttttccttaatctgtattcatgtaaaggagaaggctgacttggggtttcaaatctaacataagagaatctgtattgggatattacccataatcagatgagacataccagagacgaccataacaatttcatgcttaaactctttaccttttggtgtattgactacaataattgtttatcatactagtgagttctgagcagagcaccgaacttaaaacaacagagattttaactatcatagtttttgtttaatttaaaaaatcataaaagagggtttgactcaatctgtagtcatgtaaaggcaaaagctgatctggcgtttcaaatttgacataagagaatcagtaccttcccataaaaggtcagtgcaaattaacatatcacaaattaatgagacatatttttcccataattggatgagacaaggccagagaccacaataacaatttcatgcttaaacctttaccttttagcgtattccagttacaataattgtttatcatcatagggagttttgagcagagcattgaacttaaaaacaacacaaacaagtgcaaaatagtaatacaaacttcttcccaatagaattataatgattctaaattatttaatttccattcctagttcatagcccatattgccataccaaccaaaccccataacagaatcagaacatgaagtgattaacagaaatgtgcgccagaatatatccgaaatttccaatcgcgttactcaaaaacatgggattagaatcatgaattggcaataaacacttacaggtgcccaaacttagttccctggtcgatctgcaagtcatagacagacacatgcgtgggacgggcatccaccgtgcacctcaagctctcctcccacatttcctttgtctggttgggcagcgacgaaatgaggtccatgctccagttctgcagcccctcgcacgccgtcacgatgccgaccgggtcgtgcacctcccgcaggccgtgcgcgcggccgcacgcacggagcaggtccttctggaacgcctgcacgccgagggacacccggttgacgcccagccccaccagctccctcagcttggcggcgtcgaacgtcccggggtccatctcgatggacacctccggggacgccgacagcccgaacctggtccgcagcgcgtcgagcaccgcggcgacgagcctcggcgggaccagcgacggcgtgccgccaccgaagaagacggtctcgaggggcaccccgtcgtcggacacggggcgcgtggcggcgacctcgcggaggaggaggcggacgtagtcggcgatcctcgggtcgtcgccgtccccgccgtgtggggatgtcgggggcgaggaggtgccgagggcgacgatggggaagtcgcagtagtggcagcgcttgcggcagaaggggaggtggacgtaagcggacgccggcggcggaggaggaggaggaggcgaggcggcggaagaggcatagggccgaacaggtggtgggcgtgggcggattgggggtggtttgcgggatgggaggtgggagacgagcgggaaggttgaccttagcattattgggtttctgtaggggaatgcgcctgtgctgcagcttgggccttcttttgttttcgggagggaactggaatttgtagcactctactacttagactactactactactactaatttttgccctaaatttaaatgaataatttcttgttattaacttttgaaaccggataaattctcacgcaaggcgaacactatcgtctcttggtagcgtaatttggcaaaccaaaactatctctatagcaacttcaccatcccaaccactccctctatctcaatatatagcaactaattagaacaggatacaacgtaatgtccatattcgtggtataaaatgtgctccatacggtattaggctgctatattttgatagggaggttatgccaaaactcgagcaatactaattgttagcattttttttggcatgaagacaataattgggacacctaaacatcttacagtggtatggagtcgccaaccacctcaatctagcaaaaactaaatcaagacgggttttggtagattaaccgggctagcaggcccgatttagaagaaacaagcgataaacacccgtctcgtggacgaacataaggtttacgggataaacttacaaagggatttcacactctcgtagcgaaagcagacgatttacatcgcaaattgataaagatagacgaattaggctaggactaggtgaaaactagatgcaatattaaaaaagcaattcaattggctaggttggattgtgtgtagattcttttcaattgaacgggtcttgctgccaggtcctccttcacgtccaactcgagtagaaactaatagaaacccgaaacatatcctcccaaataaaaaatcccgagatccgataaaaacaaacttgggattggactctgtcggtctgaccagccacaaatcgccggtcaaacaagcccacacatggcggttagactggcttcgtgaaggaaaccggtactctccaaattttggaaatattttcctaattcgaatctaggtgttgaatttgcactactggaaaaatggtctttcgtcggttggccaaaaagcacattagtcccggttcaaataggaatcgggactaaacatctttgttttgtcctggttaaaaaccccacccaattttaccgggactaaagataatttcactccggttcaatagttgttaggtcgtgtcaggcccccaacgactttttgtcctggttggtatcaccaaccaggactaaatatctctcttccacctccttattttatctcccacgcctctctctcgatttcctcgtctatcttccacgtggcctctgctctctctatctctctggctctctctatctttctctcattctttctcgctctctctatctctctctcattctctctagttccctcgacggaagcggcggcgaccgtggctgggtggcgaaagcggcggtggtcgcggcccgatggtggaagcagcggcggtagtggtccgacggtggctgcggcagtggccctcccctccgccaaatctaaccggaagggacgcggcgagatggaaggctggcggcggacaggcgcgggacagtggcctcgccctcccctctgctagatccggctagaagggaagcagcgggatgggagatgagccggcggcgagatgggagggcgaccaacggccgggcgacatcggcgatgttcatttgttctagaatgtttcttgattttttttttatgatttgttctagagttttggatgtttttgatatgtgaatgtttctgtgaataaatttacgatgatctgataatataatttgcttgtgctgtgaatgaattgtgattatctgataacttgcaagcaaattaaaaaaaaaggaagaaaaggacctttagtcccggttgttggtcccagccaggactaaagatggcagtaccagtcacgtgacactgccatttttagtcccgattggtgttactaaccgggattaaagatagcgatctttagtcccagattcgtaataccagtttgcaacccgggactatagggagttacaaaccgggactacgaagcctttctccagcggtgttgggtgtaaacactaacattagttgatacaatataactctaaaatgactcatcatattcatatttattattttctccatctcataatattgctacttttagaattttgccatattggggcagcattgggaacacggacttgagcatcgggttttggtttacgcgggttggtgggctgcatttgcactaccgttgtttcttttaggaggaaactaggaaggaacctgcgcatatgcgcgggtaatttattttttaaaaaaatctactaaaaagtcatatatcatcataaaggaccatagattacctcataaccttaccgtaaaagaaggaaatatttataccatgaaatagactatggattttgatacactaaatgataatgtctatcatattcaaataaaaatcactttgtttcggttatatgtaaacttacctatcatcatcctttgaaaatagaatatgtgttttgattatttttcttttattatacatctaattcaccttaacatgttcatggtaatatacaaagaaatactctatattatcaaaattatttgtactaattgttaacacaattaattaacacaatttatatgagaacgacataagtaaaaaagataaaatatggttccatacgacattttttactgaatgtatgtatgtaagttttttttttggtgaatggtagtctctcagatgtacatacttttcataattttttggacaaatatttttctctcataggaggtagggtgtgtgtatgtgcattcatagggtggtgtgcacacatttatatgactgcctatgattaccttttacattgctatttcaaaaagtacattcaagaaaattggtgagggtggcatgaagcagcaccatgtcagcgtggcttcttcgttaaactcacaaaaagtggtcgctacatatatacataatttgagagaaaccttagggctacaaagaaaaaaaacaaaaaaaaaactacctgatgggatggaccatatatgcactcttcttttttgtttttacatctcttgtgtatgtacgtgcatagggagagattacctagtttttaggagcgagggcttacctaaataaatctagtttgatgattgaaaataatggattcaacggtttaagtgcaaatcgatggctagatgttttgtttttcccatatattttttcttaaattttctcctatttattagagcatcacatggcatcttacaagtgtttgtaggagtagaggaactctattactcatactcaatatgagaaattataaatcaaataatagttttgaagaccgtgttgagtttggttgtatcttatattatattatgtgatagagggagtataattagtcagtttttaaatcaaaatctcggaaataaaagatacaacgttgagtctccatcctgaaaacatataactttcaacaaaaattaataaccaactagtcgcatattacatattagcaaaacatataactttcaacaaaattaataaccaactagtcgcatattacatattagcaaaacatataactttcaacaaaaattaataaccaactagtcgcatattacgtatcagcgaaaatcggattcgacgagttaaggaagaacttatccctctcccccgcaaagtactgaacaggagaaaatactgtagcacaagtacggtttactgtttattggtactgtgctgttttaatcgggcatggctagcgtgcacgcgcgaggatgctaactcgcgcgcacgcgggcctccgcctcctcaacagataacgacgtgcgtgactacgtcactaatcctgacaattagcgttaatcatggtgtttagtgaaaatgctacagtaatttcccaataaaaaaaatgaaaacaattgattttgaaaattttcaaaatacgattttaaagtttttcaaaatatcgatctgaaagttttcaaatccgagttagaagttttttttattttgatttaaaagtttttaaaatttgaattgaaagtttccaaatctgaattgaaagtttcaaatttcagttgaaagtttttaaaaattgagatgaaaagttgaaagttttcaaaatttaacttcaaaaatttataatttcgagttgatagttttcaagttttgagttgaaattttttaaatctgagttgaaagattttaaatctgaattgaaagtttcaaatttcagttgaaagtttttaaaaattgagatgaaaagttgaatgttttcaaaatttgacttcaaaaatttcaaatttcgagttgaaagttttcaagttttgagttgaaattttttaaatctgagtttgaaagatttcaaatctaagttgaaagatttcaaatctgagttgaaagttttcaaatctgaattgaaagtttcaaatttcaattgaaagtttttaaaaattgagatgaaaagttgaaagttttcaaaatttaacttcaaacatttcaaatttcgagttgaaagttttaaaattttgagttgaaagtttttaaatctgagtttgaaagatttcaaatctgagttgaaagtttttaaaagttgagatgaaaaaagaaaaaaaacgtggctgctcaaaaaaaaaagaaaaaaaacaggaaataaatagagtatgggttttttttgggcttttggcagcggcgcgcgtcaattagcattctcggttttaatctggactgtcctttgcaatctagatggctacgaatctttcaaagtcacgttactgtgcatctctgcctttacttaccaaagtcaggatcctgattccccaatgccacccccgccgcgaaacgcctaattggcgactagccgggcgcccgctcccccgcgcggcacggccacatggcgcacacagaggggggcgggccgggccgggcggcaggagggcgacggagaacttacgcgtgtccggttttttttggtttttcttcggttttcctctagtttttggtttttcttcggttttccccggttcttccggttatttgggtttttaatatatatataaactctgtatacgtacgtatacaaactttgtattcatgtatacaaactttatatacgtgtatacaaattttatattcatacgtatacaaactttatatacgtgattttttttgttttttcgattttttaatacgtacgtatacaaagtttgtacatatcgtaatataaagtttgtacatgtcacatacaaagtttgtacatattgtatacaagtttgtataatattagtagtagtagagtaaagtagtactgtaccagtagtaccgtagtactaaagcgcgccactgtgtagggcagcagcagtagtactactagacaaatagtactagtagtactaggactatactaggtgggagtggctctggtcgccgcgccgattaggggta

SEQ ID NO: 2119 - DNA, 14188 bp, Oryza sativa
  unsure (1)..(14188): unsure at all n locations
cagttccacgcgcgcctcctcacctcgggccacctcggcgcccacccgggcctccgcgcccgcttcctcgacgcgcctcgcgctctcgccgcaccccgccgcgctcccccacgcgctgctcctcctccgctccctccctaccccggccaccaacgacctcaacgccgcgctcagggggctcgccgcctcgccgcacccggcccgctcgctcctcctcctcgcgggccgcctcctccccgccctgctccctcgccccgacgcgctctcgctctccttcgcgctcaaggcgtccgcccgctgctccgacgcgcacaccacggtgcagctccacgcgctcgtcctccgcctcggcgtcgccgccgacgtccggctgctaaccacgctgcttgactcgtacgccaagtgtggagatctcgcgtccgcgcggaaggtgtttgatgaaatgaccgtgcgggacgtggccacatggaactcgctgctggcggggctagcgcaaggcacggagcctaaccttgctctcgcgctgttccacaggctggctaacagctttcaggagttgccgtcgagggaggaacccaatgaggtgactattgttgcggcgctttccgcgtgtgcgcagattggcttgttaaaagatgggatgtatgtgcacgagtttgctaaaagatttggactggatcgcaatgttcgggtctgcaattcactaattgacatgtactccaagtgtggctcgctgtcaagggccctggatgtgttccattccatcaagccggaagaccagacgcttgtgtcctacaatgctgcaattcaggcacattccatgcatgggcatgggggtgatgcactgagattgtttgatgaaatgcccacacgcattgagccagatggagtgacttaccttgctgtgttgtgcgggtgcaaccattctggccttgtggatgatgggctcagggtattcaactcgatgcgagttgctccaaatatgaagcactatggaacaattgtggaccttcttggccgtgcaggccgtctcactgaggcatatgacaccgtcatttctatgccatttccagctgatattgtcctttggcagacattgttgggtgcagccaagatgcatggggttgttgagcttgcggagttggctgccaataaacttgctgagcttggttctaatgtcgatggtgactatgtgctcctatcgaatgtttatgcatccaaggctcggtggatggatgttggtcgagtacgtgataccatgcgaagcaacgatgtgcgaaaagttcctggcttcagctacacagaaatagatggagtaatgcataagtttattaatggtgacaaagagcacccgaggtggcaagagatatacagagcactggaggacattgtatcaagaattagtgagctaggatatgagccagagacaagcaatgtactgcatgacattggggaggaggaaaaacagtatgcattgtgttatcatagtgagaagctggccattgcatttgggttgattgcaacaccacctggggagactcttcgggtgatcaaaaatctccgaatatgtggggactgtcatgtggtggcaaagctcatctctaaagcttatggtcgtgttattgtcattcgggacagggcgagattccatcgatttgaagatgggcagtgttcctgcagggattactggtaaatagtggcatgctggatcatttaaaggataaatttggcatgagctcgtggagatgaggtcaaaaaggatgatataacatgtctctgatccagcatatcgatttgtatggatactggaacatattcttgaaccatgcatatcacttctgacacttcacacaatgggtcaaacatcaaaaggttgttcgagatataatccagggctccaggcttgctgttgcagatacattcaatttagtccccattgaaattaatcttgtaagttagggtgtgggtggtttgaaaatcctccacttagccttcacagagaatgatcttgagaatgaaataccaaatacagtatacacggtttgaggtttccggatggtttctgctgccactggacctcacaaccctacaaaggtttataatcaccaagagtccaggacacaactggatagtcacaatgccgtaggttacaactagcattcagctggtaatggtatggtactaatgaaaaactgacatcaggataggagcatgctatttttcctttcagggagacaacataatttttcatatctacggagcgaagttttccttcaagtctttggttctttgtcccgattccttaatattgtaagttacagtcatggttcagctgttccattccattaatagctgatgatttcattgtcgattttgatgatgcataataagatgcgcctttatatggtttaatctagaatcccttgcaatgatgatactatagtgatgaagtaaacttatcctggattataataaatacaaatttttgccttatctttgtgctatgatcattgatgcatttggcagttttggtcagtaccaacgtggtcgtaaaataatcattgcatgatattttccacacataattttgtttgcagtggagtttgggctatctggttctgtgtgaaattattgggttttcaaaaacatttcattgagcgatgtcatgtagcttcctcacaaggatttgtcacttttgcaacagtggaaggccacgacgcaggtgaaactagcaaaaaaaaaagatggacgagctccgggccttgtttcttgccagactttgtcttctacacgcggcaagagatacaggatgtggacggagaaaaagatgctggacgcgcaggtgaggtctgctcttggttttttaagcaactgcatctatgttaactttgatggtcaaagttagtcatgtctcacttagaacaaatctaaaatgacaataagtttgaaacagagggaatgttttacataatcttacaattaattattacatggtctaaaggaaaaaacacattgaattattgaaaaccaagtgtaagcttaaccggtgttgtaaataatgatcccttagatacaactttcgtttatattgaagccgatttatgcacgggagaatgtttgatgctgccaacattggggccattggtgctgccaacattggggctcttggcactgcacttctctgttatgtaacaccaaaggagcaccttggattgcctaaccgtgatgatgtttagacaggcatgatatcctacaaaattgctgctcatgctgctgatttggcaaagtgccatccgtatgcacaagcatgggacgatacactaagcaaggcaagatttgagtttagatggttggatcaatttgctctgtatctggatcctgtgaccactatgtctttccatgatgaaacattaccatcggagggtgccaaagtagcacatttctgctcaatgtgtggcccaaagtcttgttcgatganannntgtgtggcccaaagtcttgttgatgaaaatcacagaggatattagaaaatatgctgatgaacatggttacaggatagtggaggaagcggtaataccaggaatgaatgctatgagtgctgagtttttggctgcaaggaaaacgatcagtggggagcaacacggtgaagctggaggggagatctatgttccagaaagctatacagctcgcaaataaggttggtctttttcttatgatgtatagttcaacttgtgggagatgtttggactcttttgttctgaatgtgtagggttgtttactcggtatgaagtaattagtcatctgggagtaaaatggtctagtgccatatttcaatcagttttacataaataagccattagtgtgtgcttaccgtcttgaaacagcgtcagcttgttgttggcccaataacttcatacatgctagtactagttatttagcattagtgcaacttgttacaaatatttctgaattatctggactataaataaatactactcgagtactatctaccatttggtaaacattctgctaatccttttatgtcagaattgtttcataaatctatgagaactgttgtaattttgactccacacattctcttcagtgatatttcttaagggaaaattactctcacagcaatcctttgaaatgggtttgcttgtacatttgaaatttgacactaactgtaatagcagtggatagctgctctgtctttatcaacttctacttgtaatttcagggaccttaataaacctttagtggcttggacttattgtgcattactgcaaaggcactaacttttatatcactataacatgttctcggaactcagaatacaatctctgtgcagatcatcttggcgtccatctactccgggtgataaagatttactgactggagcgtttatcagcagcactcaccatcctatgttagggaggtggtaagcagtttatgtgctttgataaagctggtgttgcttagctcagtttctcctaacccatccacttttcgagcttgtatgctactccttttagtattgtcaaaatcttgtttcgacatgaagtgaaaagttgtgtgaaaagatcagtaggatcttgttcgaacctgttggcgatcagcctttgaaccccaaggtgttcgacgaaatacaaaatcaaaagagagcattttgcaccgcgtaagcttgtagcattttctgatgcatttattaacttaaatagctcggcgatcgtgccatcccacgatcgagcgctctcctcgccatgcgccctacgactccatcatgcgcttcccgactgagccgcgcaatcccaaggcagaaagcacatgtccacatgacgcctactaactccgacgcgctcgcacatgaacaagcatgcgtaagagcccatggtacaaacgcacacgatccccagacacagacatcatgtaccatgaagaaacgcagagcagaaatgggtacggcgctaactcaacaggaccatatattaaatgtttagctagcttgcactttgtctgaattcccgaatagcactgcaaaatgaagggcaatcataggtcaggtactatcagaatgcaataaccaagcatacaagtaaagctctgcagattgacagtcctatatacgagaggatgaatcaatacctggcttccagcgcttctggtttccgactatgatcagtggctgctgaatatgatgctcttcagttccacctccctctgtactgccttttagctgctcctcttcatcttcctttaccatttcatcttcatagcgccttagaatttcgagagtaagacagcgagtctggatgctggccacgttcctaatggcatcttccaaagctttcacgtcccttgtagtgggcatcagaacaatcgagaacgacgattagatgctggaggctggaaaggtgcacaaagctctgctcaaacccaagtttggatgctgctttttgtgcaaacaactcaatagaaagcctttggagttttggcatagcgccaggttcaaacaacaaccaatgcaggcgactatgcctgaacatcaactcctttagacagggaaatccaccacagcctacagtgagtccatcctcccagccttgggcgaatattactttaagatagagaagcttgggtatacacccaaggaggttgatatctttctgatcattgcttctagtattatagaagatcacaagataggcaagattagaaagggaaatcatctgctccgaaagttttgatattccaacgccagaagtagaaagctctctgagaccgggagcactactacaacatgaatccatcaatgtatctgaaaacttggttgtaacatgtacatgtaatgattgaaggctatttttacctaactcatcgagagtcatgtaaaaggcgtccttgtacctctcgaaccttgctacatcacctccaaaaggcgtccttatgcgcagataccttagtctggtcagccgacggagctcttgtaaacattttatgctgtactctatgttgtaaaaaagagatagcatctccaaagcttgcaaaaatccaatttcatctggcaatctcattgggtaatcaacaattaggcgctctagtttttgcagtctacaaacacttgacggaatgtttatttcgttgacatgtcctcctccacgaataattagtgtttctagttgctgcagccgtccaatatccttgggcatctcggtaacatttgcaacattgagcttcagatacttcaactggaaaaggtatgttaggctgttaatatgctggctctccaggctcatgcacccatccagaaccaatacccgcagagcatggcatttcttaaattgtggtatttgctccggtttaggactgtcaaagaacagcgaacgaacatgtgagcagttgttcgtaatctccttgactattctattatctgtgccattggatgggaaccaggtcctccgaatcttcttgaaagaactccaatgctgttgttcatgcactattgtgacgaaattctgtccagttgataggctaatgataagatcaagcacaatatcgtggactcggcagcaactggccctaccatcatattggatataaactggttggatcaagcttctatttataagctcattgaagtagttctctcctacttgctcccgtgtttttcccttcgcttcaatgatgaatccttcagctatccatctccatataagttcttgtctatcaattacataatcctctggatacatgctgagatacaacagacaatttttcaggggataaggaagatcataataactgagcatcaaaatttttctcacttcgacgtctgagtttagtgtaacaccaatagaattgtgcacttgcatccactggtcctctgtatcaggtttgattgatagcaagctagctatggagattatagctaatggtaaactacgacatttcgatatgatggcatgagagatgtcttccaggtgaggcgggcagcaactctcagaattaaaagctctccggtaaaataatctctgtgaatcttgctcttctagtggctgcatgctgtgaagatagccttcagatgtggtacggctgcatgcttcagctacggcagtgtttcttgttgttgttatgattatactgcccaaattattctctgggaaagcacaattgaccaccttccacgcacctatgtcccaaatgtcatcaaaaacaatgaggtacctgcgtacaattaaatttatgatccagtcatcatactttcgcaccaatgtggatgaatgaacatacataaaagctagttaccactcatgtagccatagctaaaagactggtattgatcgaagtacagatgtttttgtggctagaatattacaattaagagtgcaaagtgttttattgggtttgttctagttctagatacaacgatatatgtctgtacatttcggatttgctatatatcttgcgacagaaaattgaagttggaaacttccaaatttaatttgtgctgtcagataggcgttaagattcacgattcacgtgtgggggaggaaaagagaatgtatccgcgcatgggatgaggatcgactcatcaaccgaagctagtggttgtgctagatcgtgattttatttgtaatatattagacctatttctgtatttgaagagaaaaaaaatatgtttgaaacctctatttgctgttatgttccacaaaaattagaaaacataaaaatgtgtgtaccttttatctttcaagaatcctcgaagatgactgatgaggttctgctcatcttccgatacatctccattgctcccgagtcctttaagcatatcaaccaagatcttccttatattaggggtacgtgaaatagacacaaaagttatacacttaaaatccccttgtattgtcttgtacacttcattagctagagttgtctttccaagaccacccaaaccaacaatagaaaccactttacgttgctctaatggcttgcctttggtcatgatccacttaatgatcttctcccttggaccatcaatccccacgagcctctccacctcctcatacaatgccggtagacggggatcaatttccaccacacttggctcggagatgaaatcatcgatctgattcctcttgcgacgttgatcctcctccataacccgattcttcagttcttggatacactctgtgatctggtgtttgccccataacttctttatcttgcttcctatcttctgaacaaagttggcattcgcatcgccacaactcaacttgtggatgaagaggtcgatgcaatcctcaatatcataagctagctcgagcatgttgttcctccactccttggtcggcccatcaagcttgtcctccttggtcgacagatgctcaagcaagacactgatgctgctgagctcattcctcaaaaagatgatatccttcttcacacttttgagcagcttgtactctccctcgaccaaggcggaaagcttggttagaagaggattcagcacccctactgaagcactaacaaatgctcctgccatctctgttccactctctgctgtttcatcaaccaaccatgcaacgtccagaaacaataacaagcatgaagtacataacacaaacggctagccaagacaattctccaaaagtgtatatgatgtagatgcacccaccaactgcttgattcgtgctccgcgccacgggaggagacgccgggaaaggagcgacgcacggtggaggtggcaacctgctgggagctgccgccagcagaaggaggcagagccagcctagtcgcctcgcctcgcctttaagcgacttctaggtgggttaatcggaggggaatcggtggcgagatcagcctaactcacttgattctcaccatcacaccggcagtgaggaaggagcccattaatagcttttccattgtgcggtggttgttggagcatcgaggaaggatacgccaggaccgaccgggggaataaaaccgagggaaaagaaggcctttcggtgccgttggtgggacctgcgatttgacgtcacatgctaacgctatggaaattgacatcggaaaccacacgagtacatgaccatgaacatggcctttttactcacatgggcgatgcacccagacttggttggattcattggattcatatatattgttcgttacttttcttactctgtatacagactattcaaattattaaacaagaaatcttttttaaaatgtttctatacaaaagttactttataaatttatattaatccattaaatctttagagtaatacttaattaatcatgctaatgagcagcaccgttttccgttgaaggtgggttcctaaccccacattcctaaagcaaccctagttttgtttcagctttaattgaaagagcacgattaataattagtaaatcagcaaactccctcgattccgaaaattgcgttattctgacttaccacgtataaatacttctcgttcctatctaatataccctactaaaactagtaatgtgcccgtgctaggcgatagttgcatttacattgcttgaaaatgctattggcctatttagatctccagacaaaatttttcaccctgtcacattgaatgttcggacatgcatggagtattaaatataaacaaaaaaaataactaattacacagattgtgtgtaaattgcgagacgaatcttttaagcctaattgctccatgatttgacaatgtggtgctacagtaaaaatttgctaatgacggattaattaggcttaataaattcgtctcgcggtttacatacggaatctgtatttattttgttattagtctatattaatactttaaatgtgtgcccgtatatccgatgtgacatgccaaaacttttcacctctaaatctaaacacagccttagtacaaaatgtaatatacatagatcacaatacgattataatataaggatctagggcctgtttgttttgtgcctagtgcaccatgccataaaattttgcatgcctcgagcaccaaaatcgatggccggactcaggctaatcacgtctccccatatgtcaatccaggcgggagtgaaagagtcccaggctaggaaccaaacaaagcttaaaataagccaggctagtttaaggctggcaaattcttttcaagttaaaggtagacacacctattgggtggcatggggcaacctgcttagttacggttcacgtggcttaacacttggaacccttttaatactttttggtctaggcttaggccacatattatttagtacacaccattggcttagtccattgatcagctattctagcctttcaagcatgacaaaatttttgattgattcatcttctgcagtccacactcgtcacgtcgcgtctttggcatcattcgttcgtattctcactcggtccactaagcctggacacaccgttggtgccgcggtccagggaacgagcttgcaccgtgtgcaggcgcgggcgtgcggctcgatgattgtgcctttgttgcggcatggcagaagtgcgccggcgctatcggcctagccaaacggttgcagcagcagctgcaggcagcattgcaatagaccccaacactagcgctggtgttgttgccttatatgtattgcaattggaatatattgagtgtacactgtttttatgcaatctatctattatattattaaaggaataaaaaaaaggagcctccacgttcgctctcatggtctataaattctcatattaatcgaagaaaaagaaaaggcagagtctatatagaaatacaatttagaaatagttgaaatttggaattaaaaaataatgaatattagaagaggagactagagtctgtatagaaatacaatttagaaatagttgaaattcggaattaaaaaataaggaatattagaagaggacactagagtccatatagaaatacaattaggaaataactaaaattcggaattaaaaataaggaatattagaagtagagtatagagtccatatagaaatacaattaagaaaaaaaatagaaattcggaattaaaaataaggaatattagaagtagattatagagtctatataggaatttaaaactaactaaaattcagaataaacataacaaaattaaaagtagagttttaagtccgtataaaaatacaatttacaaataactaaaattcaaaattaagaaaaacatgggaagaagagtttaaagtcaatataggaatacaatttagaagtaactgaaattcgaaattaaaaattaaagaatattgagagatgaatttagagtctacatagaaatacaattagaaataataaaaattcagaaataaaaataaataatattggaagaagagcctagagtctatatagaaatacaatttacagaaaattcggaattaaaaaaaatatgaaaagacgagtctagagtccatataggaatatatataatttacaaataactaaaatttgatattaaaaataattaataactaacacgtatataaaatacaatatgaatattacacatttgtagtttcgtaaagttattgcaaaatttaaaaatttgatgtcattctaaaaaaattgaataatataatgagaaaacatatatgctattatatgagagaaaatataatgatgcttgccgcgcaatctgtgcgggccaccatgctagttgtaatataaactagaaaggtagcccgcgcatatacgcaggcatcttatttgatgttgcttgaatttttattttggatgttttatgtgtgggttaatttttcttttatgttttatgactctcttataaatttgtttttgtcaataattagtttggggttgctttgaacattacatcagtatattggttatgatactctttgaactacccttgcaacatatgaattctaaactaatattacttgaaccgtgcaatcttaaatttatgagaaaatattgtgtcgcaataatagagttgattactattagactatcatttgtactatgtgtgtatcttttttgaatatttagcatatcttattttatagaactttcggttacaaaatttcttttatagtacagattatttgtagattttaggatatatttacttacatttacttctacgcccttctttctttcacatcccatcttctttttgaaaaaaacaatttatctgaaataagtatgtgtggagcatttgtaattggtcagtcaccgcggactaaagtataattttgtttggttaattcttttttttacatcgtatattttcattgcattgattctgatatataagcttcgtatgatttatgttccctaatttaccaaactgagtatgaaacacccatgtaccatttgtttttaataggaattaaagagaaaaaattacaagccctatactccgaatactttaggttattcccatactgtcctaactgctgaataaaatggaccccacattttgagcttgttcatatgatgatataatccatatcactaatttttcatgatttttcataattctcgattgccatgcaaagcaccaatatgacttgctacttttggacattgtagatttaatttaatggtgcatatttatgaaccaataatggatatatagtgatatacctatatactgttctttttcaaacttctcaataatgtttgtaacatacctgtgtacgtccacgtatagagcctgggtggagttgagtttgggaggttaatttttttcctttaagacagatctgatggttgtaaataatagatccattttacttttatcattgtagagttaatttaatttaattattgtgaagttatatgaaagatgataaaatctatatcattaattgtttataatctttataacagtttaaatactatgcaaaagtcagaaaatataacaaaaaatggcatatttcttttcgaagtgaatatggatatttaacactaaatttaaaaagttacatgtatggtttagatgttacagttgtttaattttgtaacacaaattttctaacttaaaatagcttgaaaataggagaaaaagataatgaaaggattgagggagaggggagtacgtactattgtgaatagaattgatttagcgagagagagaattgaacacaagaatgtagagggaatgaatgagcggatttctttattgatcaatgcggtacaatttatagatggggaaggggtggcaaccggagacgcgatggttgggaaccatcgcgtccgttgccaaggagcgcctagggaagaggcgcggttgccttcggttgtgatccatccttttatatggatgagatcaccctgttgtttcataacactccccgtaaagataatcatagaaataattatagttaaatacatcacgtaaaactcctcgaaaacccagtgggaaaaataaggagagaaccgtgatatattattgactatttttagatctctatgagtaaagctcatagtatgatccaaaatagtataatgtctacggttatcatttagtaaaaactctagtggggaaaagccaaatgataagacatataatcttatgttgatattacctcgttaaaaactttggatgagaaaacctaaagggtaaaactcatacaaagggaaaagagtataatatgacgaaaataggttattttccaaaggaaagtactccccctgaatcttgcaaatttttaagtcgtctcataccaattccttcgacacatttaaagaatgtggagtatggcagatattttgtgaacaaatcagcaagattatcacatgacttagtttggaagatgtttatctctccatgttgctgaagctcatgaggataaaataatttgggagaaatatgcttagtgatgttgctcttaatataaccagtttccatctgaacaacacaagcggcattatcttcatagataatgctaggttattccaatgaaccaataccacaagatgttaatatgtggttaaccattctgcgaaggcatacacattcacgtgatgcctcatataatgcaattatttcagaatgatttgtggaagtggctaccaaagtatgtttagaagacttccatgaaatagcagttccaccttgtaaaaatacgaatnnnnnnnnnnnnnnnnnnnnnnnnnnnnnnnnnnnnnnnnnnnnnnnnnnnnnnnnnnnnnnnnnn

SEQ ID NO: 2120 - DNA, 1692 bp, Oryza sativa
cagttccaccttgtaaaaatacgaatcctgtttgtgatttggcgttgtggggatcaaatagatagccagcatcagtatacccaattaaagtcgaatcctgtttttttctaaaagaaaagtccaagatctcttgtgccattaagatatcgaaagacattcttaactccggtccaatggcatttggtaggagcagcgctgtatcttgctaatagatttactgagaagcaatatctggcctcgtactatttgcaagtacataagtgcgccaatagcactaagatatggaaaatcaggtccaagcacatcctcaccatcttcctttggtctaaatggatctttctccacgtttagagatcgaaccaccataggggttttagaaggatatgacttgtccatattaaatttctccaaaattttctgggtatatgcactttggtgcacaaggattccagaaggtaaatgctcaagttgtagacctaagcataatttggtttgacccaaatccttcatctcaaattccgtctttaaataatgacgtgcttcattaatatcttgtgtattgccaatgatgttgagatcattgacatataccgagataatacaaaatcctgtgggggactttttgataaagacgcacgggcaatcatcatttttagtgtattcctttagtgaaaggaattcacttaatcggttgtaccacatcctgcacgattgttttaagccataaagtgacttctgcaacttaacacaatacatgttacgatttaccttctgattcgggatgttgattccgtcaggaacctttatgtaaatatcagaatcaagtgacccataaaaatatgctgtcactatgtccatcaaatgcataaatagacgattttgtactgccaatgatattaaatatcggaaagttataccactcataactggagagtaagtttcgttgaaatcaacgccaggtttttgcgtaaaaccttgtgctacaagccttgctctatatctcatcacctcattgttttcattctgtttctagacgaaaacccatttgtatcccacagaaaagataccacgaggagtaggcattacagccgagaatacatctcttttgtaaagcgaggctaattctgcgtcaattgcgtccttccatttgttccagtcagagcgcttttggcactcttttatagacctaggttctggatcaacttggaggcaatcagcaattttttcagaaaaattaatgtcgacaattgtagctcttctatcaaaagattctccagtttcagagtagttgatggcaatttcatcaacccttatagactaatcgtgatctatggaaaaattaatgccgacaattgtagctcttctatcaaaagattctccagtttcagagtagttgatggcaatctacaatggttccgaaacaatgtgtctatggtcttccgaattcttagtctcagcattgtgcaccgctgttggtatttcttaacgacattactagaaatataattcccagcaatggcgcagaaacacttatggtatattatggttacagagttcatccgcaagcgcacggatataccattgtagcatttcacctgagagtattccaagggtatcgtatttattttatcccgtgggaagatcatgtagagagaactcaactagtatttatatattacttgtgataatcat

SEQ ID NO: 2121 - DNA, 5452 bp, Oryza sativa
actagaaatataattcccagcaatggcgcacaacacttatggtatattatggttacagagttcatccacaagcgcacggatataccattctaccatttcacctcagactattccaaagatatcgtatttattttatcccgtgggaagatcatgtagagagaactcaactagtaatttatatattacttgtgataatcatattctaagcaggggttaagataatccaagagtagagtgacacacaagcattactactcatcctcataataaataatctaagctaggtggaaagaaaagagaaagaaaatctattcctaacttctaatatacatatatacatacattctagttaactgatatactagctaataccctctatccgatgccctcctggtacttcgagaagccacccctgactgccgagttccttatgatagcccgtcatgaccatccaaccggggctaaatacggaggaataccctccccaggaaattaacttagaattatatataggcgcggaggaatacccgtattgagctgtcaccatcagcgacccacctttcattcgcaatatataaccccaaataatgatatcctgtaatctagacaccacgtctaaactaccagatactactctaatatcatcgtcatgacatagagtaattgcataagcaaacactatacccgaaccaaagcatctcccagataagctagcagtatattcagtataacatgaacataatgtaaagttggtactcatatactcggaaagtatttcaataccagaaatgtatttagaaaagtattctaataaaagtataaagcttacaaaagaggaaagaaaagctactagagccatacccaaactcttccgaaggcttccggactcctgattcctattctaattctattccactagctagatactactaaactaaacttgagaggaatgagagagctcttgcttgaggtgtgtgttaaagtgaaaagagtgagctccttatataaaggtaggtatgacggttgtggaaggggaattgtccgaagtaccctccaaccgtcattggggtgtaatcttggacgtccatgccaaaccctggcctcaacggtggagatgggggttcggccgaaccatgggctagcccaaaccagcccatcttcggctggcgacttcctctattgcttcactccacagacttgtgaattttggcccaattcatcgtgtcaattctgagttcttggcccattcatacataagtctggttctcgacatcgtccgattgatttatcgtttgtgttgatgtcgattttcctccactttattgtcattctcagcaaaaggttagtagacctaatactagtagaatattattattctaacaaacatacgcattgcaagcatcactagttctcctctattttggtaattttgacggttgaaattgatcgataacgaccgtcaacaaccaccgagctaggttgcagactatcacgatctgcttgatatacagtatcaatttggtgtgtaccaactaaaggttggtttgcatttaccgtctttctttgcttattagcaattgtttctcgctgagtggccatacttcttcctctctttttagtgagtggaagttgagtggttttatttgagcgggaatgaaagatttagtcacacctttataattggtaaatgcatttggcaggttatttgcatgcctttgcaaatgtataattttctgaacttgaagttcaatttcagtagtacgtgggtctggggctaaaataccctgggcatcccaatcaatttcctgacattctttctggtacttgaagtctccccctaatgccgggaaatgttcctcatcaaagatagagtcaacgaaccgggcagtaaatagatcacctgttaagggttctaaatactttatgatcgacggagatttgaatcccacatagatcccactttcctgtgtgggcccatagcagtacgctgtggtggtgagatcggtatgtatacagcacatccgaacttacgcaaatgggaagtacttggaggatttccacgtactaactgcattggggaagtttcatgatatgcagttagtcgtagttggacatggtcagcagcgtgcagaaccgcataaccccaacacgacgaaggtaatttgcaattcatcaataatggtcgggcaataagcttaattcttttgatcaatgattcagcaaaaccattttgtgtgtggacatatggaacagagtgctgaacctgaattcccaatgccatacaataatcattgaaagcatgagatgtaaattcggcagcgttgtccatacggattgattgaatcctatgttcaaggtaatttgctttcagccttataatttgagacattagtttggcaaaggcatggtttcgtgtcgatagaagacacatatgagaccatctagtagatgcgtcaatcaaaaccataaagtacctgaacggtccagatcttggcacaatagggccacagatatctccttgaatgcgttcaaggaatttaagtggttcggctctaattttgagataagatggtctcaaaatcagtttcccagtagcacatgcagtgcatacgaaatcagaggatttgagaaatttatcagtgatcaaatgatgaccaataaagttgccaataatttttctcatcatcccgatatagaggttcccaagtggatcatgccaaatgtggaatgcatcaacattttgaaaaattactttgtacgcaacatgtgcaatgggcttaatgtatgtatagtacaatcccgatgtgagagatggaattttctcgcaaatgcgtttgccatatccgttttgattggttaagagaagtaattcttctcgattatccatatgggtttctatgttaaacccattttgacggatatctctataacttagtagggtacgggttgaatcaggatacaataaagcatcctcgattgtaatttgtgtacccattgggagtgtaatagttgcttgtcccgagccaactattacagtatcgcacccagcgatagtcaaaactttgctttctctctttttgagagtttgaaactatttgatctccctaagtatagagtttgtggtaccactgtccacaagacataattcctctccaatcggagtgatatccttagacatctatagtgaaagaagaattgcttagtgaagaattctttatccacaatatatacatacatataataatgaaaacatcaaatacatagtatgacgtttacataggttaatagtacatactctaatgactagcaagtcttataaccttataatataaggaagttagtacttatctacttattacaaccaatattgttttgacaaactataggatatcaatataatgtctcaaacacactgagattaaagcagctttatctctaagtgggacgcactgagattacagtaaatctctaagtgggtctgttgagcagtattcgatgaacatatcgtccatcgcagagagtggagcgacatcttctgggagaacattgaggttgctctccggttcaacaggagcctagtgagaactgcaacctcagggcactcttcatgtgtaagattgaagtgggcttcaaatcttgggttctcagaagatttttttgtccttaagggatttttggtacaatagaacaagatatttcgggatgcggcagtctttagcgacatgagtgtcagatccacacctgttgcaatgcttgttaacattgctacgaggttgtggtgccttatccttcccttttcctttctttcgacccttgaatttgcgcctgttgttgttgcgtttgcgctttccagtcagattcttaggattattggaagaatttcccttgaatcctttcttattctcagcattattctgtacattgaagtgcacttcaggcagtggagcagagcccggggggtgctgttgggcattctttaaagaaagctcatggtgtctttctgcctgagtcaatgtatgtataagcagagaatgtttttggaaattgttagcgcgatactgttgagtcagtatcttgtcctctggaagcatagttgatagagttttctctatcttctctgcctctgttggctcttgttcgcaaaacttcaacctggagcaaatgttatgaacagcatggttgtattctgccacagttttaaagtcctgtaggcgtaaatgaatccactcataattagcctcaggccaaatgagttccttttgctgatcataacgctcttttagagctttccaaagggtgtgagggctcgtctctaacatgtattcatgtttgagatccttgtgaatgtagagcctcaaaacaaaaagggctgtattgagcttcctgtgctcaattggcaggtccccatcattaggttcctcaattgtacttaaaatccctcgagaggcaaaattgattttgatatcggaagcccagatggaatagttagtcccatcgaggacgagttcgttgaactcttttgttgccatgtccctacaatcatggttaacattatcaatttacagaggtaaattaataaaaacatgatattaaggttgtaatctcaatgcgaaatgtaagacttcatattttgtaatgtttcgaaaagatgccggtaataaacttgacaattcaagttagaattcgaaattaggtggcacaatgtggataatctccaagtaattaaacagtggagtagatctcttaatagtgggcaagttatacttgctacctaaaacacggtctccaggcaaatatattctggtgaataggactccactaccttgtgctcaaccaaaattcaaataatctcatttttcaaaacatattctcggaaaataacacatgtgggtaatcatcgtgagatgtagacctctgtgagatgggcgaggtgctcgctgcctaggttatgactagtgcggccaatttgtaggactccatcgggtaaacatctcaaaatgtagaccacttgatgatgggcaagatactcgctgcctaagttatggtcgatatgaccaaagtatagggctccattgacatgtgattaatttccgagtcaaagtgtgaagtggaacatgcattaaatcctccattaattatgttgtacataattaagagaatttgctaaatcaaaatacaaaatttatagaattttgtaaattaataaagcgagaaagtagagcgtgtcttgaaataatatgcaaaaggcatgttattaagacaacaaaaaaatttagtgaaacagggtatttgaataaacccctatgttaattaacacataacataaatggtctatagggccattacataataatgtgaaaactgatgaactgtttccactaaattacataaaacatagggactaaaatgtaattactgctgaaagtaaatgaaaaactaaaaatttaatggt

SEQ ID NO: 2122 - DNA, 2944 bp, Oryza sativa
tgccaatgggtaccatgcggctcggggagccatggggaacggcaatgaatgtatgcggaggccgggacggcgtgcagcggcggctccgacgtggccacgagttggagacggtgtaaagagaagcggctcccccgtgcgcgccgccatggttccggtacgaccaaatcctggtggcacgggagtgggggagcgtcgaaagcttggcgtcggctgcgacgttgatagaggtgagaaaggagcggttggtggtgatggagcggcgacgaacggggccggcagcgactccatctccagtgagagatcacacggcttgccaggcagtgtcaccaccgccgtccatccatggtgggcacagtactgtaccccctgcacaaggatccggcgaggtgcttcggcaaccggaggcggaggaggaggtgcgacaaggacaggcgggggaaccacaactggagttgcagtcacacggcggcgagggtagtggcggcggccacaaccctagccctgcctccgcgggatccccaacgcgtcctcctcatcgatcgacgaagaagatagcgaagctggcgtgcgcgctgatggcgagggaggccgagaacgggcatccatgatccaatgaaaggtaggcatcgtaccttccgttgtttttctattcgcttttcctgtagatcaaaaagtgatgttcttccttcttaaacttcgcgaactccttcgcgagagcgaaagtgctgataacgtattgtgaatagaattgattgagcgagagagagaattgaacacaagaatgtagagggaatgaatgagcagatttctttattgatcaatgcggtacaatttatagatggagaaggggtggcaaccggagacacgatggttgggaaccattgcatctgttgccaagaagcgcctagggaagaggcacggttgccttcggttgcgatccatccttttatatggatgagatcaccctgttgtttcataacacgtacattacatatatacatccatccacgtacaggtacttagtggggcccagttttagcggtggatttttctcaaagatagatctaatagttttaaataatgggtccaccggatttaatgaatttttttatttattagaatgccatgtggcggcataggagcgttcgtaggaggacacatgtcggcttaagagcgtttgtaggaagttcagtggacttttaagtatataataactaggaaggtagcccgcgcgaatgcgcgagcatgcgtcgtatgctaaatttgagacactaaaagcgaaatattaaccggagaatatatacctcgatttcttcagaaattgtttttttggcattacttgcttttataatcattaacctattagctttatattatatcatatctaagtaatatctataagcaattatttataatcttcttcatcatttgaaaagaaggtagatttattttctttagaaaatatgtgcaataactaatttgttcaagtacacttataatcacattagtgaggtacatgacatacatcaacaattatgcctaacatcttcaactctaagaaaagtatatcatgagtagttaatttgttgccaaaactatttggtatagaaaaaacatacctattgaccaatatactcgtgatagattaaggggtaatattatagcaggatcattagctggaaataccaaatagttttgaaaatgtagagaatcttaatcccacacaaactaaaattaaatcaaatttacttggaaaaacacaactaaattctattgttttattttttagacaagtagatttaaagtagtattgtatatttgtcaggtgatatttgacatcacaaaatatgttatacaattatttgaaaaattatcatatcattaattattatatgttggttccatatgttgtcatgtatttagcattacaatataattattattagtcgttaataattcatttaattgaaggaatacggcaattagatgaattaaaaaaagatggacaaggtcctctagttgaattgtgtgttttggagtaatatatatttatctcaaaattatagaaaatcctattttcagatcgttgattttttcattgtagtacttacatgcgtaagttttttgggatttatctttttatcatcaatatgtttttttcctttttttggtgaacagtaataagctgtatattttttcccaatagtttacttgtgtacttttggcttttttggtgaacatttacaaattttccattgtataccccgtagattgggaggaacagattaccttttaaatatatattatctaattaaaattttctataatttaatatagagtgttactggtgacctgggagtatttaatagcatcacatgccttaaaaagcgtcaacctgtgcattgcatgtgctacaattattaatattaaaaaatattagttatatgtaaaatacatgtttgttaaaatttgttgaaagtaaaacataaatttttctttgtaagtctaaggaagtaataatatttttttagtcctaattgaaaaaaaataaaaaatacatgtcttgttctaattggcttcggttgctgtagttttattttattaatgtcttgaactgatattttctatttcattaatttaaaaagttcaaaattagcaattaataagcaccatgatccatacttatgtatctcaattttttaattaccttaattaattaagaaaatttaattaattaagtactaacatacttaagtacgttttggacttataagctaaaaagtctcaaacatgtgtctttttccattgcttttcttaatattcataagccactcttacactgttaactcaaaagctaggttgaagtttttctctctcttttttttagagtaaaatacaccagcggtccttaaacttgtcgggaggttttatttaggtccacgaa

SEQ ID NO: 2123 - DNA, 1124 bp, Oryza sativa
agaaagagaaaaaagaagggagaggggagaaaaaaattaaaaaaatccatgtcattgtccacatggcgtgccacgtaggtaagaccacagtcaaacacggttttggaccggaatgatacaataaaccaagtttagggatcttgatgtgcactttgcaagttcgtggacctaagtgaaacctcatgacaagtttaaataccgctggtgtattttactcttttttttaattatgcaaagtccgtcggatgccttgctacagaattccttgctttaaacattttttgatttgtggatgagaccacatatagatcttcttaattgcaaggaaataagaaatacctacggtactgcagatgcaacgatcatatatcgatcttccttggtggcttggtctaaatgaacttttagatttgtgtattctcaacccttcaaatttacagggtccaatgatattagattagaaataacttaaaaacatagaaactaatgttgattattttttgaaaaaaaaacaatgcgatcgtgaagcttgctctatatgtgcagatatcttcagatatcttaatgaggaagcatcgccatatacctgtgtcaatggtaatgcagatatagtactgggtgcagataccctaatgagtaccaagtgcttgatcgatgcatgataatctctgtccaaggctccaaaggcattccggtttacgctggcagtgatctcggcaaagacagcaataataaggattttttgatttccttgtaaaagaagcacatatggaattggtagctttactaaagtttacaaccgaattcgattctgtagcatgaaaataggagatcagagcgcatctaggattttgttagattttggaggctggtatgcggaaggggaaggaggtggataggaccggtgtttataaattattagagtgtcacgtggtggtttaggagtgtgtgtaggaggccatgtgacagcttaggagtgtttatagggtgtttcatggacttctagtgtataatagatagattgaaagatatggtagagttctaggatttaattgtataagaatttcgggacctactgaattgcataggatttaatagttataggattgtacaatatttcttgt

SEQ ID NO: 2124 - DNA, 713 bp, Oryza sativa
tcaacccgcccataaccgcgggcacggctattcgaatagttttactctgatcagaggtgtaccactgtacccacaagacacagccccacatcatatcaccatgtccctcaataccaccacggtacctcgaaaaggagctgtgacaataccccttgcacaacacaatccaccatagcgcacctttcctggatcataatcacccccttataaaacaaggcatggactccccagcgacccccgtgggcttatctccgccacttctcagtctagtgctccgcaatgaaccatgttatacaaaaggtaaagccgttgcccacgctggcttgtggttggcatggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggtaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacag

SEQ ID NO: 2125 - DNA, 921 bp, Oryza sativa
acatggattgctgtcattttcaaactaagtttgttatgtattgtaagctattgttttacaaatgcactttacatgtcaagggcgcgtggaactttcatgatatatccagacagatatttgtatgtgtaaagtgagttatgaaaaatatattagttatcaataactgcttacgttcaaatgagatatgtagtaaagtgcccttacgacgacatgtctaatactacaacggtttagacattccgtgttaaaaatcttatcatagcctttaagaacgtcatcgattttatgaccactttggaaaaaaatctgaaagattagcttgcgtttattttgccaaggagttaaaaaacacgttagagagaaaaaatcacgaaaggaaacgaaatcgtgacagaggagacattatttctcataacagctcagctaacacgtattgacaacgatttgcctataaaactagctagatttttctcacggtcctagatggaagaacgaaaggacatttaggaggcagaacataaatgaaaatagccccttgctagcatcaaaccatggatcgattgtatcacggcggtcatcaacgataccagcaaagaacgaaatgcctacctattcactctcaggatagagcagcggctatattttgtgactttaggtgaaaacagatgaaaccgatatgcatgggcattaatgtggactattaagcatatatgaattttatttaggcagcaatgcttaatgtttttaacttataaattgatatttccgcgaccaggccttcaaatatgaaaatttaacttcatgttacgcggagcgtcttgtttcggtgacaaggtaagattgaattaacaatgatatggcaaatggtcccatcgatacttacattttgaatagtggatttataaccgctctaggttgggc

SEQ ID NO: 2126 - DNA, 3864 bp, Oryza sativa
ggagaaaaatctgaaagattagcttgcgtttattttgccgaggagttaaaaaacacgttagaaaataaaatcacaaaagaaaacgaaatcgttgactgagaagacattgtttctcataacagttcagctaacacgtattgacaacaattggcctatagaactagctaaatttttctcactgtcctaaatgtaaaaacgaaatgtcattgggggaagaacataaatgaaaatagcccttggctaccatcaaaccatggaccgattgtttacacgcggtcatcactgataccagtaaaaaacgaaatgcctacctattcactctcaaggcagagcagcagctatattttgtgactttaggtgaaaacagtgacatcaatatgtatcgacagtgtgatggccatcaaatgaaactaataagcattgctgaattttattaaggcaataattcttaatattttaaaactataagttgatatttccacgaccatgtgacatcccggcctagagcttaataggatcactagaatactcatatcaacaagttgcaacttcttttcctaaagccgatctcaaaagaactccgaggttaagcatgcttggcctggagcaatttcatgcttaacctggagcaatttcgggataggtgacccaccgggaaattctttacgggtgcgtacgagtgaggacaaagtgtgcagaaaagggttgtgttggtctgtgagagcagtctatgacctatgaaagctgtcagatgtaagcggggagaggcgggacgttacaaagtggtaccagagccgactctcgtggtttcacgggcgcgtgtgtcgcagttacgcgggcccagcctgggagaggtgggacgttacaaagtggtatcagagccgactcttgcggtttcacgggcgcgtgtgtcgtagttacgcaggcatggtgcgcatggctggtgtggaccaggatggtcacacagcatggcacatgagctggcactggacacacggacgtggccaaaaggggacgttcctggcccggggtgaccgacgaggtcgtcgatgtcttaagggggtgaggatgtgacttcccggcggtgtcttaagggggtgaggatgtgacttctcggcctagggcttaatagaattactagaatactcatatcaaagccgatctcgaaagaactctgaggttaagcgtgcttagcctgaagcaatttcgggatgggtgaccgaaaggcttgtgttggtttgtgagggcaatctatgacctatgaaagctgccagatgtaaccgggctcagcctgggagaagcgggacgttacagaccatgcctttaaatttgaaaattatcaaacatcacaatggcgtttctctcccttctatatttgggcaccgtccccgagtataggaatcctggaccttctcaatttctattgacgagatgatccaggtcaataaacttttctctatgatggttgatctgaaaagaatggtctaacatgtgttcatatcgcctgcatcatcgtcctccgtgtcacgcctagaaattcactagtaatttacgaacttatttgtgcataaaatcctcgtccaggaatcagccgaggattttatatacaaatccattataataacatcgttacatacttacaaaagaatagaaaaacagcagcggaattaacggtctaacgatggcttaagctccactcccacaggcagctcaactggggtataagccaaacgtcttctccttctggatcattttcttcaactgaggttgattgattatttcaaagtgagcatatgacatactcaacaagccacacagctaatatgtaagtgtacaaggataccaaaggatggaataatataggctcatttgcaaaagtagcatttagcaaacatttaagagtagtaaaacagtagagttattaattatcaattttaatcaacactgcacaggcccaaccatcctgtacaaccatacccggttgtacagatctaactccaaaccaggagctaaacaaattattactagttatagcatcaataattattgtgataggtgtgagactaatcacgaaaaacattgctcaacccgctcatgaccgcgggcacggctattcgaatagttttactctggctagaggtgtaccactgtacccacaagacacagcaccacaacatgttaccatgcacctcaataccaccatgatacctcggaaaggaactgtggcaatacccctcgcacaacacaactcaccacagtgcattatacctggattataatcaccgaggcatggactccccagcgacccccacggatttctcgccacttttcagtctggcaccccataatgaactatgctatacaaaaggtaaagtcgttgcccacgctggcttgtggttggcacggttaatgtctcataacagtagctcgcgaactggtccttaattgttatgagcacgaccttcaaaaccatgtgctcacaacccaccattgtcaagttttaattatcaattaattatcataacacgattaaccatcgtgagctacattaaatatacccataaataataatgtagtatgatccattccattaatgagctaatgtttctaagcatggctaagcaattacatatatatagcttttagctgaaccaaaccaatatataaggttcaagctaatcaatttgttacccaaggaatcaaggaatatggtattcaatgcaaattggccataacaaatgaataggttcacaccacccggtgacattcgaaaataaatgcacagttgaaataaatagagaatttaaatataggatcaacatgctcaaaggattgtgtttgggatctgtgtgacttgccttgcaacaatcggtcttcaaatagtcttctaaaccacttctgacgcactcacggaccttcgcaacgacagaaacgacaagctaacacgcaaaacgaataaaaaggactaataaaaaccaaatgaacaatacataaaaagtaaaaaaaaaacatgtagatcatgattttagatgaatttagagacttgaacggcctcattccgagttcatatgaattagttacgaattttacaagattaaactgattttagccttataaaaaaaggattaatgatttattttagaaaagaaaagggctttatgacatcattgatgacgtcatcgccggaacaaggcacgggaccacactgtcgccggcgctagaggactcggccggaccaaccgagggcatctacgcgaagaggacgacgagacgaactcaccaaggggcggcacgacgacgaaggacgacctacgacgagctccgaacggcggcgaagtcgggacgacgaggacggcggctttccggcgacgagcagcggcaacgaaggggtggacgggcttctcctcggtgctgcgatgccgagggaggtggcggcacaggtcggggacgaccgaggcgacggcacggcgcggatggaggcgaagcagatcggcttgacggcgtcggcagcgctccggcgggcttcggcttcggccaagtggtggacggtgtgcagctccttctcgcgaacccgatggtggcgacggcgaccggagaaggcggctgcaaaggcggcgcggcttgaaactcggcggctacgacggcgctaggacagacgcgggtagggcgctacggccgacggcgagctcgggcgagggtggcaaacaaaagaggagagggaggggactttatttaaaaccacgggaaaaaaatcgggcgtggaacgcagggaatcgccccgggaaaacttagggtttggtggagagataaactcaaaaacgaatccaaattcgcgccgaattcaaagggataaaataggatttt

SEQ ID NO: 2127 - DNA, 750 bp, Oryza sativa
  unsure (1)..(750): unsure at all n locations
nnnnnnnnnnnnnnnnnnnnnnnnnnnnnnnnnnnnnnnnnnnnnnnnnnnnnnnnattttggaatttccgaaaatgtgtatgccgcccaaaacccctctaaaaattttccgacatgtcccaaagttatttttggaattttccaaaatgtctagggggagattttggttctggatattctaacctgtccaaaaagttttcgaattttccaaaaaccttcagtgacctttactattttggtggtctggaaattttttgatttgtcccaaattaatttttggaatttacggaaattggtatttatggtcataacgggtagatctaaagctgtggctataaatagcccactctctctacttgtgtgggttgctggtctgatcggatattttcgtgcccttggcttgttcatcttgagattcacttttgagccttgctttcttgtttcccctctccacctgtgtttgattcggatttggtgtatgtgtgagagttgtggattcgagtttgtgtgagtgcctgttgttggcttcatgaagatttgtgagcacttgcatcatctccaggagatctttgcatcatttgtactcttggaggttgaggactcctaaacggctaggtattactctcaaggccccgatcaatatgtgggtggccgggaaaagtttgggaaggtcggatctccctccggaaagaaaggaattcccctaatggaaggaacagtgctttgggccacctcctgaggaaagggtta

SEQ ID NO: 2128 - DNA, 855 bp, Oryza sativa
cgcgcgccgctgttgttaaagccgcccccgcgccgtgcaggcgccgccgtcgcgctaaccgagcccacccgcacctctgccgccgcttcgttgccgcgaatcaccgccggagctccgattccttcgcgccgccggtgagctcgccattgtttccatctccggccatttcttctcgccgtgccgcggctcttctcttctccctcaccccttcaccgccttttcccaggtcgcgctgctcccgtccgctgttttccgaagcgctgccgccgtcattcccttccacttcgggcgccggcccttcggtgacgacttccttccccttcctttttttcccttcccgggtgcgccgccgcctttggctgtgccgccgcctttggccgtgtcgccgttccagccgtccgccgccgcctttcgcgtcgtccgccgccgcctcccttcgccggtcgtcgccgtcggcagccgcgcacgccgccgccgttcgccatggccggtcggtcggctttgtgccgagccgagccgtgcctagccgccgcccgcgccgtccgatcggtctcgggccgatccggtgtcagtcccgtggaccggcggtggaccacctgcgtggtcccggtccacggtagaccggccaccttgtgccgctgccagtggagcccacttgcccgagccccctctccctgcccttgtgcgctgacaagcggagccctcctgtcggcgcagccgcccctccccccttggatgacgtcagccctgggatttacagcgcaataaattgattaaggactttttctttattagtaaaaacacagttatttctaaaattcatatgtaattcatccgagtttggtttaagtccat

SEQ ID NO: 2129 - DNA, 310 bp, Oryza sativa
ctcgggcctctgttgtaaagcactaccgtaattccacatgtctagtgggtaaggcttagtttgtggctcagtctggttattgtcgcgtcccaaaacgactctaaaatacatcctctaaattctgcctacaataattaaaatccatgtgaaagcctccaacaattaaaatgtgcaaagttaaaagtcaaataaggcttcaggatttttgtatatttcctaaaagcctaaaatgcgtaaataaattttagtggaattttcagagcacaaataataattattaagaaataaacaaagttaacatgactttata

SEQ ID NO: 2130 - DNA, 730 bp, Oryza sativa
taagcggtcatgttatcatcaaggcaggaccactccttcataacttgattaaaaaccaactgagaatctccacgaactatcaaacgccgaattcccaaagagattgcgatccttagtccgtgaagaagcgcctcgcattctgccatgttgtgagacgcagaaaaatgtatccacaatacgtagctcagtctttctccagtcggggaaattagaacaacccccgctccggtgcctgaaagcctcttcaacccgtcaaaatgcatggtccaatacttcatcttctccacgggcatgttgtcaaaccgtgaagtttcccccccttttcttgccttaaaaaaattggttaaataaattgcccgaagaaattatcttaattaacctagagctaaatccctaattaataaatgcatttaataatcgaattcggcgtggtggaatttttcttgagttccccatgctccaatacattaacatgatttttagtggaaattttcagagaattggaaataattttaaccaattaaaattgagcaagtgcaatatttttaatcctaggaaaatcctttttctcttttcttttcttttccctcctttttctttgttgggccgtcggcccatcccttttccgtggtccctcctccttgtgggccgacccaagccgcccttcctttttggggacgccgacaggtgagccccacctgtcggtcgtttcttactccggcggttacag

SEQ ID NO: 2131 - DNA, 24442 bp, Oryza sativa
  unsure (1)..(24442): unsure at all n locations
nnnnnnnnnnnnnnnnnnnnnnnnnnnnnnnnnnnnnnnnnnnnnnnnnnnnnnnnnnnnnnnnnnnnnnnnaccacattgccaaagtgacggtccatagtttcaaccaaaagatgaatgaattcaaggatagctaactcattctgccaaaacagacacagttcaaacatattcagttacaaggacgaaagcaagaaaatggatgtgacgatggttagaactcttgtgtatagctacaacataatctactcatcacaaaatttgaaatgcaagtgcccatctctcttgtaagttgaaaaatgaaaacaataacggtttggagggagaatcctctttcttagatacataaattgtttgagtagaaacatattagatgagaaaatgaacgatcaccaattgcaacaaaattcatagataagccaggtggttaacaactaaccaaagggagcaggctcaataaagagacattgtaaaaaattaatccctacaaaatgggaccatactagaatataatctactgtcagatgcccagggcactgtttggtgaaatgaaaacagcacctaccctcatgccccctctagcctctgctgttgtgacccactattgtaataaccaatctgacagtacgggcataaacaaaccactgcacccaattaatgaaccattgcacgtgagtataactgaacaaatattaacgtaaatgaaccgacatgactgtagatcaaggcagtagtcacttttttattaatatacatttttaggggttctggaatggatggtaagatcatttctccttatttcaaacacctatctttctctctccctctctggtcactccctacctcgcatcgttgattctgatgtgcttgatcctggcaatgtgccaaaatgaggggaagttgtgtttctgatgggagggctgacaatccatcattagatcattttgtccacctcacccgtgctttgtttaactaccactgaagacatcgtagaagatcgatgttcaggaaatatccgtcagactaatcagaggttagcagttccaaatgcgaaatagaggggttctttatgagataatttgatgctttcaggcaacaaagcttttgcccaaattgtatcagcaatgtagaatacaatcaatgcttgctccaatgtctgctaaaagaacatgtataaaggctgccttttatgtttatttgaactgaacgtttgcagatttaatacatgcacagtctgagtacacatgagctcgacattgcaaagtttctagagttaactccagagctcctttagtcgatgtaattagtaatattagtccttatatgatgctcttgcgaccttgccaaacaaggaaatttgaaactattatgattcatcaagtaaatccaaataatttgatttccagtaaatagcaaatcaaacttatggatttacattaactcttagaagccaaaataagtgctgttgacctccagttagatttccgcttcagacgcacagaagtgtgccaggggggaaggggaaactagtagcaaagattgcttgagacactagaaacaaatcggagctcaacaatacaggattgagacacggtgcaaacaataatagtggaaattaaccaagtacagatatgccatagaaggacaggtcaataatgataggacacaagttaatgatgacattgagcgagccaaatatacatgtaaaattgcaaaatctatcccttttagactcaatcctaagcacatcatttgtgtttgggttgagcaaagacagatgacaaagagcaaaaaaagaagcgaatattagggaaggacctaatatcaaataattagaaagtgtgaggctttgaacccaagtcgtctagcccaccagcttatggagctagccagaagaccccggatgacaaagagcaaccacacctctacagcaaagacggattttcagccattgacacgtcgtctatacaaaccaattctaccttcatatcagtgcttattaattggtgctgcctaaaactgaatccatgaagatgatggggagagaggaggacgatgaattcacacgcattacctcatcgttgtcgacgccgactaggaagaagagggaggcgtagcgccggtacaccaccttgtagttgcggtgctccacgaaagaacactgcaaatttttgacgcaccacacaaatccaatcagatcagagcggatctcctctgtctctctctctctctaccaagaaccacacaagattcggcggcggagaaaggagaaaggagaaaggagggaattgggacctggtggtcggtgcgggcgaggcacttgcggacgatctcgccctcgagggcgcggcgctcgtcgacggagaggtgctcgtagtattgcgccacccgcgtctgcccctgcttgttcaccatcaccacgaaccggatccccatcccctcctcgatctcctcctcctcctgtttcttctcctctctctctctctcctgtttctgtttgtgttgccggcgagaaatgtactcgccgtgtggtggcggcggaggcggcccattccggcccaatcaggcccggcccgcatgtcgcgactgcatccctgggaccactattttatctgggtaataagttcatccgacgtccctgaactttacgtcgaatctgtctaaggtccccaatcatgcaaaaaaaaaaaaaaaaagtcccgaggcagtattgatctaatttttccccggtttcgctgacgtggcatacggtgagccccacatgtcagtgtcctctaggttagctattgtggtgggcgtcgcggtgaaggaggcggtgaacgcctccataggctcccgcgatgggtgagctcatgggtgcaccgtcgcggtcgtggcatagacggtggcgaacgaactcccaatcatgctagattgtctctgcccacggattcggcgctgatgggggctcaacaatgggcacgaggcatggggcggagacgcagtgcagggacgtccgggcagcagtaggcagagcagccagtagggacatgtgggcggagcaaagcatgaccggcgatggttttggaccgcacaatgattgggaaatacgccaacgagatgtcgtcgcaaaaaggactaggctcggaggcaaggattggggatgacaccgattaggctcggaggcaaggattagggacgacggacgccgtcgcagaaagagaggaggcgccgatgagagagggagtgcggcgagctcccttcaccttctcggtggtcacgctatgcctaccgtcccctgactgcttcgctcgccgctgttccgtgctctgctcactgcggcactagcccgccgccgcttcatctgccgctcgctgccacactagcctgcactgccggcagcctcgctccctgaagtagacaagagaagagaagagcagaaagaaaatagaagagaaaaaagaagaaaaaagagatgcggtccctacttttttttcttctcacttatatgtgggccccataatttttttttgctaaactaggatgccacatcagtgtaaccagagatccataccgctataggacctaaattgcacggttttgtatattttaggagtgggtattggggattagggatgtcatacagactcgacataaagttgagggatggctggtgaacttattccttttttgggaaatatgagtgaaaataattgtacaactgaaaaccatatctaaaaggaataagtccactttgactcccttaactagtggctgaatctgattcttatccctaaactacaattctggatatttcgatacccgaacggttttggagagcggtttcgctgacgtggcggtgttgacctgtcttcgtcccatgtggcgttgacatgacgtttatgtagcagtagaatttataaaaacatgtgagacccatttttcatccaacaaaaaaattgtgggacgcactaacatatggggcccatatgccgtcctctctcttattcacttcttccccctccttctctctcccccttatctctctcttactttcacccttgtgcgtttgttgtattttgtttgttttgtggtggtgatagatttccggcactaaagatcatgtcctttttatatagcttcctcctctagcccaagccattgctgcaaagtgaaaggaggaggaagagaggtgctgccaaaattttctgtgaaaatattttggtgatatgatacaaatcgaagggaactaaaaggttagcaacttcatcctctattaatgtatggttaacacattacatttctagctatgttttaatacatcattccttctcaaaaagttatatctaaaaagatgagagataacaaatttttagagaaaatatgggtacttcttaatattagaaacatttggataaaaatatttaaaaaagacaacaaaggaaaaatatagaaaatgaagacaaaagaataggaaacaaagtcgatttaaaagcactaaaatagttagaaataggtagagtgcattaaaaatatgtttacaacttcaaaataactcttaaaaataattaaaataaggataatacatgaaaaaatatatgtacaattttttaaaactggtagaatttcatgtaattaaccatgacttcgattaagtccatttaaaactcgttaaaatcattataaataagatgaattcattaaaaacgtgtaccgtcagttttgattttaattatgatgttttaaattattatatgattatttaattattttcacttttgtggacttactctacatttgtttatttgatgtagatgaatcggaaatggatgtacaccatagactgacggtcgatggagtttattgatggcgtgcattatttttgagtgtgccaatgcccacgaacctaagggttttatatgttgtccatgcaaaaagtgcaaaaaccagaagaagtattcttcatcaagaactcttcatatccaattgttgaagacggtattcatgcctagctataattgttggacctcgcacgaagagttaggagttccaatggaagaagatgaagaagaaggcgacaacattccggactgggctcaatacgatagatttgtagaaaatacaataggcgaggcggaaggagttattgaagaaaacgacggttcggatgatcttggtcagatgttgtatgatgtaaaaaaagattgcgaaagtgaaaaggaggtccggaaattggagcgtatgttaacggaccatgaaacgtccatttggagagatgagcagcggtcatagcacttggcctgtgaccaagtgctataatttttaacctctttttaatgtattttacttattttttatgatttttttaatctttaatgcagttaattgggccacggttaattactaaagtttttaacctatttttgatgcaattaattgggccatatttaacttattctcattaatttttagtcccagatgttatccaaggccgatacctaaaaaattggaaatagcgggaacggatttttagtctcagttggtaagaataaccggagctaaagctatttttagtctcggttgttcataccaaccggaactaaaaatctagttataagtagatcgagacttagcagtttttcgcaatcatcttctcgccatcatcgtcatcgccgagtggaagccccacgaagatgcctagagttgacgagccaaagaaagccgctctcaagaaaagagcgtatgataggactgacgaggaagtgaaaaggcaagtgaaggagttcttcaagtcacagagtccacagaacaagactccaatagacctgacaactaaggtctttttttagaagatgagcgaattggacaaaaatgccttagcataagactagaccactcaattcgcaaatcttttgagaagaggacaagaaagacaaagaatgtcccctagtttggaatgcaagataaacacgcggttgaccccttgcaaactgttgatgaaattactttatttatggcagatacatgtcttatcaaagagcaattgatggggaaagcgcctatcaagaaagccatggaagaagatctaaaacactcatacgcaatcggcgcaccacttgtcaagccagagctggtcaaggaactaagtacacagatgtatagatgtatcgattccataaatggtacatggatcaatcaactcatggtagggttatgttcgctgaaagatttaaaaataaagacttctgtgggatgtacgatgtggatcaagttcaaggatgtgtacaatgtataccaacaagacgcccttgacgtctctcttgtcaattgctgggttctgtaattaagtgtcgtttaattttatttcattgattagtccgtcgtatgtaacatcaaagatttaacgtctttttttggctgtggaatggaggttattcaaaattgtcgtaggggtggatacttcaagtgtggattcatggacccatacataatcaaggagaagactgtagatgatttcacaggagaaaccgaggataacatttacaaattcctagtgcaactacattataaggagttcatattattgccctacaacacgtgagtttttaccgccttttataccaatttccttctcgtattcacaaatttttttactgccttttataccaatttcatgtaatttgcatattccactatattcatgtattagactatatgcgtaatgaacaggaaacattcgacacaatattcggcatgattaacaggtaatgtcatccactgctactgtcattatgatagacgctatcgctactatgtagattaattatagtttgcaactgtatggcgttggcaaattttcgttaagacgtccgcgggcatttcaaggaagaactggttgtgagtatggactttctggtacgtatcgtccaaaattatatactccctccttcccaaattgatcatcatatatgtttattcaccgaaaccaaggataatttaaatcacattgatcaagatcaccatacacacattctcccacaatgcatacattgattggaaacactatgtcaattacaccttagcatgcacacattctcccatgctacattaattgtattatgatgaaatccgtgtacatgtggttatatgatgattaatttgagaaattttaaaatccattatatgatgatcaatttgggaaagagggagtattctataatagaaatatttcataagctcctttctccttttgtgtttacgaagaggggactaacttgtgtggctactatatgtctatgattttattcattgcatagcacaagacattaacatcgcctcgatcttacgtcaagccctagcaccatctaatcttgcgacaaccacatgggatcatcatctcctcttgcggcacctacctagcgatccatgcgcatcgtgcctttaaatatgacatgtcctatacctagggtgagtaattcaatccaacatagatgtttgggttttttaccctgaaagaatgatgaggacaacatgttattcataaataacaattaactgcaaacgactccataaagaatctgatccatgaagaatttgacaaaaagaaaagaaaacaatattttcaccatgaagcattgcattaactacaaatccatacttattattgtccaacagagtgtgcgcattctttgtgaaggaaaggtcaagtgcaatgtttgcatacgaaccgaatacccgtgcacaataaataacaaaatagcatcatatagattatataaacccatatttttgcaattcgatgaaaacattaaaaaaatattgttttgcataataagatggatccactaagaatttttgttattctttgcatacctcaatcacttttaagcttgggaagcatgcaacaaatttactgctgttactggcataccattggccacagtcgtttcaggaattaccgcaatggaatggttgttaatctaaaatttgaaacaaaactagaaacatatacaactactctaaatgtaactttgcatgtcgagctcaaatatgagagatactgggtgacttttatcctcggtcgtaatagatggatgggcgacacttagaagattatcaatttctaggtcaaaagataaactatcagaatgtatgccctaatggattaaataaacgagcttttgttggcacgcgcgcttttagagaatagctgacaacactttcatgctatcgcccctctgacccaatcatagatgatcttttgttagcagcgggagtcacactatgtaatgaacctaaatttgacatcgtgttctcagcaattgcctatctattctcaatgggtacacattggttgcaggattacacttcaaaagatatgcatgatttcaaaagatacgcatgattggtgccagaattggtagaatgcaagcaaagcactaaatggaatacatggatgatctatcgaatgggtgtgtcctgaaacttttgaggttaaatgaatacctccagctaaaacattttacaagacaatgtctaacgtaagaatgttatgccatggtgctcactctgctatcaacccattgagatccataaacagcaaaacgttaactggaaaatacatgggactccaagtgacagggcccgttgtccagctcaaactattcaagcatgacctcttaaaaaacttcgttctaattctatttggattttattaagatttgttttgctcatttagacatttttaggtgtataaatgatataacataaagaatataatgttaaaacctaaattttacaaccatgatagtttctaaacgaatcattctaatcctaattattttattaaatcttgtttttgctcattgagtcattgttaggtggataaatgatacagcatcaagaatgcaaagttaaaaccacttaatttaatggtgaatctcttggatgacattgagttttgtggcctttagattgatatgagtttggttatcttgtatgtaggcttctgaatgtaatcttttatcttacaatttggattggaaaaatgatagcgtaggatttttcctccaaaacaaaaaaaaagataccgaaagtcctagagccagtagcaaattaagtggttctcttttccatttactaaaatgttaatttcctccattatttgccgagaatgtgatattggaagtgttttctaatttaaaagttggagctaagctagtggtcacggcgaccatgaaaaacattggtaccattatttgatttgcgtgttgtagtaatgggtgtagtttgcattgcattgccttaacttattgggaacatataaatagaaactggtatccgttgtagagggaggtgaatagcatgctaattatcttcccattgctcatttttgctaggggtaaaactggtataatagcaagctaattatcttccccttaatactcgctcattttttttctcaaattgctcccttagaccatagctataatcaagctggagatcgagaaggaaaccttgctcgctcgttaggaggctttatcctcttaatttgctcgaaagccacatgaggttgtctcttccgtcattgcaaggaaaatcaaaagagtagaagaaaaaaagcactccacataaaatagaaggaaggaggcaatacccgtacgaaattaaattgcgttaatttaaattacaagaaaataaagtgccagaacttgaaattaaattgtacaactcaaatcattctaattataaagatttgaacaaaaaacactcaaagatacaccttcacatgaattttgaattcaaactctcaaaaaaccatttaggcaatctctcacaaagggacacaagcggcacctctaacactagcatccacctctctatttatagcccaagataactaaaatacttcacagacaatgtccaatttgcccttagggagaaaccctagctcacccaaaatctgagccatccattcatcgttagcttcaaaggaaaccatcaagatggttgccaaccacactgagcatcaactcaccacaccaaaccaaagaagatccaccaccaccatgtcactgagtcacgcctattaacgccaaaatttggtaaggttctttagtgattcggttaaggaaagaggtcgatcaaccaatggaagtttatctagaagcgacctaatccaagaaggaatcatgaagaccatggcatagcagtttaattctatctattaattagacaggatttatagtaatttccctttatctttatgaagtttttctagtgtccaatcaagacttgtattttttccgtttatatttagaaacatgtgtcgcgtccaatatggactagtatttacctgtgggtataaatatatacacatggggtcattgtaatttatctctcgatcaatataaatctccgtgcatcgccactctgtttttcggggcttttatcaccggcggaacttggcacctgacgtagggctacatcgctttgatctccggtgaaggggtaagtcctaagttctttcggccctggcaattgtatcggctatgttgacattgttcaaggctgcatcggttcgatctactggattgctctggttcagttggtatatttgtctacccgatatttcaattctatctttaattgcatcgtgtttagggatgtatcggtttattcgggactgtctcggttaggtcctatcttctgtcttagttgatatatctctacaatcacaatgttgttttaaatagatttgttatatctatcacattagtataaatatatcgacttatctaacttatttgatcaaacgtaatctagaactgtcttggttggatccgatcatctatattactgctgataatctaagtcttgctaagtttatagatttatgctacattttattagagtgcaagccaataagttatgtttatatcggacttccagccgatcatcgagcttacatttaatattttgtatcaatattgatcaattgattcatttggtatctacttcatcaaattatcattggttgattggattgtttgttcaaattcttccatttctttatctaagtgtcaaatctacatcggatatatagtcaattgttcaatacctatcgacatcggctagtatcgctacgtcggtttattggccgattggatctttgatcatcaatttatctgtcttatcagttataggatcaaattaactagcatgtcctgaacccgatcgataggacctgcactggcaataagcagatctcgcaggtcttcgtgtgccacgatgaaatttgacgtcaacatctaaatactaattaattttggtagatagaagtacattattatagctgacggcttatgggatgctaattatggatcatgaattaaattgtggagattgcagcggcatccaaatagaggagattcattttttaagatgaaatgactgattatgaatgcgttgagaaaactatttttctcagtagattttttttttgagtcttagctaaaaaaatcttcctcattatagaatacatgcttactttattttaacttgtatccatcggactataattcttttagaaaatgatttacatcttcagcctctaccaacaagcatacggccaatatcagactacacaatattgaaggcggctgaaggtttcataaattcggctaataaacaacacatggaagaaattgccgggaactattttgatgaacttgtaactaaatagaaatttgcaggatgtcttcggagcattgactgaaatccactgacagagtgcgcgcatcgtttggatcgttgctattctcaatgaacttctcaatggcaattgaaagggaattcaacttgtttccttttgttatagacttgcaccatatgttgacttttctcaggttcttcatatggcacatcagtttcacaaaaccatggttattggcagcaataaatcctgccagaatttgcaggttgctctttcccggctcaatttttttttgtattttatttgatacactgcctggaagttcaaactttccaaagagatgaattaacttaggaagcacgagtacttcgactgagattatcaccacctctaccttatttctcctgaaatcaagtgtctccaaaagttttagtccagcaatcgtctttggaagtgtggtaacagctcccccaatgctcacatacttgagcagtaacagcttacaaatgctgtcgagatagccatccataaagccgtcacattcttctagatccaagacttgcagcagtttgtactccttgaattaagtccaaaaaatctcggcatagttgaccagaaaccatgagagaccggagaagagagaaaccatttctccctagtacgatatttgcagcagtggtgctatgacattggagagagagacaacggggtcgcgtcctgatcaggcagcaggagcatctcatccttgtcacagaatatggtgatgaaaccctctgatatggacctgtgcatgatatctcaccccttcgttgttacgcacgttgataggctgaacaatgtcccagtccatgaacatttgaagttcttgactacactgccactgaaccaagggtgaggcagtttcttgacaagcccttcagcaaaccatcacctcaacagcctcttcctcctgattggatggttacctggaaacatgccaagatatagtaggcaagctttggcagcatcaccacacaggtaggtgtagttcatagtcagcgtcctttgcgtttttgctaggacattattgtccttattttccagatggtgaccaaggttgttgcagacatcactgcaagtgtgccctgttagtgtgccttctcactgcaagaaatggcctatgtagatcggagctagaggtagaccatggaatttcttccgaagttgttctgagcctctctccatgtctggtgaacaatcctcaacagaagcactttggaagaacaaatctttcgaatattcagtgttgagtttcccattttgtacacataaccgtctgcagtgctgcatgcattatctatggactggatatttgtggtcacaactatcgtgatgctgataccgtcatctacagggaaagcaggctctatatcacaccaccgttctgcactcatgtcatcaatcacaacaaaatacctacaagaaaagaaaccaaaaaaaggaggaaaattgtaaatagaattgactctggcacataaagcaacttattatgtattctcaagcaaagcaatgctgaaaagtaaagctagcaacaaacttacatctcaaaggctctgtttagtactctgatggctttacaacagaatttaacgacacggaaaatcttacttgaattattaatgattcctctaactacctagatttcacagcacagcaccgaacccacaaacgactaacccagaacaacactgaacccacaaatgactgaccctagcattgttgtgaggcctatattgttacttttactactaatacatttgggagactttatgtcatttgtcattggttttgtccagtacaataattccatcatttgtgaatggtctgttatgtgcgcgcttgtctctctgtgtatgtgtaattagtctttgcaagtaattatatctattgcatattaaaaatgtatggttttctcatagtctctaagaagaaaagagaactgtgccaaaaaaaacatctagccccaataagggggaccttgtctatttatgaagctgaaatatctgttccataatctatctatctatctatctatctatatctatactaatcgggtactttctacgcataaccttatgtctatcattgtctcattaaaaactttgtatgaaaaaaccagatggtaaaaactcacaaaaggaaaaagagtacaatgagaagcgttttaacaggtccatcatttagagagtctccctctgaagcttgcaagtctctgagcagtctcataccaattcccttaacacatctctcgaacgaggaagtaggtagagatttggtgaaaagaagatgtttatttctccaccttgctgaagctcatggggataaaacaacttaggagcaatatgtttggtgatagtcgagcgaatgtgcgacttaatatcctagtataccggatctaccgtcgaaactcaaagaacacaaaccattccgttgaaagtagatcagctttaatttgttacattaaattatatttacaaggtgcatctagagcacttaggctattcccaacccaataactagaatggtgtccatagtattagataagctgtcacctaggatgaaagatgatgtgacaagtgaataaatgaggaaagagaaggaaactatgtttggcatgagacatggtttctacacagcatccaagccatcatgtgagataagtatcattaaatttaagaatggaagagtgatgtttgcatttaaagagtagtgtttggtactagtttcttgatgatgtggagtttataaaaactatgtctagtgtctttggttggactggccttatacgctcttgtcttaactcaggaactagaatatacaccaattttttcgatgtactttgaggtttatgaacctcaacccctcgtctatcgcaaccgacgtacgcactctattcatgttattcgtcctatatatatatatatatatatatatgtcagattgtctcacgatgttctgagctgccgcgcaccattcatattccccaccatgcatcacctccatcatcccgatattgattaaaatcgggcgaccgggggaggtgggaaaaatcggtcgctcctcctccccccatgcgcgcgctcccctctcctcatctggacccactcacttatccctccccttgtttcacaaaagatgtttcaccaagtttacttacaatgtacaatgtttcactatgtatagatctaatattgcagtgaactgaaataatctattgtaacaaaaacccacttatgttggaaaccccctatcaagggaatttggtttattttttgttccaccgaaaaatgtttcacttagtgtactcacaatgtttcactatatatagatctaatattgcagtgaacaaaacattccattgcaacaaaaaacccacatattttgaaaacaccctattaagggaatttggtttatttcttgttccatcgaaaaatgtttcacctagtgtactcacaatgtttcactatgtatagatctaatgttgcagtgaactgaaacattctttcgctattcgttgaaacattgtttttatataaggtgaaacaacacccaatttaaacgagtgaaacattttcgatctacttaatgaaacaattccgatatactttatggaacatcgtgcaacatttaaaaataatttaataatgagctaaattttttttccgtcggaatatatccatgtgtggtcttgttttgaagatttaattataacgaatttaatggtgcaatcgaatcatgatttggataagtaatttaagagaaaaatagtttaaagtagttttgcacataaatcggacgctaacgtcagcgcccgatttttcttgaaatcgtcgggcgcccgagccgtaggcagccccccatcatccttgacgttttaatttcccctatttctaattaatggctaggtcgttttcttcaccattaattgttggatttcttcatcatcccccttctcaacaatcaacatggcgcgggtgcagcgccggctacgtatcatgcatggcggcatcccggccggttcctcattacaactatatcaccggttaatggtttataataattaaaaacttaattactcactgttgttaatggttttctcatttttctcacggtagaaacgaacacctcttaattccctaatgtatcttgccagattttagttagtagatcgatgccttctttctctttaatcccttgttcctataaagttatcccctactaagtgcaactatgatcctaaagcttaaacctaaatgattcacgtcattattaatttacagcccttggatcggtagattagattgcatctacaccgttggatgaacaaaactcagggtcgaacaggcctatatgaatataccgcagcccagaagacccaagtcaatctaagacagcctaatgagggatttagggttcggtgtgtctcatctcctcctcacttcctcttagcagagcagcagcggcgtagtgcggcagaccctagttttcttatatgattgtgtgctttcactatgtaacactactcagtccaaatctgtatccacggacgggattcgctctattcctgtctgcatcattacaaacaaacagttcgcctatatatatttgaatcaacctctcgatcttaaatattatatataacccatggtcacgctcacggtcgcaccgaatatactcttgaacgtaaacagaaaaaaaaaaactgcgtcacactaacggcgccgacacttactcttcagtctaagcaggaaaagaaaaaaacactaaataagtactgttaattagctagtcatggatcgtctaattgtgtcccagtggggtaaaatatataggcaaattatgcacgactttttttggatccacgagcttgtacgttgtcggaaagacccccaatataatggggccaacgtgcatggtatatacgtacttattcatatcgagttttttggaagattattgtcggagggtgaactcctcgagcgggggaccatgaggcccctcctttgttagttcggccaggggcagcgggtgaaagttgaagagatggaaggattggaaggaatcgagggggtcgggccctcgatgaaggccagacactagggatttattcaggttcaggccgctaagaagcgtaataccctactcccgtgtatgatgatttttctgagcttacaaagtctctgaatctctgatgtacaagctagggctaagccttttacctttcgaaccccctcttcactggatatggacctccttttatactctaaggggtttcccacatgcactgtgagtaccacctcgtgaagagggaaaatattctctacattaaatacatgtcttgtgccttaacccgaaagtcgtttgcatgtcggctgctgtgcggggcccattaaatcatgccggctgacacggggaaagccctcgtcattcaccatttaatggaggaggacttggggacgcgcatgcaccgtgaacacgatctcgggcacgtacagagtggtcaagacgattccggacggttgaaaggcgtagagcctcttatcatcgtgacgggacggggcatacctgccgcatgccgcctgacatacggctagggcgtgcgtggcttgccaccatcccatctgttattcggccggtcacgtatcggtcacaggctggtcagacgcgcaacacgccacatttaatgcgacgttgtgcgctcgttctgcctgcgttaaatacagttaggtgggcgttggggagtgtccacctaacctcacttacatggtggccacgtggtgaccgccaggaggggtcggggcagcccgaccccttgggctcggaagggatagatgccacccatccacaggcccgaccccctaggggggaacgccacatggatgttgggtgcggcttcttccctttaagcttggtacccgaggctcacactcaccgacaattatgtactcgtattatgtactctgtcggtgcccttcatctaattaaactagagaatgatgtagatttggacgatcttatacatattctctgtgctctgtccgtgtgtcggggcatgattcaaaagtttatttagagtatttaattatcattttggaaagatagcgtctcaatggttatataaaatgcattcactgcagacagctgacagtaggaacacaatcgagatgccatctgctatggaacaaaaaagaaaagcgtgctctcatatatatgattaaaaccaaaatacaatgtttaaaaaaacaaaatacaaaataaccacgtactactaagtactcttgatccattacaaaataaatttatttcgtgataacttaggttatccagattcataactataaaatgtgttgcatcctatatattttaggtttatcctatttcaaggtttgtgttttataaaagagaaagagtatagttattgattgattgatgtgacttgctaaatcatgtgcaacgttctgggtcgcgttttcttagctaggggtatgtttagttcacgttaaaattgaaagtttggttaaaattagaatgatgtgatgaaaaagttgaaaatttatgtgcgtagaaaagttttgatgtgatagaaaagttaaaagtttgaaaaagtaagtttggaactaaactcggcctatgcaatgagatcgggcacattttcttcggcgacacgccgttccagtgcgtactcgatctcctgagttggcgcatatataccttacaaactcgccatgagttcatatctttactcgaacaaactacggtatacttctgctaatttttgaacaggtgtatattcctttaaaaccggtaaagaaaaagcatatttcacttttttgtttcagaaaaacaacacatatatatcccctttcaaccgcacgagcacgacggtcagccaaatgaatatgatattatattcccagcaagtaggaaagcaaagatcttgatgattacgcatagtggcaaaacagatctccgccggcctcttcagtttaattaatgaccattattcattttgtttattttttaggagattatttactcgtattattaattgaattcagcttgcgcaatgtgcactagctggcccacttttctactatcccagtgacctttgatctacttaaactagagaatgaagtagatttggacgatcctttgtattctctgtgttgtgtccctctactgtcggggcatgactcaaaagttttattttttcgaaagataatgtttcaaaatttaaataagctgtattaattaaatctatacgtcgcactgctggcagtgtgtgcccacgttggatgcatgccatctgcactgcaaggaaacaaattaatttttacttctcagttctaaacaaacttaacctagaaaaagatgtaactcttactagtacaatgaatctttacactgcggatcacatctcctactaagttaagattttcctggacggatgcatggagtataggtcacaagggaacgaacaaattaatcaaagcacaaatagaatgtacaagacgtaaaggcacataacagcatatcaagatcttttgtgaaataatgaaagaagtacgaaaatacaaattaagatgcatgcagacgcatcatgcataattatggatgtaaatagctaacttgcgaattcacttatagattaaaaatagtatataagtgaatttgtgggttagtcactttcctaatcgcttggttgaattgctggccagcctggcctgcagcctgtgaagtcttcattaccgattaattaacagagttatcagtcgtactttggtatcgtctttttgccataattaactggctcgtgcatagatcgatattaattaaattagccgatcccgtggcatgtcctttcgctctccgctagttaacaacgtacgtgagttcattggctactgcctccggtttcattttaattgacgttttggacaattacacggtttataagatatatctttaacccttatttttctattataatatacataataaataaatatatgtttacttttattatagtgctttaaaagacaaatctatatatgttgttctagtttctttaaactaaattaatatttttaaagttattgatggttaaagttataaaagtttgatctcaaccttgtccaaaatgtcaattaatatagaaccagagggagtatgcccaacgcggtgattcggggagtggtctcgcctgtccgagttaacttgatactatccgaatccgagtttgaatttgaatccgtaaaaaataatatgggttaggatacggaaatatttatacacatccatatgttccatatctctactattataaaaattaaatatgtttccgcggtccgtcatccgtctttgagtcgattataaaaattaaagatgtttccacagttcgttatccgtatttaagtcggttttaattttatgtttttgttttaatctatatctcttctctacaattataaaaattgaagatgtttttaacggtattttggtacgtcatccgtgtatgagtcagtttttaagtccgtttgcttttgaaagtacatatctatatttgagtcagttattaagatcgttcacttttggtaacacagaaggaatcatagaagaaatctgttcaaaaaaaactcgcatgctaacttgagacaatcggacccctaattgtagctcatgattttctaaaaatatatatatatcgaagtgaactcccacagtgaatttcatcttaactaaaccatataacaataataagattaaaatagacttcacccgttgcaacgcacgggtattttttctaattataaaacatatatgaaaatctattataaatatacccacaaacatagttaaagattggtatttacgagctcacatgtaatatatttttttccttgatgcatctcttttaacactttaattgtctatttatatttaatatttatgaattagaaatacaaatagatatctgtttccgaatccgattcaatgaaatatgggatgaccggataagtgatatattatctggaactgcccgtacctaattccaattttaaaggaaaatatgggttaggatatgaaaatgtcatgcataataagaccgtacccacctgttttcaccctgtggaggatcacgatcaccgtgcagctgatttggccgggagaggactcaggcgagtagatccatcagcagggaaagcaaatcaagccatagccaccacgtgatcctcgatgcgatgaggcattgaggccgcgaatgaagaagagatagccgccgccgtggtttcctctctgacgttgcgacctcctcaatcatcgccaccacaactttttctcccgtcgtcactgtggcctccttgagcaagggagctagcagcaaccagatctggaggaggggagagcaagaaaggacggcagtggtatctagtcgattaccgggcagccaggagcggagagtgaaatggaccaaatttaagttcattttggtgccttagtttatattgagagagtacatatatggtgaaaatagataaactatagttgaaaaattttcttgactggttcctgggcaccccctctctaacatgtagctccgaccctgctagcagcagctacaatctggagaaggccgagacaccgctgtgggcaaataacactactaaaaatgatttttgaggacaaaccctcctttgtcttcagccggactaaaaagagttctcaagaggctcgcatgtaaaaggagttgatagagattcggtaaagacatgcatgtgaaactaaatttttgaaggcggacctcttaataggcccgcatcacccaactatattttttttccttctcctctatctccatcctacctttttctcttccccttaagtctctcggtcccttttcctccccttttgttgcccctcctcacacattccactcacacccgatgaccggcgacatgggagatgtcgccgggcgatgacaacaacgaggagaggtgtagtaggaggccaccaacctcgagcggatccggcagcagcggcaggtgaggtgccaattcgctgccaccaacctccccatccttcatggatccagtgaacatgtaacatcccgatttttgctacattttaaaaacccaatttaaatacaaaatctattttcaaaagttggttcttatttgaattttggtttgtgccattgaagatctcaaatcattcatccaaatgtggccatacacaatcctagaattattggagtccacggtccaattacaatctatttacaattccaacaatactctccaaaattcaaactctgatatattcctagaaattgagaaatatcattgttccgttgggctgcccctttcttttttcttcgcttaggccagtcccttccctcacctaggccagcccacctccctctcccattcctggacggccaactcagcccagctgccccctctttcttccccggaataagttcaccggaggtccctcaacttaacaacgagattttttgagatctcttaaccacaaaaccagaaatccccacccttaaactatacaaaaccgttcacttaaggtccctagacagtatatatggttggtttcgctgacgtggcatcctagtcagtaaaaaaaaatattaaacaaagcacatgggacccacatgtcagctgcatatcttattttcttctcttttcttctccctgctgttgctgctcccgtccctgccctgaccgcggtacactagatccgcagccgccgccggagtcctcgtcgttgctgccggctggagagcgtgctgttgggggaggtcgcgtcggactcctcgtgtcctcctcgctaaagatgcccccctcgtcgtcgtcgtctccgccgctggcgctggccggttcacgtcgatcccccgcaagaacggcatctcgacgtcgtggcactccatcatcgccgtcatcccccgaccttcataagatccatgcacgaaactgagacgccaagattgcagcatgcatgcacgcacgacgttgacgtagtccgtccatctatactcaccggaggagaagaggccggcgccgccgttcaagccgcatagctgttgcggctgcggggcggcaccacggcgcggcggcggctcgtcggctgcacacaaaggaaggctcgggcgaacctgagcccgggaagcgcgcgcgggtgaggtcccacgccaggtcgacgcggcggtcgccggtggcgcagaaccgcctcgtcccgcgctgccgccagaggagttagggacggacgcggaaggccagtgcctcctcgtcgggtgcgggtgctggtggacggcgaggcggaggcatcaatgctgctgctgcttttcgctcaatcagatgattcaatcacattcactgctactcgagatcaagacttggtactactcatcgattaattaacttgtactcaagacactgatactgatcaatcaatcaatcaatcagtggttagtgctcgtctgatatagaaaggcaaaaggcgcaggcaagaacgaggagaggacggacaggaggttgcgtagccatcagaaaaggaaaagagacgggagagagagagatcgcggtgatggccggagatgcggaggatggcgacggcgagagggtgcggctgttcatcggccaggtgccctgcagcatggcggaggaggagatccttgccgtggaccgtgtcgctgctcgcgccaatgacgccaccgtcatccgctactgcgccgccgtacgtgttcacgttccaaaggtgcctccgaaagtccggatgacgacttggaccgccccaccactgccgcggagcctcgaaggcggccaccgcattgtgcacggcgacggatagcgccgtcctgtcgggagaaaggtggctgggccccgcgggaggaagcatgccgccattgccgctctgcccgccgccggcctcctcactgaagaagagaagagggaagagagaaaagagaatagaaggagaagaaaaaaatgtgcagctaacatgttggtcctacatactttttaaaaaatttttgctgactaagatgccacgtcagcgaaaccacctatatatactgcctagggaccttgagtgaagggttttgtatagtttaggggtgtagatttctggttttgtggttaagggacctcaaaaaatctcgctgttaagttgagggacctccggtgaacttattccttcttccccacacaggcagcttcacatgcccgccacttgttcgacgaaatgtcgaggcgggcgagcgacgcaccgagtcgcgctgcaaagggcacacaacgtcatgcactgcccgagttgtgctgcatcacgtcatgccgctccacgacgaatcccggacacacctccaccttcccgcccgcaaaatccgacttcctcgcctcccagtacaccactcatgttggctgatgtggctggcatcatcacgctggccccactccgatgccgcccaaactgtagccgcacgacacctcgccctagccctgtctttttccctattgtccgtgccgcaccaacgccgatgcactcggtgaaccgcctcgcgttttcgtgctccagctcccgcagtcacgcgtcctcgcggaaagtgtgagccgagctcatgccactgtcgccgcccctatgccaccatgcccacttccttcccctcgaaagcattccattggccagccaagacaacag

SEQ ID NO: 2132 - DNA, 2214 bp, Oryza sativa
gtcctcgacggcggaggcggcgcgatggcctcggcggcggaggtcctcaaggtggcggactcatatctagacagacagcgacgcgacggcccacgcggcggctcggccaccaccgacgtcgacgtgaggcagctccaaccgacggcgacgcggcagcccacgtggcggcggcaacggctcggccgacgacggcaacctcggcggttgcctcgtcgtcctccgcggatctggagcaggggcacaacgtcctcgggctcgtctttcggccggcgcggcgtccacagcaatctcgagcggcgcggcgtcctcgggcttgtctctggccggcgcggtggcctcggcggcggaggtcctcgaggcagtggcttcctcggggccaaagcggcgacggtggcgtcctcggcactccctccgccgtccgctatgccctcgccttccctctgctccaaccgacggcgatgcggcggcccatgggggaacaagcgagggaacgacctccacagtgcaagaaacggcaacacgcgccctcgatttcgacgagataactcgtcgcccagttggggggcgagcaaccaaacagagctccgcgccctagtgccacgcaagctcgaatccgatgtgtcgagctaaagcaccggtccatggtgttgcactgtgaagggccttagatctacctcgaaccacccaatcctcacccttcgcccttccaaacatcgccgccaccctcgcactcccaagtcggtccgtagcgcgcggacgagcacattgtgtgcgctcgacgctgcgtcgctcggacccacgctacgaccgctccgtcctgtacgcgaccgccgctgtctctgctccaccctcctgaccgccctcaactccaccgccgtcaaagcgaggccaagccagcccgtgcgaactcccacggccgcctctgcctccgtctggctagacagtcattgaggctgccgctgccgcccttgccctggcccggaccgccattgcaccaagtcaggctcccgcgtgaccgtctcctcgaacgcctcctctaggacaccgacagccagcccgcatcaactcctccccacacctcctttgccccgctgcctccctccatcgctgcgccgaccactgtccaccgccctctatctcgacctcgctggaataaaagaaggggatcgagagagagacaaggactcaaggagagatcgagaaggagaggagagaagagaacaaaagggaaagaggagaggaataggacattgacaggtggcatcccgttggccccataatcttgcttaatcttgcacaataattacctccctttttcttaattaatcttgcacaataattacctccctaatccctctctattgtatcactgacaagtgggctccaccatggttaatttctgtttaaactctcttaatctttgagtcacttacaagtgggaccccaccttatccacccggtcgacacgcacccagtcaccgactgccaaatccgacgctcactggcaggcggccatggaccggttccaccaccgccacctcaccgctccgcacgccgggttccaccacaccgacctttcccagctgttgaaagcgggccccgcaaggaatattcctttccaataaaagaaacttattttccttcgtacaaaaaatcaatgaaacttcaaaaattcatatcttgcaaaccgtaactccatttgactccgttcaactttcatattttttataaaaatgatatctatctaatggaagttctatctctcactgttttagctactttattagcttttgtgttgattttctccttttacgcgtatagttgccaaaccttagaacggtccggaagttgttctcgatgaggaagaaccaccgcaggaccaaggcaagccacctttgacaatattgcctccaataggtggaaaattatgttgtttgcataggttacacattaaattgtttggcctcggttggcgaacgccaccggtggacctacctattagtcgcacatatattttgtaggttatgggaataacatacctttgttagccctacaaacccccccctacaaatgatgcactgacgtcttaccctacgggtatgattgccgaggtagttttgtttagccctgttgcgattgtattgtcatgtgggcacagccaaagtggtggcgggggtggcctcagctgctggcagcgatgacgtcgcgcccacc

SEQ ID NO: 2133 - DNA, 1667 bp, Oryza sativa
ggcgcgacgccgaagacgaatgcagccgaggacgcccccaatgccatggtgtcgctgacgccgccaccctgcacacccctccccccctcctcctggacttcattgctccctttgctcagacctcccactcactcgaggatggaggacgactaggcttgccactgccgcttgtcttggccgggacatgcccgttcttgatgatgcggcgggggtcggggaatagaggggtcggtggaggggcggagctctcgccggagccccatgctgccatgtagaagggcggggctccacgacgtgcagcgagggttccaatgaggaggaactccagcggaataaccggtgtaggtatgtgcagcggcgtctctggtgagtagtccggcgatggtgatggcgcggcgaaaatgctttgtccagccgtgatgaggacagaaggccgtcaccacgtcgggcatctcctgctgcggccgcaccctcactgtccacccatgggactcgcagtgatgcggtgactccaccagaattcattctggtgcagcgcacatgacgggcaccatcggaggccctcggcgagtcgcgagggtgttggagtcggtgttgccggctctggtgttcctttgggcagtggcgccatcatcgtggtgttgtcctccatgtccagcgaagctagggggaggagaccgagggcacggccggcaatgcccgcaccacggcccctgctgtgtcgagtacggcgcactagagcccggatgatcctctcaagctgatgcatgagttgacggagatggcgagcacggatgttgcgaggaagggaagaaccggcatcgagagaacaggatgtgccatcttaccctccacgtgcaggtgagtttcaccgttctttctcagtagagcgttgctgataacgtattagagtacaaaatgaatgaacagtgaaagtgtgaattccctctcttttcattgatctcaaatgtccccttttatagggatgatttatgtattacatgcctaggattctcctaggatttaaggaggttttaagcctctaaatgtggttgttatatgacacaaattctccttaatatggctgttacaagattgatgattcatttgattgctgtcattgttgcgctttgatgagatcaaatatggcctaatgatggcttttgtaacaattgcaagccaagagtgacagagaagcagcacagatgaccaaatttgctttcttgaggttatttttggacaattttgtccatcctctcagtggctactattgtcaatatcatacttaaaacagtaggaaatactacaacctgcaaggttacgcatgtgaaaggggatttttttttttaatggtagctgccctaggatgaatatgggctgtcaattgctcttgatcaaatggatcaatattgtactatactacgccgtacgcccgtagtaaagggtagtcagaatttttggcagtaaagttcattgctattcttgtaactaaaggttgtaaataagtgaaatttattcttccccgcaaaaaaaaaagagagcgaaaattactcttacgaaaagatcagattctagaaattaaaaaaaaaccggggggttcttatctctcttatatagtaaacagcaaagcaagcttcctcatttagctatagcatcattaagttaca

SEQ ID NO: 2134 - DNA, 584 bp, Oryza sativa
ggttagtgtcatcaaatcgaacaattaatcgaccttgatatctttctgcaaagtacttgttcaaagagtgcagccttggcatgacctatatggaggtaaccactgggctctggggcaaagcgaacacacacctctcaaaattttgcaccagggagatcaacttctggagctgaaggatcctttgagtcattaacctttttcttaaggtttggggcaggggatttcccaattcctcgtttcccaacataagcagctataacctcatccaatgtgtctttgaagtctgaatctatgccattgaaccaacggacaagattttggtatttctttgatttccgtagactctcccatcgttgaccaatccctgaaagagaagatatacatcaattgttagcgcacattatgaagcataggagaagcttgagagtagaaacgtgaaagaggcccatggctcaccagccagatttgaccatacagtgatatcagcaatcgtttaaacatgacccaccagaaaggtccgagacatccagtatccatccaccaatgagcaggcacctccaattttgatccttaaaggaaagtgg

SEQ ID NO: 2135 - DNA, 405 bp, Oryza sativa
ccgtgtcctcaaatgcgaagcagcagtcccctcgccaccgtcgtcgttaagaccgccaccgccgtgccggccccgccgccgttgtcaagtcgccgccgtcgtcatcggactactccccccgccatggagagggcacggggatgccaatatcatgccgcccccgtcgtcgtgctgccaccgctgtcaaaccgccgccgccgtcatcgaagacaattagtctaatttttttctggattttagggtgtttattgtaaattttagatcttcacataagctgaagataatattataagaaccgaaaagaaaagtattagggacttgaaatataaaattaaaaccacctgcactatgaataattcaaattttataaaaactaaagcttcatagtgtgtgggactgcctttg

SEQ ID NO: 2136 - DNA, 1566 bp, Oryza sativa
aatcaatagtccataagtcgtccccaagttcccaacccaacccaaatcgtggctagccctagagcgagacagatagatcgtggcacaacatcacgcaactgcgagccggcggcggagcaacgcatccaaatcgcggcatcacgcatccccgcgcggctgttgacggtcgttatcgaccaatttcgatcgtcaatattacccaatatatgaagactagctatgcttgcaatgcataattcccaaataaaatattctattccactatgtgcttggcgaactaacatgtacgcaggagaagcacgcatgagtggaggagaatcgacagaaaatagacaaacgatcaatcagatactgtgaggatcagacttatggatagatgggctgagaactcagaaaagacatgatcaattaagcccaaaattccatgttttggaatgcggagcaaacgaggagtcggcctgccagaaccctctagtttggccaaacccccatcacagccgtttaggctggggtttggcatggacgctctggatgaactcctgatggcagttgcggagcatttccgacaattctcatgctctacaaccgtcatacctgcctatttaaggaggtctcattctcacttcacaacacacacaagcaaggattgaagctccatttctccaaagttagaattagtatagtgctagtggaataggaatagaatagttcagagtccgtggaagcttcgaagagttcggtaaagttcttagcttttccttttctcttttctaagacttccttttcggtaatataatattcttctttttatacaagtttagtactttattccaattatagaatatgagtgctatgcttagtctatttatatttagtataatctcattggttaaaccttctgggatctgtattgatgctggtataatgtttgtttaccgggccatacgtcagcccaggctaagccgagggctatggttccggaacacaaatgctctgcaccgattgcaaggctgcagagtaataagtagtagcttaagcatggggtttaggctaagacttatcgttattttggagtatattcgccgggagagcagcgggccgctgatggtgacagctcagtatgggaatcttccccgcagtttatattcctacatacaatttcctggggttggatactcctccgtatacttcttcagttggatggttatgacaggttgtcgtaagaaactcggcaacccggggtaactttgcgatgcatcgggagggcacagttgagtctcggctcagctgtgctgcattgttaaaggggttataccgcaggagagtatactaattatgatagactaggtacttgtatactagaagtacaggaatagaatatttctatacttttccacttagccataattagaagatgtaggagttagctaaatccttagctgtgtgtcaacctaccatttgaactgaattaacccatgcatagactttgatgtgtataagtaatatatgaattgttagcatagttctctcttatcatatcttcccttggaataaaataaatacgat

SEQ ID NO: 2137 - DNA, 6632 bp, Oryza sativa
ggttatttctagtgctattgctgggaattaaatttccagtagtgtcgctaagaaataccaacagcggccgcgcccaccacccgcgccaccactggtccatcatcctcgccaccgctggtccgccgtcccaccgctcacgccatctcgcgccgccacccttcctctctcgtagagtcgcaatcgcaccatcctcgcccccaccatctcgcgccgccctcgctcttcgccgtctcacaccgccggctcggtcccgccatctcgcggcgccgtcccaccgtttcgccgccaccaccaccactgacgacgacgccacaggcccacagccacaccgacgaggcgactcttactcactgtcacgcccagaaattcccgaatagaattccaagcagaatgtgcattaaaacccctgtccaggactggccagggtacacaaacgacaaagttgacatacaggtccacgtcttacaaacacactaaaaatcgtacataaatgcagtggaaattaaaggataatctaaagctaggtcttgacttggatagcagcgggtgacaccattccacaggcatcctcgacagcacggatgaagcctactcctccgagtagccaccatctgacgcatactcaaactctgggggttgggagatagagcaagactgagtactacccactgtactctgcaagtcataccagaatggaaggtacgatgcaggatataaccaaagagatctagagaggttcatttgcataaaagctagcaattataaacggtagttgtaagcagtaaaacagttgtagtaattaaccaatcattgctcaacgctacaccacgatgagataggcccaaaccaccacctgaactaatcaattccatttagctaaactaggggtgagactaatcacgatgaatctggtcaaccgcccataactgagggcacggctattcgaggtgtacaactgtacccacaagacacagacccacgacatgtttccgtgagccgccatgcagccacgacataccggaaagaggccgtgacaggacccttcgcataaccccctctaaccaagcacaccacaccttaggtttcgcccctggtcctcaacaggcagcgggcagccccttctcgtgcctaggcgaatcagcaagccgcataggccgtcgcaggacccattcgaactccatcacgtccacccttgcctggatgtgtcagctagaggaaagctacactacaagcccagccgttgcccatgctggcttgtggtaagtacgataaattcttccaaggtttcccgtgaaccggtccttaatcgctatgggcacgaccagcaaaaccatgcacccacagcccaccatttagtgtattttaattaaccaacaccattgcggtggcactagtccaaagatatgctagaagccaatgtctatgcattaatgtaactagttggcaccctcgcgccttgccgcgggatttgctaattttatcatcgaataaaatcaatgttttaaatggttagatgcaactcttttttatatacaaaatagatgataatacggcttcatatatagcttctgttattataatacaattaatgttttattttttgaaacgccattgtgtattgttatgatatatgaaagttattttcatgcacaatctggatatcgtcacaattaggcagtgtagcacttctctgcttcacctcaagcatgtttccaaaatgagtttggattaatgatacctaattattgtatgttatccaattgtttataacaaaacaaagctcacatcttatataataattggagttgtatttagaaaaaaagattagtattatctttgaggatttgtatgtatgcgtagaatggataacaatgtcacgcatgattatgagctaaagggaggtgaatggataagtaatcaatgattaaattagatggatgagtagctagcttcttgatccaacggctgataactctatactaatgcgatccgatggcttaaaattgttgatgatgtggcttcttgcatgtcttgctttataggagtaaatgcttcttagtgggtaccaattatataggaagataggattcccctttgtttactagttgaactaagcatggtaagcaattcctagtccaacatctagtcatgttacatcccaagctaacaaagaaataaggtacacaaataatatggctgagaacagtaggtaaaacatcccatatcgtaacattataaaccatgcataaatttaaaggaaacatagagcatttgcaatatgggatcaatattttcaagtgacaagtataactttccttgttctgctgctggagggacattggcgactacttcgaagtacaccgaagcgtcgggagagccggattctaaccgacattcaaagtaaacaatgcaaacaggctataagactactgaaacaaagaacaaaaccattttaatggattctttacatttttcttgatttactgagacttgaatgggcttaaacagagtacggatgaattctctatgaattttagaagattcattgtgtttattactataacagaaaagtccttaattgattcattgtgcattaaataccccggatgacgtcggcggacagcggtggcggctcacggccgggcacgcatgggctcagctcaagccagcccggtgggccatggtgacacggcggcgcggcatggagcggcggcggcgcaggtcggccaccagtggcggagagcggtggcaatgcagcggcatggagcggcgctagcggcggtgctaagtggcgggcggcgcggcaccgagagggagagaaagggagaggagggcctcaccgatgatgatcaacgacagcgagcggcgagtcggcgacggcgacgggcggacgagctccggggtttcctaagggacacaacgagagaaattagagagggagagagagatcacagaggacggggacgccggccgaaggcggtagccatggaagtgctcaccggcgcacgaggggaagggggctccggcggcggaatcggtcggggaagcggcggacgggatggcgctcgggaaggcgaacccgacggcgtcgacggcacaactcggcgcggcggctagcggcggccagggcagcgggaggcagcggcggtgggtgcgcggcactagggcgatggagtgcacgggagagctcggtaagagaacggaaaagcgagaaggaggtgcgggcatcgtttatataggcacggagtggtcggacgtggccgggaacgggccgatttcgccggggatgtgggggaggtggacagagagagagagagagaggccggcttcgaatctcggccagctcgggcacgagcgcgggcggagaagtggggcggcggttgcaggggagtgcggggcgcgtgcagggtgtgggcgacgtgcacgggaggcgcgggagaggcgggaggcggcggttgtgggcgcgggcagcgctggccggaggagggagacgggcccgacaggtgggccccacctatcggcgacctggaggaaggagggggcgcgagaggtcacctgggcctcggcctcgggccagctcagctgaggacgcgcgggggagaggagggaataggccggcggcccaagaaggaaggaaaaagggagaaaaagaaaagaaaaggaaaaagaattttcagggttttttttaatgcttatgctcgattttaattagttgaaattccaataaaaatcttgttagcatattttgacatgtagaacccaagaaaaattccatatgccaattccgattattattttcattcattaatttaggatttctctcttgcctttaaacaaataatttcttgcaatgatttattaattgcatttaggattgggagaggacctttagggcgtgacactcagagctgacgccgcctcgcctcgcagcaaccagcagcccagctgatgtgtgtactgtattgatagactgatgtgtgttgctgttctgtgatgattgatgaactatgtactgaatactgatgatgtactgatggattgatggatcgatggagtgttttgctgtaatttttttagaatatttgttatgcaaaatatatgaagttatagaagaatatattttgctgttgggacataataattagacctgatataattatgttttatgatgaattgttggctgttgagacttgagaattggacttaacaaaagtttgaagctcagtttgaggggtttttgtattccgataaattttcgttgccatatccgcgccggttcgttttcgctctgtttttggtttcgataatatttgtttccgaaggttccgattccggttccgattccgaaaaaaaatgaaaatgaaaatgataaaggttgtttccgtcccgttttcacctctaatgcaaacaaccaaacacctgcatgtgtatcctctcagccaggctaaactcagcctggatggaaaagatgagctaggataaagggatgcgagcaaccaatcacacccataatgctgcgggtgttgcaatttgaaattttgctcaaacccaagatcgagttgggatgaaaatgaagcggatacggatgggacagataatgttcatatcatatttgtttttttctattttttataggtatgaataactcggttacaaaatcaaatacgaattatctatcgaatattatatgacacgaatatgaaaacaaatatttcttggaacaaaaaaaccacctataaacttttaatacgacaaataccatcacacataattagctcgtttggtaaaaaaagtttgatcatagactaaacattgctaattaaattcaacatgtacaacattgttcatattaatacaagtctaactaatattataacatataatttatattataatttataaaatattttaagatttaaataatattaatggtttggactagtgttgtgagaggcatgagaaatatggggtatgtttcatgcctttagcaaatatctaaatattttaaaaactaaataatattaaggttcacttgatatttgtatatgttggaaactccgatatcatatgtgtattcgtactggagaaaaaatatatcaattttcttatccatatctgaattatctgagaattatccactccgaatgacatccgtatttggttttcactagagcgggcagaaactatccactccattttcatcctaaattgagttcatcaaggtttattgcaagtggacctcttaagaccacgcctgtaaaaaatgattttttgtagacgggactagatttattgtatttttagctatttttgcaaacagtgattttataatctgcgtgaaaaataaaagagtgatgttgtttgcaaacaattaatgattttatagtctgcttgaaaacataaaaatcgtgatgttgggaaaaatttctagtagggcaaagtattgcactttgcatctcatgcataggattttccttggcaaaattcacaccccaaacacgtagtctgttaattaataaatataggataatgctataaattaaataagttacacttaattcaaaccgaccaaaacctctagatttgacacgagtgctcgtatttatggccaattattctttcagtggtagtcgatgtactcattaataatgagacgctcgtggtgactttatcaataaatatgttagcttagtcatttgaaggtacttatagagaaagggcgtgcgtgtgtacgtacatagggatgaatgtgcgcgcgttatgggcacatatttgtactttgtttttaaaagtaaaaacctccatcattagcttgcctagcttaaaaggagtatatatatatatatgcctattatatgtttcgaatatttgtgagtgacaatggtccacgccattgcctaatataaataatttgacttttttaatttttttagtttaaaataataattttaacaccaaataaacatactaatacaatatactatatatttgtttagtttcaatgagaataattttgtttagttttaataaataaactaatttggtgttgtagatgttgttaacttttttatattttttttataaatttacttaaagttaaaaatgtttaacttgatgaaaaaatcaaagtaacttataatataaaatggagggaacactaataatgattttattcttagctgagatgctaattagggtagtactgattctatgggctaactaaatttcccctaggaataagcaggtgattaagtggctggccttggagcatataataatattttgcaagatggtctccttaatctcgttgagatgctccatccatctatatatctatccaagtcgacctctctcttggaaaaaaaaaaagatgcgattcttcaaagaatagtgctcctcattttggtcttcatactctctgtttcgaatgacacctatcatgctaattgaaaaggttggcttggctgtgatgctgatagcccatgtatagtgtactttgtgccttttaattccaaatgctactttttacatgtttgtacgtgagaactgagaaccttccccggcgttctcgtcgcgttctcgtgcaagggaaatgatcgacacgaagctgcttaatttgcctatgaactttt

SEQ ID NO: 2138 - DNA, 10081 bp, Oryza sativa
agcctcatagcattttaggtcctgagttcaactgttcgggaaagcgatttttcaggatttaacgactttgtgcttcggggggtagacgacatatccgtcgataacgagacgcctatggtaactttaatctccaggatttatcggcccagtctttgaagatgttcatagggataggatttacgcgcatgcttgataggggtgagtgtgcgtgcgttgtgagtgtctgcgttgtactgtgtaattaaaaaaaatgcttcatctttaagaaacaaaaagaacagagacatgcttagggttgtagttttctaaagtgagacataaatccttaaatgcattttcacctgacaatagaacacgtattaattataagttgtgcagcgtgaccaattaaaaactacaaataaaactaagatgttcatgagtttttcacttgaatcaaggtgaaaaagaagaaaaccatcagagacaacacatatacagtgagagacaacacatatacagtgagtatagcactcgtgtatactggtctcatacaccaccagtcttttaaaagactacaaaacaaataaacgagaaacacatgaataagactacaagacactactaaaatacgatttttcatggcatcacagccttttatttttgctgatggactaacaaaacaaataaacgcttgtaaaaatatatggaggattctgggtcacgagctattagcgaaaaccgattttcgctgacagatacttaggaggtccatcataaaaaaaacaactctatttttttaggcagacctcttaagcgcccgctagcgaaaattgggttttcattggtggtagcaagcaccgctcgagaaacaaatccactctatttaaatactctcccataccactccctctccctctccttcaactctcaccgatgatgacggtgacgacggccacaacagcattggtgatgggaggcgggaggcggcagatccgacggcaggaaggaatgaggcggatccgccgccgctcacctcccgttactatcgatgtggctatggagccctgagtcccctctccgcccctcccctccctctccccgtcttctagatctggctcgagggagaggggaggaggccggcggtggcaacagcagaggggcacagtagtggctgcccctccactcacatatctagagtgctcgtttagaggtcccctagtatgcttgttccgttctccgtgcagatttgatttgaatttggggatgcttgggagctagggttgctagatgtgaatttttctgtgtgcatgatcttcccattctcttgcagatttatttgatgtagatgatttgcattttatattccataccagagatgatgctgatgctttgatttgtatgtcgtgtttgatccgtggaaatgagcatccatatgcatgtggtttttcttttttgccaaaatacatcatcactggcgatcgttttaaccggcaacatgtgaaaatcttcttttcgcagaaggctggcttaacctaaccgttagccaaaaccattttcgctggtggctggactaggtcgtctgccaatgaaaatccatctacgttggtagctggtaaccgtaagtgaaaatggtgtattttcattggtcattagtcgtggacggtagcgtcggctgccagagaaaacttaaaatgaccgtcaggaaaaatttgtttttagtaacgagagaatttcaagaaaaataatcgtaattgcttctggatgtgcagcagagacggatgctgtagcaagagataatacctttcgctacttttggcgagcgtgtgtgaaggaatatcagtcgggataaggcatggaggcggatacagaggctacctgagagttttttctcgaatggttactctgatcctcacttactataaaattataatacactaacttcaaaaaattaacatgcaaagatgccatatcatcatccactaataatcattaaatttaaacatcatacaaacatgctatataatctataattttataatttattaaattttatagcttttaaaatgtaagcatgttaaatcatcatcccacgtaattcacgtaatatttcaatatatatctttattatttttataatatgttatgtacctatatagttcattctcaatatcatttctcttttctctcgttatgctatatcactatatcacatcaattggtttttagtgcttaaatgaataatctatggtccaaattatctctctcattttcttctctcattaatctatatcacctcaattatatttagcatttagatgattaatctacggtccaaactatctcaatacttttcttcttttataaagtcatatgatcttccttttacatttgaatcatcattctatatactatttaaatttaaattatcataaaccatgttaacttacgtaatcttatattgtcaagcactctggctatcttacatattatttttacttatcgttattatactaaactcccgcagcaacgcgcggggtttggtttaaattgaagcccaacttcttagcgatcagctcttcatgtcaacttggctgcacattacaatactaggtttatggaaaagcaggagagaatgatttaattgatgatgatggtaaatgatgagcataggttatattattttcagggaatgccgaggctatattttactcatgcttgttatcacacgtaagacggtgaccaagtacgtaggggtggatccagaaaagttttagggcccctttaaatcgcaggattgagaaaacataggaataggaaaaacgtaggatttcgatatgaatataagtgtaaaacagaggattacaaaacaaaacacaggaatgaccgtttgattcaaccgcaggaaaaacgcaggaattggatgagagagatagactcaaaggaaagttaccaagaggttgaagctcttgctaaatttcctctaaaatctctataggaatgtccatttcataggaatttcaaaggattagatagaattcaatcctttgtttcaaagggcatcataggaaattttcctataggattgaaatcctctaaaatttctatgtttttcctccaattcaaaggggcccttagatcctaagcaaatctcattatatcaagtgtttgctatgaaaacttcatttctaattcataaaaaaacatttaaattctattccacatccacccgacgagtttgggtggttgtccagggctgccaggcggtagatccctgacaatatattggcaaaactaattttgattctagtttttgaatatgtatcaaatccatcttcttttgtaagttatccatggttacatatcaaaaggagaaatagaacagggttcatgctcaaccgttatgtctatcaaaagtggcaacctagtcgtgtctaaaaaaatattttctgtctggaaaccagtactagcaaccggtttttatagaaaaaacagagttcaaatgtttgtttggtataaacaattattacaagtctttttttttccaaattagtatttatagtgttggattgtatggaaattaatgcgcaacgtctgatggttctcccttgaaaaaacatttagaattagttcgaattagatattcagataggattttttgccacatgaaacaatataggacattaacgtccgattagttgagtattaaatattataaactttgataaatttatttaattaattttttaaaacttttttatatagaaaatttttttgtacaaaacgtattgcttaacaatccgatatatttctggcgaaaaaggtagcatttccgaatagctttagaacttagctactttcttcatcggcttcccatcattatttatatttgctaggtactaaaacctgtctctaactcacacaaaaacttgcttctttgtccatgatttttgaaaactaatatttctttaaaaaacatgtttcgtcatttataaaactcatattgaataaaaacgcatttggacaattcgatgaaatggccgtcgtcatataagtcaagatacggttttgaagtgacggcatgccattaatagagggaaatgcttgaagcaaaaggattttctgtgatggtggtggatggatgggttggacagggacatcgtcgttgtctgccatcatccgaaacagaacacgggcaacacgacatacacacaccagtccaccacatcacgcgctcgtattaccacggctgcgctgcaacacaaaaaatgcccagaaaaaaaatatatactactcccagaacgaaagaggaaataaaatattaatgttatagccactcaacaagacttaaatcctgaattttataaacacgtgaatacgttttcaatatatatttagggggaatttaaaatagaaggctctcatcgtttgaccagatacgtattagcataataataatttatgggtaaaacttatatatatatatatatatatgtatatatctgtgtgtttattcttgatgacttaaatgctaacgctgaagaataatctttgataaaaaaattcttgacgacttaaataccaatgctaaaaataatttttgatgaaaaaactttaaaatcagctttaaatttaacttttaaaatttaaattttaacgtcggttgatgctgaattggagaaactacgggagccgagctttagtaagagaaagttgtcgctcataacatgagtcagaagaggaagcattagtgagtagcttagcatggagtgtgtgcattgcggcgtgcgcgtattagtttttcgttcaagggaaaagggaaataaaggacaaaacgaaaagtggaaataaataaataataaataaataaaagtaaataataaaaaagtgattttcctcggcggcgaactgtctggccgtcagttcattctcccttttgcttttctttttctttcaacaaaaaaaaagaaaaaaaaaacgtcttttttagaccatccatccatccgttccgtcaccgagcgaagcagccgcagtcgtcgtcttctccactccaccccccacgcctccttccttcccttcgcttttacctccccgattcccctttctcctcctccctcctcctgctgctctctccctctacctctgttgccggtggaggatctggccggcttcgaggacgcctgtttcttgggatggtatgtcatttcttctctttctcgcggttcttgctgttcttgattttggggggtgatttcgggttgtgcgattgatgtagcttctccggggttggtggtgataattagtatttagttcgtcttaattttgggtcatgaggggtgtgtggtgtattttgctgctgattgttggtttgttatgtaaatcgtttcttctaatcaatttgccatggattcttggctctgtgtgtatcttgactccaaaccctatggtgaaagtgagacccttgagttgggagattaaagaacgaggtaggtttagttgctttggccctagtcttagggtggtttatcatattagtatattttttatgttttaatgtagtaaaatatttatgtttggtttgctgttagatacacaggagttaagcaccaatgatttcattcctaggttctcctttttcatataggggttctgcttctgaccagaagtagtagtgacctgtgtgcctttttttctgatctccacatgtttgggagttttgatctctcaattgctagcgaaaagttgtcataatgccagcctaatgggatcaatgccctaccaatttcttcgcatcctgccggatccattggaacagaaattaattagttgacccagtagaactgaacttttgggacatttattgctgtgtttctagttaatcaacttcttggatagctttccattaattctgaacaaaactggttcttttggatagctttcttgtgtcacatggttccctttttcccctaatttggtaatagcatattgtggttcttttgtatagttacacgattttgtaattatgaaatataaaagataaacacgatagcgcaggtttcttatgatttgagcttactttgcttgaaccaaacgggcctgttaggtaacaaagattaagtttcttatatgggttatttattttgtttttgaagcaagaggtcacatgccattaataacttgtaatgtgaaaaaatgcttcttgtttgtaatggttcccaattgcatttataatgttggggacctatgtctggtctttggctgctttttatagctaatatgttgatggccatgcctgcgtatctattacaaagcgggtcccaagtcccaactatttcattgattagcaagatttcttgatttcagatgtaacttatgctgaaagctaatccattgaacaaatacccttgattctgtttgctttaatcgtactttccaaaatataattttagttgaacaccatatgctatggcatagtggaagtcgatatgaagcttaggtgttaaatgaaaaaacctttttaacaatgtgcttatgtatccgtctcttacatggatcaatcttgtttgtattgcagttgatggtatcaacatactgaacatgtttgtgaaaaggacggcaggatcaactccctgttgagtaccattccacaagatttcaccagtatgtcagctagggcttcaaaccatgcatatatatgttcagatgattctcaaatgccgtactataataactcagtgccttcagggggaaatggtaggttctatataacacaaaatcatcaggatgctcactacgcttcttctgatgatgggtcacagaagattggttcgagccctcaagcatttgaagcgccgtactgcactctagaatcatcctcagcaaatggtgctcatcctgcccatagctctgcatcttctcacagcatctctcctattagcgggagccccctgtctcatcatgatagccactcagaccacacgtacaattcccctccaagtgcatcctgtgtcacagagattacagatctccagattaaactgagggagctggagaatgcaattcttgggcctgagctagacatagcttatgacagccctgagagcgccttgcaaccaaacataatggcaacaccagaaaattggagacagcttctgggaattaatacaggagatttgaagcaagtaatcatagcatgtggcaaggctgttgccgagaatgatgttcggctgacagaactactgatatctgagttaggtcagatggtgtctgtctctggtgatccattgcaacgattgggggcttatatgttggaaggccttgttgccagactttcttcctctggcagtaagatatataaatccttgaagtgtaaggagcctacaagctctgagctcatgtcatacatgcatcttctttacgagatatgcccattcttcaaatttggttatatgtcagctaatggcgccatcgctgaagctattaagggagagaactttgttcacataattgacttccaaattgcacaagggagtcaatggatgacattaatacaggcccttgcagcgaggcctggaggaccaccatttctacgaatcactggtatagatgactcgaattctgcttacgccagaggtggtggactggatatagttggtatgagattgtataaagttgctcagtcttttggtctgccctttgagttcaatgctgttccagctgctagccatgaggtttatcttgagcatcttgatataagagttggtgaagttattgttgtgaattttgcctatcagctgcatcacactccagatgaaagtgtaagcacagaaaaccatcgggataggattttaagaatggtcaagagcctctcccctaggttggtgactcttgttgagcaggagtcaaatacaaacacacggccattcttcccaagatacttggagactcttgactactacacagccatgtttgagtcgatagatgtcgctctcccaagggatgataagagacggatgagcgcagagcaacactgtgtggcgcgggacattgtcaatttaatcgcatgtgagggtgctgagagggtagagaggcatgaggtctttggaaaatggaaggcaagattaacgatggcagggtttcggccatacccgctgagttcagtggtgaacagtaccatcaaaacgctgttgcatacttacaatagcttctacaggcttgaggagcgagatggtgttctttaccttggatggaagaacagagtattggttgtatcttctgcatggtgttgacatgtctttggaagaagaagctcatgtacgtgcattgtttgcatctcacaatttttcatcttccagtgatttgtacttaaattattttgcatgttcctacatctgaaatcatatgcttaatttgtacactgccatcgtttcgcaggtcccatcacatctccatctccagcttgcaggtgcaagatgtaacacgagctttgctttgcagtggtgtagaataatgcaaactataactgtggatatctctagtcctcaattctccccatgctcaccatccatctaattcaacgcttatctgatcatctgagatactcaacatcagctggtgcgacaatcgtagcatagaagtcgtaaccttgttctatccatgctaaatatgtataatataggaatctggtattgcatccaaggctggatgctcttgctcttaggtttgacatgttgtaatgttcagtgatcaagctagacaggcccaagttggctgctagttttctatgtcagttgtgtacctgtgtagttgcttgtaaatttgggtgaatgctatataacatcagtattattgtctgttaatgatgctattttctggcacgtgtatttgtgtacctgtgttgtatcatgcagttagtacatatatatatatttttattttgtgtgtgcgtgcgcctttggtatgcagcagcatggtgttctgcatgcttgaaaatagctcaggttgaagaatttttctgatgagagactgcctggagcatgatggccatcgcagtgctataatttttcctatacaactccgttgaataggattaatctttttttttaaggagaataggattgatcttgctgattgctatttctaatgacaaagtgtatacgcttgattatacttttatgcagttttctagctgcgcaaatgcgaaatatgcaacatgatcgtctaaactaaatccttctgtagttttgtttaatatactctcttggtcgtgatttccacaagatgcatttttctctaatctctatcatggtcgcgatgaaccacacagacacactccatctggtcgccaaaatttaaaacctaaaccttttttaaacatctaaagagatgtatggaaattttatatctagtttgtcctcaaaagtataacattttataggagtttttatatgctttttgtaatagaagttgactatcaaggctgtattttgaagatcgtgttaatagaaacctaccctgaatttttaccataggcagaattccaccaaacaaaaccatgaccaagggtgtgtctagttcacgctaaaattggaagttcggttgaaattagaacgatgtgacggaaaagttgaaagtttatgtgtgtatggaaattttgatgtgatggaaaagttggaagttttggaactaaaattggcccaagctaagatggggtccagatcccctagagttagctataactccaccaggtggatttgaccaaatccatgccatcaattgtttcctctggctaagatgaagccacgtattaacttatattaattaactccctcaatcacatatgctcactactagagaaacgatctttgctaggtcgacccaaaaccacgatagtcccggttccaaaaaaactgggactaaaaatcatctttagtcccggttaaaaaccctatagctattttatgatctttagtctttagtcccggttcattccatgtcagtaggatgtcaggtgaccgaggatctttagggactaaaaatcatctttatagtcccgggtgggaatactaaccgagactaaagatcaatatgatctttaatgcgt

SEQ ID NO: 2139 - DNA, 1963 bp, Oryza sativa
aagtaacttaagatttgggatgttactttgaattagggatttggggatatacatagcactagattcaggagaaaatatagggactaactctaaaaaacaataaaaaaaggaccatctgcattgccgctaccctctctttaccaaccgggactaaagattcctctctttagtcctggttggtaacaccaaccgggactaaagatctatctttagtcccgagtatttgaaccgggattaaagatagcgatctttagtcctggattcgtactcccgattagaaaattgggactatagggagttaccaaccgggagtaaaaaggttatctctaccagtggcttgaatgaaaattacttaccttttcttctttttatgttcctaatgagtatgtttctgccaacaacattaacaaagtttgcacgctttcttcttctccaaacaagaagctatggtcatgtataaaactatgttaaacatttagtacatgtaaacatgcataaaccatatacacacaaaaatattgctaaaacattagagccacaagcccaatatgatttttatatcgtggatgaaccatgaaatttctaggttatgcaagtaaaatcagtttgtatattctttagatatatagtatttgttgatttgttacaaatattaggatgaaaaaaaagtagtgggaattagttagttcatcccaaccgttgttatatagagacgactgagatttgatcaaatccatcgggtggagttggagtgaactccagggaatccccacccgctaagatatgggcatgtttagattactgccaaaataaacttttctaaaatttggcagcaaaaattttggcaagttagcaacattgcaacattgctaagttttaggggttgttcagattggtgtcattttaaacaatataattgtttgataaaattcataaccatatgactacatttagttttctactttcatattataaaactttctagcattgcccacattcttatatatgttaatgaatcttactagaaggttttataacctgaaacggaggtagtactaaacattggtaatgtgaaaggaatattgccatccacccaaaacttgataatgttgtcaacctattaaaattttagcattttcaaatttttataaggtttattttagtagcagtttaaatatgctcttagtagaaatgtagaatgggttacatatgatgttgccaaaattccctagatattacaaatgttggcagcaaactaattgtcatatgattgtcaatttaccaaacaaatgatatgtttaaaatggtaccaatctgaacaggtccgtagtaacttgatacggtgatacataaggtacacagatacatatttactcatataatgacattgatagatgtataatttaattgtcgcataaaacaaggatagaaaataattttttggaattttgttcaccctacccatataaacacctacgaagatagattgacgaagtcaccataacagacgcttagtgcttatatacacgcacacacgatacactcaccatacatcttcgaatacttgattctcatgtcttagtattgacagagtcaccacaacagacgtcttgttgtcaacgtgtcgtatatcctgaaagaataattaattataaatatgagtacttatgtgattaaaatccggatgggtagtttaatcggttcagggttatataatattcaaaacaatggcagcatggttaggccaagttcgggagtgagggttagtaacctttactccagcacgtaaaacgaagtggcagatagagcatgattaattaagtactcccttcatcccaaaatataaggtattttgggtggatgggagtacttataaaatcatgctctatcagccacatcgtttgacgtgctggagtaatggttacaacccccactcgcgaacttggccgtaccatgctgccat

SEQ ID NO: 2140 - DNA, 12595 bp, Oryza sativa
  unsure (1)..(12595): unsure at all n locations
tgagtaaataaggtctcaacccaaacataatcagtctattttttgggttaatagaattcatgccactaaaattttcatggttttgaaaaataccatcattatttatctattatttatctatttagatccatgccattacaatttcataggaactcaaaatatgccactacgtagcattttctattttttagaacaaaattcccatgttcttcatccccttctttcatacttctctctctaggtggaggggctgctgatagccgacacaagcgagtctaccatcccgtatcgccctgtcgcctctccatcgtcgagttccaccgcccacgcgtttcctcgtcgccgagttccactgtctccgcacctccaatgagttgaacgtagcagttagcactctcgggctcctcaggtagggccgatgtagctgccttcgtcgaatgtgaaggtgtgggggcgatgctctgggatttagcgttgctctcgccagtggcaaatcgggccgtgaccggcgagggtgtttgagcgcagcagatccaaccatgtccgggtaaggaggaaggtggtgtggatccgacgcgacgaagattgtcttctccctcgttagagtaggagcagctctctctctctctcccagtgagctgcctcttgctggtgtcgggcgttgctccgggattcaatgtccatgctagggcaggcgatgcatatccgatgacgacggaggcaagggggcttggatccgcgtgctcgtcgctcctccccacccgcctcctctctcatctggcgacaaaccggtgcatgagaccactcccagcgtgacatgctcgtcgcagcgtcagcgagatcttggagacggcgtgtccagcaacagctcagtacggcggtggcaacgagctcgtcgcagcggcatggatccatacgatttgattttttttatggtgcttgattgtacgagatgtaggagacgtgatattttagtctaaaaatacggtagaaaaaaatgtacaacatgtcatgtatccaattttagaaatactgcagcggcatcttttcaattagtcgaattataatcttataaatttcaaaactagaaaatccaaataacctttgtttttttcccaccaccaaactctggtaatttatatttaatatttttcttattactactaccaaactcgaaaaatatttattttggcaagaaaataaaaccaaacatatccaatattccaaaatattactccctccatctcattttatattgtaagactttttttagttatctagatttatctactgattatgttttctatatatgcctagaatcattagtatctaattatatgaatttacgtaatactagaaaatcttatatcgtgtaacggatgaattacggatatacgtacagacagtaatagaaagaaagaacttgtcggtaaataaacaccacctccctctgtccaataaactgtacggtaataaccagcttattctccattcctccgggaagaagaagaagaagccggcgactcgccattgattccggccgccgccgccccgctcccccctcgatcggtcgatccggtgatggggctgctgttcgtggagctgctcccgcggcacggcgacgggggaggccccgcgtcggcggtgctcaagtgccgccggtgccgcgtcgacgccgcctccgccgacgccatcctctcacgggacttccgcggccgattcggccgcgcctacctcttcgaccacgtgtacgcgttctccctctctctcccgcttccgcattgcgtgttgccttgtgttagctaggcggttcttgggatgatgatgatgatgatctttggcccaagggggtttcgttggtgtgggggtgtgttcgaatcggatcctgcggaggttgattcggccttcgttttgggatggaaatcgatgtgggattggattgctggaaatgggggaagaaagaaactttgggtgtgcccccatgtggatggattttggtggaattagcggcattgctgttgttgttgtggtttttttctagaatattattaataataatgcaatgtcaccactgaagatttgtggtcggatcgattgattagcatggtcgggtgaattgatttgcggtatcaattgatggtgttcaagccttcaatgtatccagtttattaggtttggcccctttggattgcctgcaaggacgggccccgaatttgatgaatgatgggctcagccattgccattgcctccttgggggtggttttcttaggaacttggtagtagcattttgtcttgttcggatcattgcccttgatttatcgcctaatatcactgcgatccccatgctgttttctcaacctcctactgtatttctctacaagattgaccaccttaataccagctcaaccatttcttcagtgtattctagagctaattttgtgatactgatgtagttttggcttcaacaactagttttcacttcgaatcatggcaatgtattcagcttatttgtagaatgtttcacttcgaatcatgggaatgtattcagcttatttgtagaacgtttcacttcgaaacatggcaatgtattcagcttatttgtagaatgtattcaatatctttatgcttttgttctattcttttcagggtgaatatatccttagggcctaatgaggatcggtatctgatgaccggactgcatacggtgaaagatatctactgtagctgttgccagcaaattctcggctggagatatgtaagttaacttggaaatttgcttccatgatcatataatagttgcctcttatgcagattagatatgtgcattccgtggagaaacttgtagaatgttgcattctgaaaacaaaaaagttggatacaaacatgagttgaacaaacagtggataggaaaataggagtctctatgcttcttttcaccctcttctacagttctacttgtagtatttcttccttctactccaacttaaagaattctcagatttccataggctcattgtcctatcacataattagttgctaccttagcccagactttgcattagccacatcattttgtctcagtttgttatgtaattttattctcattgcgatcaattgataggatatgcatgtatctcaaattcataatatgcttggttcagtacttcagttggatatgtaaaattttcagattgatgtctatttttcagatgtgaatggcaatgctaccagtcaattatagtcaacaaacttaacatataaatgtgcatcaaattcagctttcaaaaatattatgctttgttttaggctttctattgtaggttaggcctacacttaatccataaccattcaatataataacaaagtcttatgtttaatactcccttcatcccaaaatataagcatttccggctatgaatttggaaaagtatctgtccagagtcatagcgagaagtggacggagggagtagctagttttgcatttgatagatgaggactaacattttaacaaaatacaacttgatgctgaaacatagtatccacaaaacactagtgtaggcctgtggggcctcctatgttaccagcacgataatgtggccttctatggtactaaagatttagttgctgtttgctgtggaactggaatatgttgggttagattctgtataaaccatttgtttgccttcatatctagctcatcattgcaactacatatgaactgtagttttctagtaatcctgtgtaataactgcattatacagctattttctcatctgaagttctgtgttttgtgacttccagtcaattttgtatgctactattctaagccctatgtcccatgaagattcaaggcacagatcctgcaagtcgtttagaaattttgcattgttcttgtacccattggttccatcctggcatttaagggagtacatcaactgtatttttttttattgcagttacagtggcatctttcccttaattaaagttgcttgaaccgacctctactgaaattcactttgtttaataaaccctgaatgtggcttatcttcacctatatgctaagttgcgcatctaaggttctctttcagttgcgtgtgggtaactgctaacttctgttttttttttcatagcttctctttcaatttttcataactgggagaatttatgtgtttgtgacatgtactcacccattcatcgtacgtattagcaatgcaataactttgttctggcatcaatacagctcatttaccatattatctcgatgtgacagtcttcagctcttaacactgcttcatttgtcacctcattgttttattttctctttttggattgttaatttgcacctataatgctctacaggagaaagcatacgaagagagcgagaagtacaaggaaggcaagttcatcctggagaaggccaggatgtggaaagaagcccggtgaaaaagactggcgccatggaactcatcaacctgtatgtatgtattttgtgtagatccaaaacaattcaaagattgtaacaacaactttggcggcgatcaaagtttgtatgcatgctgtagttgctcatgcagtactagaccccctcaaaagaagagatgaaaacagctgcgtctgatttgggggggacgaagattgacaacagaagtagagcatcactgtctttttgatgcaaattctggcacttcggtggtaacggttttaaccgaaaaatgatgaagtgccagagattaacatttgattagtgcttttggccactcatggcgcagttcatttcacactttgttgtggattagtagtactccctccggtttcattttaattgacgttttggacaatggcacagtctacaaaatgtacctttgaccttatttttctattataatatacacaataaataaatgcatgtttacttttataatagtgttttgaaagacaaatctatatatgtttatctagttttttttaaactaagtagttttgaagttattgatggtcaaagttattaaagtttgacctcaaccttgttcaaaacgtcaattattatagaaccggagggagtaattaatttcactttcttgctcacctggctttaccattcttctgtcggagtttggattgcaacctgaagattggccgagctgtatacgacatacctacatgcaaatatgcacaaaacacatacttgagagctatagatctaattgttgactatatccattgctaaataactcccaaacaacatactccaagcacattggagaatccgataatttcctcaacagagccccgtgtggccatattggaaattccgaagtgtatatcagaattccgattttttctttttgtccaactaaaccacttgtgtgaccatatcacaaattccgatattttcttcaacagagctacagaacgtcattttagatattccgacataacattggaaattctgatctattgaaaattccagcaacttgaaagttttgaaaggaactctgcaacatatttgagcaccaaattttcaacgctagatttcgaagtgatatcactctttatagtagagcttttcctatgacacaaataagagaaaaaatttaccataggagtttttcccatacacttttcatttccaattggatttgctgaaaccaatctttccataccatcaaagggctaaattcactgtgcacattctcaacaaacttgttagtcctccctattcgattgccattaactaccaaaataattaggggtctagacgcactttcaatctccctttttttttgtcgatcacaattcgattagaatgtaataaaaagatatatgtaaaaagggttttgggtccaatgatagaagtttagctcccctagaattgtgcataataggcatgtagagagctcccctaaatcttcacataagattgcttgaaagtatatatacatgacatagcagcattcacacatatgggctagaaacgataaataacattacatcacatagtttgatacaccacatatgcattaagttgaacaaatcttaaggaaataaaaacacacattgtctcatacaagcaagcccaaatttgtccgaccaacaacaatgatagatggaaaagagatgtggctctcccccctttggcatcgaggaccaaaaagagataaattaaaattggagagagaacctaatgccatatggagtcaatcatcatgcccatcatcaccactatcaccatgtcccacaccttccttctcctgaacgacaccactactagcttcgtcggcaaagggatcatcgaacacttcttcatcactttcattgacctcggagccatcgggggagcaaggaaatttgtagtctgcttcttcaattccgctcgccccttcctggcttcgatggcgttggacttgcacacattatagatagacttgagaattttccacaacagtgaagaagagagagtcggagtggagggagcttgagtacgtgcagctttagtggtagaccttggcctcctaggagtggtcatgggtttctctagcctcactttgagtccagtgtggtgcacctccttgtagaatcgaagtttggtgacttgctcaatcattttcatcaatatgggagcatagccaagactccactcaggagtgaaagatgtgaggcgaatctcctcccaaatgaactcaaacacatcaaatttcttcggagaagccctcatccttgcaagaatgttgtgagtgtaagattggacattgttgtcatcgtcatccttgggagtgagtgttttgcgaatcatcttgttgagataggcaaagaaaggaagcataccctttgttgtcccagggtcgtactccaccttatgattgtacatgaagtcaacctcatgaggctccaagaccttgtcatcatgcaaccaatccctgtcttcatcatcatcaaaggtgagatccaaaagagcagcgaattgactgtagttgatgcaatgccattccccctgtgtcatccagtgcatggtctttttcttatttcctttggtaccaaactgtggcatagaatggacagatgatttcctcactccaatcatatctcatgctcatgaaatccttgatccccatggcctcacaagcctcaatcacctcattcatcacggggtcgccataagaggcagcagctctccaattaatccactgcatgttggacttattcatgataaccgcctcatagaagtcttgctggaaaagagtccaaaaacgaggatcggtggctgagcggcatccattctttgggatctccactcttatcatctgcaccttcttagtcttggcactccaatctatggggttgcgaacatgttcagcacttcgagcggggaggtgcacgaacaaaggactgatgagagcacccttctccctacattccccacccattgtcggtatctcctcttgtacctcaggttgggtactagaactagcacctgcaagacttgttccaacggtggtagctttcggcttcctaggtgccctccttttcagcaaatcaccacccctttccacatttgcgacttgagtttcctccttccctttacaatcaaaatcatcaccatttgactccgaggaggaagatcgaacccgtcgccgcttgccattctaagtcttgtgcttggtgtgggccatgaagctctccttggaacgagtggaatagcagaaattttgatccttgaaggcccccttgagcatgaaagaacactgagtgagagtgatgactgagtagatgattgacaagagaattgaaataaaaaaataaaggctgcttgaactggtctataaacattggacattccaataagtgatcagaatttctgatcgcttcggattttccaaaaagcatcggaatttcatatcgacccgatcggaatatacattattttcagacatagcccaaacaatctcgacatctagatttatagccaacgaaatcaaatgatactctaggcaaggtttctatacgactatagcaacatcttcaccaaaaggatttgaaagataatccctagaatcatagatcaagatttggacaagaaccagggcaaagaaggggcaagaatacctcaaaaaagagagaaacacgccttggtgaagatgctgggaagtggatgccgaggatgccaacgaactccggcaaaggcttgccggctcagctgagagtttcccaatgaggatgcaccaccgaggttgcctgcctgagaggagttagaggagagtgagaggtggcggtgaaaactgaaagagtgcaagaatagaagtgaaagggtatgtatgttcagttcaggaaaagggctgagagagagacattgcactttcggaaatttctgatatgaactttcggaatttccgatcaatgtaaaggatttctgatctgtgccgcgtggacgccatcctctccagggacatccatggctgcttcggctgcgcctacctcttcaaccacgaatgtgagcctcccctcctctctctcctccaccccttgctcgcgcattgcgtgcctagcgaagcgattcttggatgatcctgggttcttggccggctggccgcaggttctgttgattggccgtggtggtttggaatggaaatcgccgtgggtgcgagaaattttgggggattggattgtctggaattcggggaaagaaggtttggttgtgccaatctgcatggattctgttggagtcgtggtcttctcttagattattgcaatgtcacagctgcagatttgtgttcagggtcgattagcatgttggactgaattgctttgcaatatcaaatcgattaggccatgatgtaaatctgttgcagtaacagatatcgacttgattttgttgttgacatgcacatcggtttagatgaatgattgcctcagccattgcctccttggggtggtttgcttaggaacttggtagcattttgtcttgttcagatcattcccttgatttatcgcttaagatctcaccacgatccccatgctattgtctcagcctcctcctgtatttctctaaaagatcgaccaccttaataccagctcatctccatttcttcaatgtactgtataatagagctaattgcttaatactgatgtagttttggcttcaagagctaatttccagaaaccacctaacatatggaccagtttgtttaattactagattgactttggatcatcgcaatgtattcagtttatttgtagaatgtattcaatattgttcatgcttttgttctgtacttttcagggtgaatatatccttagggcctaatgagggctggtatcttatgaccggactgcgcgtataccgtgagagacatctattgtagctattgtcagcaaattcttggctggagatatgtaggttatcttgaaaatttgcttccatcatataatagttgcctcttattttttataacatataattactaggcaaagtcctggtagtgctttaaatcaaaaaatagttgccccttatgcagattacgtatgtgccttcctgtggagaaattcgtagtgcgttctgcagaaatttgttggatagaagcatgagttgaattgacaatagtggataggaaaactagtactccaatctatacttcatttcaccttcttcttcttgtagagtagtagtgtttcttcatttcagtaattctcgtatatttccataggctcattgtcctgtcacaattatttgctaccttcacaccgatctttgaattagccatatcattttgcctcagtttgatttgtaattttgttctcattatgattttattcatgggatgtggaccatgctatctccattcattatcagattgctaccagtcaattatagtcaacgaacgtcacatataaattagacctacacttaatcaataaccattcaaaataataaaaaggtgtaatgactaatgtctagctagttttgcagttcatagatgaggctaacattttaagaaaatatggtttgatgctgaaactttaggagtattcgcaaatactagtgtggggtctcctgtgctgaaaaataatgtggccttgtatgttactcaagattttagttgctcattgctgtggaatatgtggctctagattctgtgtaaaccctttgtttgccttgatatctagctcatcactgcaagtctgcaactacatatgaactatacaactatgtaatagttgccttgattctgtgtaaaataatgttttgtgacgtccgatcaattttgtattttactattctaagccctatgtcccatgaaggttcaaggcacagattctgcaagtcgtttagcattttgcgttgttcttgtacctattggttccatcctagcagttaggagagtacaataactgtttattattattatttggcagtcacagtggcatatttgcgcttaattaacaaagttgcttgaattgatctctaatgaaattcactttgtttaaaccctgaatttggctaccttcacctatatgctaagttgcgcatctaaggttcttttcagctccttgtgactgctacttttggtcctagcttctccttcaatttcttgtaactggaagaacttatgtgttcgtggcatgtactcacctgttcatcatacttactagtaacacgataactttgtattctggtacacatctcatttatcatattgtctcgatacagtagtatttccttgagggctgtgtacatccattgtggatgtagaggccagattttaatccattttctaaaaaaaaaatgtagtatttccttgagctcttaacactgattcatttgtcacctcattgcttttttttttctggattattaatttgcacctataatactctacaggagaaagcatacaaagagaacgagaagtacaaggaaggcaagtccatcctggaaaagaccaggatgtggaaagaagcccggtgaaaaagatctggcgccattggaacacctcaacttgtatgtatatattttgtgtagatccaaaacaattgtaagaacaaacccagatgaaaactgtgattttaattctggtactttggtggtgacggttttaacctaaatttgatgaagtgccagggatttagtaacatttgattagtgctttggccatttatggcgccgttcattacacactttattgtggattagttaatttcactttcttgcttaccgtccttctgtcggaacttggattgcaacctgcagattggctaatctctacaaaaaaatggtaatttcgtagtcttccattcgcagtactacacaaaatttaattttgatgcattcactattttaaccaaaccaaatttcggtaacaagaattttaagtcactcaactataggccgagtttaatttacgtcccttgaccataaaatcggctatacaacatctctcaattatcaaaaccagtccattttgtgtctgggtttcataatggattttgttctacgtggttgagtgaggcccacatgtcggtcacatgagaagaaaaagaagagaggggtgctgaattgccagtgaacactgcagagggactcgattgacactagtttttgataattgaaggattctctatatctaattttatggtcgagggacgcaaatgaaattcaaaatataactctgagggacctaaagcagaacaattccaggatagattttttgttttacctgcactgtggtaaagaacaaatttgtgttaaattatgaaattttaataatattaccaaactattgataaacttgagtatattataccacggatttgagtatttttccttcatgtgtgtggtagtgaataacctcctctatttcttaatttctctcaaagttctcttagcgtgtgtttggttttgggactaggtttggttctgggactaggtgggatgggatgaaaccatccctgatttgaggattggaatgattccattcgggtgtttggtttgtagaataggacgatcccagttttttgtttggttcaaggaacgagggagggatgggatgagcgccgtttgcaaccaccgacaacgccgtttgcaacaaccatggccgacgccgcctctgccctcacctacggacgtggtcgccgccggcctccttgatggcgtcgatgagcggctgcagggggctcggcgacggcggcggtagacggctcgggcgacagcggcggcggcgggctcgggcgacgtcggcggcggtgggctcggcgacgacgacggacgggatgacctaaccgagcgctgacggcgatggtgtcggccttcgcgcaaagcagccgcggctcggcgacgacgacgncggcgaggtccgcgcgggagagggagagggagagaccagtggagaggagggcgagcacgaccaccatcgtggtcgggcgggcggagaagcgcgacgactcacggtcggccttcgcgtagagcagccgcggctcggcgacgacgacggcggcgaggtccgcgcgggagagggagagggagtgggagaggccggtggagaggagggcgagctcggccaccatcgcggtcgggcgggtggagaagcgcgacgacgcacggtcg

SEQ ID NO: 2141 - DNA, 5599 bp, Oryza sativa
agccccccactgccgccgttgccgagcccaccgccgccgtctcctgaggaagagcgcgcgagcaaagcggcggtttcatgccgtcgctcgtcacaggtgggaggagttcgtccgccagttttggctggaccgattgatcccggatctgagaggaatattcctctgtagggaccaacccatcccactcacccctgaaccaaacacccctaaaaatgggttcatcccatcccatcaaccaaacactaccttaggatggcacattgagctgacaagtgtattggtttgaatcaaatggagaaacaatttgattggattatttttattggtagtctggcaagtaatattaatcatgactaactatattttttggtgccacatttttcaataaaagaatcaaaatgtgtaccgtgaattccatatattgcaacttcgattccatatatttatactataaattttaaatcttagaacatgttttttcaatgctcgtcgtacaggaattatgaaaagaaaagaatcaataaaaagtattagaaaagttgtcgatgtttcatattcccaggtggctaagtatccgtgcataattgtgcctaacaaggaagagaaaatcgttgtgcggggtgccttgaggatatttcctcatatgctcgaagttgattccgactcctcgtggggtgtggatcccctaaagttgatgctaaaaccacccgacatagttgcaaaaatgtcaaccatccctctatttctaccggttgagattaatttctcctaattaactctctctcaattagtattgatttagtgagaatgtatcttccttttcaacaatgagataagtaacataaatgtgtatatccccgtgagatcggtttatcctcattctgcatattgaaatttttttttgtctcggacaacactacttgaaattgatctaatgaaaacaaaaggaatatgcatatgttttctagattatgttgttcttgcatgttattttggtaaagagtgcattattattttttagtgttggatggagtgtaatcgttgttgtggaagggaacatcttaaaacagtagttttcctttaattccacactaatcaagttaattaagtgcgatgaggtgtcttaattgatctcatccgtataaacaaaataatggctataagtttgttaaatcgtcctataggttgtaaatgggccaggtctttccgtatcggcctgggcatgtatttatagttcacgacccaagaatggcatggcccgtttggctacgagtcatgttggcatgacccgtctagccatgttgtgcttgggccgccaccttagccccacgtgccaacacgacaattgcatgtagcaaactagcatgacatggtccaggaatggcacagcacggccagggctgtgcggcatggtggcgaccgacgaccggcgccggccaacaaccaccagttgagcagctactatcgtgcaggagctaggaggaaagaagggaagaatcaaggaagccaggggctcgaggcagaggaagcgatgatgggcgctcatcgatgtaggcctgcacggtgacgtggtggagcggcctgccccattctgaatgtgtcggtcgttgaggcctcactagctcggggtggaggaagtaggaagcgaagggccatgatagtgtttgatgaggaggaagaggaatgtgatatcgttgagcggaggacctctctagagctttactgaagtttgtgcggtgggatgcaacggactctattcacctttttttcttggtatatatcgaatttgggttacgggcctccacacaacctacatacccatttgtaccaggctgacacgacacaactaaacatctcactggatcgtgtctaggctccggccttagcatgtgggttgacacgacatggcccattggtgagccgtgcctaatcgggtcatggccaaatgtacttatttatccaccgtcttaaccctataaaaaataaaataaaaattcatcgtcttaatggcctagccctaggggatcctgacttcctgaccctttgtgagttatcttgatatctgacgggaatttaattatttggcactttacggactaccactcgtgagatgtcattttttctggatgaacttacagaaatgccattggagggagagagagagagagagagaatctttacaaattgccaatttgcatatgtggaaggatatgtcaccttgccaacatggacatgaaaatgacccatttacccctggtttgacctcagtgtatattgaatgtgccaataacatacaaatacaatatttgatcaattgtatactatatatactagcatatgaatagattttcatgtttcaattttttttatggatttatcctgtgcaaaaattttagtaatgtgaacaagatatgagaggataaatttgtaacaaatatttgaagtacaatgaacctattggatctgctagtaaatatgtttgtatatagttgctcaaatattgcacgtgcattttatcggcatactcaatgtacaataagatcgaacgagggcaaatgggtcattttcatgccccctccatgttggcaacgtgattagcaatttgtaaagatttactctctttctctagtggcatttttgtaatttcatctgaaaatagtggcatccaatagcctagttgtaacaatcgaactgaaatgggggtttgacaaaaaaaaaaaaacagaaccagtgcctagtctagagatgtaattgacttgagaaaaatcatttaaaccggattatctgcagaaccaaaggaactagggtggcctagggatcaaacccccaacggtcaatgcatatgggttctttcacaactttacctaacctttaaatattttcatgccaaaactgtataaaaaagtgagtacatcgtattttagatccaacccttaaattttataaggaaaatagttgggcccgttactatctctacctatatacatgcgtgcgcacctgactatttgggttagttgctaccatgattttagaaatatatcttatgttgattaaaccaaaattctcaatataaataaaatatataattttactattttattgaaccgatggaagaaccggccaatcgatggattcattcaccggttcgaacaccggtcgggtttagggtttagagaggcaatccgtaggtggtaggaggggccccatccgtcatcctgctgcttccgccgcgtccatcctccctgcttaggttagcccttcgcacatcctccgccgccgccgccgacgatccccatcaatcccgcgagcgagcggggccccgtcgttcgtcctcctgccgcttccgccgcatccatcctggttagcacctcctctttcccatctctctctctctctcgacccacgcacttcacttcttgtcgaatttgcgttaaccctagttagctcgctctgtgttctagaaatttgccttgatgtttggcatgttagatccgcccatggtagttgggggggggggtggagcgagtgcagactgatttgtttacaggatgatttgatagatggtgcgtaattttgatgtggctttctgatttccgctaatctcgtgttcgtatctgtgctactgcagtaggatcgatggaggcgaagttatcgttttctcaggacagcccgccaatttccataatttctgctgctaaggttgccggtgtctccctgtccatagatcctagtcttgctgcgggctcagcacccgttctatgcttcagttctgggtaagtggctgctcttctctgtatgtgtttttttttcttcttgtaggattgcataaggttctaggcatttgtttagctatctggagttgattagctataagtggagatgctactaatggcaaaaataaagatgttgttttctttttagcaaaatatgatgtttgaacgttgtgcatcattactgaatgcaatttattgctgacttgtgttttccaagtggctattattatgatcattgttttgattatatttttcacttggctgtgctgtacttgttttttcacatagaagtacatgaccaattttagtttccaaattatcactttacttttacttgtcctttattttatcttttgggtttactcaccatctggaactgatagtttctcatgggaatctttgtttctacacagagaatcactccgtggtatcaaccctattctcgagtacattgcccaatcctctccaagcctccatggccgagatgctattgagtctggacatgtatgctgtgaccaagttcttgctaaaacatatttcataatctttgttttgttagtgttctaaattgctgttgttaatgaactggcaggttgttgaatggcttgaatacgcccccaccttccttttaggatcagaatttgaggttgcctgctcatttgttgatggatacttgatgtctcggacctttctggttggtcatgttttaacgattgctgatatcactgtatggtcaaatctggctggtgagccatgggcttctttcacgttctactctcaagcttctcctatgcttcataatgtgcgctaacaattgatgtatatcttctctttcagggattggtcaacgatgggagagtctacggaaatcaaagaaataccaaaatcttgtccgttggttcaatggcatagattcagactacaaagacacattgaatgaggttatagctgcttatgttgggaaacgaggaattgggaaatcccctgcaccaaaccttaaggaaaaggttaatgactcaaaggatccttcagctccagaagttgatctccctggtgcaaaatttggagaggtgtgtgttcgctttgccccagagcccagtggttacctccatataggtcatgcaaaggctgcactcttgaacaagtactttgcagaaagatatcaaggtcgattaattgttcgatttgatgacactaacccttcaaaagaaagcaatgagtttgttgaaaacctcctaaaagatattgagaccctgggaatcaaatatgatgctgtcacatacacatctgattattttccaaagctaatggaaatggctgaaaaactgattaagcagggaaaagcatatgttgatgacacaccaaaggagcaaatgagaagtgagagaatggatggtgtggagtcaaagtgcagaaataatactgtggaggaaaatctgtctctatggaaagagatgataaatggttctgaaaggggtatgcaatgctgtgtgaggggtaaacttgacatgcaggatcctaacaagtcccttcgggatccagtttactaccgttgcaacactgatcctcaccatcgtattggttcaaagtacaaggtctatccaacttatgactttgcttgtccattcgttgatgcgctggagggagtgacccatgctcttcgttccagtgaatatcatgacaggaatgcacaatactatcgaattcttccagatatggggatgaggagagtagaaatatatgagttcagcagattgaatatggtttatactcttcttagcaagcggaagctgctttggtttgggcaagacaaaaaggttgaagat

SEQ ID NO: 2142 - DNA, 6011 bp, Oryza sativa
ttgatacaatttatactccaacaggtattactatctgctagttagctcttgctttgtgttatttacatatgaaaatgatgaatcctgattgcatgcccatttctttgctgaagggtgcttcgaaaaatttgaatcttatggagtgggataaactctggacaatcaacaagaaaataattgacccagtttgtgcaaggcatactgctgtgttgaaagatcagcgtgtgatcttcaggcttactaatggtccagagaaatcatttgttcaaattttgccaaggcacaagaaatttgatggtgcaggaaagaaggcaacaaccttcacaaacagaatttggctagattatgctgatgcatctgcaattagcaagggtgaggaagttactctgatggactggggaaatgccatcattaaagaaatcaagatggagaatggagtaattactgaactgattggagaactacatcttgagggatctgtgaagacaacaaaattgaaggttacatggcttccggacatagatgatctggttcctctctcattggtggaatttgattacctgattagcaagaagaaggtgagttagcaattccagctagatgtagttagcatgaaagcttcttgcttgccttaactcaaatagtctgtcttttttacttgatattacatgctatcttttctctagtttctctatgtggatatcatattttcctgtacagtaatgttttttaaaaaaattgtggaactaaaccttctctcttttgtcatgcaaaatgtgaaccatttcttgggtggagttagctcctatattactcgttcatttatcaatgagttaacactgaatgtcttctatgtttgtggccatgtgtacagcttgaggaggatgagaacttccttgacaacctgaacccatgcactcggaaagaaaccctggccctaggagacgcaaatatgaggaacctcctgcgtggggaggtcatacagcttgagaggaaaggctattacaggtgcgatgccccttttgtcagatcctcgaagccggtggttttgttcgctatccctgatggtcgacagcaggccagtttgaactaggcggcatgattctgatgagcttctcaagtcgttgagttgtcagagattcctgaatgctctactgaaacactcccatctcatactgtaatgtcgcttatgtgtcatgggtgatttgcgctaagttttggtgcacagtttaatgtttctcatgctccatgctccagttattaagaagacacaacatttcttagatggcaacgtgttagcttggcgatatcatactgccagatacaagcatctgaattttttgaagactaatatctgatattgcttggcatctgaattttttgaagactaataccgctctgggaaactgagttgaggacatttctggtccatattgcttgacatgcccttttatgtttccagttgttgattataactggtgaatctaatatcagtgttcgttggttttgtgtcagaaatcttttctacttttgcaaatttcatttgataaaattcctactttttttcctttagaaaataaaatgttcattgctatatcatcccctacactaacatttgggtctcacatttcatattattacactatcctttaataaagttctctcccattttatgttggctcttcaaaatcattgtaacgatgaaaatgatgtaagtactatttggactaaatatgtgcttaattgatttatgttgtgttcttttccccttctttctcaactcaactttctctttttttcatgcgcatgcttttcaatctgcttaacggtgtgtggttttttttaaaaaaaagttttctatacgaaagttgttttagaaaatcatattaaccctttattttttaaaaaaaactaatacttgattaatcatgtgctaatgagtctgtgtgggattagttaacaccaaatgccgatcgcagccttaataaggtcaatttgtttttcgttgaaatgccgattcttatgccagtgagaaactgagaattcattagaaatgcctatgcctctaaaatgaggcttatgcagtcagtcattgtaggctaacgaaaacatgttggttagttgattacaccttgcgattacatgtaatactggttgccacttgctacatatactgatatatacagatgcagtacataatcacaatccatcaggtttgccacaccagtttgaagttagtcaatactggttgctacatatacataggcataatccatcaggtgccaaataagtttgaagttacagccacaaacgaggttctgaggtcttccaggaaataggctgcgaatggaattgcatgcagttttggtactacacgcctgattttgcaacggcgtattgtcctcaaaacagatctctatgaacaataatccttggcgacatatatttccctgctttggattgatttcaccttcaagattacaatgaatataataacttggatgttgaaggatattaacacaaacttatgatttgtatgcctcgttcatcatctacgtccattgggttttcacagatccacaagccctgttcattggagcggcgcaaactaatcagcagttcattctttccaatttggaattgcattatctagtcagtaataattagatgaaatatgaagtacgaaaagtcgaaaacagtgagacctcaggatcttggaagtgacaacatggctgctgaaagccaaatcagtcccgaaagatggtatttttggttccagatttcatcacaggtccccgacaaatccatagaaaaacaaatcaaataaaaataaaaaacaacaataactataatggcagtaccaacatcatctccagattgggttggcctcagaattgcagaatggcagcatggccgccgagcggcggccgatcagccccgaaagatggtgtttttaatcgaggttttcttcaccggccaacgcagacaacagtgggactcgttcttaactcttactagtatgcagcaacaaaagaaaagtttaaaagaagaaaaaaaaccaagaacttgaggaagaaacgaaagaacagtcttggtagcaacggatcagcaatggacatcagaattgcagaattagcatcattgcacgcgcggcggcgccaaatcagccccgaaagatggtgtgtttttcttgcggtttttcatcaccgtcgtccaatccgccagccagacaccaaggcataataataacaagtgaaaaggcagaagaaacgaactcagctttctttctcgatggcaaactcatcgcaacggagaacaaaaaggaaaaagagagaaaaaaaaaaccaaacgagacccaatcaataactcagatctgctcgtcaatggcggaagaggagcggcggcggcggtaacctttgggtgcggagctaagtgagggagggacgagtagtttatatggaggctttgaaaccctagctagtcatggcgatagacgggccgggccctgtggtggagaattcggatgacgtgtacctgaaggcccagaggccggcccatgagccattcacagttcggtctcacctctcaagcgcagagattctgagccacggggggcgtggccatccgaacttcgtcggaacctgtcatcaggaggaagctccgtgacgtgcgaggagagaggcgaaaccgcattggagagaccgtgtcctcaaatgcgaagcagcagtcccctcgccaccgtcgtcgtcgaggccgccaccgccgtgccggccccgccgccgttgtcgagtcgccgccgtcgtcatcggactactccccccgccatggagagggcacgggatgccatcatcatgccgcccccgtcgtcgtgctgccaccgctgtcaaaccgccgccgccgtcatcgaagaaaattatttctaatttttttctggattttagggtgtttattgtaaattttagatcttcacataaactgaagataatattataagaactgaaaagaaaagtattagggactgaaatataaaattaaaaccacttgcactatgaataattcaaattttataaaaactaaagcttcatagtgtgtgggagtgcctttgccttcaagctgtcgtcaccgtctcccgaggtcagatccggcgagaagggggtgcgaactggccaccagtggtgctcggtcgagctgcgccaccgctgcccgtcaccgcctcccaaggctagatctgacgagcctcagaccagatcttgcgaggagtaggaaggcagcggcaccccgacaaggagaaggggatcgacggtgatgggagggagagcgctagtggggggagggtgagctgcggaggggaagcgacgttgccgataaaaagaggggaggggaggggagaggagccgctggtagggagagatgacccacggtggagagggagcgatcacgctggtgggggaagggggaggagcggagagggagcggaggaggaggaaaggcaccactggtagggacaagtggcccgtggtagagggaggggaggggaaaatttcgatctggggttagggttttttgcaccagcggttttgaacgagttggaaccgattcagccgtccatcaaattgaacagctcagattgatcgcgtgttgagtcagcccccatactcaggccacagcactgctgggctaccgcgcttcatgggtcgcgcgcgcgaatgccctagcaggttggtgagtcagaggtctttttttttcttttttttactttctttatttctggaggaatatatatttttaaaggctcatacataaaaactaaaccctaatcatctaatatttttatatttgttataactttagtttacctgttgcaacgtatgagcatttttctagtaaaaactttataaaagaattctaaatagagttaattgcactttgtctaccttttatttccaaagtttcactttgggccaccctctagctaatatttgcagtttggaccacccaagtcactttttctagctgcatataccctctaatctcgtaaagaatagtctacatgtaaattgggaagattatcggtttatgagtgccgatgtgattaaagttatttatgtgctcgagaaaagtttttgggggtggttcaaagtgaaacaaaggcaaactaatctagtccaaagtaaaagagatggtttaaagggttgtcgaaagtgaaactttggtgataaaagatggccctaaacgtaatttactcttttattctataccatactagattagaagtttacatgttaaattatagtggtttaaaattttatatttcatttaaaatagaaaaataagattcaactaaatattatcatggatttgtgaagctaggaatatcccgtttcgaagaaatcttggaccgggagttataccaaatagggacttaacattgtttgtagctcgaacagtgatcaaaaaattatttactacttcttttccaaaatatagactcataacgttagattatttctaattcagttctaggttattttattttgagtaaaatacatggctaatccttaaacttgagagcaggtgtttcttagatccctaaacttgaaaattacacatataagtccaccatcctggtttaatgaaccatagtcggtccaaacctcatttgacccgagctaatcgtcaacatgacattctatgtaggcaacatatttacagctagctccctccacggcgaagagtggtggaagaattacaatttgccccttcatattaaaataccctggaggccgtgagggaagggggagcacgtgtagtgaggccgggtcgaactattttttttgggatcgtgagagagatggaggctgccgggaggaagggattagggggagggaggaggaggcggaggcgcacggggagagaggagttacgtgtctgagccttacatattttttaattaggtatatagattggtagtatttgttgttggctgacttaatgatgaataaataaggtaa

SEQ ID NO: 2143 - DNA, 2306 bp, Oryza sativa
ggcacgggtgcgtccccgacgccgtgctctaccagacggtgatccacgcgctgtgcgatcagggaggggtcaccgaggccgccacgctgctcaacgagatgctcctcatgggttgcgccgcggacgtgaacacgttcgacgatgtcgtgcgtgggatgtgcggcctcgggcgggtacgcgaggcggcgaggctggttgacaggatgatgacgaaaggctgcatgcccggcgtgatgacgtatggtttcctcctgcagggactgtgcagggtgaggcaggctgatgaggcacgggcaatgctcgggagggtgccggagctgaatgtcgtgttgtttaacacggtgattggcggctgtctcgcagaggggaagctagcagaggctacagagctgtatgagacaatgggtttgaagggctgccaaccagacgcgcacacctacagtatattgatgcatggtctttgcaagcttggaaggatcggttccgctgtgcgattgcttagagaaatggagaagaagggatttgctccgaacgtagtcacctacacgatcgtgctacattccttttgcaagaatggcatgtgggatgacacaagagcattgctggaggagatgtcagcaaagggcttgactttgaattcacaagggtacaatggaatgatatatgcactatgcaaggatggcaggatggacgaggcgatggggctcattcaagagatgagaagtcaagggtgtaaccctgatatttgctcatataatacaataatttatcacttgtgcaacaatgaacagatggaggaagcagaacatatgtttgaaaacttacttgaggagggtgttgttgcaaatggtataacttacaatacaatcattcatgcactgctgcgtgatggaaggtggcaggatgctgtgagacttgcgaaggaaatgatacttcatggttgctcacttgatgttgttagctacaacgggctgataaaagccatgtgcaaagatgggaatgttgatcggagccttgtgcttcttgaagaaatggcagaaaagggtattaagccaaataatgtttcatacaacattctgatcagtgagctttgtaaggagagaagggtacgtgatgctctagagctctcaaagcagatgttgaatcaagggcttgctcctgacattgtcacttacaatacactcataaatggattatgcaaaatgggatggatgcacgccgctctcaatctcctagagaagctacacaatgaaaatgtgcatcctgatattattacatacaatattctcattagttggcactgcaaagtcagattgcttgatgatgctgctatgcttctaaacagggcagtaagtggtggaatagtacctaatgagcgcacatggggaattatggtacaaaactttgtcaggaagccacttaccattttggctgaccaggttgaagtgtattagaaacatgtgcttctctatgttatatttgatggttgttgcggcttttgaagttaccgtagcatccgttgttcaatcaaaatgaaatggtcatatcatggtgttcatcgctgatttcatcatgctcggtgacctggtatgtatttcccctcttgttgaaagtgtgtactttccatctgttaacccttttgttgacattgttctacagatggcagctgtatgtccagtgggtgatcgtagaataatgcagattcttcctgacaagaatttcaagttgtacttacatacaaaaggtaataacccttaaatttcaactcgtgtaaaattagaacaatagtgctgactgttgagatcttggcccaccatccatacctttgatttttgtaaagaagaaagagaaaataggtccagatcaatttgttcctaagatggcagatgcttacttttcatgtatctttcagctcatctcagattcctatctgtattgcggtagggccaatgaatgcaaagctaacattttattagaacagtctaccagtttcattgattctgctcctaaggttggaggtgtttccttatccattgatcctggtcctgccgtgggttcaacatccattctatgcttcagttctgggtaagtgggtgttgtgtaccgcaggcgcaagcgcgcgccagcctcatcgggagctgttgggctgccagcagatgtgcaggaacagatgccagaaaggacgcacagcgagtgaaggcgtaatccgggtgcttggatcccagtgctttgcttcgtttagattgcatttcttatccctttgaaatagcatctggtttccttttgtttagcattcggtttagcca

SEQ ID NO: 2144 - DNA, 239 bp, Oryza sativa
cctgcagccctactgaaaattactttgcatgagcttaccgaaaatatgtttttaggcaaagtaatttaaccctgttaatgccctatttttctagaaattgaaaaatcaataaagggcaaaatcaaatgttaaaatggagaagaacaggtggtatgacgttggaaaaaccatgattgcaaaaattcacttcacaggttcaaaccctggtacttgagtactccctcccaaaaaaaagacaa

SEQ ID NO: 2145 - DNA, 3297 bp, Oryza sativa
aaccgctaatatcatatttgattctgtttctgaggaaatattttcgttttcgattccgtttccgagaaattccgaccggctgattccgttttcgaaaacaggcccggaatccgaaaagtttccgtatcgttttcacccctagtttgcattggtttaaccaggctagtataagatgttgtttggttgactgtcctggagatacgattcaaaagagattttgtttggttggttgtatgaatgatgaattatttttttttgagggtgagattcctacgaactcactatttccagcagggtttacgattccgacgaaatccaaccggatttcacgaaatttcgacgtttcgacgaggctcaaaagtagaaaccgtctgagatttcgagaagtttcatccaaattgaaatttgaattgataaaaaaataaaataaaatcttataaatactatgatattcatagaacttattaggatataaattttcgaaaaacattatgtattgtgtgtatttactgaaacttacatcaggaaataaaagaataaagaattaaaaaaaggaaaacaaattactgtttcgatcggaatttcgccaaaaccgaccggttttcgagaacttgttgacaaacttagggaatttgtattcaaattttggtttatgaaatttgttcggaatttaccagtttttcaccggatttcgcgaaattccgaattccgccagtgcactaaattcgtatgataatttttaaagaaatttatcacggagcaaatgcacaataaaaatcatagtgcttattactgtctaaccaatggaggaaggaataaaataattcctcgatgcattcgtcgcctcttgtggtgcttatcacagtgcttaatactgtcgatggagaaagaaatgaaaaaaaaaaaagaaaatcctcgatgcattcaatcggttcctcggggaagaaagctcgccgctggtctggtcctccacccccgccgctcgctgcccctatctgctcctcgtggccggcggatctggggccagcgagctcactgccgcctcttgcagccgtggaagaaagagaggcaatcactcatcgcctctcgtcttcctgttgccctgttgtttgctgcacctcatggccgccatgcatatgcagttcgtcggagttgaagaaggagggcggtagtggcatgcgaggaagatggcggcggcggcgcaagccagggctgagcctcaccaaaccctcgtttttgctcgcacgctcctggccaggccgagttgtgaagctcgatttgagcgtttctgctcagcctggctgaggagctctttttgcatgggaaggccatccagacaaccgaaaattgcatccacagatacgggccaagcctcatgcagatgcaggcaaccaaacacacctatatttcacggggtgcatacgccgggtgtacggagaaacccccgcgacgccccgcaactgacgggcccgcggcgtggtgtagaccgcccaagaattggtctatggatagagagcggtgatccctctcgctgcggcactgccattttccatatccacccttagaatctccgcaaattcgtcatctactccctcgcatcgcatggcaccagcttccaccaccggcgacgcgccacgtggacgtccggggacgctatataaagccggcgccctcggcctcctccgcgacccatccaaacacccatccgccgccgctggctgaactcgcgggtgatctgatcggagccggaggaggaggaggaggatgttcgtggagggcttcagggtggagagcccgcgcgtgcggtacggcgacggggagatcgagtcggagtaccgatatgacacgacggaggtggtggcgccgccgtcgccggagaaggggtgggtcgtccgccccaagtccgtcacctaccacttcaagaccaccaccaccgtccccaagctcgggtactacgcatgtataattaaacacgaaatgctagctgctcatctttcttctcatcttgttgatgagatgagacgatcgatggagaggaattttgaaattgggtagtagtacctgtttgtttttcacttaattacttaattgtgttcgatttgattaacttttggagttgtttatgtatgcaatggatgaaatgcagggtgatgctggttggatggggaggcaacaacggcaccacgctcacggctggtgtcatcgccaacagagagtaattaattaattaattagataaaatcttaattataacgttatgttgaattgctcgtttatccagatgttgtaattggattctagttcatccacaaaaatgcatgagttcattgcatcattattgaattcctcacttgtcaagaaatgatatggtgcagttgcattggattatggtttatccaaaataatgcatgcaatgcgtcctgtcttttttgaatgccaagaatgatatgtagtgtggcagaatatgaattattcctcatttatccaaaaatgcatgcctgcctgcctgctttggactgccaaacagtgatactcctactatatgtagtgcagggttcaaaattccggaatgaatttcggtcattttggactctctagatacgaaaaaattttggctgaagttttattttttttttcacttttttttgtgaattcagtaatattttgttctaatttgaccaacatttgttcaaaatttcggtatatcagtgacctctgattgaatcggccaaaccgaaaatttaaaccctgatgtagtttgcaattagtgcataactatatgaactcatcatttatttatttatttatttaaaaaaatcgtctccatggatcctgattgccaaattaaaaatgatatagtgtgcaactgaattcctcatttatcccacatggttaattaattgttctaatttcaaaaaatatttcaggggaatttcatgggcgaccaaggagaaggtgcacaaggccaactactttggttccctgacacaatcatccaccatcagggttgggagctacaacggggaggagatctatgcgccttttaagagccttgtacccatggtgaccccatcttctcaaattaaccttctaccactcagatcatatcataaaatttcccctttatctacattttctatcatgaaaagatatataaaaaacgactctatttatggtttttgacaatgtaaaaacattctgattattatacgatgcacccatatatatatggatttgcgtatgcgaacaatccaacctattttcctgtaagcgatcgggttttatacgtagtttatt

SEQ ID NO: 2146 - DNA, 8355 bp, Oryza sativa
tgaaaagatatataaaaaacgactctatttatggtttttgacaatgtaaaaacattctgattattatacgatgcacccatatatatatggatttgcgtatgcgaacaatccaacctattttcctgtaagcgatcgggtcttatacgtagtttattaagtgtactgtatttcaaaatatttatttttaaatatacagtcgtatttctcacgcttttcttaattcattgacaccaagtttttttcttcatattctattttcactcatatttcttagactataataataccatgatataaccatatactagtctctacctagcccttgaaattgaccctattttcataatacaataaagaatcgtaatatttctgacactaactaattatgtcaatttgagatacaaacataccagaattgatgaatcgtaatactttgagacaggcagacactgatgatgataattaatttgattcggtttttgaaggtaaacccaaacgacatcgtgttcggtgggtgggacatcagcagcatgaacctggccgacgccatgaccagggctcgggtgctggacatcgacctgcagaagcagctccggcatcacatggagtccatggtgcccctccccggcgtctacaaccctgacttcatcgccgccaaccagggctcccgcgccaacaatgtcatcaagggcaccaagaaggagcaggtcgaacaggtcaagaaggacatcaggtagctagtctctgagctaccaaaatgatatcatcttgcttgttgcctctatttcaggttataagttgtttaatttgattttggtcaaagtcaaactgcttcaagtttaaccaaatttatacgcaaatataatatatttatattagcaaattagttttattaaatcaataattaaatatatttttataataaatttattttgggttgaaaatgttactattttttctataaattaagttggtcaaacttgaaacaatttaactttgatcaaagttaaaatgacttataatctgtaacggagggagcagtagactgtatgtgtgttattttcttataccaaaacaagctatgtgattttctgtttgacatgaactgacaaaattcagcaaaagtttgtatgtacattaattttggttttgatggacatgggtgggatttgttggtataagggagttcaaggagaagagcaaggtggacaaggtggtggtgctgtggacggccaacacggagcggtacagcaacgtggtggccgggatgaacgacaccatggacaacctgctggcgtcgctggacaaggacgagccggagatgtcgccgtcgacgctctacgccatcgcctgcgtcatggagggcgtccccttcatcaacggcagcccccagaacaccttcgtgcccggtgcgccgcccgccgtctgctagctacatcctccattaacgacgacgacgagacattgtttcatgaatcccgttcttaggttgacgatgatgtgctgatgcatggacagggctgatcgagctcgccatcaagaagaactcggtgatcggcggcgacgacttcaagagtgggcagaccaagatgaagtccgtcctcgtcgacttcctcgtcggcgccggcatcaaggtatatatgtacatatgatgaactccaactcgggtgatcgcgatcgatgaaacatgaattggtttgttgtgcatatggaaattggcaatggcagccgacgtcgatcgcgagctacaaccacctaggcaacaacgacggcatgaacctgtcggcgccgcagacgttccggtccaaggagatctccaagagcggcgtcgtcgacgacatggtctccagcaacgccatcctctacgagcccggcgagcaccccgaccacgtcatcgtcatcaaggtccgcccgcccccattcttgatccaattcattcttgcagtagtggcactcatcatgcatatggtgtggctgatgatttggttgctgtttctatggattaattgttaattgctttggcactcatgcacagggttagaaattccggaatgaaatttctgaaattcagtcatttcgaatcctcctattccggaatgaaatttctgaaattcagtcatttcgaatcctcctattcgatattatttcggctgaattttttttttgtttttttaaattcggtaatattttgttcaaattcaaatttggtgacctccgatagaatctgccagaccgaaaaattataccccgctgatgcacggtggctgatgatttggttgctgtttctattgagtaattgttaattgttgcagtatattccatacgttggggacagcaagagggccatggacgagtacacctcggagatcttcatgggagggaagaacaccatcgtgctgcacaacacctgcgaggactcgctcctcgccgcgcccatcatcctcgacctcgtcctcctcgccgagctcagcaccaggatccagctcaaagctgaagaccaggtaacaacagcaatgcaatcacatcttgcacagatattggaatggacccagttcatctctgacaacgaactctctgaatctactgtccgttctgctcattgtgcaggataagtaccattctttccatccagtggctaccatcctgagctacctcagcaaggctcctcttgtgagtgcattcatttcctgaaatcaaatgcacttttggcctgttaactttattgccattttagaccataacaaattttagcgttaccaaattttagtaggataacaaactaaatataatcttattattgccatcataccaaaatttcgtagttccagaagttctctcatgagaacactactcaaatttgacaaacctccaaaccaaacacgttacacatctaacgctagctaccaaaatttgataacatcaaaatgtaccaaaatttggtaattttggtaaggttgattttgacaacaagtgaacaagcccttccattttcacttgcaggaacaaaacaaatttctgttagtttctgttgcaatgcaatgtgctgaaaaatcatttgaaattgatgaggagtttggttgatgaaactgcaggttcccccaggcacaccagtggtgaatgcactggccaagcagagggccatgctggagaacatcctgagggcctgtgttggactggcccctgagaacaacatgatgcttgagtacaagtgatataggccttgacaggtcctcttatcaggagggatgatgaacagcaagtggtggaggaaggtgacagttttcttcaacaagaaaaagaacaaaaaaagagagaaaatgaggaacacctgaaagaaataacaagaggccaagtggggaagcaaatgaaatgatcaagtgatattcattcagaaaatgggtgtcattcacttggatcctcttaattgggggcatctattgacagtttgacactctgctccatgattttttttttcattttttgtttttttaattgagatggagacttttttcagctctgctgctagtatgctgtgagctgcatgaacattggttaatattgtgtatgatgataggtgaagcaaggaactaatcgtcttctatgcttatggatctatagtacaagttgtcagtattactgttaagtcttatatctggaacacttttgaatcaaagaacagctttggtcctagtctgtatttatgaggccatgttctgcttatcaaaatgcagcaatttcctgttattatcctgtaattatgcagatagtgaaaaaaagcaaccttcttcaacatctgcatatgctgtgcaaattctgtagtaatggctaaaacatcttggcatccatgggtaaacatcaggttaatgtgaaatgaggtgtgatggttacagttgccagtgccaggaggtgtcttgcggcaatttccagttcatgtcacataatcaatgtatgttcctttcctatgcacggttgtctctcacacacacggcagatttcttccaccggtttacaactcgaaccaaggatcacaatattactttccaatgctaaattagcccaaaaaccgcgagcaattcggctcaaagatacttacacaggttaatggcctcttgctcctcgctcacagatagtctttttcagcagctgcacttctggttgtacaatatattgatgagtgtggtgcaccttgctaggaggctaggagtgcagcttcaaccaaacttgagagggggacatcatggatcatggatgtcttttacaatttagatttcagatttcctgacaatggacacgacgacggctatgtcatcgagtttgcccccgctgaaacccaggtaccccactgcaagagcggcatctgagaatggggtacttccggctgcagatctaccaacttcctgcgccttggcagccaggtgttcagcaatctcctgcaagtggaatagccatgcaatgattcaatgttcagattcgctaggcattttatttatgaggcaagttgattctaaccgttggtttgagatcggcttgtaaagatttcgagaccatggtggctacttcttgctcatacacattgtcaaaaagaccatcacttgctgttacaatgacatcaccatcctccagctcaattgtataattctgaaggaaaagggtaaacaataatgttagttttaaattacttaatacgattgcacatgatttatagtacaaaggctaatctttgcacctgtacaagtttcaggggattatcgcccttctcaatttgcagtggaaagttgaaaccataaaccattggttttgatttttggtacacctctccatttcttatcaccagaaatccagagtctccaatattcgatgcattgaggaactaaaacaatgacaaatgtagcattgaggaactaaaacaatgacaaatgtaacaataaatacagtgcaattggttcattagaaacaagaagagtcttgatcaaaagaacagacctggccatcaaagtgagcaaccaaaacagtggaagaaccaggagagtgcgcttcatctgcagccttggaaagaacttgttcgggtttaatatctgcagcgccttgattctccataatgaactttttacaaccatccattagctcccttgcataaagccctgcattgatacctgtttacaaaaattatacaacaacttagcacttcagcattcccatgaataattatgatacactaagaacttcagtatgaacatgtatcagacacatagtgttggctcaaaattaactttgcagctaataaataaatgagtgaatgttaacattggcccaagggtactaccgatatgaacacattttgccctcttacttgaagacttggtccaaaccaggttgtatgcctttcattctatatccatatatagagcctgtggtagaccagtggcctgtgtgggttgacatttcaaaagaatattcttctaaagaaggatgttcctatttcttgtactagtagtaataaacttattctacaacctccatttgaccatttccacatccattctacagtattatagttccatttcttttgtgcaagtcaacttttggtgaagagtagatccaatacggggtgtaaaacagaaaaacccatattcatctcccagcacctgctatggctattcaactcgatggttattgtgtaaccctgatggtctttgaattgccatcgtcctgctaccaggcccacaggcaggacaccattttcccattcctatggagtttagaaagagaactctgtcccttgttcctcaaccattattcttgctagtagtaactatctggcagtacttgatatcttactgagctggacgtaaagaagctaaagttggttcgtattttcccactacgatgtcaaacccataaaatactcaaggaaccagaaagaaaatgaatactaaagtattctttaaatactgaaaaagttgcttttggttaataacatcatcagtcaattaattttcactatagtaaaaatgtaaaacatgctttatatgtcttgtccaacatctatagactatagatgatatagtcactaagtcaataaaatctgccaaggtccttgtgtttattttgtttaacaagcaaacatttcttgaattttctgatggataaggattgactacatgtttggaaaacacattgtcttctaaagtgagcagtaactaaaatttaagaatagaattggaatgtggaaacctgcgcctggaatggaaagcctagttcacactgttgcactgaaatattcatgcggtttaccttcaaatgaccactggccaactccatcagccacaccaaaccagccatcacacgcaataaaatatgcatcttctccacctgttgctgcctggaaagttattcaaaccataattgaagcatcaggtgaaccattagtgtttctgacttacagtaatagtgttatcaaatggagtaccaaagaaaagtatgtagaatgtggaagcaataattaactgcttatttcagcaatagacatactttaaatgaatttgcttctgtgatagggtcaagatagactaaagtccaaaggtatacagcataaaagagaacacgtagcgcaattattagtaccttagaaggatgaggcaagatcgcagcacctgatgccaacacaagcgttgatgaggctactggaaccatcctttatatgaattacaacatgacaaaattattaaagctgtttttggaggtccaggtttaaaagcataaagacaggaaaagccataagatatgtttgcatgaaaaagttgcctaactaaatgaagacaaaatacaggtcatatccagctttgtaagcatcagatgcgcacaaccattactgcacaaacttgtatggaaatatatgagctattaataatttactgaatgcctttatgatttgaaacacttgaaatcgaagtaagaaaacaaattaatacctatcagtattcttcacctctgaagtgtccttttcccaatctaccttgttacaaacttcttcctatagggaaaaagagagaacattaggccctcacttgcacaaatcaaactaaataccaccatgcggtaaatatctgatagcacaagatctatgcccccaagtacagatcatattcacaacaatattaccattgtgcgactaaatttctagaggcatataccaaactctcaaggtgtatgtctggacccagtttttatgaagtgttgatttgaaacagaggcagtgtgttttagtataaggtatgatcccttacaagatactgtcatagtataaggcaggagcagacaaaacaaaaatatcgtgacaacaacagatgatatacaacattgatcccgagtatgaacagatggggaaagcgaccacataacaactggccctcatccaaacaaaattgttacagacatcagtgagctgcggttataaaaaaaaaaaaagaggaaaccgagggtccaccaaaatgcttcaagtttctgactttgtgtgtgtccatgaacttagtaaatgatttactagtgcaggtaccaacaacatgaactcttcaatttactccttgtaaacagatactagtaaacaaattacaaatcgattgaagcattaaccgagtcacccaaccttgtcaagaaaaaattaccatcttcaatcattcacaattgacagcatccttttttcagaaattaaccatgtttcacaattcacagcatccattttcaggaaaaaaaattactacaaatatatttttcttgatgaaggtacgggtgaaatcgggtgaggaatatcaatcagggcgtatcgaaatcagaggagtaaaattgatctggtgagggaaggggagaggcataccgccggtggcggcgggacggcgaactcggcgggctggtcgtcgtcggcggcggtggaggcgctggactcggtgtcgacgtcggtgtcggaatcccgcgcggtggagccatccgaggcctcctcccccgcatcctccaaaccggaggtcgccgtcgcctccgctcctccactcgccaccacctcctccgcgtccaaacccgtcgccgtcgccgtcacctccccttctccaccgccatcccgggcctcaggttcagcagctgcggcggcgtcaccgtcgagccctgattcgacgacggccgcggcctcgggagccacggcgtccgcccgccgctgctgctgctcctcgtcgtcgtcgtcccgggggcgcgcgaagcggaagacgatgctcccgtcggcgagctctgggcgggagcaagagagagagacaagtgagaccgagagcggcagagacgctagctgctaggctgctgctgctgctactg

SEQ ID NO: 2147 - DNA, 11357 bp, Oryza sativa
agggggaggggcgagcttgcaggggcgcaggtcgagcagccccgccgccagcggcagctccgccatggctcacctcgagcaagcaaagagagatttgaaaatggagatgagctcgagagagaggaggaggaggagacgaggttttttgtgctggagtagtagtggtgggagtgaagagattagcgttggtttctaggcgaggaggaatgagattattatgagaaggggtaaggaaacaaacaaggagggaaggggacactggggggtgggcccggggtggagtaatggtgagttaatctgggtggttaacggtgcaacataaagaaatgggtttggacggtggtgctaattgtgtggtcgttatttttgcatttacccaccggtaactccgtcgcaaaggttcatcctacaaacacagcctcctactaattggctataaataaaccctaacctgtataaaggtatatactcgcacacactatcctatatattcctactacacatatcttgtacaagaaaaatagaatcacaggaaacaggaatagaaaattagaagaataaaaaaacacataggagtaagtaaaaaacagaggattataaaacacagaataaatacatgaatgatcgttcgattaaaccacacaaaaatatagaaataatcatttgattggaccactggaaaacacaggataaacacataaataatcgtttggtcggacaacacggaaaatgcaggaatgatcatttgattggaccacaggaattagatgagagatagaatcaggaaaattttcaagaggttggaactctggctaaatttatttgaaaatctctataggattgtccattacataggaactagcatggtggcccgcgcagattgcgcggctagtatcattatattttctctcatataatagcatatatgttttttattatattattcaaatatattaaaatgacaacataattttaaattttacaataactttacaaaactactaatgtgtaatattcatattgtattttatatacgtgttagttattaattatttttaatatcaaattttagttatttgtaaattatatatattcctatatggactctagactcgtcttttaatatattttttaatttcgaattttctgtaaaagtgtatttctatatagactctatactcttcttccaacattatttatttttatttctaaatttttattatttctaattgtatttctatgtggactctaaactcatatttcaatattctttaatttttaatttcgaatttcagttacttcttgtattcctatattgactttaaattcttcttcccatgtttttcttaatttcaaattttagttatttgtaaattgtatttttatacgggctctaaactctacttttaattttattatatttatttcaaattttagttagttttaaattcctatatggactctatactctacttctaatattccttatttttaattctgtatttcagttatttcctaattatatttctatatggactctatactctatttctaatattccttatttttaattccgaatttcagttattttctaattgtatttctatatggactttatactctacttctaatattccttatttgtaattctaaatttcaactatttcctaattgtattctatatggactttatactctacttctaatattccttatttttaattccgaatttcagctatttcctaattatatttctatatggactctatactctacttcttatattccttatttttaattctgaatttcagttatttcctaattgtatttatatatggactctatactctacttctaatattccttatttgtaattccgaatttcagctatttcctaattgtatttctatatggactctatcctctacttataatattccttatttttaattccgaatttcagctatttcctaattgtatttctatatggactctatcctctacttataatattccttatttttaattccgaatttcagctatttcctaattgtatttctatatggactctagtctcctcttctaatattccttattttttaattccgagtttcagttatttctaaattgtatttctatatggactctagtctcctcttataatatttcttattttttaattccgaatttcagctatttctaaattgtatttctatatggactctgtcttttctttttctccgattaatgtgagaatttctaggccatgagagcgaacgtgaaggctcctttttctattcctttaataatataatagattccaaaacatatgatatgatttaatcatttctttaaaaggtctttatagtaaattttcctatataattaaaattctctaaaatttctatgtttttccttcaaatcaaagggacccttcaaattaataaagtcatcatgaacgctgcattatcgaatggtacatcacctacttataaaaaatagtcataaatatgagcatccatattaaatataggacataaacctgaatggactgatttcatcacaaacaacctaactaattgagctacgatcaatttgtatttggagataatatttgacgttgagcatatgatttgatgaaaaatgttcaaactttgatgttacttttatatcgaaataagtttataaaacctacatgtttttctaggactaagacctatatattatggtgtttttcatggtaaatctagacagatcattttgtatttttataatctacggggctaaaagtttatctcaaaatcgtcctaaacattaaatatatatgcttggagccttagaggtagtataattttcataaaattcctgattccaaactagtagtagtgctactactcaaattgtttctccaagtgtcatgtcaatgggtggtgttgatactagctagactcgccaaacctacgcatggtctctacttaggttgagagaaaaaaacatttttcccgacgtaagggtctttttttcgcagatgaacatgactagccaaatgaccgcctaaaaaatataaatcggcttgtatcttctcacggctttctttacggttactcttgatgcaccccaataactactgtatagctagattttgtcgaatttcatgtcagctggtttggcttgttttccaactatggctagcctaacatcacccctgtcacacacaagatgttacccccaccctacggccagttgtctattttgtcatatgcaatttttagccccgtctctcctctccatgacaaacggcattagcagagtgataataacttactctgtcggtttcatattataggtcgctttgagttttttcctatttttaagtttaagtaagtttatagaaaaaacattttaaacaccaaatcattttcattaaatctagcacggaatatattttggtaatatgtttgttttgtgttaaaaaatacttctatatttttctataaacttaatcaaatgtaaaaaaaattgactaagaaaaaaatcaaaacaacttataatatgaaacggggaagtagacaaaatcagatcttctgacgcattgtcaccatgatgtcgtagctgacatgtggactctagacgattggtctcatatgtcaatgaccatatcacctataggatgaatatcatgttcatcgaaggacttatgaatactgtattaggattatgggcaaggaaaatgctctggtactatgtagcatatatgactataagaattttatagctaattataaatctagttcataagaaaaaacaatatatgtaccgatagatattggtaatttggtacatagccatattataatacatatatgcattatgatttatccatttaatacccagataaataaaaagcacaataaatataggcatttactttttttatcatacataaataaaaaaaccgtgttcatttctttatgtaacactttcttccaatttgtttcatattttaggttacctttttcattttaaaaattctcctataatctaaataaaacttttagtaaatttcacaaaactacatgtacttttagaggtgaaaacggagtggattcagacgtatagtggtcataccatatcctaaaccatattttttaagcggattcagagcgggtgcagatagtgtacggatgcggagcggattgtttcggatgtcggaaatgatacggattcggttcggaaacggattaaatttatcggatgttgcgtgtgtaatacaacatcgagttagcaatgcaaagaacaataatacaataatcaataaacgatccatcgtaataattatgtgcttaagtgttaaacagcatgaatatatgatgttcataatataaaattacagctacgcaagtgtgacatgaaacggtgaaagtctcagactaagaaatctaggttaattgatgggttaggctattagatggaccaacttatgttatatgctatagataaagtggtcgcttgcgttgataattttggattatccggcaaacggtctattggataatccgatgaaaatatcggataattagtatccgccggattttagagataccatatcctcatccgcatccacatccatatccgctggatatctaaaagaccataccatatcctcgtttcaaacggattcggagcggatcggatcggatattatccgatccgttttcacccctaggtactttggtcaaattaccacaaaactataaatttaacatgatatattacaaatttacatatttaacgctaaatttgtcatagaactgtagacttaagatagaatatcgtaaaactacagatttaataacaaaattatcacaaaactatatgctgaatatcaatttaatcacaaaaattggacatttataactcaaaaataaaattaatgctacggatttaaaccccaaaatctgtagttttatgataattttattgttaaatatatagttttgtaatacttagacttaaacctgtagttttgtgataaatttattattaaatctgtagtatgataatttgaacaaagtgcctgtagctttgtggaatttactctacggatttaggttacctagttcttttacaacacatgtttcttcctccatgcaccctggtgttggccggcatgcatctttgatgttgatgggtggtggatacctttaatctcctttcattttaggtcctgtttggttcgcgggacaaaaagtttttggcgtgtcacatcggatatacgggcacacatttaaagtattaaacataaactaataataaaaaaaattacaggttccgcctgtaaagtgcgagatgaatttattaagcctaattaatttgtcattatcaaatgtttactgtatcaccacattgtcaaattatggagcaattaaacttaaaaattcctctcgcaatttacacgtaatcggtgtaattagtttttttttctatatgtaatactctatgtatgtgtccaaatattctatatgatagggtgaaaagtttttgtttactccctctgtcccataatgttgcaacctaggatgggtacgaatctggacatgcctcatgtccagattcgtagtcctaggatgaggcatgtccaaattcgtagttttaggatgggtctcatcctatcctaggttacaatattatgggacggatggagtagaaactaaacaaggccctagtggccagccactcaggtgccggtgcctagcaagcattgactacatacatagggttgggaaggaggtcgccatgtatgtcattaacacccaaaatcctaataataaagggtcactatttgctaattaatctgagaaaaggtgtggatgtcatcatgcgttgttttatgtatgtagttaatgaccgactttaaagtaccctttagaccgggttatgtttggttccgatatatttattagattgcaaaatgacaaaacaaagtcaaatcaaagagcggagctatagtgcaagaggggatgcctacaactcggtaaaattttttaactataatttacctgtttttcattatatacgtatccttctaatacaaacttagtcattcatatcagcttaaacttatccaaagcagagtaaagtttgcgggtgacaccccctcaatattttttttaaactacccctcaatttcatatacaacaaaaaagattacaaccctaccattacaagaaaaaaaccaaataaacatatgttaaaatagaataatgatgctgcacctcataaaacactgaagatatgtgagctgtagagtgcagccacagcgctggcagctctggtatgtaagaaaaaaaatacattaataaatatcggtcaccatttttatttcttcttacagaacagccgaccgatgtcgtcaaacatgtcaaacaagtcgacgacctgaatccgcactgccaattgaattatcaacaaactagaaattaaacaatcttaattgattgatgagtgatgacattgtgaacgggataaccttaaaaagaacgaggaagaccctgtttctttcagcttgggattattataatccagattattgggagtaagctgaaagaaacagacaacttattgaagtagcttattataatctgataagctcatttaggtgagctttttccagattattgggtgaaaaattacccagcatgccaccccactccctctttagactggcaaacccaataatttaggctctaataatctatgaaagaaacaactaaccacttattctactacagattataacaatctagattagagtaatctgactcaataatctagattataataatcccaagctgaaagaagaaacagggcctaaaagactctaaacataactctataaacttcataaaagataaatcctagactactaatactcaatagatttttttcctacaaaaactttattggaaaatctacaaacttagtagaacttaggctgagttctttcttcactttcccaactcacgcctctcgttttctgcatgcacgttttttaaactactaaatgatacgattttttgcaaatttttctagacggaagttgtttttaaaaattatattaatttatttttaaaattattttagctaatacttaattaatttacattaataaaccatcagtttttccttgtgagactaaactctaccttctgaacagagcccaagatggattgagagatggcatgcttccctcttgcctctagcaagaacgcccaaggcagaggatgggataaacggatcgaaatggtgacaaaaagtttcgagacgagttgcgaccttggtaatttcgtaagaatcgtatatagacgagaattttttttaaaaaaaaaatctcattttccattgctctaatcgaaattcgataatcacgtctatagtggtcctactgtgcgaaaattaatcatagagatgcaaccagtcattaaccaagataaattgcaaatgatacggattcatcaatatgtgatgtgcaacacacaccacccacctccaggtaggcccggcccccacgagcctgatgctactgattattaagaatagagttgacaagatccttatctgtttggatatatgccctaaccttcgaagcaagaacataatctattccacgtagcaaatcatttttattccagggacaatgatgatatctctttcttttcactatttctgatctacactagaagattaaatacgaacagttttgatttgatttggacggcccctatttaatttggctctggaactgtgttaaatagtaccgtagtatgaaaaatatacgggatcttttaatgtggtcgatctgtgaggttctttgaaaaggtttttattagaaagagaacacaaccaggacagaattttttttagaaacatagtacaaccacatacgctctccggaagactaggtcggtatatcttgaaattgatggagtcactgcggatgcctctcgctagatatcgactagtatgtcacctagcattgaaagaataattagtagtaaatataagcaccagtcaaatctataatttgaatctgggtgggctggttctaccgcgagcaagctaaccagttgagctacgcgcatttcgcagctgaaacggaaaattatggagcaaattttattatcggtgctaattaatgacaagactgatcgtatgtgctgatgtaagactaaaaacacattaattaaaataatcaagatgggaaagcctgtatgtatggatgctcttaatttggtttgatgtcttggtagctggttgctggtagatttgagttgatagagtgccaggaaaattcgatcgatctggaggttgtcatctcaagatcaatgataagttggtttgaatatcctttgcacagtgacactctaaaagtgacctttttgccaataattgctgggcaaagacaagataactagtattccctccatactcataaaggtttaggataatatttaagtcaaaccttaagaatataaattatgaataactctcaaattattaagtttgaaaatataaaaattatatgaatagatttatcttgaaaaatactttcataaaaatatacatatatcacttttcaataaatatttttatagaaacaagaagtcaaatttgtgttttggagatcgtgtcgctgtcttaaacgacttcctttatgagtacggaaagagtactcataacagggctcatattgaggttttgtactgatacctcctgttgataacctagagagatcgtgtatgcatgtttctgatattgtaatttaggcaatcttcactctttttaaaaaataacagccttgctaagaagagtgacaaccataatttagataatcttcaaccaaaagatataatttttacaattttttactagcttgatcatgaatatgaccaattaagttttctttagttacactactgcctacatttttttgtcgaccataactcttaggctctgttcgtttcctggagttcccaactcccccatctcattttccgcgcgcacgcttttcaaactgctaaacggtgtgttttttgcaaaaagtttatatacgaaaattgcttaaaaaaattatattgatccatttttgaaaaaaaaattagcaaataattaattaatcacgtgctaatggactgcttcgttttccgtaccggagggatgggttcccaactcaaccaaaagaacagaaccttaggctgcatttgttcctttttgttggcaactaatctctcgcgcaagtaaaacagaatgactcattagcacatgattaattaagtattagctaatattttaaattaatagattaatatgattttttaaaacaacttttatattatttttttcaaatacaggagtataatttagcggtttgaaaaacatacgcgcgaaaaacgagggatgtgaattgggattcaacttaagaacacaacctagtacctatcagtgccttccttcaaagactttagtacttcttttcgagtttcaatacaaccttttgtgatatccaggaattttagataatggaaatgtatattacgataccgagacatgtatatatatacctctcgatacctcctagccaataggacaatagagtatttctctattgcatcctctcaataaggaccgtaattactctcttgcaagtttagtatcactatcttttgttttgattcatctagatctgaattataaataggtccttggaaagttacaactcaccttagtgaagttacagctcaccttcaccagtctcccggagcaagaagttattaattattattgcaattgacatggtccatgtgtaagagagtacctaaccattaatctctcaaagcctatgcattaacaaattcctcgatctacatattactaacaaattaatcgcacatcacatcatccactctgcatataattgaccccttttacggaacactgcatactggtgatattttttgccacttttgaaagttttttgttgttgataattaattattgagttaatccaaaagctcaaattgattgatggccaggcaatccaagtgtactggagtacatcagtaatgactttcccctagagtcaataatctcagccgtccaaatgaacaatcgaattgcttgaaaatgtgcagtacacaaggcaagctgtaatcactttttttttccttaaaaagtttttgtgatgtaatggagtacctccccatgtgctaatcgccatggtttaagcaccgggttttacgctaattgaggtggtgcgccccaattagttgtcataatcattatcataatcactaaattaacctctgcgagttgtgtgaaacgcaaagacaagaggaggaatacactacatatctgagtcggaataaactatatgtgatcagtgggggtgtacactctggaagcactactagtgtatagtatacatatatagttttatgtaatgtttggatatgtagctagctagcaaagcaacaagttatcatcaatccacttacatctgacaccccccccccccctaaccaacatgccacttctattcttttcttctcttgtctcactatgattctgaatgttttcttcttcttttgtctcattgtgtttctgaatgtgttctcaatttctcacagtgtgttctgaatgatctctctgtactccgatccacccatttttcagtgcttggtggatttatgatttttatgatcctcggaaaataatgcactataatgttaaattatggtatcgctcagtatctcaacaccaaaaaaatatcaagagaagaggatgggtttaaagaaaaatatggtaacatctacatgtctcggtatttggaacgggtggtaagaggatgttttaacatgggagcagtctaatctacggattgatgattcttagtatttcttggacattttttttattataaaaactagcgtgtgttaggaaacgataggcgaacaaacgataaagaacaatagatcaatcacagaagacacgagatttaacgtggaaaaccctcccaaaacaggagagaaaaacaccacgggcgccagccagcaaaatatcttcactatatctgaggtgaggttacatcgccgcacggtggattacaagaggtatatatatggtggaatcctaaaaaggatgacgatatcaatcacagaagacacgagatttaacgtggaaaaccctcccaaaacaggagagaaaaacaccacgggcgccagccagcaaaatatcttcactatatctgaggtgaggttacatcgccgcacggtggattacaagaggtatatatatggtgg

SEQ ID NO: 2148 - DNA, 3763 bp, Oryza sativa
  unsure (1)..(3763): unsure at all n locations
cgcacccccggacgtccccaggtgcacggcagaagctggcctttattaaatacaaatgaatttggatcacaactcaacagcatgcagggtgtgcatctggttgtatgcatctaagttatgtccttagtatttctcaacattgttttataattttgatgtaaatgattgacaaaaaacttccatgtttttttttaaaaaaaaatctgtaaatcgcctcgtatctgaatggaaggtatgcaaccaagagttcggtgctgaaacaaagctgaagggatgcaaatttcacaatttcacgcgaattaagatttatcaattaatctcattcttgtctggtacgaaaagtcgaaaagtgcgaaaagaaaaaagagcaaaaaatttgccgtacagacaaattaatccatgagcacaatgcagagcatgcatatgcatgtgagtgggcatttacaagtgcactttttgttcgttgtggaggagtgaaggaccggagagaggacctgatcttgcttggaaagttggataaagatgttggatctcagatcttggatattgctgtctcatatggcttcaaaatcatgcgtcctgctcctccctacacatggcaattctcaaggaaaaaaagttcccacttctacacatggcggtcacatggagatatataaatttgcaaaattttgagaaattctgcatggtatataacttacaaggtcaaactaatggcaaattgcagacatggtttctgaaattttgccccattgtgcattccgaaatgttttttacagggtgcactgttcagtaacttttgtaacaaatccaactcgattttttttagagacgaatcaaactcgaatttgaatttgttcatggaaccaattatttctgcagctttgctttccagaaacaagtacacacagatagagtaagattaacttctgcagattgttaatttggtttgtctgtttctaataatcagtgttttgtttgattgtttccttcgacgcgagtggacgcatatgatgcaggcctaactatgttcaatgttccaataaattaagcactttttaatcaaagctggtcggccggggacggcagacaaaaatttgatgtttgaataggatccgaagtacaatcataattgctcatatgttcacaagattttgtaaccaaaaggttaacatcaaccaaattcaactccataaagtagcactaaggataacaccaagggtatataaattattagcacatatatagtatggatggcacatcaatttgtgcgttgaatatgctttgatgttgacaaaaggatgagttagaagataacctttttgtatcattgtatgcatgagtgggcatcttaattcatattggttggaatttttggctctagtggcacaaagcatgcttcatagtgacttcaattgttccattgggggcgtgagaaaagcccaatggataaaaaggttctctccccactcgcaataggtagtagaatatttgttttattagaagagaacccacaattttcatatggtgtaaaatataataataatatggccatgtggttgctaattctgcacttggaaaagcaatttcaaagatggtgaaatgcgaaaagaaatgttgactattgaaggcagcctatggctatgctatcatcttacctctcttatatatgatgaaatcagataacctcatatatatgctttcttgagaaaaaaaagaactccttcttttgtaaaaaaaaaaagtattgatctgtatgttcagacatctaagtgcacaaacattaacagcgaatgactattaatcattcaatctttgcttttctgaatatttgtttcataggataactcaaaattatatgcaagttttgatgcaaagcttcatctgagagagagtaaaacaacaagaacagatatatcaagctcttcagtgaaaatggaaacagaagaactacaataatcaaccctaatcatgacaattccattgataaaaagtaaaacatcgttcttttgcagaaacatccattctcaagttccctcttttatgatcttccccttgtgctatgtcggcaaacaagagaaacaaactaaattaaagtcttttgtttcctgtaacttttgggtagtttcagaataagatacatagctattcttctcttgagcttgaagatgaaagattccatgccagaactttcttgaccaactaattaatctggactttggtttcattccattccttattccatatgagtacagtagtacactagtactggtctcctttcctgaaaaaaaaagaggagattcagaagttcagaacaataggcaaacaaatctccaatctgtggttgacacgtcactccttcctcatggagtcaatgggggtgagcatcagcaagtcatgtgtgctgcatgttgtaggtagccttgaaggaaagcagttggattggatctcattttagtttagggcaggaatgcataagcccatttgttgtgtcatttattaagtttatactacatttcaacatatagttaatgcaaggttggagttgaaacaaactgtctccttgatcctaattcctgaaacatgtatgagattttgctcatggcatatgcccatcaggagtagtgcaccacatttacatacatagtacatgtggatgcaactcaatggaattttttttttttgatatttggattcatttgtgacccgaaaaattttacgcatattttcaatcatgttcaaattcttcagtaccatctgagtgtagattttacctgtaataattaatcagaaaaaaacctacaaaattttgcagtccttacatgtcttgattaaaaaaaacataaaacatttttgcgttggcatggatcgtatgtattgcccatttgagggttgagaccaagaaagtttcagcatcgatacactttaaattccatgttggattcttgaagcagtccattagcacaaacaggcttgtcattagtggaaacttatgtcacatgaactagtaaaactatagatccaatcatacttccatgcaaacaatgacccaatagaactcagcaaagtacagattatacaatcccaacatgaagcaactgcaactttcattcctcgaatcacagatggctgacacgactcagttatagtgcagagcacagtacaacttataatggtataacagtagagtaagatgtttcaagcaatttgtccatgcaaatcgtttattcatagtactcagttcatatagctctggtgacacccaattcagactgattgtcttagttctgtggcaccgaaattatatgtttttcgatcatatccttcatgctccagttagtgtaattattattattattataataatattattcttgtagctccagaaagcccaaccaaatgaggcctgaccatagacgtccatctgcacatcagcaaaattcgtgcggtcatcgtcgtttgcaccttgcaccccccattccgtagtccattcccctgcacatttggaaagacttcttcccactgtgtcgtcacaaaacagcctgtccagcttcaccaaggttggtcgctgttgctcattgctccaaatatatcttcttccaaataaatacatctcctttcttgctgcgaagtattcattaatcagcgattgtttctagcattgttcttgtctacagctgaggcaattaaattgaaatcccctgtaatcatccatttcccaggtnnnnnnnnnnnnnnnnnnnnnnnnnnnnnnnnnnnnnnn

SEQ ID NO: 2149 - DNA, 1457 bp, Oryza sativa
  unsure (1)..(1457): unsure at all n locations
atcagggcaatgtaaaaagtgtacccttgtcatcctaaaaggtattccacgcacagttacatacaccgacaatgtgccttatggaatacgccgacgaggaaaatcaactcgatagtacagtgctaggagcctaggagctctacacccctatcaaatgcacgtatatgcaagcgtacaagtaaattaatatttgtttaaacaagctagtaatggtacttacatagggtttaattagtggcggaaacgtgttacttacatgggtatgttaaggcatattaagagatattccattcaaacatataaccacataattttttaaggaatattttaggttaaataaagggagcaaaatagatgcctttcgtttagccactcgtgaacatataccatcaaacacaggtacttattcattatcatactcgcacaaatggtggccaaatgataacgccaagataacgagttcatcctatcctgacttttatcaataggacggtagctagaagatgatatatgagtgtctgtgcaaagtcctattgatgcaacagagataaaaagctagaatgcactacaaaaattggggtgtagaatatccccaaaatgtcacgaccggaattaacccaacgggcgtttcttttgtgcgtgtattattccttgtcccaggaggcaaggtacaccaagagttgatacaattcagagtttaacaagcggaagcgtaaatagataatttattacatgggcgacgaaggcccagcacacataaagacaaacgagaaacagcggaagactagggcgacgaccacaggcgcttgacagcaggcacgagctagacaccaaagccttcatcaaccaggggctcctcttctgggttgggaaaaattgagcaagactgagtacaaccaccgtactcaacaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccgtaaacccacacgaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggggcggctattcgaatagattatactctgatcagaggtgtacatctttacccacaagacacatcttcctcacgtgtaaccacgtgccacataccaccatggtatacggacggaagacatgatatagtttccaacccatcctagccatagacaagagnnnnnnnnnnnnnnnnnnnnnnnnnnnnnnnnnnnnnnnnnnnnnn

SEQ ID NO: 2150 - DNA, 1815 bp, Oryza sativa
  unsure (1)..(1815): unsure at all n locations
acatttcttgagttgcgacacatggaacacatcatgcacgttgcccaagaaggcggccagctccaactggtaagcgacttctcggcgcggagcaatgatacggaaaggacccacaaaccgaggtgcgagcttcccttttgtctgaaacttgtgtacacctcgcaagggcgtgacccgaagatacacaaagtcatccactgcgaattctaggtcacggcgtcggttgtctgcataactcttctgccgagaccgggccacctttagattatcccgaatggttctgactttagcttcagcttctctcaggatatcggtcccgaacacttggctttccccaacttggtcccacaatagcggtgtccggcatttgcgcccatacaacgcttcataaggtgccatttgtatgctggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattggcttcccctatcggatacaattttcttaggaacgccatggagactcacgatcctagcgaagtagagctcggctagtttgttccctccataggtggccttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgatgacacacatcacaaagggcccggaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttctgttccatagggttccgtgttcatcctctgtgaaaccagcggctttaccctgtttcatattcttgaggagtccatgcatgtccggatcgttcttctgagcctcgcggatttgatcgagcaaggtgggcttggcttccaacgcagccaagaatccgcgacccactatgcttagattcagggcttccatctgttgattaagttcgggtggaatgcccggacgttaagagtgttgcaatggctttttcgacttagagcgtcggcgaccacgttggccttaccaggatgatagtgaattcccacatcataattcttgatgagttctaaccatctcctctgccgaagattcagatccgactgggtgaagatgtatttcaaactcttatgatcagtatatatttcacagcgattcccaatgagatagtgccgccagatttttagagcatgaaccaccgcggctaactccaaatcatgggtagggtagttgccttcatgaggccgtagctggcgtgaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagttttgaacgccttctcgcattgcgggctccacacaaatnnnnnnnnnnnnnnnnnnnnnnnnnnnnnnnnnnnnnnnnnnnnn

SEQ ID NO: 2151 - DNA, 482 bp, Oryza sativa
  unsure (1)..(482): unsure at all n locations
cacagtgttgttttaagcctacgagcaacagaatgaatacatccagattgatcagttgaatgaatgaagcatcaaaacaataatgtcacaaagtgatatgtcacatctcataccaatcatttacaaagttccaagctacttgtttcacttccttctgagagatcccaagtttttccatagcatcaagtagtggtctgtaaggatgttggatgttgaaatcaaaccgaacagttgtaaggactaatctctcagaaggaagtgaaacaagtagcttggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2152 - DNA, 1411 bp, Oryza sativa
  unsure (1)..(1411): unsure at all n locations
atctgttgccatgcaatgtggagcattgtatgcctggatctatcgacaactatacatgagacaatgtggatataggagtacgatgtgagatttccgagatatccagtgtaaatacatggtgaaatgtttaactaggtcggaaacatgtaaaccacagaatataagttctcaaaaagagttttatttgaaaaaaagaactcaatgatagctatatgaaattagatgggcatacaaaattcaagataaaactcaactttgtttgtgagatattaagtttacaaatagcaaagaaaaaaacacaaataaagaatactctttttttcctcactgtttatcaatttcatatgtcctgaaattttatatggttgtctaatataaccttcctgtatgtgagatattttagaaatttatgcgatagttttcccatgtttaatatccactgcatgtttttcccatatatcaatgtgcaactacacattacccattgaaagttttcgcatgtattgcctttccggttagaagcagacaatacacaatttcaaggatgtggtacacggcccttgggttctgcttaataacaattgcacctgagacaagttaacggtattccattatacaaagagaataatgctcttatgccacaaagttggatgcgaaaactctcattttgaacaaaagtttgaagcctttactaaaatgccacaaaattgagtaccaattcattcttttaccacaatacagtgagaaatnnnnnnnnnnnnnnnnnnnnnnnnnnnnnnnnnnnnnnnnatttttgtcctatccccacccttcttctctgtgtccagcaaggacagacctagctctgtccggccaaagtttgagccagacctggcagccagcccactcctgcacgtccgacgccccactcctgcatgtccaacgcgcacgccatctccgtgcacctgagctcggcatgagctatgacaccctagctccagtagccagcttcaaccttagcattacctccgcctctggccgccagcagcacaacaatatgcgtcctgccctcagcaactggctctgtgcagcccacctactccgcgcacggctttcctcctgaaagccagttccacgcgccctgctcccggccgcagtggcggacctaggtcctaggcctgggtgtaaaagcccatagagagacatacatttttaagatataattttctgttgggccaaacacagtgggcaccagcccgtgcggccaagctccattcacaaactcatagaagagagaaagagggtgcagaagaagggaaaattgcacatttggtgggttaaaatggtaaagtgtggcagataaacgagtatacaactgaactttgtggcatttttacaaagccaacaaatcatgtggcaaataagagtatgg

SEQ ID NO: 2153 - DNA, 1885 bp, Oryza sativa
caatctaacaaggggtacaaggcttgcactcactatatggataaaattgaaagtacgtatcttaagcactgtaggaaggttgtgtatatgggtcatcatcgattccttgctacaaaccacccggtacggaagaaaagcaagcactttgaacataaggcggaccaccgtacgaagcctaaatatcgcagcgggaaaacagtgtttgctatggtgaaagatcttaaagtagtgtttggaaaggggcctggcagccagcctatagagagcgaagatggtcatgcggcgatgtggaaaaagaactctatattttgggacttaacctattgggaattcttggatgtctgccatgcaatcgacgtgatgctcctcactaagaacctttgcgtaaacctgcttgtctttctgggtgtatatggaaagtccaaagatacactggaagcacgtaatgatctgaagcatatggaacaatgcggcgaccttcacccggaaccaaaggataaaggaagccattactttagtccagccagctacactcttagcaaggcagagaaggaaagtatgtttgaatgcttagagagcattaaggtaccgtctggatactccacgaatataaagcgaataataagcacgaaggagaagaagttcacaaacctaaagtctcatgactgtcacgtgttgatgacatagctgctactagttataattcggggtatccttccagacaatgtccgggcaacaataacaaagctatgtgctttcatgaacgcaatttcgcagaaggtcatcgatctggatagattagaagcccttcaaaatgatgtggtgcaatgtcttgtcagctttgagttgatatttccaccttcatttttcaatataatgacgcatctgctttgtcaccttgtcaaagagattggtattctcaggcctgtgtacctacacaacatgtttcctttcgagaggtacatgggcgttctgaagaagtatgttcgtaaccgtgctcgtctagaggcaatcatcgccaaggggtatggaacagagaaggtcattgaattctgcgtagaatttattgaagaccttcgcccaatcggggtgcttgaatcacgccatgaaaggagactacgggaaaggggactctcggaaggaaatcaataatgacggtggacaacaatttattccgtaaagcccatttcatggttctgcaacaatcttcattggtggctccttacgtcgaggagcacttggctctagttcgcgccagaaacatcggtaagtccgatgcatggattacacggtatcacattgatactttccccgcgtggctgtgacaacatctcatgtgtaacgagacgattgaccaacaactggccttcctagcgaggggaccatctggctcgatcgcgacattctagggatataagatcaatgggtatacattctacacgagagcccaagacatgaagagcacgaaccagaatagtgttgttcgtatagatgccataggacacgatggtacaactggcatgtattacggtgccatcgaggacatatgggaacttgactatcgacctctcaaggtctctctgttccggtgccaatgggttaggttgactggtggaggcgtaacgattgatggcagtgggatgacaacgattgaccttaacaaggttgtcggactaaccttttgtccttgccaatgatgtaacgcaagttttttacatgaaggacatgtctagcaaaggaaagaagggcaaagggcctgacgagccaaagccccacgtggttcttccaggcaaaagaaaaatcgtcgaagtagaggacaagactgacgaggattacgatcagtttgatgggcaaccccctttcacggtgacaattgaccctagca

SEQ ID NO: 2154 - DNA, 4014 bp, Oryza sativa
tgaaatgcaaacgaatgttaacgaaccttgaatgaacgggaatgaaacacgaacgaacgggaacgaaacacgaacgaatgtgaacggaccgcgaatgaacaagaacgaaacgtgaatgaacgcgaacgaatgtgaacgaaccgcgaacgaacgggaataaaacgcgaatgaacgcaaagttacatgtctcacaaattaatccatgaacctaaacttctactcccctccgtcctagtttaatcatgcagcgcactaatcaaaatatgttcctttgtgtttagactaacacatttttttccatgttgtaggaaagacgtcgtcgtcgtcccttaagccaaagtggtagctagccctagtaggaatttgcgcaggcaagtgatgtaattatatatgagtattagagtattaatatatgattattagaattttaatacaagagtattagagttttaatatatgattatttagacttagcatatatgactattagagttttaatatatgaaacttagacttagcatatatgattattagagttttaatatatgattattagagtattaatatatgattattacgaattttaatatatgattattagagtattaatatatgattattagagtattaatatatgattattagagttagcatatatgattattagagtattaatatatgattatttagacttagcatatatgattattagagttttaatattagaaacttagacttagcatatacggttattacactcagcatatatgattattatagttttcatataagattattagagttttaatatatgattaattattagacttagcatatatgattattcgacttagcatatatgattattagagttttcacataagattattagagttttaatatatgattaattattcgacttagcatatatgattattcgacttagcatatatgattattagagttagcatatatgaatattagacttagcatatatgattattagacttagcatgtattaatatttatcgttttaatataagattatcagagttagcatatatgattattagagtattaatatatgattatcagagttagcatatatgattattatagttttaatatatgattattagagttagcatatatgattattagacttagcatatatgattattagagttttaatatatgattattagagttctaatcaaatattatatacgtaaataacaaacggctgcaaatatttcttgtatgaacagatggctgatcgcgatgacaaacatatactatacgatacaatcgcagagggaagcagccagtactggaacgaagaagaggggaacgaggatccaaaccagtacctgaacgaggaggggaacgtggagagtgatgcagaggggactgaggaggggaacaaggaggcggaggctagtggaagtcaatcctccgctggacagaagagggcacgcggacaacgaggtgccgcgaagaagatagagggtcggcacatcataactgaggtggacgaagacgatcgacctagtgccccggctgaagcagccaagaattttgtacgacacagcggttgggttgtgaaggataacgtgcctgtcagcaaggtgtactggcgcagaacaagggcacgcggggattatgacagctttgtcccggaatcagagaaagatacgatgtggatcacaatgctcgagacgttcacgctccctgcgggtacggagaacatagtgaaacagtggactcttaagaaaatggtagaacaattccagagcttcaagggagatctctacaagaaatacatcctgaaggggctgacaccgaacttcgacgtattcccgaagctaagggatcattgggacgagttcgtcgcttacaagacagggcaacaagggcaagcgatgatggacagaaacaaagaaaatgccgccaagaagtaccatcacctcttggggtcagatggctatagcgtcacaatgctgaagtgggaggagatggaggccggcttgattgagaggggtgtcgaaccggccaccgctaaatggctggatcgatcgaagttctggtactatgctcacggtggaacgcttaaccctgttgacggctccctggtgttcagcgatcagatacgcgaggctgccagtcgactaacggatgtagtggaagcctcttgtcagggcacgttctgacccaacagagataaggacgagctgtcactcgccctgcagactcccgagcatcctggacgaacacgagggaaaggcgtggttccttggaagattggattcaaggaggacatccacacgtacaagagtcggatgaggagcaagagagataccgaggcgaagattgcagatcttgagtacagggtatcgagctacgagctcagcatgcaagaggaggtggcaaggaaggtggatgaacgcatggccgcacatcggtgccatgatgcccagccatacattcctcctgtaatggtcagcccctcaggcaatcgtagcagctgcgcctcaacggggcaggtaggatcacagagcatggacgccgtgcaaactcaggacgaaaccacttgccccattgatgagatcacgcagcggacaccatgtgagctgcatattcccttcaagaacttatcaatcaaggtatgcccgtagttttatgtttttttggacttgtacattccgcaagtttctgcttaggttgattactaatagataacctctcatcacgtgaaggttacgtcgggaatgaccatcccaacggacccttcagggacttaccactgcaggctgattccagcaggatactcgagggtcgaagttgaactggtggaagccgcgtacgaggaactcgagttggactaccctggaggagacggtaagacgtatctacgcgacacaagccacgccattatactatggcgcaagcgctacatcatcctccctgggcgacaagcggtgtctcgtgcaccatcccctccggctccaccatctcctcctcaggctcctgcaccgtctcctactgatcaggctcctgcaccgtctcctcctcaggctcctgcatcgacttctcctcaggctcctctgccatgtcctccggcaccttccaagtcaagaactcaccaagctccaccgcttgcccgcacaagggcaacgaagaaggcgaaagttgacgctgccaagaacaaggagccaccgtacgattgcacgcaagaggagctcgacgcttacgtggcagaataagtgaagaggcaattgaagcctcagagtccaaaaaaagagattcctatagacccgagtgccaaagaattcttgcagaagatgtcgggaccactcaaggaggccttaaagctaacggactatgagcgaacacttaggaaagcacattctggaaagtccaaaaaagtccctcagcttggagagcaaccaaaccaggaggtcgagttgttagtgaccgggcaagaatttggaataaaaaaattcatttctgacaccgggctaactagggctcagttgcttaaagcgcaccaatccctaaggcagaagtgagacaccagtacgaactcggtaaaccgcttgtcaagcctgatgatgagggcacaactagctcggatataaccgtgactaccttatgtattaatcaaccaaaggtgcatatgttctacattagatttacttgttatatatttgaacaaacgttgctacacaatgagtttcgtgtgtttttgttttcaacagaaactgaccactgacctcgaacagggactcaaatgtaaatataaatattacaaggactcaaacataaagtgcaaaactaaaattggatcatctcaaaaatggattgctcatgtcatgtatgttctgtttttataaaaaatatctcaaatccgttacttaacacttctataaagaggaaaatatggacgggcacggatagatcggatttgatccggagtctctcctcacgcgcgcagtactcttcttacgtgcacag

SEQ ID NO: 2155 - DNA, 6938 bp, Oryza sativa
cagctttaaactccatgtagggcttggtatcggttctgtcatttggtccgcggcacttggaaagaaaaacttagccagaggttcaaatttccagtgagtacatgatctaaatttatattgaatctctaattcaaatataagtgtatattaaatctctcgtcgtttgtcatgtatatagtgtgcaaagcaggaagagggaactaacttgtgtggctactacgtatgtgagtattgccactgctttgcaactcaaatcatcaccacaagagagctcgatgtacgtataaataaaccattcaaaatttcattgcatacgtatcgatttcttgtttactaattaatataacttcatacattcataggttattcacatgagggacaacctcacacacaaggactttatcacggcggttcaagaacaactcatgggattcatcaaagaacaagtccttaatcccgagggtgaattctactacgacaaatctacaattcataagacgttatcttctgagataacgactacgtcgaagtcgtagctaggacataatgaattgtaatacatgtctatatttatatatgtacacatttactttactgtaaatatatattttggtcatatatgcacataaaatgttaagtgctttaatatatacatatatgtctattttgtacacatatccatatgcatttgcatacatataaatatgtataaatacatatatatattattcatgtatatatgtaatatatatatatatatacatacatttatatatacatgtatatatatacatgtatatatatatatacatatgtgtacacacacacacacacacacacacacatatatatatatatataaaccatgcagcaacagggccatgcaaataaaaaaaaaggtagatcgatctttagtctcggttggtaccggtaactaaagatcgatctttagtcccggttattccacccaggactaatgatagcgatctttagtcccggattggtagttccggtttgagaaccgggactaagggggttaccatccggaactaataaaggtttctccacccgtgtaaactacaaatgttatttgcaaaagtggccactgaggttgaggcagctaaggcatcaatacaagcggcttaacattttagccgcatatgtaaaaaaacatttatgtaatagtgtaatgaaaaataatggataagtgtgtggatattatggataccacatacccactcgcttggatattcgattgaagataggaggtgggtcgagtctaggaattatgtaataattaggactggggatttattattgccttgtttcctacggcaagtctcataagtcttactcatatacggttatgtaatatataaggaaaccgatgccggattcggttaggtttctacccttctaaccttgcaccaacctatacaaggacacggggtgttttgaaggcataaccacagccaagatcgttagatcaatacaacactcgacgaattcaatcgccgaaacaggagtaggggtattacctctttgtcaagagggtctgaacttgtctaaaccttttgctttctacctatccactttcgatctcgtacaccacctttttcttattgccaatatgtagaactgacaaagtggcttaaaattatcatggtacatagattattgatattccctatgtgaaacaatacatataaatatatgcgtatcatagtttgctaacatttgatataccttgatttttcttggtacatagaaaatcgaaataagttaatcattatatgtgttccatggctgcaattttgtctgagttgtcagtatagcgtgtttataataagtatgttataaaatctaaatggattttaaagttggttatgcatgtgtacgaataacaaacataacttcttcttctctactactacttattataggagtattcacattttcaatagcctacgcatataaaatagacaaaattatctttatatatagaaggtatggaagccaaagcaatattcatctggttgttaaaaggacctgtaagtccattaaatggcaccatatattatattttagagcgcttatgtaaaggatcaactgatttaatttgtcttatcaattgtgcatatttcaaaagacataattatttggatattgttgcatctgactaaaggtaaaatatttttttcataattgttatgttagtcaaagttaagttagttctttttcacctacatattatatatccaatttttctatgcgtgcttacaaagtaattaatgtatgatgaagcaacatatattgttaaattgttttacaattttgtacggtaatttggattatatgcaaagtgtaatagtgtggtccctagataaattactcctttagccagtgagtttataaattcttatcctaataccgtcgatctaatttcgctatgaaattttgtggaatcactgatttaagattacataatacatgttcatttattttaatgttgagtaaattgcattggtggtacacaaacttgttaggtgggtgcaatttagtatataaacttataaaatgctcgtttcagtacacgaacttgtctggttcgtgcgaatgaggaccaaaataacttggcaatgtcaattttatgaagttgacgttgattaggatgcgacgtgtatacctgtagcaagtatgcataggacatgcaatatttataaatttagtctctactttatccttcatcattgaaatgatgaattttatatgtttctaacccttatatcagtgctcgatattttaaatctttttctactatcactaaatcctattctatattttattgaataggtgtaagtctagtggcaaccttctcatatatatatatatatatatatatatgtttacatagcatcctaatcagcccctaaatcaataggattagtcatatagtgtcctttttgacttctcccgcacgcaccacgcaagttcatgcaccaaaacgaacattttacaagtttgtgcactatattgcacccacctgacaagttcgtgtaccgacgatgcaatttactctttaatgtttctttgtggccgctagataaattattcttttatatgaaaatttattcatggttcatgtttgtcgaatggttccagatgtcaaaatatatgttcatttctataatatcttattgctatttggttgctatacaaaatatatagtggcgtaactacattcaccttcaaggtagattattcgattttaactaattcatgccatattaattaataatatcaattaataattaaataatttatatgtgcagtgtcataataatatttttcttggtttgacattgaaaagaaagggtatatatccaagtgatgtcccaatatttttttctgggtttgtcaccgaaaattaagggtatatatattataatttttatataaaaacatatgtactaatagattatttagctaactaattaatttttatactatgtatggttgttagaggtagaaaataggagagagaagagacggaagggtggaggtcagagagggagggagggagagtacgtacatatatgtgcacgttctatttttcttttcaaatatattacgtgatgaatatgcgaacggaaagtggagcgtgtacatattttctttcttggagataagatgtaatggtgaaaattagtataatttaatggtttataaaatattaggtccacctaccacgtggcgatataggagcgtttgtaggagcgctacgtggcggtttaaaagcgtttgtaggaagtttaatgtataattaatttttataatgtatggttgttagaggtagaaattaggagaagagacggaagggaagagggtcagacagggagggagggagagtatgtacatatatgtgcacgttctgtttttcttttcaaatatattacgtgataaatatgcgaacggaaagtggagcgtgtacagattttcattcttggagataagatgtagtggtgaaaattagtataatttaatgatttataaaatattgggtccacctgccacgtggcgatataagaacatttgtaggagcgccacgtggcggtttagaagcgtttatagaaaatttaatggactaatagatagctagatgctcttctcttatttcagcacattacactccactccaccacgtgctactatcttgatggggtttatatcatctcccatccaagtactaatgttctatggggtttatagggtctcccatcttagcactatctatcattacacaccatgcggagtgtaagaacttgataagatacaaagcgttgctcgccttgcaacaaggatatggttgacatgatttttatacagcacacatatgcatgtgagagtgattttagtccttatattatagccatatgtaaagggtcccgtttccagtcaatccccatctgtggacaccctaataagtgttggaaggtccgaaggtgatcagtttctccatcaactgcccctcccagtatctatcatcatccttatatatccgacttatagtttggtaaatctattttatgcaaggtgacagtttcatgaagcaaaataaggtttatgcaaaataattcaaatcatcaagatcaaaggttcgcttgcctgaattctcgtagttcaaatcaaaaatagctggcgctcccaactgaccagactccgcctctagttcccttgttgtattccgtcaaatgcgtcgagatttaattaaactatactaatagaaatacaataatttacaaatacaaatgtgcttacaaatttgtaacctttttattgtaccgaaactccagttgtgatgtgctagataatttatcaaactatacttggactacagaattgggtcactatgctcaggttggtgttctgtgtagcctactaatgtacatctagcaatcagtccacattttcctttcttctctattctctcacctgcagaaacctctccccgtctctcccctcttatcactcctgcaggtaaaagcatcagctagctaatccccttcttccttcctccatttgccattagcagtggatatcttttccctcaaatcctcactctactactctagtactgctgctgctaccaccatgttgctctcggcgacctcaatgcccaggctaccagcaagacctcccctcttaatccttctctctatgctctccaacccacagctccaagaagtggacccccccatggctagaatagggtcacgcatggagctctagacccagacgccatgaccagcgccccatggagctcgacttcaccgagcaatcatcccctaggtaagtgctcctattctttcctcctccattttatctgctgctagcctgctaccgctccttcttttctattaaaagctgaactaaggtgctagggaaaaactacacagtggtgatggattgttttaagtttaatttactagaggatgtggttgtggtggtagtatgggggaaattctcaccttctcttttctgttggtgcgtgatgttttattgattgatccccctcaagtttgcagctaatgagcttcactccccagttcttcctcaaaccggtagccctccttgctaatttacaaatgttttactctttgcaactaaaattgcacgttttgctaattaggagtacatgggattatgggactacctatttcctcgcgtgttccatgtttacttgtgatccctcctttgtcaagcttgggtgataatttgactagcttgtgtcacttatgttgatcttgctagaatctttatatgcttagccatttttaattaccactagctcacattatgggataatcacactatatgcattagcatcttgatgagctatgagctcgagacatatggtcatgttttattggtcgtaattatctaactaaaatatggcttaacaacgagctctgggtgtatggttttgctagtcgcacccatggcaattaaggaccggttcgggggaaaccctggaagaatagaattaccgcgcttacacaagccagcgtgggcaacagctgcactttgtagcgtagattttcctagctaacgtacccgggcaagggtggacgtaatggagtatggatgggccttgcgacggtgtaacaccctgaaaattcccgacaataaaaatcactaaaatttcgaactttttaaaacttttgcatcatgctggatgttatggttgctattgcttgccaaactataaattgtcacaatgaaacattaaattaaagatgtacaatttgcaagaatacgctatctatcgatcccataaatatttgtgcacatgatagcaaagccaaataaagtacaagtcacttattaatttctataagttacggattgaatagtgtcctgacatctaagtaaccacgaaatagtcgtcactacaatgactctatatatataggagtgtttcactgaaataattaaattaatatctataacttacaacaaatctctcatggcataaaattcactcatataaaataattgttcacataaaataaatttatccctatatataaagattgaaggatgggagtatctaattaaatacttagatcaatattataccaagtctcaaattacctctagaataaaatagattaaacttttccatgtaaaatacattgctagacaaataagttcaaccaatgagctattgtattaatagtagtcacattagaatattttaattaatttttataaatatcagagcctacaaggtatataggaaatcataaaagctatagtaaaatttaaaatattggacaatattaattttggaccaaattcacatttgaatacttaatatttgtgatcaaatgcactggtgaaaatacaaattgaattagctatctttctcgaatttt

SEQ ID NO: 2156 - DNA, 1543 bp, Oryza sativa
attttttaataatattttgtgggaaattttagtatttattttttggttaaaatatttggatgaatgaatttatattttcattattgtagtatagtgcgctgcaaagttcgaagcgaatcttttgtactccgtcattggaaagggtatgaaaaaaaagacaaaaatagtactgatagttactaagttaataataaattgttcacaaatagtacggacacaacataaatgtctcaatttttaacagaaatagataactcaaggacgatcagtgcccttcgcacgcttgctaggtccccccttcttcctacgcctaacctgctcagtgggataagtcaaattatcaggggggtgcctctctcttgctgcctgctgtggtgtcacattgggagcctgaatggcccccatctcctgcgtcggctgtgtcacctgaggtgctgcgtgccagtaatccatccctagttccccttgaggaggctcagtggaaaagaagtcctcaacgaatgctgtgcgaggggagtaagtaggcattccatgatacgtcgatgccgaaccgtactcatcgtctgtttgcataagagggagaaacaaataatcgcgtagttagtaatgatacatgcatataatttgaaactaaagcgtgttattgtttaaacacagctctcatgggccacacaggcctcattctaattgggccgggatatcacatataccgtacatccacatatgttatttatggggtaaccttggcctattaagttgagtacttgtctaacattgcattaaggagaccgatgcagtataggtagtggccacgagtgaactgtaggctatctagaggagctacccatgtgtgtgttgaattttaggatgagtgaactagtcctaagtgtgtgttttctgtgaggggatgagtgtactgttccgcctcacagcgtgggtgtctaagtttgtccaatacaatgctgaatgcctcatgggaagagttgcttcgccacggtgtcaggttcgataggccaaccgtcctaacaacactaatgttctggacttagtagggattgaaaattcatcgtgctcatgcaaggtcagacggtagtcaatgtaaaagccttgttataacctctagaccacattcaccatgaagagtatggcagtgcctggcgagcacaaaacaaattagagtgttcatatcatgtggatatctgtacaaactctgcaaagcctaaaactgtcacatctagaaatttagcccaaattttcagactattttgtgtattaagtccctgtccaggaatcagctagggtacacaaaacaacaagtaaatatacagatccaaatataaataaactgtaaatacttacataagaggcacttagtcctcacacagaaaaaaaacagcaacaacggacaaaggcgatcctaatggggctttagctccactccataagcaaaactcaactggggtataagccttggtcctctaacttcatcttcaactcaaaaacactacacttttgaaaaagggtgaataatagcaaggttgag

SEQ ID NO: 2157 - DNA, 491 bp, Oryza sativa
  unsure (1)..(491): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatgcagctcacatggggtttcccccggctggcgtgatctcatcaatggggcaagtggtttcgtcctagtttgcacggcgtccatgctctgtgatcctacctgccccgttgaggcgcagctgctacgattgcctgaggggctgaccataacaggaggaatgtatggctgggcatcatggcaccgatgtgcgcccatgcgttcatccaccgggtaccgagctcgaattcgc

SEQ ID NO: 2158 - DNA, 1020 bp, Oryza sativa
  unsure (1)..(1020): unsure at all n locations
cccatgtaataaattatctatttacgcttccgcttgttaaactctgaattgtatcaactcttggtgtaccttgcctcctgggacaaggaataatacacgcacgaaaggaacgcccgttgggttaattccggtcgtgacaagttggtatcagagcccccttgaccctaggacgagccgtagatcccaagccttagcaatatcatcaaaaataaaaatcctttgctaattgtgaaaactctctagtctctctctgtcctgctgcttcatttatcgccaaaatctgacttttaaatgttgcttttctttttgtttttgtttgtagatggccggcagcgttagtcgtcgtggtctggacatgactggtttcgtcttggagctgcggggtatgtgcgttgtcctggggtatccgcatggagtggactaccagggcaggccgctcccggagcaggagggtgacgatgcagagccccacgctgcttgggaggttactgcagtgatcctcactggctcacccgagcggacttcgttggcagtcaccgcgggtggagattctttctccgccgcttgccagagcgtcgctctcctcgccatcggcactcttcactagcgctacccggacgagctgcagcactcgccctaccgctaccaccctcgtcgcggaggagcccgcgactacgccaccttctgggatgctagctcagaggatgacgctaccatcatgcacctggcgcgcatggtggaggcgtacgacgcggctcgtatcgacttccatcagatggtgcgccgtgggatggtcgagaacgacctgaagatcctggagctgcgtcaggagaatctgcagctgaagaaggacctagacgcagtggaggcacagctgcatcagctcaagatcacccagggagaggtctgtcgccccaagcgtcgccgcgtctgccgcagccagaagatcaccgcccgcaagagcacctccaggcccgagcttgttnnnnnnnnnnnnnnnnnnnnnnnnnnnnnnnnnnn

SEQ ID NO: 2159 - DNA, 823 bp, Oryza sativa
  unsure (1)..(823): unsure at all n locations
nnnnnnnnnnnnnnnnnnnnnnnnnnnnnnnnnnnnnnnnnnnnnnnnnnnnnatgcttatagatgcttcgctatttaattaggtaacattaggcggttttacaactctagactttgggatattcatatcacctggacactttggaattgttggagtattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcgtggcacagggccggtgtcctgctgctaggggctcagtcctgcctgcctgtcctgggggttccggccgtaggtgggattgggtcggtactcttgtctatggctaggatgggttggaaactatatcatgtcttccgtccgtataccatggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcggg

SEQ ID NO: 2160 - DNA, 1125 bp, Oryza sativa
gatgagctccagcggaggctggaggcaacgcggcgccagcaggaggccgacgccgcggcgctgcggtccatggtagcgcagctggaggaggcgaggctagaactggctgacgctattgacgccaagaacctggcgctcagccacgccgatgacgccatcagagccggcgaggcgaacgccgcccaggtggagctcctcaacgcggaaatcaaccgactcaaggattcgtttaattctgagctagagagcaaggtaaaagaatccgctgagaaaaccaggaagctggaggccgagacgtcggtactaaggatcaagctcaagaaagccaaggttgccgaagagaaggtggctgaattggaaggtgccgttgaaggtctcagagctgatgttgccaatgccatcaaggccaggagagaagcagatggattggttggtgaatggaagaagaaggctcaactttttgagatcaaactggagctagccaaccagtccagcatcctcaaggctgaatccatgagttcggtgatgaaggaattggatgcggcgaatgctttgttgcaggtaaaagagtctcaaattgctcttcttcacgacaagatagagtccttggaacatgaagtggtgaggcagaatgaagatatcaatgcatcaggtcagcgcgtcgatgccgcgcagagaggagcattagccttaaggacagagatccaggagcttaggtcaaggcttggcgcgatggaacaagagaagaggggtactatcaaggatggaagctttacaagctcccaaattgaggccatatgtgaagagaaggataagctagctaaggaactagaatctagcaaatatgaatgcgagaaagttagaaaagcaatggaggatatggcctctgcattgcaagagatgtctgctgaggcaagagagtcacaggagaattacctgcacaaagaaaaagagatcgagcacaccagggcaaaattacaagagctcaacatcagcctcaacaacaccagggataactatgaggtaatgcttgatgaagcaaactacgagaggatctgcttgaagaataaggtggaacagctggaagcagaagccaagaccacatctgaggagtggcgatccaaa

SEQ ID NO: 2161 - DNA, 411 bp, Oryza sativa
ggcacgttaggtagcggtcgcgtcgagtttgttgtcgagaagtgcgatagaatcaacttctagagaagtgttgagatcaatctcaacgagtttgatggctcaaatctctaacctgggtttgtcattccaatctaacttctattagattgatatctaaaggtagattgatctcctgttactttcttgttttcaaatgctagctgagatcgagatgagtggtcgtcatcccagtgcgtcagcccgacgtgctccttgatgcactcaatgcacacgccggtgcgggtcacgctcatcatgggaacaaggcaggtctacgggttgtgtccacaacctattaacgttaatcgcacgcggagccgccggcaaccacgatttaactcgtgtgcatgtgtaattcaaccggcatgcatg

SEQ ID NO: 2162 - DNA, 628 bp, Oryza sativa
tactttgtcaagaactagtggaaataggttatttctaaatgaatatgcatgcaagcatttctagttctccattatttccaacagtattgatggtcgaaattcgtctataatgaccgtcaacaggtaataggaccataaggttgtagtcgtggagacgtggatgtatcgatggtgttgatgtcctcatcatgagagctcatggagctggagtcgccaccgggccgtcacacgagatccgccaccggggatgccgctcgagatccaccaccggtcggcagcgtagagatccaccactggggccgcctctcgaagcgaggaggaggatgactgtcacatcctgattttcgttttaggatttataaattatttaataaattattattagaatttatattaaatgttcattaatttacaagagaagttaaatgtgggaaataaaatttcctaaatataaagcatggacggatttattttttattaaattctccatggttaattatactctctggaattttctcggatttttcggagctcaattcctaattttagccatgcaaagaacatttaaaaaaaaatccacatattaaattaatcattaaggggatcctctagagtcgacctgcaggca

SEQ ID NO: 2163 - DNA, 1170 bp, Oryza sativa
  unsure (1)..(1170): unsure at all n locations
atagtgttcaacgcgtgtttcccggcgtccagcggtcctcggcttccccaatggcaacggcggcagcnngacaccnccgcccccccgccccccactccctccaacctccagctctggacggggagtcccgcaatatggtctttggtagcggtgagattacgcacacaaggtgttcgacgcaatgtattcgggaagaaagctgagaggaatggggatttttgttgggggcttagcttaggttgtaaggaaacggtgtggataagatcgccagcacattcccaggcgaaatagagctctaatggctatcggataagggcaaggaggtggatgacacggataaggtttgatctcctcctccattaaggttctatggctccatcatcatacctaaagcctaaagtctgtgcgttctagctctagctgtggtaggaggctccgttttacccagcggacataaggaggggcgccaaaacatcatgagatgtggataaggttttctcttctctctcacactcagggatttggggaatcaaatggccggtattaggtttgcaggcctcggagctaggggtgacgaagggcgaggtggcggccgttatccctcggcgtcgagaggcgacgcgcgatggcgacatcgatgacgccggcgctcgtggcggcatgggcggagcggcttccgcggctgaggtccatgtgcgagcgcggcatggcgcacggtctcgcggtggagtggcgcacggttaagtaaagacggacgcgtggtgggggctgggtcgctgggtgttcgactcactaggttcgagtcgaacacctggcgcgcaatgaataatgccatgctggaataaaaagagatttttagggttttggtttatttaaaaatcgagaaagatagctaattcaatttgtattttcaccagtgcatttgatcaacaatattaagtattcaaatgtgaatttggtccaaaattaatattgtccaatattttaaattttactatagcttttatgatttcctatataccttgtaggctctgatatttataaaaattaattaaaatattctaatgtgactactattaatacaatagctcattggttgaacttatttgtctagcaatgtattttacatggaaaagtttaatctattttattctagaggtaatttgagac

SEQ ID NO: 2164 - DNA, 987 bp, Oryza sativa
attttggatgtattgaatatccatataaatcaattgttgtatggtatatgttaattatgtatgattattagaatttttaacaaatttaaatcatgcatatgctagttatatatgataattagaatttttaaaagttttaaatcatgcatatgcttattatatatgattattagaacttttaacaattttaaatcattcatgtggtatttacatatgattattagaatgttaaaaattttaaatcatgcatgtggtatttacatatgattattagaatttttaacaattttaaatcatgcatatgctagttatatatgattattagaatttttgataattttaaatcatacatgtggtatttacacatgattattagaatttttaacaattttaaatcattcatgtgcttattatatattatccacttaatttactatagacaacaatatattttcaaggttttgtcattaattttgtgactttaaatcattttaatgcattatttactattttagaaacccatatgtaatgaaatttaatatgcaatgctattatctttagtcccggttcttaaccctaaccgtgttaaaaaagaatttggaaatagcgggaaaagatcttttggcccggttggtgataacaaccgggactaaagatatctttagtccgactaaagatatctttagtcccggttcgtaagaacaaccgggactaaagatgttaagataagatctttagtcccggttgttgtcatgaatagggactaaagatatctttagtcccggttgttctcactaaccgggactaaagatcatggggtatatatatgcccaaggcgcactcgtcttctccaccaacacttagatgtttttctccgatctcagctgcatcaccttcgccgccgcgcctagggcatcccttgctccgacgccgcagtcatctcgctgtcgtcgtcgtcgccgtcgacgccgccgccgcattggggtg

SEQ ID NO: 2165 - DNA, 4638 bp, Oryza sativa
  unsure (1)..(4638): unsure at all n locations
nnnnnnnnnnnnnnnnnnnnnnnnnnnnnnnnnnnnnnnnnnnnnnnnnnnnnnnnnnnacgaccatatcgatgagtcgtatgaaggttaacgatggtttagatgcccactggcgttatgatagtaagcaggtgcaagttgggcagatgtttcatgacaaaggtcacttacaagatgcggtgaagaggtgggcatttgaccagaagcgtgagttcagggtgaaggtttcaaataggacgacgtacgacgtgaagtgcacacaggctggatgtccttggagagtgcatggttacaagccacaacatgacactttatgggtagcttcgagggttgagcaacatacgtgtttgttggagaatactcatctggtacataggaacatgacagcggtatttgtggcacaaatggtatattcaaaggtggatagaaaaacatctttgtcccctttcacaataatgcatgacgtagagaaagagtacggatatgagatatcgtatgtcaaggcttggagggcaaaacagaaagcacttgagatgaggtttggaacttatgaggattcttatcacaatcttcccccactattggaggtgatgcaggcaagaaacccaggcacacacatggctattctccacgaggtgaatgaaaatagagagaatgttcttcgtcgggctttctggtcatttgggtgcatgatagaggcctttagaaattgcattcctttgctctgtgttgatggcactttcacgacaagcaagtatagaggaacaattctaaccgtgatcggagtcgacgcggatagccatgtcattcctgttgcttttgcatttgttgaaagcgagaacacatcaagctggctatggtttttgtggcacattaaaatgtgtgttgttcaaaacagaccaaatgtttgtgttctgcatgaccgacatgccggtttgttatcgacgatacagaagcttcaagaagatgtgacagagtccgtgccatggccagatttgcatagcagatggtccatgcgacatcttggggctaattttacaggcaatttaggagtaagagattgatggacctggtcaagaagttatgcaagcagaatcaacaaagaaagtttgatgctatatgggaacaacttgatcatttgaccactacacacatggaagaggttaggaaaaagcccgtagttgccagacaggaggagccggagggacttgaacccattcctaatgaagcaccaagtattactcggtgcaagaagcgcggaagggccacgaagtgcttcacggagtgggttgaatttgagccaagggagaaatggtcgttattgtacgatacaaatggatcgaggtatagtgtgataacaactaatcttgctgaagtgtataactgggttatgaaaaaaatacacgaccgctaccacttgttgctatccttgagggcatcactaggggtacacagaagtatctctgtaaaaggtattctatggctagtcttaacctcagcaaacccagtgttaagtatagcccagcaattacacagtacatggatgagaaaagcaagaagggaggaatgcatagagtgtggcctgctgggaatagagagttgctatttgagatacgacttcgtgacaagagtggtgtcggcattgggactactgacatcacattggaatgcacgttgtggccagagtatcatgcttgcaaatgcaattgcacaagccttatctgttacaccagccatgttctcatgttcttgtcgcttccacaaaaggaggtgttgatgcaaaccattttgtttctccgtactttatgaaggaagcgtgggaggcaacttggcgaggtgaattgcgtggttggcgagccgtgtgcgatttcactcgtcctcctccagggcaagccaattgggttctggattcatttattagttgatactaaaggttgtcgccagtcgcgtaggatcaagaaccttatggatgaagctaaagcgaaagatcgttctcgtcgtaagaaagcttgcattctttgtggggagaaccatgcccgtaaagattgtgccatgtacaatgtagggaaagacgccgcacgagctgatgttcgtcgcgttccaaagggaaagtcgaagaagaaaaataatccttagatcgctaatagccttggtgggcttgtacttttaagttggtgtcttcaaatttatgtttagcgcgtctgtatttttaatttgaacaatcctccacttttaacttccgaatcaatgtgttgtgggcttgttttttgtaatatccgaatctatttgtaatgggcttgtaatttaattttcgaactgtgcactgcacttttaatatccaaatctacgtgttgttggcttgtagttttaatttgcaatatactgcacttttattatctgaaggtattgtaattttaaattgaataaatgtgttgcaatttaattatctaaattatgtatctgaattatgtgtcatgcatttaatttactgttaccatatgaacattgtactaatatggttttcaatatgcaggtatggctgaacaatatgacgtgcagctgatcgacaaggagattgataggaaccatcggtcgcgacgacttagtagaggaactttctgcaatgtgctgaaaatgcgaggaccggatcaatattggcgtattgatcctcgttgggttccaaggtgcgtaataatatattgttttaaccttataagattttgacatttccctgtattaataacttgcactctctcttcttgtaggttgagagcagctggcttgttgacctttgcacgattggtcgagccttcacgcggcgcttctgagtgctctcgtggatagatggaggcttgagacccacactttccacctcacagttggagagatggtgcccactttgcaggatgtgtcttatctgttgggtctgccgatagctgggccagcagttggcccaacaatggtacaagctggatgggcagacgaccttctggccaattttggtggtgtgctgcctgttgcactggaggatctcatggatgggcacgggccgacaaaaagttggttgaatcagtttcgacatgatgtctttcctgatgatcaggaggactggatcgtgcgacggcacttagtcgcttacctgttgtggttgtttggatgggtgatgttcacaggaactcacactgactcggtggacaagcacttcatccactacgcggagcagattgcagagttacctatcgcagagtttccacagtacagttgggggtcggcggtacttgcggccacatatgctggactatgtgatgcttgcttgaggaacagcaagcaaattcactccctggatgcccgttgctactcatgttgtgggcgcacgagcgcttcgacattgggaggcctcagctggactcgtacgcaaactacgaattgcgagagatgtacaagtccggggttggtgacctcgacaatcgtcccactatgggatccttgtggacacactgtgaggtaatttttgtttaattcgtttgtcttctcattatatacggttcaccacaagttgaataatttcctgatataactaatcataagtactatcttcttgttacagccgaagtgggttagcgggacgacgcgtcgtgtgtacacacagttcgtagctaactttgatcagcttacgcctgaccgtgtgcggtagactccgtacactcaacacgatgtcaatgatcgtgcaccgcacggtctcgcggacctttgcacgcgggatcaagcactatggaggacgacttgtcacctcgtgctggacgtgcacgtcgagccacacaatgtccaaagggttcttaaacagttgggcatgtatcaggacttttctcccagagttggtcatgctttggctgatagtcttcagaggttggtacacataacagttgtttaatccaatttttaacaaaaatatgtgtacgtacgattttgaataaatgtgtccatttcttgctgtgcaggtattcccgaaaggggctcgggctttcctacgagcttgttattgtgaccatggttcagccgactgtacaagagtgggagcacgcagttgataatttggcgcttcagaaacctccagacgatgggagttactatggggcctaccttcgttgataccgcagtgtcacacgatggaggtgttttccgccacaaggagatagcaccgtcccccaccaggcagcgattactgacacgtttgcccctcagcctcgatcagcttacaactcaatggtatgtgtttacttgtggaacatgcggaatatgagcaactagttcagtatttctaataaatgtggaactagttcaatatttttaataaatgtgctagttaagtattttttataaatgtgcaacttggtcaatattcgtaataaatgtgcaacttattcaatactttgaataaatgtgcaactatatcataattttaattgtcttgcttatttgtggaacatgcaaaatttgttgagcacgtgcaagtcgagtcggacaccttgctgcaaagactagagacgagacctccaaccgtcaagacctccagccgtcaggcctgacgacgtggcgagcatccttcacaacttccgtgcccgtgctgccacactactt

SEQ ID NO: 2166 - DNA, 3243 bp, Oryza sativa
gcatagttaggggtgaagaatgtccggttttgtagttagggggtaattcggactaccgcaatagtttaggggggtaattcgtactttttcctttagaaattatactgggcctttagctttctcctcagcaatggtcgtatctaccactgatctgatcatacccgtcaatgtattgactagcacaccagattaattaatcaaatgcatgatgcacagctaagtcaatgtgaccttccagagttggcttgtattcttctttatctccatcaccttcagacttcttatctatcttttcttcaacaagctttgggaactcgactttattcttctgaatcagcttcccttgccgagtcatactataagaactgagatacatccgctgcatatgttgaacaagcttctctctgctttcttttcatcagacaagtgctcaatagtgacggggatgatgttgtcgtcggtgatttcaatgagagatggcggcatgatgaatggtgaagtggtcccaccgggcgcgctaaaagagtgttgatgagaaacacaacggtctgggagatttctttcactcctatgctggttcaaggcttgcctcaagtatcaagaaagacaataaacgtaattagatgaacgatacccgatcggccaatagagccgataacgtatcatcaagacccagccgataagttaaatcaaatcggttgcggttttgagatggatacgtaaagcaaaaagtctgaatatgtcctatcggctgtaatactatgtcttttgtttttatcaatcacttttagatagcattatagaaatagccaatgatccaatatttagagcgagaatatataataatccaatacaaacttatataaacaggttaatctagataaatgtatcaaataataatctatcaccagatataatagattagttgagatcaatcagacttgatatatttatacagagtgatctatctatataagtggcaaatatagataaaacagattatgaaatatgcattattatgtatattaggtaagatcagctgaaactccgatgctatccttagttatgattaattccaggctagtttatagggttcgagacaagactagggttgttgcaactcaaagtatgttaagaaacctaaagtctaaacaatcaagaaattaaccacttgttaggatggtaaatacgttagctaatctaatacagtaaagcaatttagcttataccagcataaaccctaaagtgagaatcagccgatatgactaaatcgaaatactaaactagattaactaagatatatgataaatgatgaccacggtaaaaaggctaaaatcgacataatagccctgatagtgcaagccatcaagacaagttacctcttgtcgagatatcgcagccaatacccgactcgaagccagaactcatcgaaaaagtaaaaaaaaaagtggcgatgcgccgaaagttgtattgattggattctcgtcccttattacaatgatctagagtttatattcataccccaagtacaaaacttgtccattatgggcttgactcaaactttcccatggataaaaacaacaaataagtccatacgatggactcttaccatatctcaaattcaaactgtcattaatatcctaattaatagatacatttgccttaaatgagttccatctttatatcgcaatattggttatctcgtggcccaaaccgaacccaagtctaactgtatcggctgctttccatatcggctcaatcaaactccgactctattttcagctgatacgctgtcagttgatgcgcaatctgttagaactatatacgatatgctccctccattctaaaattagttgatctctaggatttaaactttctcaagaatagttcgataaattcctacaatcctatctacccttatcagcaaattaaattcaatattacttaccactcaccaccaataatattttttccattaataaaattgtcactggatacaaggaatacttctattttgtgatatagagggagtagaaagtacacaccaatagttgataccccttgcttggttggtgttctatgcacgcatgatgcatatacataggttgtgaaatgtattggagaacaacccaagtgcaacctcatattcctttacattcatataaccgcagcatacatatagatacaaaaactagagaaccagtcagaaaacaaaactagagcataaatacttctcacaaatacacaacgtaagaaattaacccgaaaaagggaaaggaaatataccacccttcagttttctcttccctcttaagcttacagttatcatctccactgccacgtcagcaggacgtaataatatataaacgagataaaacagtcatatgtgttatagatcaagcaattttttccttttatttgataaggattacctaatgttggcttttctttttcagtaagccaccgaatttcttcatcaaagccttcttttgctggttctgcttgactaccaatttggtgttactgttggtcttctctgtggacaacctactgccattgccatcagcagcaatgtctctgtctgtgtccaacagatcaacttccggttcaccgtcgtccctctccttagataagttgtagctgttctcccacatcttagaaactagcaaaactggcccatctttctccgtgtttccctcgtcatttcctatcagagaatacaagtccttgattttctctgaaccagatgattctttgacatgcagatgcaggccatcattctctttgtacgcttttgtgtctttgcctcctctgtaattattatccttgtccatcagagcttccagttctcttaccttctcctctagttgagcatttctgttctccatgtctcttgccgtctctagtgctttacccaaccgagttctcattgacatgatctcttcttctgattttgtgatagagctaacaaagctaagctctttggatcgccactcctcagatgtggtcttggcttctgcttccagctgttccaccttattcttcaagcagatcctctcgtagtttgcttcatcaagcattacctcatagttatccctggtgttgttgaggctgatgttgagctcttgtaattttgccttggtgtgctcgatctctttttctttgtgcaggtaattctcctgtgactctcttgcctcagcagacatctcttgcaatgcagaggccatatcctccattgctttt

SEQ ID NO: 2167 - DNA, 738 bp, Oryza sativa
ggtggtcggctgacgacggcgacggcgtcttctccaccaacgccggggacctctcggcacgcgccgccgcatgacgtgggatgccacaggccaccggcctagcggtggcggccacatgtggcgtgctcttgctgcttttggcagcgtcggccgtgctagaactgcagcatgtgtccaacaaatcttattttgctcagaccaagaactaagtcaaatggaaccaaaaaggcagccaaacaattgcgggtaaagaagatgagagattgatgccggattggcacacttacttgagcctggacgagcccgccattgcttctgcctgctgctccccgagcttccgaattggagcgcgcggtgggttgaagaaaagaaaagaatggaggggaggggcagtgcagtgggtgtcggtgttgatcgcccactaggggcaaggggaataatagaatctcatcgccaacaccagcaaaaccagcaatcgctgtttggcttcaagaacagatcttcctttttttcttttttactgtgaaagatcacaatcaccatcacattctgtggtgtactggtgtggcatgggtaggctggctggctttacttgggtttgcagctgttgccgcctcgtcctcaaagggcaagttttataataaatgtggtggtcacctccaattttattcacatcatccatacaaaaaatcaaaattaacttatgtaaatgcattgcatttaatacactagtctcaa

SEQ ID NO: 2168 - DNA, 665 bp, Oryza sativa
  unsure (1)..(665): unsure at all n locations
nnnnnnnnnnnnnnnnnnnnnnnnnnnnnnnnnnnnnnnnnnnnnnnnnnncttctcaaatacatcctgttgatagatactacttgtcaaccattaactggatggtacatatatactgaaaactcaattaatgatccaactataccttctggtggattcttcgagctgtagctgggtccctcctgtacattgttccataggccactctaattacttggtccagaggacaaggtgtatcttcaacttttgaagccagaaatatgcacactgttgcaatcgtctgcaataaaaaacaagtaaagctattggctctggaatgacaataagcaaataaaataaacaccaattacttgtaatagtatttagttatagacagcttgcatcacatgcacagctttttttttcttttcttgagcaatgaagaaacatgtcagcaagtaacatctgcaagtgcagataacgagcacaactccagattaattgcagagacaagaatgtgtttctcaattaaataaccgcatgacaggaatacagtgaatgtggtgaggcgaatcaaatctataaaactactgaggatttatacttattagatggtcaagtatagtattttagcttctaataacaggattgtaagctgtaatccttgtggctaatggcaatagtgt

SEQ ID NO: 2169 - DNA, 2260 bp, Oryza sativa
ctcattgcacacgccggtgcgggtcacgctcatcatgggacaaagcaggttctacgggttgtgtccacaccctattaacgttaatcgcacgcgaagccgccggcaacacgatttaactcgtgtgcatgtgtaattcacccggcatgcatgacttaatcacacacaatacattgatatatgaagcatctatatctttcagcttactgacggattgattttcatgattgctttgttttgcatgtatgacgattcaatcacctgataagatcgatcaacccacctccatccgagctatacatgtgttgataaccaaatttgacacgggtcatgttatagctagtttgagccaaatttagaacggaattgctaactatcgtttgactgatttatgagccttccatcattcgcatttttgccgtaggatatggtttttgagatccgtgctagcatctagctgctaattaactaggtccacgttgctaattaactaggtccacgttactgttccctgttgttaaactagccgtacgtgtttttcaatgctaatttatttatgatcccacgcgtactaattacatcgtacttacactataattatatattaattacatatgtaattttagtgtatttacgatgtaagtctgaaaattacatatataattttagtgtatttacgatgtaagtttgaaatctacttgagcccatttgagccccatgagcttcagattgtccacgtggctcgtttgtttgttttttgtattttgtttgtgcatattaatgtcatccgttagatgttgatttaaagggtaagaaatgtgcatcataggaggctaaaaaatctgtcacatgatctataggcagtaaccaaatttgacacgggtcatgttatagctagtttgagccaaatttggaaactaccaagtcattcccgcgaaggccagtctaaccgccgtagtgtggctggtcagaccggacaatgagctgtgatcagaccgccgggtggtcagaccttcagcatagagtcagagtccaatttaggtatttctcgtatttccttgttttagatcggtgttggtatttcttaacgtcacaaatgcagcacttcacctgggattattcttaggtatcgatttccacaggcaacgggtattacttccttatcaggttcacccaaggacaccaagctaagatgcgcaaaggatagagaggatttcctagtgagaaacattgtctaaggaaagtttaattttaatcctaacgcgataattcagacactggcaacccgctgttcctagatgtcgctctactacataccctgacagggaggacttaagtgctcttgagggctgtcaccacctctacacccacctcaaacgtactgtggggatacacaacaattactggatataaattacctaaacaccacgtctgagcaattaatatctactttagtgtttctaactcactaaagcaatcactatattttagtcgattatagggaacaataattcttataagaggtaattctcacaagtactcacaagtaaatctaaattactcagaaagatatttctattgaaaacagagtaatgaacagaacaaaataaacatgagaggattaccgacatctcggaaattcctccgacttcttatactctactctcttcttaattctagtatacaaaatagtacaacagagcctcttataattcagctcaagcttggaagtgtgtgaagaagtgaatgagtgaagctccttaaataggcagttaatgacggttgtggaacgggaattgtccaaagtgccctccaccgccattaggatcaaatcaggagcatcccttccaaaccccaggatcaacggtggagatcagggttctgggctggcccatctggccctcaattttggcctgtggactcctcctgttctgccttatccattactgcgagttttgggctgattctctggtattttagtgaagtctaaagcccctcccttgtatggatatgttccttcttcactttagtctgattttcctcccaacttcggtggtttaggacctgcatcaattaaacacgaacactcgtggaatatgttagaattaacacctaccactatattggatgttttattatctgagttttatgcaaatgctggcggtataaaaatgtgtatttaatagccgccaacaatcgggatttctcgagtcctagttgatttctaagcctaattggacgtgggaaagaccatgggaagtaa

SEQ ID NO: 2170 - DNA, 616 bp, Oryza sativa
ttttgttgtgaaaacagggtagtgcatgacaggtttcaacctgccggaaaacttcaaagaaaatccagaagctttcttccgagcgtcaggccgcgagtcgttgcttcgcagaaaactctaccaacggagaaaccagccctaccagtgccaccgaccttcaagactatggccagcaagactcttcgcgagttcgctgctccctctgctgacaatgtggccattgggccgcaggtcaacataggggacgtggattttgacttgaagtccagcctcatgacgatggcacaggctagcccgttctatggcaagcctaatgaggatgccaatgctcatctgcaacagttcctggagatctgtagcacgtacaccattaagggtgtcagtcccgacgtcgtcaggttgcggctatttccgttctcccttctcgggagagcaaagtagtgattttatgccaaccatgctgctgtcaacacctgggacaaatgctctacggcattcctctcgaaattcttcccgacgggcaaaaccaatgcccttcatggaaggatttccagtttccagcagacaagggacgagtctattcccgaagcatgggaatgactgcaggagtacgtgg

SEQ ID NO: 2171 - DNA, 1104 bp, Oryza sativa
ctgacgcaatagatccaaattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaggttgaagccgacgtttgggaaagtgagcaaggcaagtcacatcatctttgaacatattgaatcccagtttataaaattatgttgatttaaattattgcattatcgctttatttaaattcccgcgttatcactgttttgtttagccatgcctatttacctttgttatgaccttattattgttattgttattatttccttgttcaccctagattaaacaaaaccccaactagtggacactctactcatggtaccactagtatgatgttaggtagatgcttcgctatttaattaggtaacattaggcggttttacaactctagactttgggatattcatatcacctggacactttggaattgttggagtattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcgtggcacagggccggtgtcctgctgctaggggctcagtcctgcctgcctgtcctgggggttccggccgtaagtgggattgggtcggtactcttgtctatggctaggatgggttggaaactatattatgtcttccgttcgtataccatggtggtatgtggcacgtggttacac

SEQ ID NO: 2172 - DNA, 1635 bp, Oryza sativa
  unsure (1)..(1635): unsure at all n locations
nnnnnnnnnnnnnnnnnnnnnnnnnnnnnnnnnnnnnnnnnnnnnnnnnnnnnnnnnnnatggtatatgttcacgagtggctaaacgaaaggcatctattttgctccctttatttaacctaaaatattccttaaaaaattatgtggttatatgtttgaatggaatatctcttaatatgccttaacatacccatgtaagtaacacgtttccgccactaattaaaccctatgtaagtaccattactagcttgtttaaacaaatattaatttacttgtacgcttgcatatacgtgcatttgatagtggtgtagagctcctaggctcctagcactgtactatcgagttgattttcctcgtcggcgtattccataaggcacattgtcggtgtatgtaactgtgcgtggaataccttttaggatgacaagggtacactttttacattgccctgatcgttttgacgaattggccagcatgaatgtcctgttgtgtgttgatgcttcactgcacaacaactgccccacatgcttgacgcccggatggccgtattcagaagcaaaaataaattaaattaaattgtctcgaggtgtgctcctctgtgtccagttctttttcgtgccctctctgatgtaatgtaccaattagtacctagttaatcatgaatacgtgccagctcgaccaacaaagctagctcctgtgaggcaaaaagtgaactatacgttggcatatatcatggctgcccaaagagcacagtactatatgtcatgtgtacgccatagtttgctaatgccacatatttgatgccaatactccatccagcttgctgtccttcacggtgcatgtacacggttgtggcttatttcgtttgctcatcaacatggtttaatttgcagttttgcacaaagtagcaaatattatgtttttttccttgtatttcttataaaacctaaaaaaaatttcagagctttttatttttttaattttattaatagatcttccacgccaccgtagctagcatggccaaccaacgctgctacgccagttcggtttttaaaaataatttttggaaagatttattaataaaattagaaaataaaaagaaaataaaaaaaattataaaacctcctgccttttcccacacatatgtcacactgaaaaccagacagcggtgagagagggggggagtggaagagaagcaagcgcgagacaaggcggacaggaggcgtggcttttttgtgcggtccgtcacacacacaaacacacgcgctgtcgcttttctcggagaggcaggatttgcaagggtggttagggcaagtactataaggttttaagcacaaactccaaagtgccatgtatgcttaaataatgatgtggaggagagaaaagaagagagaggggaggagccacccctcatgcaaagggcaacctctacacaaattttaaggaacaagagaaaataaaaggactgattggtggcaagtgtattgagactagtgtattaaatgcaatgcatttacataagttattttgattttttggatggatgatgtgaataaaattggaggtgaccaccacatttattataaaacttgccctttgaggacgaggaggcaacagctgcaaacccaagtaaagccag

SEQ ID NO: 2173 - DNA, 1963 bp, Oryza sativa
  unsure (1)..(1963): unsure at all n locations
nnnnnnnnnnnnnnnnnnnnnnnnnnnnnnnnnnnnnnnnnnnnnnnnnnnnnnnnnnnttcattaagttcatgaagaaggcaggagcattggttaaaccgaacgacatcaccgtgaattcatacagtccgtatcgcgtggtgaatgcggtcttcggaatatcttcttcacggatgcgcaactggtgatatccagaacgaagatcaatcttggagaataccgtggcacctttaagctgatcgaacagatcatcgatccggggaagagggtacttgtttttgatggtgacttcattgagagctctgtagtgaacgcacatcctcttcgtcttgtctttcttctccacaaaaatcacaggagcaccccaggaggaagtactcggacgtatataccccttttctttcaactcttccaactgtttcttaacttcggccagttcatttgctgccatacggtagggtcgcttgtacagaggagtggttcctagagcaagatctatccggaactcaatctctcgcttgggcggcataccgggtagttcttccggaaacacgtctccgaactctctgacaatggggatttctgacagtcctatctgatgaagttctgaactactgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaaggaatcccctgaatttctatagggacggcaggactataatactttgctgtcataacccctccaggggtggtgatgagtagagggttcctaagcctttctacccccaactgatttctccccacgaatggcacagatataaacaagtgggaagctccagagtcgaacaaaatggtagcagggatggaatggatgaggaacgtaccaacgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacgctgcggaccttgaacgtccctgcggccttgtccagactgcgcggctggcgtaggaggacggggcgcacgggtcccttgctggctctgctggtgctgcggctgtgggacgcgcaccacgaattgaggtcgaggcgcggagcgaggttgctgctgctgcgagaaagatccccctggatagggattggtgtagcggatcctttggttagcaccctgttggttgcggaaattcgccaagcgacgcttgtgcgactccagttccttgtgcttggcttccaagcggatgctcttttccaccagacgttggaaatccggatagtcaccggagactagacggacagacagctccgggtccattcctgccaagaacttctcttgcttctcctcatcttcccgcacatcctccggggcgtaccgggccaagttgttaaactcatgcaaatactccatcacggagcggttgccttgcttcaactctcggaactcccttttcttaagggccatgactccggcgggcacatgggtcctccggaaggcggcggtgaagcgggcccaagtaataggctgcccctctggctgcgtagcctggaaatgatcccaccatagagatgcgggtccctgcagttggtgggcggcgaagacgactttctcctcatcgctgcactgcacagtgtctagctttttccccacggcatgcaaccaatccaacgcatccacggggttgttggagctagagaaggtaggtggacggatgcgtaggaactcggcgagtttagagtgttgtgggggtggtggtggagcattatg

SEQ ID NO: 2174 - DNA, 1709 bp, Oryza sativa
gatgtccatcgacccccgacttcgtccatctccatcagtgtacttttgtttataaccagattgagccacaaagtaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaattaagtagcgaagcatctcactccctatcacccaaacaaactcagcctaagaagttttaggttatctctaagttaaacttttcatttttaactaactttatacaaaaatatagtagcatcgataataccaagttaatattattaaattcatcgtaaatatatttccttagtatatttcttttgtgttgtaaatgctactaacttttctacaaataaacatgattaaatttaaaaagtttgtattaggataaaccctaaatgacttatctctactaactgaatttgattgctcaatattcgattattcttttacctttgaaagaagaggcattgtcctcgtccccactattgtagtccccacataaaaaaactacccgaaaaaaccagcccatccaaaaaaaacaacccaccaaaacacaagatataaaagacagaaccctataaaacatgtgcatgacactagtaatataaacacggtggagtagtagttaccatggagggccctacataaataaaaaaacagatcaaacatgattcacgcaccacgaatgattaactaatccacatcaaaataactatttcctccggattgataatacttgtcgtttagataagggcacggtcttcaaaaaaataactttgatcattattttttattataatatgtataaaattgttaacaaatatatgattttatgaaagtactttttaaaactaatctatacatatagtcaccatatttgaaagataaatattttaaaaataattcataatcaatgattctaaagtttgatctaacccttctctaaaatgacaagtattatcagttcgttgggagtaaatccttatctaatgtgcaaccaaaatcaccattggctagatatttaggcccctccgaaacagagcaaaatcataggaattccagagaatttcatatcataggaattccagagaatttcatatgagaatggatcctttcgaaacaaaatgattattttctacctattcctttaaaaatcctatggaatggatcattctagaacatttttgaggaaattacgcatgaggtcttacctctggtgtttcttcttcatgtgtatagaattattgtgtttgtcatgtgagcattcaaacaacaattttaaacctttcagtgtttcgaaacactataggaatctaaaaagtgtggcattctactcctcattttttttctattcacgtgttttctcaatcctccgtttcaaagtatcgttacttttttgctagcacatgaactcgatcttggttgcactactgcagaacacctggttgcaaacttggcatacatgccggtttcgcaactgacaccaatgatgctaagtcattggtgccgttgtagaactggca

SEQ ID NO: 2175 - DNA, 588 bp, Oryza sativa
  unsure (1)..(588): unsure at all n locations
tatagggcgaatccgagctcggtacccatagtcatctgtggtctgaaagaaaaatgttaaaataggtaacaagcttagcaaacttccagaataaaagaaattattgtgtgctaactaagggcacaaactagccgtaaaaccaacatataagtttgaaaagtgagctatactgacattaaaaggtacactcaacaaggaaattggcacatacagtttcagtctaatgccaacatcccgaatgaatgaacagtacaactgccgaatttctgactccattatctcagtaataccatctttcctagatggggaaaatttctccagttcttccctggtgaagtaccaagagtacatgtgctcacatgataatttactcgtctgggattccccatccatcagtatgtttgaaaaaacctgcttaaggaccctccaaaatcttcagtgtagtttcagacagaacttccgaattgcttgtgctgaacagcctgcagaaccatgaaatttatgtatataataaaaatatctacaatatgaatnnnnnnnnnnnnnnnnnnnnnnnnnnnnnnnnnnnnnnnnnnnnnnnnnnnnnnn

SEQ ID NO: 2176 - DNA, 1039 bp, Oryza sativa
  unsure (1)..(1039): unsure at all n locations
tttttctttttataaaatcattttaactttgtttatttcttaataattattatttgtgctctgaaaattccactaaaatttatttacgcattttaggcttttaggaaatatacaaaaatctcccaagccttattggacttttaactttgcacattttaattgtgggaggctttcacaaggattttaattattctaggcataatttcgaggatgtattttagagtcattttgggacgcgacaaacctaccccccttaaacggaatctcgaccccgagattcggaagaactgacgaagagatcgggatgggctgccttcagctcgtcttcacgctcccaagtagcttcttcctcggcgtggttgctccattggaccttgcaaaaacggattacccggttcctggtccttcgctccatggtgtccaggattttcactggcctctccacgtaggtcaagtcttcgcgaacttcaatttgctctgagtcggcctgctcggatggcactcgaagacatttcttgagttgcgacacatggaacacatcatgcacgttgcccaaggaggcgggcagctccaactggtaagcgacttctccgcgccgagcaatgatacggaaaggacccacaaaccgaggtgcgagcttcccctttgtctgaaacctgtgtacacctcgcaagggcgtgacccgaagatacacaaagtcatccactgcgaattctaggtcacggcgtcggttgtctgcataactcttctgccgagaccgggccacctttagattatcccgaatggttctgactttagcttcagcttctctcaggatatcggtcccgaacacttggctttccccaacttggtcccacaatagcggtgtccggcatttgcgcccatacaacgcttcataaggtgccatttgtatgctggcttggtagctgttattgtaggagaactcggcataggggagactcttatcccaggtnnnnnnnnnnnnnnnnnnnnnnnnnnnnnnnnnnnnnnnnnnnnnnnnnnnnnnnnnnnnnnnnnn

SEQ ID NO: 2177 - DNA, 435 bp, Oryza sativa
  unsure (1)..(435): unsure at all n locations
gggcgaattcgagctcggtacccgataataatataacttatcaccgaatccaccgtcttgtgatatctcatttaccacagccttgtttggcatgagcattgctctctcactgaattgtacagtggttaaagtcccagttctgcacctgcatttctcagtcccagcactctatgtcaacttaagaaaatgtaaataaggtcatgaacagaaaaaacatgtgttctgaagaaacggaacataacaatgtagctccttgaatttgagctatggtagactttaattcagattttaatatctaaaggataaggcagtgactcggttatcagaatataacatgaaacaaataattttgagagagcataatacaagtatatgtgatnnnnnnnnnnnnnnnnnnnnnnnnnnnnnnnnnnnnnnnnnnnnnnnnnnnnnnnn

SEQ ID NO: 2178 - DNA, 1000 bp, Oryza sativa
  unsure (1)..(1000): unsure at all n locations
tattgatggtcgaaattcgtctataatgaccgtcaacaggtaataggaccatgaggttgtagccgttttactttgatgtatcgatggtgttgatgtcctcatcatgagagctcatggagctggagtcgccaccgggccgtcacacgagatccgccaccggggatgccgctcgagatccaccaccggtcggcagcgtagagatccaccactggggccgcctctcgaagcgaggaggaggatgactgtcacatcctgattttcgttttaggatttataaattatttaataaattattattagaatttatattaaatgttcattaatttacaagagaagttaaatgtgggaaataaaatttcctaaatataaagcatggacggatttattttttattaaattctccatggttaattatactctctggaattttctcggatttttcggagctcaattcctaattttaaccatacaaagaacatttcagtaattatccacatattaaattaatcattaaatggtctgattataattttgttaagtactttgagtgtccaagtattttcaggatttttcttgaaactatttgagcattggaagtatttttaacaattcaaagatcatttcagtgattattttaattggaaaaagtttttaaatcctctcctaagccgttgggctgatttcagcccaacatctctctccctcgcgcgcgtgctgtgcagcccaagtcggcccatccgagctcctcctctttctttctttgctttgttttcagccagcccaagacgaaaagtctaattctcctccctgctacagtgtcgtcttcaagcttggacagaagcccgagctgccgtcctgtgctctagccgacgccgcttcctccaccaaatccgccgcatcccgtgctccgtttgcaaaattagttgaggggaannnnnnnnnnnnnnnnnnnnnnnnnnnnnnnnnnnnnnnnnnnnnnnnnnnnnnnnnnnnnnnnnnn

SEQ ID NO: 2179 - DNA, 1938 bp, Oryza sativa
  unsure (1)..(1938): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccaccatctcgctgctagcaattgtggcagttacctccatcaatgatcatgcagcaagaacgctctttgatgacgtacattgtttggacaatgtgtgtcagtgattttgctccgccttctccatttgtgcactgaggacacgctgcacaatgaggttctcatagtgctctgcatcattagccctaatatgctcttctggcggctcctcattatttgcatggtcagctgcaagcaaagcaagtgtatcctcatcgaaatcactagtagacaaatattcaccatcatttttgactaccaaaacatgcttgctagggtagtcacgctgcatgtgcccaaagcccttgcaatggtgacactgaacatctcttgttttacccgtggatgcaattgaagaagcactcgcggctagctaaacagcctttgtcgttgaacttgcaggagggccacgtggcttgttactggatggaggaggtgctgctcgactgggtgtgggtgtggaagatgaggaaggagtacggccggccggagaagtggtgcctgcctatcataatgtagatttacctgcacttccctttcagctttacaagcaagatgaaacaatcgagtcatattagtgtaatctttgtagtctacgatgtcataaatctcaccatttaaaccacccaaaaatctagccatagcagcgtcctcagtttcctctaaattacaacgaagcatgcccatttgtaattcctgataatattcccctatacttttcacaccctgtctcaattgttgcaacctattcaacaaatcacacgcaaagtaaggagcagatcatgcccgcatgacccgtttaaaagcatcccaagtttgtggcatgttattaggatttttcttgccatgttctattcaccaaaccgaagaaaaatcagtgaactaactagtaactttagaattctcaggaaaatcatgccatgcaaatttttggtcaacaacaatctcccaagaaaggtacgcatcgggatcatattttccatcaataggaggtatcttaaatttaattttagaaaaaaaaacatcatcattattgcgtaccttgcgttggcggtgaccacccatacctctatgattattgcgtagttgtcaacgatcaagagcatctcgatcatcttgtttagtgtcagcgtatattcatcctcaatgccgtcttcattacgtcgaccattacctctagcattgagatcatcaaaatgcctcacaagagcagcaaggctagtgttaatgcaagcgatcgatgtctccaaccctgtaagcttgatgttggtggcgatctgtgtggactccaattgtccattcttctcatttgtcacctgcaaatcagcatcaagtccttctttgtgctacttaacttgccttgtaaaatattttatgatgcctttggtgcgtggggaatgaaacgcaccctcctcatcattatcctctgaacatgccatggctaataaaacaaaggcaacaaaaacaacaaatgaggaaatataagccctacaactattgggatgtagcttttgcaagatgctcactctcagcctatcttacaagcccttaccaattcttaccttactcataggaggggacgtcaacccacaagtctgcaacccgtgaacgaggtgtatcggtgccgtagcaacaagacctatcaagttgtagtcaggttt

SEQ ID NO: 2180 - DNA, 4035 bp, Oryza sativa
  unsure (1)..(4035): unsure at all n locations
nnnnnnnnnnnnnnnnnnnnnnnnnnnnnnnnnnnnnnnnnnnnnnnnnnnnnnntccattcttctcatttgtcacctgcaaatcagcatcaagtccttctttgtgctacttaacttgccttgtaaaatattttatgatgcctttggtgcgtggggaatgaaacgcaccctcctcatcattatcctctgaacatgccatggctaataaaacaaaggcaacaaaaacaacaaatgaggaaatataagccctacaactattgggatgtagcttttgcaagatgctcactctcagcctatcttacaagcccttaccaattcttaccttactcataggaggggacgtcaacccacaagtctgcaaccgtggaacgaggtgtatcggtgccgtagcaacaagacctatcaagttgtagtcaggtttgtggttgagttgtcaatgggctgaaagtaatgctcaagagaaaactagcaaccaagttagccaaatcaagttgaataatataatcgttcaaggtttgtacagtgctggtcacaggcccggtcctgtcaattcagtggcctggagcgaagctagaaaaatgggccctttaatacaactataataatataactatgtttctaataaatttaatgcataaaaaaacattcttataaaacaagttatatatcttaccttaaaattttcttctaacatgtaccgatgcgaagtcatcgacgatggcatcaatatcaatttcatctaatagtttcttctcgatgcataaagttgccaaaccatttaatctttcttgagacattacatgatttcactgtaaatttagaaaaaagtaagtaatttatgaaaattatgtcatactagattcaattcaacattataataaaaatgagtgctggcaaattacctagttgagaactaaagaaaataactattcactgccctagttgcacagctgcaccgcgactccgcgaggatccctaaatcctaaatcaaaatttcagaaatcagaagaggagcaattggggagtaacattttgcatcccaaaatttaaacatataaacttagcatacatcaaaggggagagcaatggggtacctcctggtctcctagaactgaacagagagtcagagagataagagatttgcatctggctaccggctgtcgtggtgccgctgacggcactgagcacgacaccggccgttgacgcatagccgcgcgcagtcgtcgacgtagctgaaacatggctggaacctgggagggtggcgaacagccgaacatgcgaagagtcaggcgattgcgagcgaaggcgaagcgatcggacggaatcacggaaggaagccaaatcgacgcaatttttttcctgtacatttgcttcttcctctcctgagctagtgggcttcttagttcctatgggctattatgtacagcatatatggggttgggccccttcacttcgtgggccctgtgtggaggcccagctcgacccccccgggccgggcctgactggtcctaggctagccgaagtagagacgtgagcctaaccacaaagaacatcacaagacacaaacctaaacaggaacgatgacagtggtgacaacaggaaatggcggaaggtgctgaggagagagatggaacttttatttttatttttttgatattttttcacagttaggagcacattggaaccaaccacataaattcttagctcaaacggacaaaatatgaagcatgtaaatttttttcaaagttctatctaaaggttttgcaaagcttctcgcctcaaaaacataattttgcaagtggaatttcgcgattttaattttgtcgagtgtggaatttggcgatgtaatttttttaggtagatgtccgtggatatattatgccaaatttcgagtccatatgaaaaagatacgactattttaagggagatcactcgaatcagggttctatttcctttaaagtagatcactcgaatcagggttctgtttcctttctggtggcagcaggctcaacgacaattaaactcaataaaaggaacatatcaaacacaaacagaaaggaatttggtggatggctgtgatggtgctgatgacgacaaaagtggtgatggcggcggtgatgaagatggcgatgtgcgtggtaagaacaagaaactctaatagactaagtgctaagaccaacaagttgacacaaccgatgcaatcgaaaactcaacaagccctaactaatctaattttttttggctttttctagactataggaaaaaaaataaacaacggagggtaaataatctctcactgatcaaccacgctctgataccacctgttgtgaacccgcgagggatttgtatcccaatctttcaataagaggcggagataactcgattggatgaagacgacgtttatggcccaactataaccgtccaaggacgttgcgccttagcaaccgatataccgtcaccaatggtcgtcacgaacttgtggtgcacgacaacccgacctagagggcactcgtatgccctgcaagcaatcgaagaacaagtagaactgctagatgaatatgaaagtttcactaggaaatcacaatatggcagggttccgaatagaagcagacgggcggtttcgccaacacgcgcgctgcaagcaggtagcaagttgctaactctgatcatcaaaaaccaattgttcttggcagtggctataaaggtataagaagagggggagaacaaccacatgggtgttggggttgtgctctaatcataggacgcgtccttaatggacccaacttgatacatagcctattgggcccaaataagttgacgcaatacctttgatagaaaaaggctcggtgataaagcgatgattgcggccactccagaattgatatggacatgaggccagatccatttcaaagtagacttgataagctttccatgaagtacttgcacgcccaaatcggagttcgtaggaagtcgtggcggtcgtcacaagttggagttgtcctgtagtttgaatccagcccgcgcgaatcctctcccttttgatcctctctatcattcctaagtaaaacaagagtgcacatgtctctgggggtataaataagatgaacatgaactcaagaatgaactcacctgatagttgagttgacgtgcacaagcgcaggtaatgttgatattgacgtgcacaagcgcaggtaatgttgatatttcttaacgacattactaggaaattaatcccaagcaatgttgccagagatattagacggtattcttatgggttatagaataaatcctcacggatataccactgtagcatttcaactggaaatatttccaagtatcgtatttatttaattccaagaaaagatatggtaagagagtactatgctataaattcatattacacttatataaaatcaaagtcttttgcaggagttaatcattttaggataaggataggttgacacacagaaggatcagtttagaatactcttgataattgataagtctaggctaagtggataaaaaaaaagaaaaatatcatttatgcacttctagtatatagtcattttagtatacatttgctattgtacaactttatggctaataccccctaactatgtcctcctaatatattgagaaaccaccccatattgccgaattccttactacaatccgtcatggctatccaaccggttaaagatatggaggagtacctgcaccaagaaccttcttagccctatatacgacgtggaggaatacccgtgctgagctatcaccatcagcggcctacctctacagatctgtggcatataacaccacttaataatatctaataatctaagcaccacacttacattactaaatattactctacacctctgcagatgacatagagcaaccatatgaatgaacactaagccaataccattgcatatctttggtaagctagccacatatttaatacgagtcaagtataaannnnnnnnnnnnnnnnnnnnnnnnnnnnnnnnnnnnnnnnnnnnnnnnnnnnnnnnn

SEQ ID NO: 2181 - DNA, 3420 bp, Oryza sativa
  unsure (1)..(3420): unsure at all n locations
taaatcctctcctaagccgatgggctgatttcagcccaacatctctctccctcgcgcgcgtgctgggcagcccaagtcggcccatccgagctcctcctctttctttctttgctttgttttcagccagcccaagacgaaaagtctaattctcctccctgctacagtgtcgtcttcaagcttggacagaagcccgagctgccgtcctgtgctctagccgacgccgcttcctccaccaaatccgccgcatcccgtgctccgtttgcaaaattagttgaggggaaatattcctcttatcctcctctatcctttcccccaagaatcggactttatcacgaagaaatcaacgcggaatcgaattcgttttcgagtttatctctccaactaaccctcggattttccggcttcgattcctctcggttggagtccgatctcttcaatccaagcctataaatagcatcccctagtcgtcctctttcgtttgccccatgtcccgagctctctcgtgccccgtagtgccgccgccgcgccacccaaaccgccgccgtcgccggccggcgaacagccggctcgcgccgtcgttttagccgccgccgccgcctcctcacgtcgccgtcgggtgcgcgtggaagaggggaagctcggccgccccttcgccgtcaccaccggtcaccggagagccgccgccgccgcacaagctcgtcgccggtcgtcgttcgtcgcattggttagtaccggtgagatcgcgttgttctcctctacgcgtaggtaccctccaaaagtccggccgagtcttctagcgccggcgaggtcgtcgctgatgtcgagtcgacattgatgatgtcagcgatgacgtcattaatcccttttcttagttttctctattagatgaaaatcgattaaacttcggaaattaataactaaatcatcgtacctcggattcgagtggttcaagttgctaaatttttctaaaatcaagatctacatgttaaaaatatccacatgtactggttatgcttgtttttgtactattttgttgattttgttctttcgttttagtttccgacgttccggaggagagcgttttcgttgaggaaggttcggaagtgtttgcggaagctcaaggcaagtcacaaagatcccaaacaaccctttgagcatgttgaacccgtttaaagctattgtttgatttcaacttatgcattattttcgaatgtcatcgggtggtgagcctttcacaattaattaatggccgaagatggctttattttcctatgggttataatttgattagctagaaccttatatattggtttgggttcagctaaatgctatatatatataattgcttagccatgcttagaaacattagcacatgattgggataactaatgttacactatcacttatggttatatttaatggtagctcacgatggtcaatcgtgattggttaattaattattgccaattaaaatttgtcaatggtgggttgtgagcacatggttgtgaaggtcgtgctcatggcaattaaggaccgattcgcgagctactgttgtaaaacattaaccgtgccaaccacaagccagcataggcaacggctttaccttttgtatagcatgattcattgcggggcaccagactgagaagcggcgagaagtccgtgggggtcgctggggagtccatgcctctggttgtatttatagagggggtgattatgatccaggtatggtgcactgtggtgagttgtgttgtgcagagggtattgtcatagcctctattcgggtactttccagtatcgcgacgcatggtagacatgatgttgaggctgtgtcttgtaggtacagtggtacacctctggccagagtaaaactattcgaatagccgtgcccgcggttatgggcgagttgagcaatgtttttcgtgattagtctcacacatctcacaataattattgatgctataattggtaataatttgcttagctcctggtttggagttagatttgtacagccggggttggttgttcaggtttggttgggcctgtacagcattggggtgctgttcagtgttgattaaaattgatgattaattactctattgttttactactcttaaatctttgctaaatgctgcttttacaaatgagcctatattatgccatcctttggtatccttgtgcacttgcatatttgctgtgtggcttgttgagtatgtcatatgcttattcttgcaataatcaatcaacctcaattgaagaaaagggatccagaaggagaagacgtttggcttataccccagttgagctgcctgtgggaatggagctgaagtcatcgctagaccgttatttccgctgctgttttcttttcttttgtaagtatgtaacgttattattatgatggatttgtatattaaattgtcagtttgtgtacctcggctgattcctggacgagggttttatgcacaaataagttcggaaattactagtgaatttccggacgtggcaacgaccacgagtgggcctgccgctgctctactcgccgcttgccagagatgagcccgaggatgccgtcgatgctccacgtcgcgatggccccgacgttgctccacttggtgcttgccggagacgagactgccccgcccacactgtcggccttgatccacgtaggagaaagccaaccttgttttgcgccgtcggagttcaattcgctgatgccggagttcggtcccgccgccgaagctccaccgccaccgagcttggttgcatcattggaacttgatttgccgctggaggggaggggatggatggggaacgggagagggtagacggagatgggtggcgcccacggagatggagaggagagtaggcgatgaagctgggggcgatgttggtgaggcggcgaagatggagaggcgtcggcgtcttcgttgggacttgggaggggatgaggattaaatgcaattgggagcgagagaacggggtgagggggaggaaaaagtaagggatggctgacaagtgggtcagtgggcaggcatgattatgtgtgtagatcttttttttttgttgcagggtctgaaatataaaaaattggatggtttgttaatacaaaatataggaagggctgacatagaagaatttaagggctgagatgaaaaaaagttgttaggtggagcctccattgtggagctagtgtccatataggaacctcatcctatgtggcatagcgaggcatgattttgagtagattgtactgctattgtccttagggaatccacaatgtgagccacttctagagtgctgtagaggaactcagctcggaatggaggatacccctggatgggctcctcaaaatctgaaacaacttaatannnnnnnnnnnnnnnnnnnnnnnnnnnnnnnnnnnnnnnnnnnnnnnnnnnnnnn

SEQ ID NO: 2182 - DNA, 13141 bp, Oryza sativa
atgcagtggatattaaacatgggaaaactatcgcataaatttctaaaatatctcacatacaggaaggttatattagacaaccatataaaatttcaggacatatgaaattgataaacagtgaggaaaaaaagagtattctttatttgtgtttttttctttgctatttgtaaacttaatatctcacaaacaaagttgagttttatcttgaattttgtatgcccatctaatttcatatagctatcattgagttctttttttcaaataaaactctttttgagaacttatattctgtggtttacatgtttccgacctagttaaacatttcaccatgtatttacactggatatctcggaaatctcacatcgtactcctatatccacattgtctcatgtatagttgtcgatagatcccatccatacaatgctccacattgcatggcaacagatcagaatgtctgatgtttgcacttcagagaacacaaacaacaatttaattggcacataagagggcacaaacaacaatgaactgaaatgaacagacaaatcagtaattgcaagatgtttgcatagaaatcttgaaatgcaactgataagtgattatggttacaaattggaccatgcaagtaggctttagaatttctaagctctgctcagtgctattttccttttattagtgcattgaggcggatcaaactcatctacatttttggtaaggttttggaatttagactttggaattcaaactcatcagcacacattgatttcctctggagtatagacgcttcaatgccggatatcgtcttccattaggagtacatgttcaaaagattcaatctcgtggaattcacatgtctgtacaggttctgaacaaaagagttttaaatggaaggaaatgtaatgaatataactgcacacagcattttgatgaatataaatcagtatccgtgactcttgattagttatggataaaattgaaataggtcatcttatggatttcttttaaagtaaaatcatcagatgattagcattttaatgatgatgacatggcttaatatgatggctcatgttatactcaaaaatataggggagagattttctgggatggaatacattagtatcttgttataccatgtatgttaatttgattaaaaaatatcatcttcatcaatataatttattttcctttgtggctatgagaaacttttttaacatttctgttaatttcgttctctgccaattgagggaaagggaggtaaaaatgttcacagtagcatggtgaatgcaactgtagcaagctatcaaaggaatagatcatgtaaaacatgcacaatttagctataatctgtacatattggcttaaatttacattcataatgttcgttgctcagtatgtggattcatattgtagatatttttattatatacataaatttcatggttctgcaggctgttcagcacaagcaattcggaagttctgtctgaaactacactgaagattttggagggtccttaagcaggttttttcaaacatactgatggatggggaatcccagacgagtaaattatcatgtgagcacatgtactcttggtacttcaccagggaagaactggagaaattttccccatctaggaaagatggtattactgagataatggagtcagaaattcggcagttgtactgttcattcattcgggatgttggcattagactgaaactgtatgtgccaatttccttgttgagtgtaccttttaatgtcagtatagctcacttttcaaacttatatgttggttttacggctagtttgtgcccttagttagcacacaataatttcttttattctggaagtttgctaagcttgttacctattttaacatttttctttcagaccacagatgactatagcaacagcaataatgttctgccatcgcttctatctgtaccagtcccttgccaaaaacggatggcaggtaaggagcttttttttttaatttatctcttttgttgtggtgggttggtgtcttttagaaaaagcatttttctgaaagaatgttttagaaaagcaattggatacaatcttctctttaaaaaatatttactggcaaaggttctcaaggaacatatataacccttgcatattttttatacttgatcagttcatatactctttgcaacttgtgcttaactttccgatctattatcggttgtacaataaatatgaagctgcataataacactaacatttaatcttgtattgcttattaagtgcatggcgatgttacagtgccattaggtgatttagaaattcaattccaaagggatctacttgtgccaatcagtaatcctatattgtaattccttacttttttactgtgctgtaaagttttgatatagtctgatttatggttgatttgcttgggatgtttggaagatacaatagtattgagatgtattgtacaatacaatagaacatcctttttgaggacaagtctgttcagcattcctgttgaagttacactattgccattagccaacaggaatacagcttacaatcctgttattagaagctaaaatactataactgaccatctaataagtataaatcctccagtaagttttatagatttgattcgcctcaccacattcactgtattcctgtcatgcggttatttaattgagaaacacattcttgtctctgcaattaatctggagttgtgctcgttatctgcacttgcagatgttacttgctgacatgtttcttcattgctcaagaaaagaaaaaaaaagctgtgcatgtgatgcaagctgtctataactaaatactattacaagtaattggtgtttattttatttgcttattgtcattccagagccaatagctttacttgttttttattgcagacgattgcaacagtgtgcatatttctggcttcaaaagttgaagatacaccttgtcctctggaccaagtaattagagtggcctatggaacaatgtacaggagggacccagctacagctcgaagaatccaccagaaggtatagttggatcattaattgagttttcagtatatatgtaccatccagttaatggttgacaagtagtatctatcaacaggatgtatttgagaagcagaaagcactaattttgaccggggagagattagtccttacaactgttcggtttgatttcaacatccaacatccttacagaccactacttgatgctatggaaaaacttgggatctctcagaaggaagtgaaacaagtagcttggaactttgtaaatgattggtatgagatgtgacatatcactttgtgacattattgttttgatgcttcattcattcaactgatcaatctggatgtattcattctgttgctcgtaggcttaaaacaacactgtgcctacagtataagccccaatacatagctgctggttcgctctacctggctgctaagtttcagaacgtcaagcttcctgtgcatggagggcatgtttggtggcaccaatttgatgttgccccaaaacctttggaaggtatgtagactactaagctgaaacataatagtaccttgtgtattcttggtatttacagtaagagactaagagttacactgctatagctgtccttcagcaaatgagggagatggttcacatgaaagcaaagctgtttgctcatcccagtccggctaagcaaaaggaagttctttttgaaggaatgctgctcatatcaaatagcccagattctgtgttgactcaatctagcttgtcagtaagcagctcgagtcctgaaattggagaccccaatgaccacctgcaggtggattcaagtcaagacatagtgcatattgaggatcgtagcaagtcatatcctgaaaggaatttatcgaatcttactgctgatatgaataatcccggtaaaacacacaataaagaaagcttggatcaggccttaaaaatcaaacatggtggactgatctcatgtaatcagcagataccattagatgcaattgcaaagattgatagcagcactgctaaatgcgtggaacagaatattggcatttgttgcagctcaagtaacacattcaatggcaaaatcttgaacccgttctcaataagtcagcgaagtggtgataaaacaaagttatgctcagagggtggatcatcgcttacagatgtggacagcaaaagcactcaatctgtcgaaccgcccactacaatttgtaaccataccagtgacagtctcaatgtggacagtttgtgctctgatcagagactggctaattccactgcaggtaccacggagaaggcatcatttgtattgcctgtccagataaaggttgatcatttgtgtgtggagcgtaaaaaggtagatgtggcacggataaaggatttgttgatgaagaggaagagacgaagagaaagacaagggcggtgcattccttcagttgacctaagtgaagaagcctggattgagagagaacttgagtctggtatagtttttaaaaaagttgaccatgttgttgcatcgtatgatttaagtgatgaaggctggattgagagagaactggaatctggaattgttattggacaaaaaaatgaccagcctgtatctttagatggtttgactgaagatgattggattgagagagagcttgagtctgggattatagttgaaccaggaccagctggtaagaagctaaagtcaaagcttctttcagagggtcatgagataatgaatagcaggtgggaaataaatggcaaatcaatgcaaaatcaagtcacatagaatatgagatatccatacagataggagcaccattgtttactcgtgttctttatttgattgaattaactatacacctcgtgtacttgaaatgctaggggtgtgcatgggaaagatttttgttctttgtataactagtaacagtgggaattcacaatttcaatctttaggttgtaggtgcaactgtacaataattaagtgtaaatgtacaatccgtccttgttagcagctaatccttcattgtaaactgtacctgtcatcaaaacgaaaataatgttctggtgtaccgggaagctttttttttttttttttaaatctgcaacgacgatttcttattactgaaattcagtgagatcacgaatcaccaggaaccttacaaattctgggatggggtcaacccaaacaaacgattgacccgggttccaactcacccaaatgagcaagttcgtgagcaactttattacaagaacgaggcgcaaaagagacctcaaagctagcaaactgaaactggagaagcgtttttatttccgtgaagattgtagcaccagtggctaggtcatgcgatgaggacttaatcgccaaagccagtatggccgagtcagtctcaatttccacagcagatacaccttggaccgagatggttaacagagctaccaagcatgcccttgcttcagcagaaatagcatcattgacgaattcgatgcgcccagcacccgcaaacaaaagcatgaccctcatcgttgcgcaaaacaaaaccccatccatctgttttgcgatccgcttgaaatgcaccatcaatattaagtttgtaaactcaagctaaacgtatgctataactttgttggagtagaagttggccacattaatgaatcaatcagaaagctacagttttgttgtttccattattaaactgtggggttcgtaagcctgatggctgtgctatgttcagctcatggaatagcattccttgtgcccgttgaacaactagatgttgtggagcgcctagggttgctaataccttttgtttgattatctttttatatcttttgtccgatcatatgtttataccttttatcctactatgtagtaatcataaatacatgtttatgtgctatatgtagaatgcaggacattgaacacacttcatatatatttcatatatagatatatcttggtttccgtaaggaactagaaactaaccacggctttgccgcgcattagtatatataggctagctcaattggatggacccaatgcactgttaattatgaagtcaggtaaataagaattgatcataactaaatatgtatatccaaaacaaaaaaaagggctacataatcacaaaattttacattcaacttacccgataatctagttttacataccatcaaactaagttgcttttgttactgacaatgagagatcaactttgtttctccttataaaaagaatatgaggttcatatcaaataggtaaaatttgcaacaggacatctgaaaaacgtgtaattagctaggggacatcgtaagaacgtgtatttgctgtagggcatcgtaaaaaactggtaattagccgctggacactggtgggattattttattatttttggaggaataggagagagaaacaatcattaaagactagtttacccttggctcaagttaatccaacgtgggccgctaaacattttctttagttagtcttcactaatcacgggcttaaacacatcttacattctcatcaccaagcaaagagcaagagaggagaagaaacgatggtggatgtgaagcacacggtctcatttttacaggatcaaactctcactctcacaatctctgaaccttttgtcgaatatatgaatagttaactgaagaacagagtagaacgagcagagttttggcacagcgaagtaccctgctgcttttctggtttcctaattattctcctcaattacagagtttgttacatgcataacagaaaaaacacccgattgatctggatccactactgaccgtgccatcccacgatccaattcagtccaaccgaaaaactagctagaaaacagctacatgctaactggaagtaaaacggctgctgacagattctaacacagccaaccatatgcaatgcaactacagaaactagatgcacaagattgcattatttagctaacatcgcaggccgccgctgactgctcgttcggcaccgcgttcgcgccaatggtcgccgtcggctactgatgagtggctgagcgcgttcatgtctacatcaccgtgctgggcatgaaggacatgaagccatggagcagtagcaccggcgacagtgggcgagcgaaggaggagcggcaacggcaggcgagcctgggaggagcagcgacagcaagcgagcgcggtgggcggagcagcgacagtgggcgagcataggaggagcggcggcggccgcgggcgaggttgaaggcgacggttgagagcagagagagagagagagagagagagagaacgagagagggagaaaaggataaggaagaaaaaagaaaaagaaaaaaaaatcaaagggtagatctgtacttacacagctgtttctctctccaattcttccggatataataaaataatcccgagggtgtccagtagctaattaccagttttttacggtgccctatagcaaaaacgcgttcttgcggtgtctcttagctaattacacgtttttttggatgtcctatagcaaattttgcctgtcaaatatgttttccttacaaagatattgtatgatcaatactttcagattagcatcaatgatgaaataaggagatttaactatttgtaatgaatagaaagtaagacaatattttcagtgaggataataatataacttatcaccgaatccaccgtcttgtgatatctcatttaccacagccttgtttggcatgagcattgctctctcactgaattgtacagtggttaaagtcccagttctgcacctgcatttctcagtcccagcactctatgtcaacttaagaaaatgtaaataaggtcatgaacagaaaaaacatgtgttctgaagaaacggaacataacaatgtagctccttgaatttgagctatggtagactttaattcagattttaatatctaaaggataaggcagtgactcggttatcagaatataacatgaaacaaataattttgagagagcataatacaagtatatgtgatctaaaagaaatgcagcttgttatcaagacaaagttctttgtgactatagggtagcccaagcagaagttctggttgtgatcttcgttcatgcagaggtgaaaatggaaagcaaagaaactctagttttaaaagcaaaatagaaagggcaatttctttctgctgttcttataggtcaaaattgtcccactgatgtgagcatagtagaaacgatttcttggggttagttttgctagattactccgtgccataaaaaagataaagaagattttataaacaactagacaaatgtccataaaattagcatcaggtaagcaaaaggttttggatcttaacgaacaatcatgtaaataacttatataactgctaactttttttaactaatgctaactaaatttaagctcaaaatgccttactatgttttctttttctctctttctttttttttttccttttgcagattagtgcagcagctacctgaccataggtgaacgcatcgctgctaacaaagtatacagataatgaaatgatttggaggtcatttaatcgatatctgattgacgtcctcaaccattgacacatactcatcagattataatatacatgaaggttacgggtcattaatctgctgattgtatgcatggaaagcatgaagcatcatgtcagatatggaaaccttgctaataaattaattgaattcagaaaaaaaaatctagatgcatttttccagttcaattaagaaagtgtagatgagtcagtattcacctaaagaaacgagtaccggaattgataacttgtgtgtatctccggtgagctttattgcctctttgccagagaataaacaaaattgaggatgacggtggatgaaaggctgccgccgtctagctcgttcctccacagcgaggtcagggagaaggaggcctaaagatgagcaggaataaagggagaaaacctgcagcagctgtggattaaccagagaccgtcgggggtggtcgactggagcatctcgctgaggaggatgtcgtcgtcgtcgtgtcgtcgacagtgtcgccgctcagcccgtgcatgtcgtccgaggggagcccagaatagggatgggcaggaggcagcgtcggcgctcgttctgcccggatctggcgcccttgagctcgtccgatgagggactggtggcgtggcttggatggtgcagcggtgacgtctgaaggggatggataggaggcggtgatggggaggagaaggttgccgtggtgccttgcatgggaaggagatcaggagaaggatgcagcggcggccggcagcaataggaggcggagcgatgaggaggggaggcggcggcgtttcgggatggcggataggcgggcgagaattttcagaatatgccatcgaatacgcaatgcttttaggatttaccatttaatttgtgctactttcagaatacgctatcggagtgcgaattttcttcgttcggtgccattccgtacccccaacgtcaatcacaccgtcatcgtccatctcccggcgccgccgacgtcagttcgccacctcccgcgctcgcgggcgtcacgccgtcgtccgtccgccgccgcccgctctcatgtgcgccacgcagtcgtccgtccgcccggcgccgccgtcgtcagtccgccaccgcctgtacccgcgtcagccgcgccgttgtccgttcgccgccgccatcgtcgtcgtcctccgcagcttcagggcaagcaagcgcggccaccgcgcgtgtttggggcggagctccgcatgtggggcgcggcgatgctccagggctgagcccggagctgcgtcaagatggcgacgatatgacgcgggctcctcgttgcctggattggtgtcgtcgatgccctggacgtcgacacgacgatgcgaccaccaaggccgtagaggccatcgccgtcgaggcctcatgccgcgaccgtgagaacacctcggttttaatcaccggggaaaaaaaggagtggctgtgtggggaacaagtagaagaaaaggaagctgaaaagaccaagcaagcaagcaacaaggagtctcctgcttgcttatgcgtgatattttgcattttaaggttgatgcttcgttctgggaaaaaaatatagcgatttgtgaatgttttcagtctaagattctggatggtgccattttgttttgagctcacacgtttcacccacccatcattctcaagttcgtcttgctgctatgtttgcatggtttctcctctcgaaataccaaaaaaagagagaaaagattgttgtctttgattcataagaacgaatgtttcctgaatattgagtaaggaaagagaatctgcttaaacggctttgtggcggagctggcgagcaggcagaggccgccacatacgacaacgtcgacgagctgttggtgaggacgacgacggggcggctgatggtgggcgacgacgacggccaagctgatggtagatgacgatgagggcggcgccgggcggacggatgactgcgtggcgcacgcgagggcgggcggcggaggacggacgacggcgtgccgcacgcgagcgcgcgaggtgacgaactgacgtcggcagcgccgggagctggatgacgccggtgtgaataacgttgggggacggaatggcacggaatgcagaaaattcgtactccgatgtgacgtattctgaaagtagcacgaatttggtggtaaatcttgaaagcggtgcatatttggtggtatattctgaaaattttcccggcgtgtgagctggtgacaccgccggactgacctcttggtgctaggtggcaaacgacaagataggggaagcctcgaggttggacctgacgcaaccaccaacgtcggaggagagtggagaagagccgagaggagtaggaaggcgacgacggtgacgatggagcgaggcaccggcaatgccacaaaagaaagagtaggggccggtgttggcagcagcaggggcctgggaggtaaggagcggagcgaaggagggaggagtgcgaggcgaggagctcaccggagcccaataacctcaccgccttgggaaaggaaggggatgaaagagacgtggggagaaatgaaaaagaagggcaagatggccattttgttcttagatcgggtgacatggcctcttgcgggctcaaaaatgacacacgagcaagaaatcctctctatccgatggcagaacagcgaagttatccgagagagtggcatttgagaacacgccatccgggagagtggcaaatagtccaaaaccccctccctccttgccatagaggccgtcagtgacggcgacagttgctgagccggctagggcgtgcacgaggcgcgttaccctctgcctccttcctagctggagccgttggtgagggcgagctggaagtggcggaagctagaactggccggatctggacctacaactcgacaccggcgatggagatgaatgcacgttaaggctgccgctaaaccaagccacaaatgaggagattacagtgaaggcaatctggcaatgcgagtggagcaccttgcaagcaaatgaagaaaatacctagaagtgaaatgtcttttgtagttgctatgtcagtcatttggcaaaatgctgggatactggtttattctatagtttgacagaattagttcctttagctagcttgcaatttttagttgcagacttggcataagtgatgggatggcatcactgacactgagtaagctgtttttatcttctttttccctttacctttcatgctggatataacgagcctcgatatacttgtactaatgaaactaggaggggttagacctcaatactattatactattaatatgtgatcctacttgtcgtacacacaatatatcttaaagtctgtgttatagctggctataaatttgtagaacgttgctcttctctctcctcttttatccttttgaaatatgtttataaccgacttatagtctactattgtatctcctctaagatatacaccgtcaacagcaagttctaatcagtgaatccaccggcagctatacaaacatcagaacacaagaaggaaaaaagcagcagcaacctaatgaagtggtaaatgctgcattcaaacggcagaagaaaaaggaaaaggagcacgtgtcacgccttgaaacccccaacacagccttgcaaaccgactggatatgaggaatctttatctcttataccgatttctgggtccgatcccttagcgttgattgggccacgtggctaaacctggaagcaattttacatatgataaaatcgcgccacgtgtcctatcccgtaacacggccccacacagggaggaaggttggaggagagagaccccgagctagaggaagaagaagggcaagatggtcattttgccctcggatcaggtgacgtggtgctttgcgggctcaaaaatggcacacgagcaagaaatcttctctctccaatgaaaaaaatagcgaagtcatccgggagagtggcatttaagaacacgccatccgggagagtggcaagcagtccaaaaccttgatttttatggatctcgattctcgagcgacgagaggttgctggcaacaatggggagcaaggtgaagcgccagcgacaccgcgtggccggccaatggtgagcaccaacgataagcttgcagtttctgataatttttagtgtagcagagctattaggccattcacaatgggtctacatggcattcagtctcaacccctaaaagcgaatattccttgccacatcatccaaccgcgtggctttctcaagtccgagtagccaactttggctatgagttcctgctctcaggcgggccccacactcattgctacaggaaagaggggcgaggggcgaggcagccaacggggagaggagcggcggcgccccggggcaggtcgccggcgagctcgatctgcaaccggcaccgtcgctactagggccacccgatgttgtcgtcgctgctcgggccgtccctccacccggcgcctccgtcgggacggggtcgacgttgttgccgctgctcggtacggggggcgccagatctgagtgctggtaggagaggaggcggcggggtcgtcgccgctgcatgccgccggtgggaggagaggagggggcgggggctggggggtcgtcgccgtgtgccg

SEQ ID NO: 2183 - DNA, 4175 bp, Oryza sativa
  unsure (1)..(4175): unsure at all n locations
tttagaccgttccgtaatatacaaggaaacgtaatacccaagtcaggaggtggaggagaggagggggcggggggttggggggtcgtcgccccaacacaggcgcagccctggttgccgcgctttgccaacgttaaagaaggcggagaagagcaggggtgggggtggggggtcgtcaccgtgtaccgccctcgttgccgcactctgccgacgggaaagaagncgaagaaaagaagggggcgggggtggggggtcgtcaccgtgcaccgccctcgtcgccccggtgcgggcgccgccctcgccgccacgttctgccgatgggaaggagaagagaagagggagaacaggggaaaggagaagaggagagagagggagataaaaaaataaaaaagatgctacatgcattgtggagtatgtagcctataaagttctttgtctagttggcatgggaggaacaccaaaattgcagggcgctctgtgaatggccttagttgattagccagcagcttttacagaacatcactagatcagtcagccacatgattggcacatatgcttgtagtttctgaaatttttactgcatgtcctgaatctgaagttttggatagatgaaaactcaaataactcgattggatagcaacatttccaaaattttgttgttcaaaggagcacatcgattgattttttttctgaacttctgacgatatgtttcttgttgaaaaaggagatggattggattgtgtttctgaactgctcactacgtacatatatatggtctcgttgaacatgctatttttagcagtattatgactacaaaatagtagtagtttttttttgtggatatgaaatatggataaggatcatgcataggtaggcctgctgctagagttttgtttttgtgatgctttaagcatctccatttcctgctcttatctaaattttcatgtgtgcattattgaatttgcatgtgcaatacgtgcagagcactgcttccatctgaattttcatttgttcggtcattatttcgtcaatgcaatgttttggaaaaatggcaatagcatcttcagggtggacagcaacattgattttcattcatttcaaccccatgcatgaatcttttttttctcatttagatgtattgcacaatgttatcgattgcaggtcaggactaaggcaagccaaagaaccacaatgaaggaaatggaatctgaccgccatacttgtttgaataaaaaaaaaggtggtctcaagttatgcatgggtaatttaggttatgtttcttgcactacaattacgtatatgctactctgacttactaacaaatcatgtatacgataactcagagttttgctatgtgagccaaaggactgaagagatgaagttctcaaatttgacttctatggacaacctgcttaaatgaaaaatggcagtattgttatagcagccaccgttagaagcacaaacacatcacgggttggtgcttggcgtggctggtgatgacggaattgtggcgagatcaatatatgtttgtgatcaataattcttataagaggtaattctcacaagtactcacaagtaaatctaaattactcagaaagatatttctattgaaaatagagtaattaacagaataaaataaacatgagaggattaccgacatctccgaaattcctccgatttcttctactctactctcttcctaattctagtatacaaaatagtacaacagagcctcttataattcagctcaagcttggaagtgtgtgaagaagcgaatgagtgaaactccttaaataggcagttaatgacggttgtggaacgagaattgtccgaagtgccctccaaccgccattaggatcaaatcaggagcgtccctgccaaaccccaggatcaacggtggagatcagggttctgggctggcccatctggccctcaattttggcctgtggactcctcctgttctgctttatccattactgtgagttttgggctgattctctggtattttagtaaagtgtaaagcccctcccttgtatggatatgttccttcttcactttagactgatttttctcccaacttcggtggtttaggacctgcatcaattaaacaccaacactcgtggaatatgttagaattaacacctaccactatattggatgttttattatatgagttttatgcaaatgctggcggtataaaaatgtgtatttaacagccgccaacaatagggatttctcgagtcctagttgatttctaagcctaattggacgtgggaaagaccatgggaagtaagtccacccctaatataaatataagggggacaagttcgattgaaacaataaccactcaatcgtcaaactcaatttagttatccaaaccctctatattctacatctccctccttgcttccaatcccaagtaaattctccccaaatcccctaattgctcgccgcctctcgtctctacggtgttaaaggacatcctagctggcctgccgagtctagcacaaactagagcgcattcaccctaacagggtccctcctgggtgtgtgttcggcagcctctacccacaccctacagcggcacgtctccgggtgattccgtgggttgcacataacatgctcaagttgtggcggcgcgattctacatcaacaacatgcacatgcgtgatctacctgtacaggtacacatcaaccagtgactgttctagccagaatccacaaagcatagatgttaacaacaaaatttggtaagatacgtggacataaggatggatccgaagcggatttgaaggagttagtttggtttccaaaatgaaacaatgcatctgctggagtctgtatcagtcgatatagagttggatttgattagtcgatacatacgatttcgagttcatgatgagttcggattgaggattcagaattattgccatacaaggatagagtccaaagaagcaattgcatctattaattaggataagagtaagctttcctttttgtgttttagaaatctatattagcatccacaatgggctggtgtgtttattttgtgaagtttgaatcatgtccgatatgaacaagttttgtactacgagtataaatatatgcccagggtcttgtatgaagaacaacaacagttcaatatactctcagtgcatcgccaaactttttgttttcaattttctcaatgagttcttgtttcgagttggggcatcttcttcgatcttccgatgagaggtatgacttgtcacagtagtttgcatcggtggattagtataacgttttaaatgttctaatctatctattgtagctgctggttatcagttatcttagtgttaacaatggaattttgcatcagattcaaaaaggaagaaggaaattaagggggatttggtgtggtattaagtttatttctaagagggattaagcatcagctaagaattgcctaaaggtttggtttggccggtatgatataatttgggctcggcatgggcttagatcaggataccgggcattgccaatcagagatagagctcatgtaaggcaattgtatctattaattaggatagttatgtcagtttgttagaaaattggtaagagaccaccgtatatggtcttgtttgtattttatctttagaaaggttcgagtcgtgtccataatggactaagtttgtattcggggtataaatatgaaccccatagcattgtaatacgggagataatccaatacaactttggcgcatcaccacccttttctcttttacttttcgacgagtttgcttcacaagaagcaacccgtctcgatggcttgtgctatcgtgggctaatatgtcatttttagatattttagtcctttttatcgtgaccatcgttatcatatgtctctattaatttagtcttagcatatcaatttagctctatcggttgcttctcgctttaggggtcctgccggtatcggctaaatcgtgttgctagattagattagcttagacatctaccaccctgaaaatttagtcaatggcttgattgtttagatatcatgtttcttttcatacttagtgccgcatcagtatattcgacctactaagtcgtgtttagaaccatgatctctagcctgtttcttgattgttaataagggtagtatcggggtttcagtcgatcttacctaatatgcatac

SEQ ID NO: 2184 - DNA, 538 bp, Oryza sativa
  unsure (1)..(538): unsure at all n locations
ccattcataaatatatgatgattgtaacgttggtctcaggtttagctctgatctttacatctccatctgacctatatataaataacatctttccaacaatttttttcttgcatacagtttttccaacaaatgttcaaaataaacatgaaatatacattcagttatttcgtactatgttgttttatcatgttatttacctgtcatctctatccacatggtgcagcatatcgaactggtttctccttccccagatgcagaagtagcaacattcgatattgttggaccagtttgtgaatctgcagatttccttggcaaagacagggaacttccaacacctgataaggtttgaccatatcttgtgttttctttttgatatccttgttggtaccctacaaacatattgcgcttgtagggagctggtttggtggttcatgacgcaggagcctactgcatgagcatggcttcaacctacaacttgaagttnnnnnnnnnnnnnnnnnnnnnnnnnnnnnnnnnnnnnnnnnnnnnnnnnnnnnnn

SEQ ID NO: 2185 - DNA, 15634 bp, Oryza sativa
  unsure (1)..(15634): unsure at all n locations
ttagtttgttttctattttttaagattaattttcattatattttaaactatgagttaaaaactctttcaacagttatacaataatgacatatcattattcatacaataatataaaataatccaacaaacaattcttatttattatttttgaagttttaaactaatattaatgttgtacttcttttaatttttaatttagtttgttttctattttttaagattaattttcattatattttaaactatgagaataaaactttcttaagtaaacaaacaaaattcctatatattcttcttccccacacaaattttctctctcatcaacttacaacaaagttttggagacaaaaaaaatatgtgaaacattgctcccaaagtaatataacaacaaaaaaaacattggaggatgaagttactaaccttctatacacctccaatttatatataatcaccaaaaaaatttcacaagaaattttggcatgacctcccctcttttttgaagaaattttgaagcttgctcgggctgaaggaggaagaagacatatataaaggggatctttagttccagttggtgttaccaaccgtctgaccgatcaaagatggtttctccactggtgttactcctggaacttattaatccacaagctaacatttaatgaattaactctcttagctacagaaaaagttcatttgacgttctaattatatttttcttatcttctttattttatgtttctcttcatatatacaagtcgtattttgctttgataaatgccaagagacaaaagctaataataaatccatcgagtcaataaactcatatccttgtacgtagtagctttataggtttctctacatcttgtatatatacacgccactagctcaaaatagtttaaattgttcctattaaatctacatgttaagacccaagtggactatatgtttttctctaaaatatcgtacaggtcctacgtatcatgaagaaacaatgtccaagatatgtatatttcttccgtctttactcattgacatgaatgcatacaacaaattgcatgcttatgaaccaattaaagtgatgactcgaatgttacaagtaaaatacattttgttagtaaaagtttctttgaggtttcttaagaaaaaggagacaatgagacaatggacgacattcaattaaaaaaagagaacatcttgcttttaatttaaacttaatttgttagacctgtttttctgcacaaattatacatgtgcccgcgcgaatgcacgggctaccttcctagttgtactctaaatattacaaatacgcgaccggtaatatatagattgaatatgggtacagtgatacaagcctgcgcagtgctcaattaaaccttgattcacgcctgtctcttggattagaggctacgggtgcctattgcggttctttctaactatacaagtgattagtagtttttcttataaattaaatatggactcttcttacaagatattttttaaaataataaattataatcgagaaatgatgacttgatatgatttatgaaatcgcatgccatacatccttgctaataatactgcttgctgagtacttgtactcacccttgctattaactatcctccaaacacttttgggcaagccacttttgggcaagccagtgagttaaatggtgggttggagggtcagtactatgccccttggtgtgatgaaaatcaaggggatgttgtttatgactatcacgtgtattatggaggatgggatgagttgatgtacgcaggggagtggtctagtagctatgtcagtgaacctgggatatcgaagcaggaactcccccgtctaaaaaaaagacaaaccataaattttcgtgtccaatatttgactcttcgtcttatattaaacttttttataattagtattttcattgatgttagatgataaacatgattaatactttatgcgtgacttgtctttttaattttttttatatttttttcaaataagacggacggtcaaacgttggacacagaaacccagggtttgtcttgttttgggaccgaaggagtaatgactaaagtactgctagctcctgcttagaacttgtattattaatgggtgaacttgtaaggccatgtttcagactttaaccctgcatggcatggtattgtaatgttatctgaaccttcgctatctctgatgtggatcattattcgcaaaagcgctactgtggcgaaacataattgatggactagtgacgtcattttggtaatgacggcgcgggtcgtcacaatattcttactctataggaccgaaatcttttgaaaaatattatttctgtaaaaatgtatttaaagccactcataagtcatcacggaagagagagcgggtggataaataaggaacgagagggagagagaggggagtatgataagtgggctctattttatttattttattttattagaaaaaatgctcgtgcattgcaacgggaaaggctattttaatcttatttttgttatatggtttagttaagatgaaattcactgtgttaaattcgtttggatatatatattgttagaaaatcatgatctgcaactaggagtctgatcttctcaaattagcatgcgaatttttttaaagagatttcttatacgatttcttctgtatttccaaaagcgaatgaacttaaaaaccaactcaaatatggatttgtatttccaaaaacgaacgaatttaaaaaccgacccatacacaaatggcgtaccaaagtaccgataaaaacatcttcaatttataatagtagagaagagatataagtagtagatagatagagaataacaaattaaaaccgactcaaacacggatgacgaaccgtaggagcatcttcaatttttataatagtagagatttgataaatgggatgccacgtgtacaccacgtcaacagatactatagtcaatattgctctggaattcaaattataccgtttttaatagtttaagatcatgatatcgggtattacgtactctctctgtcccaaaatataacaacttttagccatcaggatttatcccaaaatataacaatttctccagcaacattctctgtgcaaccaatcatanacccaataagagcaaaatggaaaacttgtcgtgaaaaattttctccaaaaatttgaaatttttgagtatgttacaagcatttagctgttctcttcccaaccaaatacaaccctccaccattcacttttcccatatacctccactactcatcgaatcacaaccctccaccattcacttatacctattttcttaataaccgtatcccacttaaaaactttttatattctgcgacggagggagtattatagttgacaaaggtatattcagggagtcaaagtggacttatcactgcggctttgataaatccgaagtggactggaaaccgacaccgtgtgatccgtgggcgggcctggacttgttctccttgtcggattccagcccatataccacatcacaggcgcaggggcacagagcagggcgacccgtcgtataaaaccctaacgccgcctccaccagctctctcaccccagaattcccaaatccgcaacgcacgcacgacagccagagagagagagagagtcagaccgccgacacccgacgacatggccgtcgcctccgcgtgggccaaacccggctcgtgggccctcgccgccgaggagcaggacgacctgcccccgccgccgccgcccgttcccgccgccgacttcccctccctcgccaccgccgccaccaccaaggtccccaagaagaagaagccgcagcccgtcccgctcggcgagttcaacagcaccaagttcgtcgcccccgcctaccgcgggcccacccaagacgacctcctcagcctccccacaggcccccgcgagcgcaccgccgaggagctcgccaacgccacgcgcggcttcggggctcgctggggcggcgccggcgccggtggcccccgcggcgacgacgagccccgccgcggcggatctggcccccaggacttcggcccgtcgcgcgccgacgaggccgatgactggggcgccggcaagaagccgctcgagaggagggagcgcatgggagggtttggcgtggactcttcgatgtcgcgtgccgacgacgtcgatgactgggtctccaccaagagggcggcagcccccgcgcccatggagcggagggagcgtagcgtggcgttcggggccgactcgcattcccgcgctgatgattccgcgagctggatctccaacaagggctattttgcggggccgccaccgccctccgacagccggaggggcggtccagtctggggtttcaacagggatggaggcccagacgccgactcttgggagaggaggagggaggaggtgagcggtggtggttcaagcggtggtgcccggccacgcctgaaccttcaaaagcggaccttgccactggctaatggcactgatggagaagggaaggaggacaaggaggaggagaagggagagatgcagcctaaaagcaggtcatcaaacccgtttggtgcagcccgccctcgcgaagtggttcttgctaccaagggagatgacgggaggaaggaggaggagaagaagaaagaggaggagaagctggagattcaaccaaggaccaggacttcaaacccgtttggggctgcccgcccacgtgaggaagtgcttgctgcgaagggtgaggactgcaggaagattgatgagaagcttgaggccatgaagatgcgcgaggcaccaccacctgagagcaggtcctttggaggagaggttcccctgttagaggagagtacaatgggagccgtccactgccagagagtcatgtcgagggagcttggaagaagcctgatgcagttcaggctgttggagaatccgaagatgggtctgataagcttaacacggctgaggctgcgagaaaatttgaagaagggtttgataactgaacttttatccttcttttattcaattggctaattcatcatcgattgctccctgttattgaattaatagttaattgatctctgttaggtactagtagtttttattgatctcagttattttttgtctgaggtatgctttctattgctagggtggaaaacaaatattgagcctgttactgtgtgctatctgcttttcagtatgtgtccctctagattcattgtcaagtgcatgtcctagcagattaccaattagtatgcagcgaagctttatttttactggcttcattaataaaataagttcctctcttactagtcaatttagcaacagttttattaagacaaattgcattcatataaacatagtggttggtatggtaatgtttgatttgattattgtttgtcttttgctgggaatgttttgtttaccagattttaagattatcattgcagtgaattgaaaaacattatttacttgcttgatgtgatatttagacatgagccaaatacccgtgcattgtaacaatctagcataaatatatgatttcaaattgaataattcacacttaattctaatacaaacgacgtgcaaatgatacagttatgcagagaaaattgttcagatgaaagaaaaatgaacacacttatgcatagtatggtggtggtgcaaactcatttccatcactgctagcttcttttacaatatactagtaaatatcaccctgtagttttggttcgttacatgttcttatggtctcaatatgacaaatgcttagccaataaccacttaggtagttggtgttgttctccatttgttccacaatctaaattacaaaaagtttcttgtctggtgtttatgctccttttcttttggcttcaaacttatgtacttgagtgctcaaattcgtgttgtgttgggttgcaatctaattctggagaatatgcgtctggtgtggcattgtactgaacaggaagggtcctgttcccatctgagttaacatcctgtgttcgcatacatctcttccttctaatgcatggaattataagcatacatcctgttttcaattctttgaaccatatagtttggtgatggtggatatcttgaatatggtatagtttggcataaaaaaaaacacagtaaggtacctacatatgtttttccaagcgattgacaatattgtggctgcgagtggcagatgtagatccaactatcagaatgaacaatgcaaccacaaccttataatagggaaatactgaaacagacatcatgacatgtttcttatgccttgcatgaatttttttttggttagtttatatgtgatgtagtagatcagccaccaggaagaaatttatcatagtaatttactataatttcattattgtgaatttatatgtttgtcatggtttgctttgtagaatgtgaattcggttaatatgattgttgtaattttagtaagtcacgtatgagttaatattcattgttattagctggtatggtttgtgcaccattagtgtgttcttgcttgtttctgattcatggacctcacatggaggaagtcttcgcaagcctgcaactgtacccctattgccttggccccttctagttcagtttaatttttgcatgtcatctcttattgaaagaaggaaaaattgtaaatatactttgcatttgtccacttaggttgaagaatcttgtttggcttatgtctcttattgaaagaaggaaaatgtaccatttttctaggttgataaagctgcgttgttagcattctctactatagggttattgttgttttcacaaagttcatgttgttcttccattgtcatatcacttgaatcatatttcagtgtttgtcttctttcatgttccctctatctgctgaacattatttcattgcaggtctgatgctaccaaagagactgctgcagcaaactaatctatgccggtacttgcgaacccaaggattgcagatctcttctgctaaatagcctttctattatttttttgctacttgtgtgctacagttgtaacactgagtcaattttgcgtccatgtttcttatcttttcttagcacctggtaatcgtgatttatggtattgagaattttgatctggaacttaggtcttaatcatagtgggtagtagctattcattctattgtgactgttagttgtcatgctatgttgacatggtgataatgtctcgaagaaagaaatagtgcttttttaaccttgttagctgtggagatgtggagtagcatttgtttagaattttgcatttacaatgcggctgaggtttgcgccagcaagtgtgaccgcacctatgatttctgcgctaccttgaatcacggtgaacgcttggctgaggtcctgttcgcgaaaagaattttttgtcacatcggatctttgaccgaatatctaagatatcagaaggggtttttggacacgaataaaaaaaattaatctcataactcgtatggaaaccgcgagacgaatttatgttttagcctaattaagctgtcattagcacttgtgtgttactatagtatttatggctaatcatggactaattaggtttgaaagatttgtctcgtgatttccatacaaactgtgcaattaatttttatttttatctatatttaatgcttcaagcatgtatcaaagattcgatacgatgtttttgagaaaaaaaaatttatggctaatcatggactaattaggtttgaaagatttgtctcgtgattttcatataaactgtgcagttaatttttatttttatctatatttaatgtttcaagcatgtatcaaagattcgattagatgtttttgattcgatacgatgtttttgagaaaaaaaaatttagtaactaaactaggcctcatttcgatgcctatggctatgtggcctgtttgacatgcatagccggtccaatgaatcactgcgaacgttcggctcatttggcttgttggaataaactagataaaacagccccctacgtatgtctgtaacatttgataaagcagccccctacgcatgtctgtaaaaaaaaaagttaagtggggtttcatgcggccttccatgatccactagtcgttctcatgctagattagcccctttgtttgacattcatatggattttacaatctgttgggaatgcataattttttattcaacgaagaccttcagttataccatcatttggctcgtacgttaaaccgatgctagcctagtgtctagggtcctccagtgtggtttgtaatatgagataccaaacctagtttgatgaacatctgcatgtgtctcttcatgatactcaaagtgacacatgcagatgtcctcgacctccctgccacacatgtagatgttcttttcccatatcatttttctaatctgccatcaaattcgcaaacaaaacaaagattgcattgctcatttttctcacgttggattggacacttttgtaagctgaaatttgtattatggagtttgttgttgttgttgcaaaagtcagctaaaggtaaacaactactccctccgtttaatattacaagacaatgatagaaagacttataatatgaaacggagaaagtaatcaaaaagcttctcctggtggagttgattgattgatgcctatttagatttcctccagtattctcaacgcagattccgcatagatgcgttgtctgaaaattgaaaaccacattacaggagcataaagttaaaacaaaatttagccaaaatttatagaattggagggagatagggaatgaaaggtttttctttcttggcgtacttctcttgggtgtgtctagggccagccggccagggcgattgtgtttcatgtatccatcccatggaaccttcttaaggccaacctgagcagcgatcatatccctcaccccatcaaagtattggaaaatgatgtgagcaattgtatattttattcatttattttaaatgaagagccaattcaattgcggtctctcctggcataatttgctgagggtccaagaaccaaacatcacacacaacaccccatgatgtcataagtcgaaacaattcaactgcaaaagaatgtctgacaaagcgttggatgtttagtttatacttcgtactcaaataaccaagacggccaaattaagcagatctgcacaattattttttgcatttcctcacttcttactgtcccaaaaagtgtcagtaaactctttgttgtatttgatagctattgggcatacaatgcagccaagctcaaaagcagcctgaaaaatcacagtgcagacaaatatgcaagccgtggttagtctggcaagaaagatgaccaaatatatcttatggaagaggatggctgattctattcgaccgtcttgtgtatgctttctggggtacccgatatacactgccagattgctactaccatatttggttactgctcaaaaagagtttaacgcgggtactctgatacagttttgtttgaagaaattgagtcttgaattttgtcttgtagaaactctgtacaacttaacaatttgaaatatcatttgtatgggcatatcacatatccatatatgattttttttcaacaaaaaggaaatgcttaccttcttgaacatgactgtataccgattgttaacgcaagttccttctgggaatatcataagaggattgttgtctggaagttggacatgctcttgtaggttgtagcctggtaatgaaatttcttcgagtaaaagtaagattaccaaatataggattgctaaggatagcatttcttacttttcttccaccatgttgaagcagaaggagcggctgcttgtccttggcgttggcgcgggtgtgtggttgggtgatgacgatctgctagccattgtcaataataacgaaattagggccctcctgtgtgtctcctggtagaaggcatcccatgcgcaccacctgaagtagtcaacaatgcagggaacttcttgttagagtggagccagaaggtcttaaggtaggacttggatatgacaactttgccggtgatggcggtgaaggggtcgaactccacggtgtcgatgacgagcacgtggtcgaaagatgtggtgtgcgtgtccgcgccgccccagcgccgctatcaacacagagctggagcgtgccagcgctctgaaggctagatcagaacgtgccctcgtttagcaggaggaaaacgacatacgcgtcaccgccaccaccatccattaaattcgcaccttggaggagaatttgaaagacttgggccctcttcactgcaagctctccacgtggtgtgctaaatttggattgtcgcacccgaatgcttgccctttgtgcgattaagatggggagacaatgcaacacatcttcatatcttatcttgtgtctctgcccgtcaagtatggttctctagtcctagaaaatatcagattgacgatggcagcacctcaaccttaggcaacctgtttttttagtgggtgatccaaggtagtcgagcattatactaaggagacaaagaaatgattaagttccttaatcagcctagtggcacaagaaatttaaaagtactggaataattgtgtgttcattaatatcacaccaacggcacagttgtcttgcaagcattagcaatagagtgttcgtattggctgatgccacataggtcgctttcttttgatggttagctgctcatgggaggtttttgtgtgtcacgtgttttttaatgtctttttcctagagagttccttttttgtggaccactctattgtacaaatttctgcttcttgaagcacaagcctctcgcattttcttgaaagaaaaaagaaatgttctagggtaggactagtgatccttgtattgtaaaagcataaaggaccgatgcaaacgacgacccccaatacagtcctatggaagaggcagtacaccatcatgcgcgccacattttgcagcaacatttgaatccgatcttccaatgcaaccatatagatcgatggcaatacacattgccagtatatcacgaagatccctcgtgcttcaaagtaaaaaaagatagatatatactggtttaccgcaccatatcttggtttcatttaacaatgacctatttattcttcattcagatccaacatgcacccgcatgttgaactatagtaaataaacgcatatgagaaacaaaacagtattttgtcctgagccactaaaattcttggcaacatttgctacagtacatttaaagtttgtggcctttgcggtgagacacctagagaacgtgtatcttctcgtggacactgtaaaaaatatggtaatcagctgctggacacccgcctcattattttattatttttggtggaaacggagagagaaacaatggttaaagataagtttgcccatgggcccacttgtcaatcacacatctggctttctacgttcctcttcttgctgctgggccgactcgccgcgtggacggaggacaaagaacgacgtgcccacgaggagggtgagggcattgtctctcgcggtggcgtcgggcaaccgactgcgtcgactggccttgaaggtgagggccccccatgggccgacagtgggacggatagagatgatcgggaggctcgactggcggaagatggcagcagcggcatgcgtcgggtcccccgtgggccgacagtgggacggatagagatgatcgggaggctcgactggcgaaagatggcagcagagcggcatgcgggaggctcgactggcgaaagatggcagcagcggcatgcgtcgatggtgggacagacggagtcgaccgggaggctcaattagcagaaggcggcagcagcagcatcctggggagggctcgaagcgacaaggggcatccacccctaggcacggagctctaggctggcatcgacggagtcagggtgtcggtggagacgaccctagggcgcgaaggacggtgattgcggcgggcagaggtggtgtactgctgatcgatggcagtggcagtgaggcgccgctagccttgacgtggtactcacgacggcatccaccgagaggctggccagtgacgaggagtccaagacacacggtgtggagggccacccgacaaggagggtgagggtgctgcttctcccgccgcctctctgccggtcgccgccccacccatcgtctaccccctccgccgcccactgttgcgctcacttgccaccactcggtcctctattgccagcagcctcccaagctcgctaagaaaagagaaggaaaagagaatataagcaggaagaatagtgtccaggggcatttcagtactttcaacactctttctctattttcaccaaaaataataaaataatacatcgagagtcctacaggtaattaccacattttttaatgttcacaagaagatatacgttttttagtgtctcacagcaaaggctacaaaatttaagtgtcctgtagcaaaatttgccaaaaatctttggataaaataaggtaccgacatcacagtacaataaaaaaaaataccgattctacagcaaactgtactgcgctatcaatccgaatcctgatacagccacacataacaagagaaaaatcttattacaattgcaggaaaacgagttaggcagagagattatcaaagaacttcatgtagtcatcaaatgactctccacgccgaatcttagcaatggacccatcatcttctacctgcattacaaataacagggcatattggatgggaaccaacaattataaacattgcataaagggagcattttgaaaacctatcaacaaatgatttcggatgaaaaatatataggtcagtttgtacccaatattcaggtggtcgcaacttcaagttgtaggttgaagccatgctcatgcagtaggctcctgcgtcatgaaccaccaaaccagctccctacaagcgcaatatgtttgtagggtaccaacaaggatatcaaaaagaaaacacaagatatggtcaaaccttatcaggtgttggaagttccctgtctttgccaaggaaatctgcagattcacaaactggtccaacaatatcgaatgttgctacttctgcatctggggaaggagaaaccagttcgatatgctgcaccatgtggatagagatgacaggtaaataacatgataaaacaacatagtacgaaataactgaatgtatatttcatgtttattttgaacatttgttggaaaaactgtatgcaagaaaaaaattgttggaaagatgttatttatatataggtcagatggagatgtaaagatcagagctaaacctgagaccaacgttacaatcatcatatatttatgaatggtgagcatcttatccaaacgaactcagctattatgaacaatggacaaaaccaacactctgcttgcaaccactatcagttgtatcactaaacaaacctggtatgctccatatagacttggtctgataagctctgccatgctgccatcaactacaatgaaattctttgtaccattagatttaacaccagtgaccctattgacgaagcagcaagtgttagctatgagggatctcccaggttcaatgatgagtgtaagatctcgtgacagaactaattctcgcacctacaaaaaatcacaggggcacatataagaatcacgccatatgccaaattttaacagtgcaaaaatccaaagtaggaagtgatctatttaaataaataatgtgcctacgaagatgagaatcggaaatataacatggatattgagctcacagtgttgatgaggtccataggtgtaggcaagactgcatccgtgtggtgataatctatgcccaggccaccgccaatattgagatattccagttcaaaaccttgtgctcgaatttcatcaacataattcaccataagacctgccgcatctctaaatatatcgacctagacaacaagaaaacaatatcatataccataccatgtagctcaaatgtattgtctaattatttgaacatggtctgaagaaaaaaaagttatttagcaaataagcataagcccacatctttaacaggggcttgtccctggataaacagaaacaaacacattaagtttgatgaagtttcaaagtcagcataataagtctttttgaatggacacactgctgcacagaaatagtatacacacaagaaaggaattatccctttctcctaatttcttcagtaagctttattcacataagctgcaagttcacaagcaatggagaatgggagaggagaggagagaagagcacgggttctttgatgctgtccatacccggtgctgcatccctgatttccattccccgaactgatcattatactacttgtcaagagaaaaacattacagcgtccaaaacacgaacacgatgctttccatcaccgttgctccacatccactgaaacaaaatcacgtcggacatgctcaccgatgtctcacccgatatcacatgcgagagccctcttctaagttaataagtcttccaattttaaatatttgtgatgaaccttagttcgttatgggataaacattacaaggtggacggctggaaatggatagactagagactatcagctgtacttaattctttaataatcaaccaatagtcagagattttaaaatttcagaggacttcatttagtcccagctgtactattgatttacaaggtggcacttagtttatctcagaggactgggactcagataaattcagctgtacttgcttgttaataatcaatcaatagtttcctgactatatagtgagcctcataacaaccactgctacattatgatgcaccgatacaacagaaaacagcatattcctgtaccagatatgtatccgagacaggagtacgcagtcaatacagtattgcagaaatattgatcatataatggcgaaacaaatcaaaactattagcaatgcttcctcgattcaaattagatgctcagatatgcagtcaagccaaccctcattcgaaagcccacagatggtagtctaacccaagaccactaacccttgttcgcacctgtgtgcgactgtgagtgctgttcccctcattctccacctccattatagcatcaccctgcctacatcaccttcagtgagcaacctgctcgcctcaactacaccatgtgtgcaggaggcttttctatgacaattgaaagttaacaaattggaaagatgtgtcttgatttaaatgtttcttatcaaacttaaaatgttttggataaaaaaaaaacttagggtgtgttcgttagtttggggttgggaacccatctccccacacggaaaacagaacagtccattagcgcgtgattaattaagtattagctatttttttaaatgaattaatttgatttttttaaacaactttcatatataaactttttgcaaaaaatgcaccatttattagtttgaaaagtgtgcgtgcggaaaatgagggaggggtgttgggaacctagaacaccgaacacaccttaaaatgttaacaaatttggtttcatgttaaatggtccccattttatcccattgaactgacacatcttagtttccagagagtgagacacagagggtaaaatgaaaagctggtccgttggagctaagagtctgacacctgcatgtggaggtactcatgcctgtgacttgaggcttgaaacatt

SEQ ID NO: 2186 - DNA, 906 bp, Oryza sativa
  unsure (1)..(906): unsure at all n locations
agtcttcccctctgtccctcgacccccggccgaagtcctcttcctctccctcttcttccttcctccctttttgccctccttccgggccagcccactccctcctcttctcctcccagcctacctagatcagtttttacattcctgtactgtgggaaaaatatgatttggaaatagaaaaagtacgaattaccccctgaactatcgcggtcgtccgaattaccacccctaaccacaaaaccggacattcttcgcccccaactatacaaactggacgaattacccccctcaacctaatccgcagtggttttggtctacgtggcgtacacgtggcatcccagccagcgtttttttaataaaaaatggtgggacccgtctgtcatactctcccacctctctctttcctactttcctctcaatctctctctctcttcccctcttcccctcaatctctctttgtctacaggtgtgcacgagggcgggcggcggacggcggcgtcgcggcgacggccgagcgaaggcgacttcggtggcggctacgggcgggacgcatgggggcgggcggtggacgtgcccgtggtgcctgtggtgctcgtggagctggagctccctgctcccctgcagcaggtcggacagcaggggcgccacgaagccgccgcggcagcgcgggcgcgtggcattgttgggtgcagcaagcagggcggcgcgcgcggtgtcccgggcgagaaggtgcgcgagcacatcggaagcggtggcgttgagcgcgaagtgctcgcggtgggtgaggcggaagtggagcgtggaggcgttggtgcgaggcgagagaaagcctccgccggatcggtggtcgcgggnnnnnnnnnnnnnnnnnnnnnnnnnnnnnnnnnnnnnnnnnnnnnnnnnnnnnnn

SEQ ID NO: 2187 - DNA, 1026 bp, Oryza sativa
caattttaaggatatctacgaactataccagctagacgtcgtcgacgtctctcttctgagcgcatggattttgtacgtatcgttgagagttatatttcttacgttcctttaattagctccttgtatatatgtacaccataaataacaattcctttattgttgtaaaatggagattcaatgggcccgacggcggggggttttcgatactggattcatcgaccctcggaatgtaaacgtcgaaatggtcaccaagtatccacaggccactgaggaaaatctcgtccatctcctcaaggagcagcatttcaagacgttcatactactgccgtacaacacagcgttagtttttattgtctaccgaacaaatttcattcccgtacatatacatgtacagtgtttcatatatcatctaacacaaattgcatattccactgggtccttttactcttcgacttggaggcatgcagagttaatgtctatgactcaatgaataaagatgagtctacttttgaccaggtttttgaacttatagataggtaatgtcatatgttccagtgttattattatgaattttgctattgctagtacaaatcgtagctttaaactccatgtagggcttggtatcggttctgtcatttggtccgcggcacttggaaagaaaaacttagccagaggttcaaatttccagtgagtacatgatctaaatttatattgaatctctaattcaaatataagtgtatattaaatctctcgtcgtttgtcatgtatatagtgtgcaaagcaggaagagggaactaacttgtgtgggtactacgtatgtgagtattgccactgctttgcaactcaaatcatcaccacaagagagctcgatgtacgtataaataaaccattcaaaatttcattgcatacgtatcgatttcttgtttactaattaatataacttcatacattcataggttattcacatgagggacaacctcacacacaagaactttatcacggcggttcaagaacaactcatgggat

SEQ ID NO: 2188 - DNA, 2542 bp, Oryza sativa
  unsure (1)..(2542): unsure at all n locations
nnnnnnnnnnnnnnnnnnnnnnnnnnnnnnnnnnnnnnnnnnnnnnnnnnnnnnnnnnnnnnnnnnnttataccatggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacggccttgataaataatattgcatagttctagaatcgtgtttacaaaatagctttgagcaactaagtgtcttttaatgctgtttgctgcaaaccctaaccctttatattataacccccttgtactcccttgcatttatcctgcacttgtgggtgtgtcttgttgagtacggtggttgtactcagtcttgctcaatttttcccaaacctagaagaggagcccctggaagatgaaggctttggtgtctagctcgcgcctgccgtcaagcgcctgtggtcgtcaccctagtcttccgctgtttcccgtttgtctttgtgtgtgctgggtcttcgccgcccatgtaataaattaactatttacgcttccgcttgttaaactctgaactatatcaacttttggtgtaccttgcctcctgggacaaggaataatgcacgcacgtaaggaacgcccgttgggttatttttggtcgtgacaatagttatgtcaaaccagattggtatcggttgggctatctaaactactaaccaattatagtatgatatatttatatagattgattcgtctatataagcatgtactagagtattagctagtacattatcttccttgctctatttgctctaaatattgttctatcagctactttcatagtattgtcttaaacttctttattaaattttgatggacagtattacagccaataaggcatgtttagagtttaatattcactaatttacctagtctatagctaatttggtataactatatcggctgagaccaccaacgatatgctaccggcccatcggccgatcggctatcggttaactaattctgctttttgtctttcttgctgattgcaggattaactcagctagcatgcccttaacacactcgaggctagccttggacctgcactggagttaagcagatctcccaggccgcattgtttttacatcaacacttagttaatctaacccgatgactcgatttacttgcatcggccaagccttttgtatggttttgctagtatcggctaaatcgtttagtcagtttagattagctaagatatccaccaccctaaaaatcaataaaaagcttgattgtttagattttatgcttccttccatacttagtgctgcatcaattgagtttgacctactaagtcgtgtttagaatcatagcaactaaccttgattgcaaataggggaagaatcagggtttcagctgatcttaactgatatgattgcctttctttgtttaatatcttcaatctagtttttcatgttatatctgccctttatataagtatatcactctatttaaatatatcaagcttgtattcaattttggccagattatcatatttgggattgatgcttgtttggtatatttacttagaatgatattcttatataaggttgtatcagagcaatagccaatattgtatctttattaacctaaactctatatcatctgctaagatattattgacgaaaaatccgtgatcggccgatagtgccggaactgtgttggcgcgaactaagccgacgaacacagcggcttgggagatctgcttagctccagtgcaggtcaaaaatattgatgagatgtgggcgtgccagtcattttgatcctacaactgacaagatatgtaaacaatagatcaaatagccgatcgactaacaagccgatggagcaattctagtcgataccgataccagccgatgtcgatagggttttgagcaatcagctctatgtacaattaatgtagattctaacactcgagtaaataatgatatatagataatcggctgataataatatatttaagcaacaatataatctaatagaaaccaatcggctaataatgatcaagtgttgatccaaaggttaaagcatacatcggctggaggtctgatgtcaataaatccaaacgattagataaacagtaaaacctttgctgcaatcggctaaatccaacttgtatgtaatccttataagccgatgcaacatccagataactcatcatctgaaaccccgatgaaacccttattagcaatcaaaaagcaggatagaaattatggttctaaacacgactagggctgatgcagtgcaaggtatgaaaataaacataatatctagacaaccaagcttttcactatttttagggtggtggatacctta

SEQ ID NO: 2189 - DNA, 5613 bp, Oryza sativa
tataaccccaaataatgatacctcataatctagacaccacgtctaaactaccagatactactttaatgtcatcgacatgacatagagtaattgcatatgcaaacattatacccgcaccaaagcatctcctccactttagtgacattccctgcaaatactagtggaagtctattattctaatacatttatgcattgcaagcatcactagatctcctctattttgggaatattgacggtcaaaactgatctataacgaccgtcaacaaaaccccccaagcttggaccttcgctcgtcccgagtgaaggacgaaaggaatcaaagacttggttgttgatcaggagttgctactatgctgcatatctcaaagatacaggtgcaaggtatatgtactctctctcagattaaataatttttggcacggtggcttacccttacccctgattcccacgagacactgcttttccttgccttgggcggttgaaagattgaacagcaatttagagtaccaatcacccgatctttatattcaactcttattccggaagttttcaaatgattttgcaaaaagaaaaccaagttcctcaaatgattcactcagtctctcttagtgtatcaacatgaattcctcaccaaatgttgtcttgttgattcctactctaaggttttatatgtagagctcggtagggatcaaacatggcatacttgcattcacatttattactaagtcaaaaacttagactagagcagataactaaacatactcaagatcaagatcgtgcataatgtgtgtgtggtatatggtggaatggcacatgaataaaaaaataaagaaaatgcttctcctttgcgcttactttcttctcccaaaaatccttcttttattgattaggagagggcatggctatattattttttttcaatcatgctcatgcttgatggagcataactttatttttttttctttcataaccatgcctttccctccttctctctttttttttcaaaaagtatattattttctttaggagaagaaagcacatgaaagcatggagaatttattttgatggtaatatggaaatggaatggaatattgcttagctcccagtgtaggagtttggcatatgcatatatgtgggtgtatgaccttgatcatagagcatgagaagtatctacacaagtcacaagagtttgatagagttcaatggaatgacaagcaaccaaaatgtatatggtttaatcatgatagcatatttttggctctggtaggaatttatatcaaatgaggaactttcaaatttattagtttgaaaaacaaaacatccggaattcaagtcaaactagtatcaggatcatagtaactcttatttactatctcatatctcacaacaacctagacttagatcagcaagtgcagcccatttacctgaggttcccggataattgttggctacttatatttaacctttgagagagtatttaccaagaacccatatatcagagatataaaatagagcaactatttatcatttcaacaaagagaactagcttgtcttacctagcttgactcaaacctatcctatctttttggtattttatattttgcaaatttttatgttgttttcaagttttataaaatgcaattggaaagggaaatatgcaatgtgatacaagttacctcaataggggggagcgatgtctccccccaagcttggctttcgctcagggtccttgataaggattgaacccccgaaaacggaagtacgcttgaaggtcatcgtgcttttgctgcatcatgttgttgttgttggcgaactgagcattagcagattgttgccattcttgcgtttgagctatgtgttccgtgaggttgtactggatctcccccgtctgcatatcaagggtgtccattctcttagtgatttcacccaagtcccaacgagaggaactcgagcgccattcacttggagatggaggcacaccacttgatctgggaggttgattgtccccccattggatgtcatgaggcgcatgccaccggtcctcactggcgcttgtccaggttgagattccgatgctatggcgtggagcttgggtccacccgggtgcatcccagttggtgcccaacctgcatcatacatctgcaggggtgttgaggatgatgaactttcttgctcattccttgtcatgttgcgcgtctccctgtatgttccacctgcacgagattcttctatggtctgcaggggaatggttacttcatggcagttgtacaaatgataccccgcatttggcaacgggatttcatttgtacttttcgggaaaatcccccccaccggggaaaaagtatatcaaagatccatctgctccatgtttcacaatatgcccttgcactagataagcctcatcaatacgcggacgagcggctgagataaaagcaatttggtcgctaacgacccctagcccttttgctatccgagtaatcagagaagtgcactaaacaggagcagagaactttatactttctaaccattgccttatcatacatttcacaggagcaattttgatttttctaaccatggcaaacatgataattaattcatcccctaatgggtatcagatcacctctaggaaacaaagtcatagcaatccatttgtacatgagcctaagtgtaggattatggatatcattcgttctaggtttcttgcaaattgaagcaccagaaatgtcttcccaaaacctatttttctcgaacccagaaattcctttccggagatcgattttataggaattgtgaaatccaagaagtgtactcaagcctttccatgtgagtgtgaactccttacgaaaaaagtgaaaagaaataccatattctatttctttcaagtgcacagaaattgcaaagtaagcaaatgagaaccaggctcatctaccacagcaaatctcttccaaccaaaaactttccagatagaacaaaattcaacatccatacctatcttttttagcaactccgaagagtattctcgcgtgtgagcatactcccggtcgctcagcatgtagtaggcttgtctctcccgatcactgacaaggtcgaggtcggtgtcgttcaggagtcatcgcggaactttggcgtcttccatcaagacatcagctgatgaacgagtactagactcatcatgatgacttgatgaagagccggaccctttgaatagacgagacagtcgcctcctcatactgcacaatggagcaaaagtggactaactcggcgggggttagaagtgacaagaatttcacctgccagttagtttcaccaaagcaacttgtatatatatgcaactaaatttttgaatttgagggaaactatcaaagcttgaatgaacttgagagcaaactttggagcgggaatgaaaatgtgttgaaatgggatggaattccctctcccagccgactggcttttatagggtgcccacaacggtcagaaatgacatgtgggacctactagccgttaccctgccaaaagtggcagggagccgttgcctggccggttcggccgaaccagggtgttcggccgaacccctggtgggcccaaccagccccacttttggccgttggattccaacgatcagtgtggtcgtggcacagtaaattttcgttgaaaattttattttggtttgctctgaaaaattcatttgaagaatttcctcaaaattcaaaaagcctaaatgcattttgaaattcaaatatgtgatgatgcaagaattcaaattgttgaaagcaaatatgcggatacataccaatttaccttttgatgaaggtcgcatcattttaggtccgacgtgcaagaccgtccctcctttcggttcagtgcgcggattttccacccgtctccggaggtgatggagcgggcgtctttggttttccttccacaccttctttggttttggtgcggaagacggcttcttctgagccggttgctctaacttcttggccggtacgggtgattttaccggcgttttccaataacggttcctgggcatcgttgtttccttctccaggaagttctgcataaatttcaccaggctgtccgttttgggtggctccactttaaccacttgaatattctgcgggttcgacccgtactttattctgaccatggagcattgttccgtccttggttgaaactcaaatctttcctccttgccattgatatggaaacggatactactcgttcccacatcgatgttggatcctgcggtgctaaggaatggacgccccaggatgagtggcgtctccttccccgtgtccatgtctagcaccacaaaatcaaccgggatgaagaagtcccgtatcttgactggcacatcctctgctatccctaccgggtaacggactgatgagtcagccaattggaggtacatcagtgttagtgccaacaccgtgaagttgagcttgtcgaagacgtcttttggcatgacgctgatgctggctccaaggtcacataaggcctggtcgaattgttgtgccccgatcgagcaggtgatcgtaggacaccccagatctttcttcttttccgggagcttatggagtatgacgttgctgcattgttccgttagcttgaccacctccattgttgggagcagtctcttgttgttgagtatatctttgagataacgggcatatgtcggcacttgtatagcgtccaacaacgacacgttgatgtggatcttctggatcacttcaacaaaacgagcgaactgctcgtccactgacggtttcctcatccgttggggaaacggcagcaaccgtgtgtcacagtattcctgcagcacggtcttttctggctgaatctccttgtcagccgagtcattagatggcgcttcttttgacatcccattagttcctgcagggttaggatatggcggatcacgagtggacttacctcccctcgtcgtgatcgccttgacattttcaatggaggagtcgggttgcctcggaatcctcccagtttcatttgcagggactaaagatgctaactgagctaactgggtttatgtcattttgttaaagctcagctgattttgaaaggcagaagcaaagccatctaacttgacattaatgttctctaggaccttatcattggcagcaagttttttgcttaatccatcagtggtttaagcttgcgcaaaaatgagatccttcagggagggctggttagagaagttaccgttattgttacctccttgataatatgggcgtggttggttccacccctgacctccttgtggacggtacccgttgttgttgcccatgtacatcgcctcctcacgggtttccgggcagtcattcccagaatgacccgtgccgccgcagacctcacacgtgacgtgtgagtccaaggccttgacggtgccttgtggctttttctcatggtcgtccaagcgtttcatgaggaggtccagcttggcagcaagtagctctgtctccttgacggtgtgtatgcctcgctgacgggtctggagtcgttcctcgctccaacccatattggagaccatcttctctatcagttcaacgactccttgaaccgttttagaaaagaaggctcctccaccgtagcgtc

SEQ ID NO: 2190 - DNA, 3594 bp, Oryza sativa
ctttactaaaataaagaaaatataaattccttatcggacactaaacacactttcctcaagataaaaggaaactaacaaactcttcctaattaatagataaactgtcatggagcatcctctttgaactcggtcatttctagataaacttcctttaatagattcctttaaaccgaatctactaagaatccgactattggtgacttgataactcccatcggccgattccaagatgctaaagctgatagtgaatctaagccgatgatgacttcggggcttatcaaattttgatgttaacacatggttacagatatgatccgcaagcgcacagatataccattgtagcatttcacttggaagtattccaaggtatcgtatttatttaatcccaagggaagatatgataagagagtactttgctactaatttatatattacttgtatacatcaaagtctatgcaggggttaattaattcaagggtaggataaggttgacacgaagaatgaagaactaagatactctcactaatatatataatctaggctaaatggagaaagaataagaaaataatcattcctatacttctagtatacattcatctttagtttacaatcatgtagccaataccccctaactatgccctcgcggtgtttctagagactacccctgatgccgagttccttacaacaatccgttatgaccatccaaccggaaatgaatacggaggagtacccataccaggaaagtgtctttggactatatactaacatggaggaatacccgtactaagctatcaccatcagcagcccacctctactgacctgcagtatataaccccaattaatgatatctaataatctaagcaccacgcttacattattaaatacaactctacatccccaagaacgacatagagcaatcactcgcatgaacattaaacccacaccaatgcatatctcaggtaagctagctacacaattatatcgagacaagtataaagtaaagccgatactcagataatataaattaagtaaaagaccgaaactatataaagaagaatatttcattaactctataagtcttacaaaaggaggaaaagctactagagccatacccaaaatctcttgaagactcgaggactaaatgaactattctattcctactccactagcacaagaatactgaactaaacttgagagagagctcttgattttcttcttggagtgtgtgagggagtggaggaggtgatggccttatataggctactgttggtatttcttaacgacattactagaaatataattcccagcaatggcgcagaaatacttctggtatattatggttacagagttcatctgcaagcgcacggatataccattgtagcatttcacccgagactattctaagggtatcgtatttattttatcccgtgggaagatcaagtagagagagcttaactaatagtttatatattactttgagataatcatattctaagtaggggttaagataatacaagagtagagtgatacacaagcattactactcatcctcataataaattatctaagctaggtggaaagaaaagacaaagaaaatatattcctatacttctaatatacatagtatacatacattctagttaactgatatactagctaataccctctatccgatgctctcctggtacttcgagaagccacccctgactgctgagttccttacgatagcccgtcatgaccatacaaccggggctaaatacggaggaataccctccccaggaaattaacttaggattatataccggcgcggaggaatacccgtactgagctgtcaccatcagtggcccacctctcatccgcaatatatagccccaaataatgataccttgtaatctagacaccacgtctaaactatcagatactactttaatatcatcatcatgacatagagtaattgtatatgcaaacattatacccgcaccaaagcatctcccagataagctagacgtatatttagtataacatgaacataatgtaaagtaggtactcatatactcggaaagtatttcaataccataaatgtatatagaagagtattctaataaaagtacaaagcttacaaaagaggaaaggaaagctgttagagccatacccaaagtcttccgaaggcttccagactcctgatttctactctattcctattccaccagctagatactactaaactaaacttgagagaaatgagagagctattgcttgaggtgtgtgagtgaagtgaggatgagagctccttttatagcctcccaatgacggttgtgactgttggaatggtcggtaataccctccaaccgccactggggagccatctcagccgtccaggagaaccctggatcaaacggagctgcgggaggttcggccgaaccaccaggttcagccgaacttggggccggcccaatctagcccaatttcggctagcggccttctccgttgttcttctcctcagacttgtgaattttggcccagtttgtcgtgtcaattctgagttcttggcccattcatacatacgtctggttctcgacatcgtctgattgatttatcgtttgagttgatgtcgattctcctccactttagtgtcattccctgcaagaggttagcatgcctaatactagtggaagtttattattctaatacatttatgcattgcaagcatcattagttatcctctattttggtaatattaacggtcaaaactgatcgataacgactgtcaatagctaccaatgacggttgtggtggttggaatggtcgtaaataccccgcaaccgtcattggaagggatcctaggcatccacgtgcaagggggagccaacagccaaccctagttaggcccaaccggcccagtttttggtcggtgtgttgcctgttgatccatcagcccagtagtgtgatggttgggcctatttgatattatttctcttagtaaacaaattactattacatcgatggttctcaacattaaatatttatcttgccacaaaatttcacttagtaaataaattaatattacaccgatggttctcaacataacatattcatcttgccacaaaatttctcttagtaaccaagttactattacatgttctcaacatattatctcttagtaactaaattactattacattgattgttctaaacatattgatcttgcccacgaaattccgttccctaaactaattaatcctactgatcacaaacatatattgatctcgccacaattccgtcatcaccggccacgccaagcaccaacccgtgatgtgtttgtgcttctaatggtggctgctataacaatactgccatttttcatttaagcaggttgtccatagaagtcaaatttgggaacttcatctcttcctttttgaatctgatgcaaaattccattgttaacactaagataactgataaccagcagcttcaatagatagattagaacatttaaaacgttttactaatccaccgatgcaaactactgtgacaagtcatacctctcatccggaagatcgaagaagatgccccaactcgaaacaagaactcatt

SEQ ID NO: 2191 - DNA, 733 bp, Oryza sativa
  unsure (1)..(733): unsure at all n locations
nnnnnnnnnnnnnnnnnnnnnnnnnnnnnnnnnnnnnnnnnnnnnnnnnnnnnnncttatttctctattagatgaaaatcgattaaacttcggaaattaataactaaatcatcgtacctcggattcgagtggttcaagttgctaaatttttctaaaatcaagatctacatgttaaaaatatccacatgtactggttatgcttgtttttgtactattttgatgattttgttctttcgttttagtttccgacgttccggaggagagcgttttcgttgaggaaggttcggaagtgtttgcggaagctcaaggcaagtcacaaagatcccaaacaaccctttgagcatgttgaacccgtttaaagctattgtttgatttcaacttatgcattattttcgaatgtcatcgggtggtgagcctttcacaattaattaatggccgaagatggctttattttcctatgggttataatttgattagctagaaccttatatattggtttgggttcagctaaatgctatatatatataattgcttagccatgcttagaaacattagcacatgattgggataactaatgttacactatcacttatgggtatatttaatggtagctcacgatggtcaatcgtgaatggtaaataattattggccattaaaatttgtcaatggtgggttgtgagcacattgttgtgaaagtcgtgctcatagcaaattaaggaccgattcgcgagct

SEQ ID NO: 2192 - DNA, 560 bp, Oryza sativa
aacttctccaaaatcgctcgacccatgacacagttgttgaagaaagaggagaaatttgtgtggagcccgcaatgcgagaaggcgttcaaaactctcaaagaaaagctggtttcctcgccagtgttaatcttgccggatactcgcaaggacttcatggtgtattgtgacgcttcgcgccaaggattggggtgcgtgctcatgcaggacggtcatgtggtggcctatgcctcacgccagctacggtctcatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaattttcggcagaggagatggttagaactcatcaagaattatgatgtgggaattcactatcatcctggtaaggccaacgtggtcgccgacgctctaagtcgaaaaagccattgcaacactcttaacgtccgtggcattccaccccaacttaatcaacagatggaagc

SEQ ID NO: 2193 - DNA, 460 bp, Oryza sativa
ttcccctttttcctgaacaaatgccttatccgtggtattatagggaaataccacatcaccttagcaggaattctctttttcgttggctgcccgtcaacttcacctggatcatctcgtctaatcttgtatcgcagtgctttacaaacaaggcatgcttctaggttctcgtactcctcaccacgatataggatacaatcattcggacatgcgtgaatcttttgaacttccagtcctagagggcagactatcttcttagcctcgtacgttgtctcgggcaatttgtttccctccaaaaaaatgtttttgatgaatttcaataaatcgccaaatgccttgtcactaacaccatttgttgccttccattgcaagaactccaaagtggtatccaactttttgtgccccttctcgcaacttgggtacaacaacattctgtggtcctctaacatacactccaatttat

SEQ ID NO: 2194 - DNA, 20362 bp, Oryza sativa
  unsure (1)..(20362): unsure at all n locations
nnnnnnnnnnnnnnnnnnnnnnnnnnnnnnnnnnnnnnnntgaaaaaaaagtttgaaggcgatatgacaaattgataaggtgttggtctgcactgggcgtagaatccaggagctgcaatcaggaaattcttggtctttgtttccattaaaaaagaatacagtgataattgaaacttcgttcccattcaaagatagtaatggttgagacattggatatgtgggcagccggataatgtgattttttttctttcgccattagttaccatcatcagacacantgtacannccacctgtagaacaccatgnnaatgcatatgcatggtnntttggggaagaaatatnnngaggggtttgtcccggcccctgtatgagcncnntaatctcttatcnaagaaaagaaaaaactganggggagtagttcagtttttcttttctcttctctttctatnngggtgttacccagatgcccgaagatggtgcaaaattgcaaaaaacctctgataatctataattctatctccattttatattataagatgttttaactttttctttagtttataaaaatattagtaacatctactacataatcgttttgtataagaatattactatatttgttctacaaatttaatcaaaatttaaaaagttcaacttagaaaaaaaaatcaaaacgtttttcacatacacattgacagacggctctgacaagtagataaccagatacctgccggtagtagaaattgcagcccagcccaccaaataacaggaggtcaaaacggcaagacccagaacccggtccaacaacatcgttctggctcaacaaaggaaagggccacaaggtggcagcattcacgttattataacaaaatgaacaatagtcgagaattacggcggagaattttattatcaactgcaacagttcaggcacattagcaaaaccttttaataattaatcccccattagacatatcttcaattcaggtacattagccagagacgacgatctgttgttacgttatggtgacgatacacatgtgcgacagcgatactgcataaatacgagatccaaaattaagcgtgctaattatctgcctcctgtagtagcaccgcatctatgtccttttttttttcgctttacctcttctctacttgcaacatgcacagtctgaagcgcaagagagctcaacgccatcttgcagaagctgacaggtagggtgctgatcactcatcatcagtactcagtcatcacttcttcgcctgccttcttgatgcagctccgatgaggagagccttcccaacaagcccagtgttgagcacgcagacggcagccactgcgccaccgaacaccacccatttccagtcgaaccctggttgaaccgctctggaattctcactctcatcgatggttttcgctgcattggagggctcttgatccagggggcaactggaactagcaatagatgtcttggtggttactcgagccatgatggcactgcgagagagggtgttctctgtgtctctcatttgctggtatgctctaaatccggactggaacttctttacagcaccccacatgccatgccggacacccaccttggcgacatctttagggatgcccatgtcctcgtagtggaccagcgttacttcacatgcggattgctgtccatcttgtttcggtgattgaactgtggttacccaaacagaaaagggaacagaatgtcaaggtataaacatttgtgttccttcttgaccaaaacttgtgatgaaaggaactaattcaggtgaagtaagaatagtggtaggaacaaaagttacctgctctaatacgccaacttgagaaatacagttccacacgccttggtttttccttcttaggcaaagctggataaggaactccctgcaaatggaagtgtttcagtgctcacaagtctctcaacaagcatatgcgctataatagatagtagtcaaattttctacatagtgcattgccaacaatcttcaaatacatgtatttctaatgttgattatgcaagaatgctaggccatggcgtctgattctctgggctgagatccaggtttgaaatttgaaccaaatgtaagaagagctacatgcatgagctatgcaaaagtatcctctagaagccagacactattgacttcgatctccattcacatcaactacaccttcaacaccttaaaatacaatggatgtatgtttgatctagcactctcaaaaaaagtaagtacaatcgtatcgatgtcagaattgcaatttgcagaaagccaggcaagattgctacgcaacaaacaatgttttagtataccagatcttttgttcactaaaagatctgccttgtagtcactaataaatctaattaccttctagacctagaatcctcatccttttagataattggaaaatatccagcctctgcgtcaagagaagcacccagaccgctacctagaatcctcaaaaatcagatactatctctattcatgaatatttatcacttttcaccacattttcttctgaataaatatttgtcacttcatgttcccaagtagaatttccagttttgtccttattcccctttccacttttggcagaaaatagtaagtagtttacttactagggttaatttggtcacatataaatagccttcgcaacagaacattggttaagcattcgtgaacagaggtagtatcttgcaataggtgctcatacaattacagtagttaagcacttaagttagatatccatatgagaacatcagccaaagccaggttagcatatcataaaaatgtcttgtgaaaatagtaatactggaaccttgtggtagaaatacctttgtaacacaatagtaagttttcccagattcccatatccgccgcccaaaaatgtattcacggtcactgcaaaagaaagggaactacaaaacaagcaacatgttgaaattacatgattcaatatgtaatttgggggatatgcttgtcaagagatatgcaggtcaagttgtcataccttttttatccagtgaataatcatagttccattttgggggaactcctccaaaattttgaaatatgcaagcatgggatcccacttcagacgaaattcatcatcccagaagaaatctctaacaagctcaggagtagcatcctcaaaaatagtgcgactacagtacatgataggtcccacctacaagcaaaggaagatcagtccattagatgttgcactataacctatatgctattgatttggtcacatcaaacgtagattcattgaaaagacaggaaatgaaccaaaggtgcaaagcaaggaaatgaattaatattataccacggcaagccaaggtcatcacaggattttaaaaacataaattctgatcttggtacagttgattcaactttcagagtttttctttcaattcagatgctagtatttaacttatttctaatacagggccctctaatcatttacgcaatcacgctatacatatactttgacatctgtttctttcctacaatcccattggaaaacatacctcaggctcacggcgccaggccttgtaagtcatgttggaagtggtacgttccatcaaatgctgccatgttgtatccccactctccttgttatcaagaagttgtacgaggtgttctaggtccttctcagtgacaacatgatggccgccctcaaaaaatgttctaatatggacagaagaaaaggattttagcaaacagtttgttgcataaacctatattgaagtcagtttaaatagatgcaatcatgctttgaaataactttttgtttgcattagttattaactactgtaacataacaaatgggtcacccgatgaaaaaacatatcaactaggtcaatatataacaggcaatcatgtaaaagttcaattatgtccaacaagtctaaaattctcaagtcctaatcagcatttgaaatttcagtcagaagctcccagtcatttatgttgatgatggcttgatgcattttatgtcagtacatcgaccattgatcacccacttgacccaatgaactcaatcacatcaaattcagttgctaaagaaagaagaataagtctgttactcaactccacaatttggcaataacagtattggtcaaattcaagggtaaagtacaatggatcatcttattaacagttgtacttaacaaatagcaaacgaattttcttgtactaatccttccactatatgattttaatatgacacattgaaacccttgatacgcacaactttcacttaatgttatctgtcggagcataaatactacggacatcaagcaccttaattttaacataacatcgataatttgaaattcaagcatgccataagcataaattcgctctgtcagtacatgtttttttagataatggattttcattaatccagcctctatagctctgtcagtacatatggcatcatcatcagttcagttaaaattatgcaatttcaccaaaagctacggcgctcctaacctgccatcagcattagtcaccacagaattgagttgtgagcacattgatttcgattatcagtaataaattcaatttcgagatggcgcacacctagttcccaacggacgcagctaacaaggcaaacgctgcgcattcccacctcatcctaccacgctaacccacagcgataatagataatccaactcaagaggatcccacctgccatcgacgcaatcgccggcgtccccggaggcgtcggcggcgtcgtcgtcgtcggccaaggcggcgtccttgcgctggtgcttgccgcggctgccgaaggcggtggagaggagccgcggcgcgacggagaaggcggagagcgcggtgcaggcgagccagaggcggcgcgcgccgaggcccgggggaacgtagaggaggcggaggcggcttcggaaccccaggtagagcagccccgtccatcgcggccgccacgcccagccgatgacgagcccgatcatgacggccgcccagatcggcaccgcgcacagcagcacgtccaccgccatctccgccaccgccggccgccgcagcagccccaccgcctcctcgtaccaccccgccattgctagggctcgaagcttcctccctctctctctctctctctctcctctctttttttccccttgcaaaaatggagaaagggaaggggaaggggaggagagagacacgggccagggcgacgagttgtttttggaggggtgggtgaaacatgcgtcggtgaggctggccggtggggccgcggggatctgggcccacctgtcagtggcagcgggggaggggcggttggtgaggcgggcccacctggcagtggataggggtgaatcggcagcatatgcctccgacatatacgggtctcgcgaggcggactcgtgtttatccggagaccggagtggatagaaataataattaatttagcgtgcgagattcacgatgagatccctccgcttgtgacgtggcggggcgttaatggccgcgggtaatcgttgaaacggtacgggcagtggggattggtcactggagcttgctccctgacacatggggcagccaattaattactgctccgctctgctttgacctgcaatgacatgtgggcccagccatctggtatgttgatcgagagctccatccataaattcgtactccctccgtctcataatataagagattttgagttttttttatttgtacttcttgattgctcgtcttattcaaaaaaatttaaaattattatttattttttttgacttgctttattatccaaaatactttaagcataacttttcgttttttatatttatacaaattttttgaataagacgagtggtcaaacagtgcaagcaaaaactcaaaatcccttatattatgggacggaaggagtattaattttgacttacaataatcaaatttgaccaatggtataaaagaaaatgctccatattagtttagtcaagttggtactatattgttttgtgttctagtcaatgtagtttatggaataatgccttacaataacagatattatctttactattaaatcatcgatggtacgagttgaaattaacaaatattgacaattggaatttgggagatcggtcatgtttgatttagattattaaacgaattattaaaaaataaacataataaatagcttagacaagttaataatgtgctagaaaacatctttttgagattgttttgttaaagcatggtgcaaataattcggtaaataaactgaaaagaatatggcaggagtaattatttctgtagcaacgcacattcagatggattcatggagtgcgttgcgaaatattcagagttggtcgaccttgttgatatcggttgaagacaacagaaggaatccagttaggcggctgcctcctgcatatcctaagcgaagcagctgggtcagttcagttcactttctcgaatacattttcaagaggtagcaacagctaatagcacgaataaaatatgaggcggttgttcaatgatgacacaaacaaagctgtaccgaattgacattttgagtctcaaccctcaacgatcaaccagaacatgtgattgcatcacgacaattattcgatcagaaaggaacataaaagtcatggaggaaaaacagcagagagatcagaaaagcgtatatgaatatataagctcgtgcctgtgttaattgagattccagaagaattgtcacaaaccgttgaggaacatgagcctagacgcttaagatacaataatttgaaatcacattaaacgcatgtgcaggatgtactgccaatccgagcagagagcaagatttgcaaagaaaacaaaaaaaaaatgtagctagcacatatactacttgtacaatcctcgagtgccatacatagaagagctacacttgaaaacaaacttctcgaaattactcaaattgagctacctttagaagaactatattggctttgcaactttactcaaccaaccatttcttgtcttgcaaaattcagcagcaccatcccttgttgattgaccgaaaatagcctgtgccccgatagtaaacctaatttaccaaccagcatcctccaatccctgcaacatcatgatgcatttaaatactgaagaaagcaagtaccagttttgaaataactaaacacttcattggaatcgagctcctagcaactgatgatctctttgctactcataaaattttgggggcctttcagtactctcaatcttttctgaagtaatctatgtgaatgctcaacaaacaaacatcaaggtaaaatatgtacccttggccacttttaatcaaatttacatattatattgttgaatttttttttttgtgtgcatggacaagagtaacccctgtctagtccaagctccagccaacattagtactacaccatcttgtccccatctcatcctctaacctagcccctccagcagtgcctcctttcttcacaatgcattggcatccataggaattgagagcgactctactgcccacacctttgcacagggcaggctttcgctgcatcaagtgggatgaagacacattcagggtggcttgttcaagtccataaaaaaactgagcacagctagaagctgatgaagcagttcactgtctttattggaagggtcaagtccgatttacccccctcaacactattgcaaaagtacaatttacccccttcaactataaaaccacaagatacacccctcatctattcaatccagacacttaaccccctcataccctgttttaggtggtttagggctgagttgtcttgacattacttgttctcatacaaaccttgcttctgacacattttgtgttctcataaagaacaaatccctgtttgtcattacaatgtcaacctggtgctattaagacttatattacttgttccttgtccttgcttctgtttctttttttttttttttggcacagacctcattgcacaaacaatatatatgacaggaaacaactgatttatatttctgtaaagaccttgggggtttctgcaaacaactgatttatatgacagaaaacaacgataaatttcttcttgtccagaacttggggggttttgctgttacattgcatggctacattttgatgttttgatctactaacggtatatgttcttcgctgtatgagtcagtcactgaaatgcaccaaattgtgagttccaaagaccacgaggtgccatctgggagaaatggcacaggtaaaaaacaagtgcctgcatcaagctaagtttgcaagattcagtggattatcaagacaactcagctctaaaccacctaaaacagggtatgaggggggcttaattgtccggattgaattgatgaggggtgtattttgtcttgtttcgtagtttaggggggggggtgtaaaatgaaatgaatccatggttcaagttccaggcctcacttaaatgtgacattgttcatagtgttaaactgacatagttcatggtattgttctaattaataatctgacacggttcaatacaaaaacctcgcatggccctgactagtctgggtggagaagcaactcgacagatccatcctcagaatcttctccagagtgaagtcagcaggaccggaggagaagaacatattccggttcagcgcgcttttgtggctgccatggcttgccgttcgatcaaggttttggggtcgggttgggaatgagttagggaattcagagctcaggtcttgggtggggccaggaatagccagtggtaaaaaacatccagtcaaaaatgcattgctaaagaagataaaaaatcgggcaaagggtatacaatggcatgcttggaagcaacgccagtttggaatgacatatttctaagcctcaactgatcagtggcatacatctaaagtggtaactatggagtagcaccaatctagtttttcttatattgagtacttgttatgggagcaaatattctggttgtgatatcaacttggactaccacgctgtaaattgggcttccccaaggcagcaaggccccacttacactagaatgaaattgagatcaagatttacatactggtcaacaaccaattcaaaataaagtatcagcttgcaagtattcaatgatctatgatgcaatgcaactcagtaaatcacccacaaagaaaaaaaatgtagtcattcagattgtcaaagttcaaactctaagatgcaatgaagctacacgcttttgatgggaatagccagaatgtggtccagaaaaaggatatgcatcagaactatttgttcacattcagcttcgagctttcaactatcataactgatatgtactgaaatttatatttacctgtctaagttatgacatgattgcctctactttggatcgtacttcaaccccagagaacgcttctaattaacttataatttataaaatactgtttcagaaatctaaggtggtgtttggatgcagggagactaattttagtccctatcacatcggaggttgggacactaattagaagtattaaacgtagactaatgacaaaacccattccataaccatggactaattcgcgagacaaatctattgagcctaattaattcatgagtagcctatgtgttgctacagtaaacatgtgctaaatatggattaattaggcttaaaaacttgtctcgcgaattagctttcatttatgcaattagttttgtaattagtctatgtttaatactcctaattagtatccaaacatccgatgtgacagggactaaagtttagttaggggtatcaaaacaccccctaagtaatcacactggaaaattaggtggaaaggaattgcattctatgtgtggacaactggactttaaagtgggtcaccacacacaagtcatataggtgtagattctaaaatagagacctgccacgcttgaatagacacacttgagactggcaattttatgaggtttcctatgttataaactgtcactattaaaccaccatgcgataattccacattttgttaccataataatccaatattcacatcaaatgaaaaaaaaggcccataacctatgttggacatctttgggctcaaccctgtcggttaactggtaaaggttcaatctgggaattttctcaacactacataatgcaagaccagctgtgattgacatgttgcaagtttgtttgatcacttccatgagcaaagtttgtatcataaaggccattggaactcattatttatgcacaaaataaatactgattaacacatgaaacacacctatattgatatggtttactccacttatcaacaacagaggcaacaagacaatttacattgttttcaaaaatcatttgtaactacgagattcgaccatccatagccttgcattatcgatacaattgcaagcaagtacataacattagtctccatttgcaaattaagaggcatcacaatataaccaagtagctcatcctccaatgcgcagtacataaatatccaatgcgcaatacataaatatctagcccccagagcatcttttaaaacttctaacgtgatttttttatactctagttatgcatctactgcataatcataaacttgcaaggacggataattatctccaagcaaaagatgccataccataaccaccgggagcaatcacatgcgtggctgcgggcgaaggatcatgatgatgatgtcaatggccatgaacgcgatgagcgggctgaggtcgagcttgcggccgaacacggggggcatgacctcgcggcagagcgcgaggaaggggtcgcagaggtcgcgcagcgcggagaatggctggcggtcccaggggatgttggggaaccacgagaagagcacgccgacgagcagcacctccctgtacacccccagccaccgcaccaccgccgacatcgccgcggccaccggcgcccgcagcggcgcgaggttgacgctccgcaggccgacctccagcgtcgagagcggggccagcagcccgcccaccgccgaagccgccgcctccgccgcggcgcgcggcggcggcggcgacgagcggaggccgcgggggagggggagcgggcggagggctagggtttggggcgggaggaggcgggtggcggggctcgggaaggcgcggcggaagaggggaggggggcgcaggcacggggaggtgaggacgccgtgcatctcgccgcctctctggggttctggaaggttctagaaggggtggggaggcgaggaggcggaggaggagatgaaggtgggggaggcttgcgaagaggaaaggatatggtgtgccaattgggatcctctcctgtaatgtatgtgcagtaagtgccactgacatgtgggcccggaataggtggaacccacatgccagtgacacatactgcaggtgcagtacagtgtacagcagtggatttgctactttttgtgggctccacttgtaagtgggtgtgtgttttgtatagtatccatgtcaaactggattaggctgcgttcagcatctctagtttccaaccggaaacaaacagttcgcacgaaaaatggagcggtatattagtgcgtgattaattaagtattagctattttaaaaaaaaatgaactaatttgattttttaagaaactttcatatagaaacttttttaaaaaaacgcaccatttagttatttaaaaatggtgtgcgcggaacacgagggagaggtgtttatatacggcttatatactccctccgtccctaaataaaaaatgattttggttgaatgtgacacatattagtacaacaaatgtctagattcgttgtactagaatgcatcacatccaaccaaaatctatttagggacggagggagtatattagttctaaaaacaaacttgtctgtggtcggcaattctgcatctataatttcataacttttttatttacaattccattgtgatgaattaatggccggccagattttggatttctttctagcaaaactcctattagaaagtagaaatccagataactagttatatatgaattttagacataaccagatgataatagataagttgtgttaatagtttaatatgtcatgattatttttggttgtgattgtatgaattatcatgacagtcatgtcaaaagttataattaaactcatgtagccatgtcaaatataattgatagtggcaacaaaatatactactccctccgtattttaatgtagggaaaattggaaccatgccattataattttgtaaaatttgagatatgtcattctgacccacatgtcattgactcatgtgggtactacatgtcattaagataccgatggcatatctcaaactttgtaaaattataatggcatggttccaaattacgctttaatgtatgacaccgttgactttttaatcaaagtttgatcattccttttattcaaatcttttgtgcaaatatgaaaatatttatgtcatgcttaaagaacatttgatgatgaatcaagttacaataaaataaatgataattatataatttttttgaataatacaaatagtgaaacgttagataaaaagtcaacggcgtcatatattaaaatatggaggtagtatttttttcacactgttaaagcatcagagtattaactattttgtagggcgaagaatcaaaattccatcacatatattcgagatgaagcccaagtgtccaactcccaggccctgcccacccatgggtgatgggccattgataccctgtgggttggcctgtggactattgagattatagcagcattcccttgcatgaaaataattctgagttttgtatttggaatcgattttttttctttttatgaactgttgcaataaactgaaatgactaatgtattattttcctcctgagaaatatcttttggcaatactatagttcaaacttctgacttctgaatatagataaacgaactcgatcgttgaaatctaaggatgaaatgatgaatgattgttggcagcatgtacttatatattttcagatataataacagtaacaaatcacatgtttgccattttcctttaacagcaagtactaactcgagggtacaagcgaatccaacaacaagccaaatcactgggcggaagcacaaatacctttggtatattaaagatatcaactgcagacctcgtcggctacattttttttctttcttttaaccatcagctgcattgtcagctaaccatcttcttatctttcaatttctacctgaggcaacacgacatgatcttcatgggaccaagacaagatatacaacttgataaacacatcacaaacaggtgcanaaagataaatatattggacattagagcatctccgacattaggtaattttgcagagttgtagatgtcatgtcactgatagataacactaatgctgaaatagttatgaatactcgggcacagtaatatactagtgtttagttccaaagctgccaaccatgaatatgcagtgtcatactcataccccttacttgtcattaagacatttaatagtacaaattacagctccattaataataccagggcaattacttaaattagtgcttcaataaccacagcttagaaaaatcctaataactacattataggattccacggtgcagaaaagcatctgtcctagaaataatagcatgatggaggatgccaaagcaaatcttccacaacacagggaactactttccctgtggaaaaatcaacagaatgttgatccctaaaggaaaaccaggcaggcaggcaccaccaacatagaatgggagctgtttacggctttacgcctagaaaaacatgtgccaagtcagtcattatatatattaactgaaccaatcaagtcaaataaaacattagaaaaatcatgcataatgaaacattgatatagagaatctatgcgatcctaaatatgcaaaagacaaagtaacatctatagctactgaacagtgaacatattaagcttctagaaaaccaacatataagagcaatgcgtgttcaacacttcaactaacaattcaataacttgcaaatacatatgcatatcgtcggaaaaatacacctgctttctctctgctaattaagttcagcgctaacaggcaaaaaagtcttgcatggtaacaagtcatggtatgattttaatagagacaacgttgcaatcataaatgacaacgataaccaaatttcagttgtgttgattgcggctgctgtgcttagggagttatctaagagagcttggaacatatacactctccaggttcatgactgatcaaattgtgttgtactttgtcctcaaggtcactacttattgattgcaattttttgttgcaaaacctaagaagccagtacttcttctaagccctttagcagctccagacaagcagctgtgagactaataattgccaaccttgtatgcacatatcttatactaatccggtggaaagccggtagattccgaacaaatttcataaaccaaaatttaaatacaaattcccttagtttaccgataagctcatgaaaaccggtcggctttggcgaaattccgggtgaaatcatcgaaatttcaatcggtagctagaaaaagaggtaaactaaaattgatttcctttttttaattcgttattcttttcttttctactgtaaatttcagtaaatacatggaatacatcatttttttcgaaaatttatatcccaataggttctattaatatcatattatttataagattttatttgattttttcccttttttatcaattcaaatttgaatttgaatgaaactcatcgaaatatcagacggtttctactttcgagcctcgttgaaacctcggaatttcgcggaattcgaccggtttccattggaattgtgaaccctggcacatattggtgcaactaatagttcatttgtgcggccggttaagcacaaatgcaaagctgaaccaagaacatcttataacaatagttgtaactaacacacacaaaatgtttgtcaagaaaataagcaatcagtgctggtaatgaatacagacacttgtaacggtttgtaaacccaatcgagaaatgtgtgtacatctaattgcaatacattatatccaattaaaatgcaaagctacagccgcacagctgatctgggactgttaatagtataactttaatactaggaaaacacctaataattaaattgatattaggaaaacacctaataactagtaagccctgggtgcaagtgcaataatcagtgaatgttggagaagcccaatagaatcattcccctggaagcaaggcttcacttaccccctttctccactttcttttcactctctaccccttgctttctctctgaaagcttatctgtcccttgttccttcaggcagataagggaaacaatgagcttgattaattacctctagcaccacaaaatgctccaatcaaaggaatggttactactaaagagaacaatggagttaaaaaaaaattggtcaccaaccattgtctattaaagcaacatgtgtagatatgatgaatgatgctggtaggacttggtataaaatccgccgtaagtcgtctttatgatgctggcgacaatgacggggtttgaatctcctgaagataaagatagagatgaatattaagtgtttcacgtaaaacgaggtggtaatagcgtgtgattaattgagttttaattattataaacttgaaaatggattaatcttatattttagaacaactttcatatagaaagttttcacacgaaacgcaccgtttagcagtttgaaaagtgtggcacgaaaatcttaatcttcatccaaatcttattagagaaagaacagggccgattccgaggttgtattgtgcaagacaaaattccatgtgatggtaaaagacaatggtgtcgctaacaatggtaagaaacgcactggagttgacacatagattcctcttaccaaggaagagggaattgcaaccgatggtgctcaccaggacaaccattcccagcataaggtcgggtagcctgtaaactgaaaaatgccgatgaacactactaagatttgaggtggtcaccagatctgaatctccaagccgcattccaccaaattgtaggataaatgtgcttcgggtgttcttgctggacatttggcaatcaatcttggcggcggcggcgaggtgtccgtcggtgaatcgatctgcaatctctggttcatcgtaaattggcatgatcatatactccctcagctccgtttcattttaagtgtggttgtaagttttggtgtccaatatttgaccatccatcttatttaaaattttataaaaaaaattaaaaaataaagtcacacataaaatattatttataatttatcatctaataacaataaaagtattaatcataaaaaaattaaataagatagacagtcaaacattgaatacggaaactcacaattgcacttgaaatgggacagagagagtaacacatatagcttgccttggaatgacaatggggagaagaaattcttcattctcctgtttgttgaaatcctccattcatccattgcttatcgccggagatggcgacggacacatacaccgttccaaatagccacatcgtgagcgagacgactccaccggcggccactctgacagcggcgcgcgcctcgacgtctctgagacaaaaccacttacctcacatggctcacgtatggcagctaggtgtccagcggcgggaactcagcgatgccgccggtgaagggggtggaggaggcggatgatggcggttgttggagtgtataaagtgaattgcctgtcttttcctataaagtgcaacatgcttacttaatatggtatcagagtcagaggtcgcgcagtggtcgcggaagatgagagagacggacgcgggcgatggcgccgccggtggagaggttgaagaagctgacgaaccccgcgcagcttgcacggcgacgacacggccgcgcgggcaggtggtggctcaccagatcctccgggagagatgcccacgacgaatcatcccgagtggcggcgacggcggaggcggccgaccggccgtcagccgccggcgcgtgctcctgctgctgcctccgcacgggatcaaggcagccgggcgcttgctgctgctcgccattacgagacctcgtcggcgatggcatgccgcgcgcgtagacgatcggcgccggcggcggacgagctcgtcgcccgcgaggcggcggcggccgatgacaaagtctagggcatatcctcacggcccaactctttgtttttagactagcccaagcccaatctactgggcctcacacaccgatggcccatgggccattgctagctcgtggagaatcatggagagcatgaccgatgcaaataaattcagagcttttgtactactgtattactaggtcgctatattttatagtgcattaggtcgctaggtcgttccaaaatgttatcttttattaagagttttattctttttttgcgtattaaaaaaacatattgttgtagatgggtattgcatcattttcgacaatagttcagacatcagggtacagatgaaacgacttctcgtatgaatcttcagttctgagcctctttcccaacttgctgaatgaaccttggcagatgtgaaatgatcagaatgctgatacattttcagatatagttacaatgaaaaatcacatgctttgctcttttcctttaacaacaaatattttgggaatttgtttttttttcctagctaatttctgaagaatttgtactgcttcattttattgcaagtgactctgatgcaatgatgcattctatccatccaatggttattgttagtcatctctcacgcaaattttgccgacatgctgcagcctcaagattggtacatccaagctacattgccatgatcgagatgagcaggatgcagacgttgtacgttctgtacaaatcaaacaatcacatgatattacttctactactactactacctttttttctaatttcttcaccaaacagcaaagcttcgaaataggatcgagatggtgactgccgactagactagcttgtactacgtattgtcaaaactgaaaaagaaaaaaaaaagaagaatgacaattttgttgcttcaaaatgtgtgcaaattctacatgtacactcccaaagatgtagttattgaactaagtgcagtgtaggcaaacaattcagcaaaaaatatatgtactggatcgatccattaaccacatcgctttgcttaaatgtgtagctttctactcctctttaatagtgtggtaggctgtcagttgatgtaccagtgagtgattatgggatctcgacaagaattatggctctagctaggacagtagtactcagcaaatggagtggaaggtatcactttttttggtctgtgcaatcatcttcaagatctctacagggttatattgatggttcatatactaaaggaaaaaaagtagaaatttgaaatttcacgaaggatcgaggagaaatttcgccaatcaaataatgatctaacggctcataccactcggagagaaaatcagacagtacatgtttattttatgacttgacactttagtttgtgagaaagattattttttccattacgctagatggactctgaactaccatctctcattctaaatataagacggtttagacttgtttctttagtgcaagtcattttgaaacatctactatacattttaatccttttcctccacgtctgcgcctcctaaataaataaatatgactcattttttcccaatatttcatttcttagttcctgtttgttttgtcgctaaaattaaccctaatgccaaattttggttatataaagatgttgatgtaatatttggtttagaaccttaccaaaattgggtgcagcatttttggagtgcaagctttcgaagttgccacaatttggggatttaattatttgacactctttaccatatccgtctcgtccttatcacaaagtggcaatttgccacccatctctctggagtggctaaaaggtattatcacgctaatatttgatagggtagtaatggccaatacatgtttggtttgttgcctttacttaaatttagcatcatcaaaatttgacacgtttagtttagcaacaaacaaaaccggccttcaattaattcttatacataactctaaaacaacttatattaaaatcagtaatgctacttctaggattgttcaagaatgataaggtgccacacatatcacataattaatcacacactaatttgagctttaagataaccaccctatctgttttagggggagaaaaacaaataacatcccccaatggacaaaatgtcaagatcagtgttcctttcttaaaatgcaaaaggtgtctgaatttgcaaggtgcagcatccccatcttaaaatttcacactgcatgctgaggtgagctttgcaacatgtaggtaagatcagatggattggacaccatgagtggacaatgctggccggataaaatcaagcaaaccattatccctgcttgccttaaggaagctaattaattaaagttcatttcacactcacacacaaacagcctctgtgtattctgtggcaagataattaacatggtgaggtgaggtgaggtgaggtgatgttgctgtccgccatgcattattaattagtgtcccccattatcgagctaagctagcgtcgcttttggattaagggtttggtgctttgtgctaatcgagcttggactaattagatccaggcgatccatccatcgatcgatccgtcattgaagatggccacttctcccctgtgatgacttttattttgctgctctatctgatactgctgaacggcagcagatcgatcgatcgcgatagtacgttgcccattgtctgactggggatggcagttagccagtagccagttactgctgagtgctgacgaattcacgggacagtaaccgttccaattcatgctactgccaccgttaattgctgctatctgttaatgagttttctttttcgtcccctcctcccatcttacgctcatgtacgtagcacgagagaaaaaaaaagtgttgaaaatgatgtccgtggtatatataatatatctagccaaaataaatcttatcaaattttggtaaagttattagatagtaaaaagtacgaattacccccccaaactatcgtggtcgtccgaattaccccctgaaccacaaaccggacattcttcaccctaaactttcaataccggatgaaataccccccttgacccaattcatagcggttttatcctacgtggcgtatgcgtggcagtccagtcagcatttttttaaaaaaaaat

SEQ ID NO: 2195 - DNA, 2335 bp, Oryza sativa
agcgtcatctattaaaaaaatggagggagtattaaactatcaggtcgaatttctctaaaactaattataactatttagataactctcgagagcgtactagtgatcagctctcctgtacacaataaagagagttagagagcgcaaatgaaagtttgctttgaagtgagcctgtggatattgttggttgggctcgttgccgctgacaccggaggcaggagtggggcccacctgtcctttgacttttcaacgccctggacaaggacacgcgggggaaaactaacccagccggcccaaccagccacagaagatcccggcccaccgcgccgcgccaaaaccggcggcctttcaaaagcgccggaacccaccaccgacgtgtccggtcccccaccgaatcccagccgtccgtttccacaccaacgccccagatctttcgaaagcgcggggggccagtgacgtaattgttgccaccctttaattaacacgagtccccccgtcgcgattagcgcgctgaggtggcacggattaaaaacaccgcggacgagcggggcctagctaaggtcgatgacgtgtggggccccgggagcggtggggcccacccaggtgggtgtgggtgtgtggattgcggtggttaaggtgggggctcgtgcggtgtgtttcgctgcgggtcgcgtcaccgcggaacggaacggaacggatcggcggcgtctcgtccgttttgggtgtgtgtgtggtagttagagagtgcttagcttgggagattacaaccttaatcatgccgttttcgttatctcacatctggcaagtggtgtgaagatgatgtttaaaatgtgggtggttaggttgaaacctcaatcgttggctattttatcataattcaaggatacgcaaataaaaagaaacccaggtaaataagatagtagaccatgttgaatgcttaaaatgatgatgattattattcggtttactcattgtttgtgaaccttcattaacacagcctatcatttgggagatttacctagcctagtaatgcctagagttttgtatatgttttaaatctcgtgttttcaaatcaagtattctttatagcgatccaaatctagatattcaaacacataacatatagcatctagagtttgcatgtagtgacggagcgtcccatatagcaagtgatcgagctagccaccgaagagaaccttaccctatgcgccacaaggccatctctactaggtatactacatatgtcatctatttgctgtcgagagaaagacaaattaaaaagtgttgattgtttttgagtctgtaactatattggtgggtcgttacttactatgattggtgctttagtgggccgacaagtgcaccagtggacaaaaccgacgtgtggacacctcccgctcttgcccccaaccgctcaacgcctcaactgtagcaccgccgtgctttacgccaccacctatcctattcattgtccattgtcgccactcgctcgttttatccacccgtcacctaaatggccattacccgtcttatttggcctacatatatttgtttttttgtgctccatcattgtttgcatgtactcccaacccttttcaaaggttatcgaaacaatacgtcattgtttttcaaagtacatgtcatacaagatataaatattaaataaacaaaaatagtgaagcgaacatattttcctacgtagccctttgactcaaaggattggaattttccaaatcctaaaatttttgtatggaatgacttatgtacgtaggttttagaggaaacttagcaagaggtccaaccatttggaaaaatttctgagtctatccctctcatccaatatttttcttacggttcaatcaaacgattatttctatatttttcccgtattttacaatcctctattttacacttacattcatgttagaatccatgtttttcctatttctcaatttttttcatttctacgattcaaatgagccctaatactataatacacacgcgcatgtatcttctacacccatttgaacactgtcgatttcatcaaacatcacaactataataattgatcgaagaatgaagattatataatacgagactaccatgcactggtttattttctcacaccaaacatgaaagcaaactaacgtgatcacacaggtgagaggtcaccgctcttcgcaacgacaaaacactgctccaaaacccatttaatctaattaaaataaaattatcattactacttatttaacgattcccagaatcagaatagccaacgaaatgctaactaacccgagtttccacgtggctggtcaaaaccaaatcccccctcctcccc

SEQ ID NO: 2196 - DNA, 3486 bp, Oryza sativa
aggggacgccggggcggcggcgaggcggcggtgggatctgcccgagaaggcggccgacagcacgtaatgacgatggctttgatctagttttggcctttgattttttatttttttggggggcgaggttttcggggggctaatggtgtgttggtgtgtggtttcctggggttgtcggtggatctgagtggctccgtggtcgattccggtggagttctaggggaaattttctcgagtttttggtgggatttttttttttggattggtgggggggggggggggggtgactagggtttcgcatgcggggagtggaggcgttggcttttgaatggttcggaatggtttgcttagctcaatgtctgtgttccattgttattgccgcaaaatggtcactgttctaatcgcattcccggttgcgtcaatggcattgagggcgggttgatagttccgctgctgcaaggagttgagggcgcgttcgtgcggatctttaaataattcgagcgaattgggctctggcttgccatttcatcagttggtttttgcgaaaggatatcaaattggcatatgctgtagtcgcgctggatttttttttctttgaatgcttctgctggacgtggcgttgaacttgtcgagggggaattatattctcgcgtgacgtgttgcaaagcatttttaaaagtgttgccatttctaagctatttgtttggataaatttgtgattttgtcttagtggccaaggtgttaggactgcgccacttcaattttatattgcaagggatgttgtgggcttaatgattcaaacttaactaattcttttggctagtggtatttataatcagaaactatttctcaggattgtggaatcgattttgattcttcaaaatatagttttgcaaatttttacatgaatttaagtagaatttatgtgagtaatttggagttctggctatgatggcacttgcttaaattactacaagtatttacttgttgatataacgtgaacaaaaaataagtatggtgcactgattattctagaacaatgtagtacaattggagtttgaaatgattaagagacatcaccaaatgtactgataataccttcaagttgacactacagctcttggttaaaacttacaaataaatgcatatcattgcgatatttgttgttttagaaagcttcgacagccccccctcctttttttttgtgatggctctacatgcacacacctgtttcgttaacattttagcatatgtggaattcttctgcttgtctttagtcatagttgcttgcatgtcattgataattcatatgattgggtagttatcctttttttattttaagatagtgcaatataaaatactacattagctcactgtttgtctctttaataagtaataactctgttgtttttgctgatctattgtgaggggcttcaaggctccagctatgcagtcatgcatgtatttataccttttatttatttttgcagtccaagcggcaaaggggttgtagaaatgtccacggatgatgaatcagattgtgtggttatatgtcccccaaatgggaaagctggtcatacagaagttatgagtggcaggcatgatgaagattcttcaagagggcaagaaaccccttctactatagactcacatatgaatgggaatgtccaggatggagtgcctgcagatcaagatgtgctgaagctggttgatcagcagaagtcttctcttcccagttcaccaataaaccatggtatagctgaacaggaagagtcaaaccacactgttcctcagccatttgctcctgcaactgaaagggaggattctggagaaggagattgtactccagtgcctcatcccaccagcaacggtgaaaaactctctgataaaagtagcacctcgctggcaagtatggcgaagaaggtctgacatactctatttcacattgtatcatatatgttttatctgctttgttgttgcacaatcgcctgaatactatttaattttggaataaatgtcatgatgcatcattttgttggtattatctcagtaaatttctgtattcttttagctttaaccttcaggtatgggtcatctatcacttgaaatggtgcaacatatgctttgatttggcaattgggatgatatttggaagatcctacacagttatctaaataagccacaatttgttgcatcaacctgaaccccctatgtacacaagaaaatttttattagtttcttttctgtttacttgagtatgcctgtgactgcagttctgtttggctggcataaactgtagtaagctctcttgagatgaaataagccagttctattgacaatattttccatggttatggattgcagagtccatcagtgacacccaggaagcctctgcaagctgacagtacttcccatagtcacgaagatgattcatattcggttacttcgtatcctttcagatattgacttgatttctcatgtgtgccttattcttcgcagccacacctacactattcataatagctacaattgggatatagctacatgctttgaacattttgttccttgaattactaaaacacagaaaatttgtctaactttttctttaatgtcttcaactcttcataactggtggaaaactagaaatatatcatgttctctttatttctattgggctttcctgagcttcattcatccagaactgtaacttcagcaaggactggaaaaattaagaagacaacagttcctgtcgcacctacttttatatgtggtaatcgtcttgagaagaggggagaggtacgtatttaatttcatcatactgtagagaaatggctttgtaagttaaaggggacagcattgtaataattattctagtaccgttcagttttacacaaaattggaagaaaaacgcaaggccttggaagaggagaaactagaagctgaggcaagaaaaaaggtaggttttgtttcttttgtcatttgattcttttagagccattgtgatagtggcatacagagcaacacaattattcatgctcggtttttcctatataatgtaaatctgtaaagtagcctttctgatgtcatgtctgaattgtgttttgcttcagacattttttacctcctcatgaatcatgtcttatcttttgaaattttgttatttgaaattcaaaaatctacagttcaaatgtttaattcacaccattctatctagtttcacttttatgtaaatggaatctcaaagcgtttttcggactttgcaaaaaagatgaaataactggaattgctttcagtagaccatcccaatttggtagtctagtaaatgatccccaagaccccaactatcatggctttcaatcaccgttaacgttgaacttgagaaccctgccagatgacacaacaaaacatgctgaaaattctagtctcccattgtgatatggagctgtttagtagttcaattgtttctgcttttttaaatagaataaagta

SEQ ID NO: 2197 - DNA, 10129 bp, Oryza sativa
aagggaaattgttcagggggtaccatttttcagtcaagatgatgccacatcacacccgtgtggcatgccacatcagtgccacgaaggatcctagaggagctgtgatgaattggaacctagatgacacactttgacaacttctgggacttagatatgcattttgagagtttagggatctaaatgacacacctctataagtttaaggaccgcctgtgcactttactcttttaaatatataagcacccataccagattttgctcttgttcagcaaattagtttgcctttaatcatgaaatgtccatcttgatttgttttggaaaaactgatggtcagaaatcagttagtgtaacttgacttgtggaggaaacaagtatcatatgtaggtatcatccctttacaagacaccgacagctgacagcccaagttttttctctctctctaatagacagccctaatgatatttcttaccatgatcagggtagccctacagagtatttgacattgattatggcctgttacctgttattagacaccacatgtataatttggattcactgaatggtttgtgctacgtcttgttactgatgactgttaatcattatgttgctttttctacactgttagaaattttatgacatggcagttagcgtagtagacaagttggatcaatttattaatttaactttgcattagcagggtcattttcccttttgctaattattgttgccataccttctcactgtccaagtatcaacttttataggaagagcaagaagaagctctgaaacaactaaggaagaatctggttattagagcaaaacccatgccaagcttctatcaagagggtcccccacctaaggttgaacttaagaaggtgatgcaccgatctcctgctatatgtgcttgagctaaaatgattatttctgtttttcgatgtgtgctcattattgttcatgttgttgaatgcaattttaattcaagtgataatatctcaacccattactgtttagatcttttccctttaattgaactgattgcgtatctgtaaaaacatactcgactacatgcttgttcctattgttatctacataggccctgttcaactgcacttgtttcaactgtagtgcagccaatccaaacagtactatgtgtctgtagctgctgcagcaagggctgcattgcagtgcagccgaacagagccataattaaattgggaataccctgaatgaacaataagagtacgagagatgtcccaggcttttacattacttaaaagtagttaatgttttttctcgaacacgcagggaaaaagaatagctaatgtaaatgcagtatttatgttttcctgtatgataataatagaagtgcacaatgttgcatgaagcattggtatgcaagctgctggttcaactggcgaccattaacttgccaacttttagtatgtgctaaacttgccagcttttagcatgtgcaatgttggtattcactttgtcttttatttataggtgcctccaactcgtgccaaatcaccaaaattgacacggagaaagagctgcagcgatacccctcatacaccagagggtaaaaatggaagtgcagcatgttgccggttacatcgtcacagtattgggaactccaaagaagttaacagcaggacccaatgttctccgaagagtgctccaaagactggagtagccgcaaaacccagagcgaccaagggcgtcatgaagaatgtgggaaagccaggtgctgcgaatgttgctgtacaaacctaactcatgatccattcccattcccgtgcaatttttcgatttaatttatacctcacatcgccgatgacggcatcatgtcccgacaacagtgtgtttgttgctggattattttttttgcattctccttgtaagaaccttggtacagagaccatgtggtattccgtgttgtaaatttgtcgaggttttgtaagggggtaaccgagtcagtgctgtaagaactaatctggcagccgataggctgttggtgtgacattgttgttgatgtatggcggcgttcgcagatcctatggtattgtatttaagcatcaacttgttattgttgatattgttgcaaaatctgcgaagaatgtctgcatatttgaattcgggatcgccaaaattctgggaaaaagtacagagaagtactgaaatggcaaatacctccctcatgcattggatgtctctctctacgttctgctgctgccatttggttcaaccccattatcacatggaagtacaaaactttgaggagaaaataacttcgaaatgttggatgcacacttttctttgcaccaaaaataagttgtcaaaagacttgaggtccacatttgtacgatttggttgataagatctgactttgagcaaaatcgactctctgcaaaatctttcttgcagtgagccagctgaggaagccatgcgaaaggcaagcaatgcatgcacgccaccgaccggctatatctctatatatcagcatgtgcatattggttagtgtcatgactcatgagcagttgtcaacatgtcaggcgcttctagtacagcgacctgacgaaacaaaaaaaagttggaaagcggcaaaaacacacttttgagtcatcaagaattgtctttaaagccatttaatttccaaggagacttttgagccatatcatttttttaaaaaagaaacacgttataaaaacaggtgctcatatacgtgtgtacatacggggtacggcatctacccaaaaaagaatactagatttaaaccactcatgacggaggaagtaactagttgcatagctcaacttcacacttttgagccattttctagaacaacttatttgaaatgaagtttccttttctcttgaaaacgtttgcaaaagcctagagcccaacaattaactgaactaaacatgcagctctcatagaacaaggggtggcgatcgagctcagggttcactatctgggattgccgaatcatttcaggacaccaaaaaatttaaatttcggatgttgaaaaaaaatctgaagtttaaaatggtttactaaatctaaagaatgattttttttccatggaaaaacgtcctacatgaacccatcggtacatccaaaattgggaaggactggggaggattatgtttgtatggaaaaacatcctaaacgaatccaccaataaacttgaaatttcaaaaaattaggtcagaaattgtgaatttttacgtgttacccctgtttcaaattataaggcctataattttttacacgatttttaataacatattttgattattaatttatttcgtattatatcatcaacaattataaaactagtatcacatgaaagtattttaaaatacgaatctaataacaataatataacatacataatacttggtgtagatatcattaatgtaattattaataaaaactatcgagtttgatttttttcttaaaaataagaacatcctataatttgagacagggagtactaatcatttttcttggtaaatgtgtcaaattaggcctctaaaatcacaacccttttaattgaattctatgctccgattactgacaactcggacaacatacagctgacctttgaaaaagggtatattgtgatcgagttaggcccgtgccatgatgggtggttatccaatcatccaggttttgattcaggtcgtggcctgcaggacaatactatagttaagagagaattaggccctggtttgacatttctgatagccggcacacattttcttccatcggtttttcttttgccacgcgtacgtgcatgctgccggttaaaggcccgtttgcttctaagtttagggttccttttatttaataattttggttttttaatatataacatcattaactttttaagatatgtctcatcattcttttttattttataacttaatttatctttaaaacttctttaaaatgtttgcataaaagaattatataagacgcatagtcaaatgtaaatctaaaaatcaacgatgtcatatattaaacaatgcattggctccatctttttcattaatcattttgcaattcaccgagcctgttcaataatatggattttacagtaatttcatagaaaatagtttaacctgtatatgattgtagcattctagaggaagtaaaataacttggtggcactatgaggatgtgctacttcaaaaatcctctttccaagtcctataataatcaatggattgacgggctgatagtggtagagctatgaattttgtaaagccatgacaaaccttataacccaaattaactaagactatatatgttacaaatctttagttaatttgggttaagactatatatgttacaaagtaaccttataacctcattattttgtgtttctagctgggatgtcgctcggcaatagccattgcatgttcttccacctgtgggccgggccagctgattccacaagtttttgcacatagttatggtatatatataccattgatacttgaatcaaaattcatgaaattttaaaggttattgaggaattgactcccttgcatagggcgtgaaacattggcaatcatccattcagcccaaaaggtggatcctcctagtagatgatagtcgattcgactagtgttatcctagagattctaggatcgggagttagaaacagagtacctattagtaatgagtatgtgcataactttctagtatgatttcacagttaaacgttaggtactataaatcattaatatttgaattaaaaatcatgaaattttaaaggttattagggagttgaccatcttgcagggcttcggttctaactctgtcattgtcgctcgaccttaatggtttgagggcataaactcctagccatccatcccgcctagaaggtggatccgcccttagatgatgaaagtcgaatctaatcagtgtttatactgctaaagattctaggatctggggttagaaatagagtacgtgtattaaggaatatccgcatgcacatagctaacttttctaatatcaagccacaatcgtgcaacatacatacatgcacctaaaagttgacaaaaactcctaaccatccactgttgctaaattagatcgtgcagacaacattctccttcttttgacacatgagcagggaaaaggtcaccctgcgcacccatgcatttccatgttgcttcccctggaaaaatgcatgcacgtacggcagtctgaaaatgacaccaccgatcactgatgagtcgcacaccgtggtcgctctgtgaattgatgatatatatccattgacaacctcgtcaactctgctcgacagcttatctagcaaaatttcaatttgaaagttatttttttactgatcgatctaggtatttttacatcatatatagtctatatattttctaactcttgcttataaaatattaagggcccctttgaatcgtaggattgaaaaatcataggaatatgaaaaacacaggaagtattatgataggaatacaagtataaaacagagaattgtaaaacataggaaaaataaaggaatgaacatttgattggaccgcaggaatcagatgagagagatagactcaagtgaagttttacaagaggttagagtggatgttaaatttcctacgtttttcctctagaatcgtaagaataggaaagtttcctacgtttttccttttctcatttctacgaatcaaaggcatggataacataggatttcaattcctttatttttccttcatttatcctcgaattcaaagaacgcctatgtttatattgtgtttcttaaaaaacagtggaagtgcaaaatattgttttaaattatttttggatgcttcgtttatcctttttatgatttaccagccgtggctcaaccaatcagtcacttcgtctcccctttgcgacaaattattaacgttgtttctaagtcaaattccaacgcaaaacgtctctctctccccatactccagtaactccactagtgatgacactgcacacaggcgatcgacaatatgtattcatgcatgcatatgcatccgtgtgactataaatatgtgcagagagtgcaaggacctactgcaagattgggcaccgatagaattaagcatttgatccccagtcaaaaaaaataaaaaataagcatttgatcgatcgatcgatcatgaggtttaccgcagtggtagcagctattgttgccgtcattcttctcgtcttcctggtctccggcggcatggcggcgcggccgatggtcaatatggagaagaccacggccgtgccggttgtgaggaaaagtggtgtggtggtagagtcgtggacgatggagagctcgtcgctgccgtccggctgcaccaacgggaatggcgccggtggctactgccgccctcctgctcctgccggtcactaattaattaggttgccgtcaaccatcataccatatggttctatataaggtttaccgatcacaaatttgatcatgcatatagttaagatttagcagatgaagcttgatcgtattcttatagcagtatataggatgaatgggaaataaaatgtatgaacatgattgtaaattcttggtacaccacgcctccagatatgtaaccccaattaaagattatatatttatatgatattgataatatttgttgttatctttatcctaaactagcatggtggcccgcgcagattgtgcggctagcatcattatattttctctcatataatagcatatatgttttctcattatattattcaaatatattaaaatgacaacataattttaaattttgcaataactttacaaaactactaatgtttaatattcatattatattttatatatgtgttagttattaattatttttaatattaaattttagttatttgtaaattatatatattcctatatggactccagactcgttttttaatatttctttttttttattccgaattttctgtaaattgtatttctatatagaccctatgctcttcttccaatattatttattttaatttctgaatttttattatttctaatggtatttctatgtggactctaaattcatctttcaatattctttaatttttaatttcgaatttcagttacttctaaattgtattcctatattgaccttaaactcttcttcccatgtttttcttaatttcgaatttcagttatttataaattgtatttttatacggactctaaactctacttttaattttattatatttattccaaattttagttagttttaaattcctatatggactctattctctacttctaatattccttaattttttaattccgaatttctattttttttcttaattgcatttctatatggactctatactctacttctaatattccttatttttaatttcaaatttctattatttcctaattgtatttctatatggactctatactctacttctaatattccttatttttaattccgaatttcagttatttcctaattgtatttctatattgactctatactctacttctaatattccttatttttaatttcgaatttcagttatttcataattgtatttctatattgactctatactccacttttaatattccttattttttaattccgaatttcaactatttctaaattatatttctatatggactctagtctcctcttctaatattccttattttttaattcgaatttcagctattttctaattgtatttctatatggactttgccttttctttttctccgattaatgtgagaatttctaaaccatgagagcgaacatggaggctaccttttctattcctttaataatataatagattatagtaatttttaactatatgtccgaacatactcttgttcagatagatacatagtcaaaaattgttatattctgatacacggacggagtatctggtaccatcatcggtaataagtattgggtgtttataagatttcaagtacaagattaatttgatcctaattttcattatatgatcgtcctggcggctgtacaagctgatcgagttctttgatctcaatggataatcaactaaccgtgcgtgtggtagttgcaattagttattggattctttgctatctgaactatgattaatgccgatgctgaaacagtagaaaaataataggaatgcatatataggccgcatataaccctcttaaaactttgatattttcctgacaaaattaaatgtttatatggtaaatagaggccgatacaggtttggtccaggcccaaaccagcccacggtatattgtgtgacatcccggcgcagggcttaatagaatactcatatcaacaagttaatctataaaagttgcgcacgaggcgggtagttacatattagatcaaggcatgcctctgcatggtgaaaataaatgcctctaaaggggtagcttaagacttggcgctgatgataattaattagatttattttttcacgaacgcgtaaaagattgctcgtaaatatatggtaagtagatttagatgtaactacaaggtgcctttgaaatttcaagggatttgacccatcaaaagccagataattataaatatttgatctgtagtcatcttagataaactaatctagttatgtgttggctaaaattgagacccccccctttttcacttaatttcggtcatttttatcctatttgattgcttcctctcctatatgtaaacatgcttatttctcctatctcttcttccaaatggataataaattatttttaatcctaattctcttatacatcgtgtattagaaaaatcacaatgaaaattacaatataattactctttaaatttgaaaaggcacaatataattataaatgcaagaatatatagtttatacaatataaaaaacaatttgattgttcttttgtgaaaatatgacgctataagtataactactctcccttttgagataacgtgactctacaacagacgagagaattattgccatctatatttggtgagtcccagccgtatctatagattcaatgaatatggccacatgcccacatatagctagcactaatatataccatatccagagacatttacagtatataccaggccccgggtcgcccgggccactaagatagactttatgctccttcggttaaaaaaattattttaacttttagacaagtttttatcatacttttagactttggccatcataataatttctcaaatgcttaatgtaaaaacaatgaagtgatatgcatagatatatcttgaaagatataatgatatcacagatttattagattttttactcttttttaaattattctaatagtattggtttcaaaagtcaagagaatattatcttataaatgtcaaatatttacaacatgaggaatagcattagttttcatcatggtagcaacaatgtgtcctaaagggactggcccaagccgtggcccattttggttttctcctgacccacaatgctaatcactctagaatgcagttattcactttttttcttaaggggctaataatactcatacttttccataattccattggtttgttttgtgctacaaattcaaaaagtaatagcacaaaacgccatgttagaactataactactactccatccgtttcatagtataaaacgctttgacttcttcactaatctaattttttaagtttaactaagaaaaacatagcaacaatttcaacaaacatactatagaagtattttcaatgtgggattcaataaaactaatttagtgctatagacgttgctaaatatttttataaattaatcaaacttaaagatgtttgcttgaaaaaatattttataatataaaacggagggagtacaaatctacgacgatgatcagaatatcagatcacactgtgcagtgtggccaaaatgtccatgggagaaaaaccagccactcctgggccgatagcccggcccatatctggtcaagcccaccaccagggcccacgggcccatcgtccctcctactcctccttcccctcgcgaaaaatatattttccttttccaccattcccaccgccgcttcgttcgccggcgatcgatgagcgcggcggagctgtgc

SEQ ID NO: 2198 - DNA, 38905 bp, Oryza sativa
  unsure (1)..(38905): unsure at all n locations
gatcccctcccccccccccccccacgaaattctctctgatcgtcgcgttctagatgttttgggggggcgttttttcggaactacgcttggttttgggggggttgattgattcgaacgggatggagagggtatggtatgggtgtaattgtttggaggtttgaggggttggatgaactctggtgtgtgctgggatgcgaaatggtgatgggcaaatcggagttgttttagaaacttgaggaggagaagggctttgatgagaaaaggcgcagcactgcacatgctttttgaagtttgaagtacaaatgtgtagtataaagtgctataacccatagaagtcagaagttgcatgacactatctagttaaggttgtaggtgtagttatactatcagagctggtttagttggatcgacatgcgcgttaccaacttatgataatatgaattgtagtattacacaatgtttttttgttactgtgtaacgatttctgatgatgcttataaagcttaattataaattggtgatcttttttttttaaatgcaggtatgagcagcttgaactagaagggaaacttttggaggtatagagctttttggtttctttgtttgataaacttaaatacttggactgtgagttacatgtgatggttattagttaggcgaaaaccatgttggttaacaaaatttactggtatgattagtcttgttttcacttatcgcaatgtattagctctatctagtgagtggcatgctgctaattgagcaccgacttttagggggaggacttagactttgcgtttgacagtatttcggccttctcagagactggagaaaaccaggaagacacatttctgacagaagaaagtcttgagcacatccggtatgtcatatctcgtcttacacaggaaaagcattcgatgctcctcttgtttggatctgcatatgtagttgtccaccttctgttgtgatgtttacagattacaagtataaatatttatttggtttaacacgtgttataaaatggcatcattccctaatttatttggtctagatgctttggtaaaactgaactcctacattgagagtgattgacagatggttctgtcagtggtagcgcagccccacatgattcgctccatgtcaacacctagtcttatctcgttaccctgctgttttgatctcttcattgacataggattttctgattatttgttacagtgactcaaagcttacactcagagctgaagtttctgatttggaaaggcagcttgcttctcttgaatggcagcttgatatgcttacagcacaagctaccaccattactcagggaaagaagtcacgtgtatctgctaaaactaatcctaatatacaaatttcaagattagatgagaaacttgctaagagaagtttagaggtaaaatgttcctttgttttatcatccaaatcagaggccacattactgtattctactgttcttggctgtattttcatgagatagatggaactgaaatatgcttttcatattacaccatgatactcatgtctggctttagaacctgtcacctatctagcctataatcggttggaacatgatagtgggggataactaaccagaccagtagactttatgatctaatggcctacggctatcaatgttatctgatcgtccgattaatcgtgattaattgtcctgatcggcccctaactctgatcagggacattcatttgatcagctcgatcagaaatctgatcgtccgattaatcgtccgatcagagcacctatcaatcacttttagaactagtcttaaggtttaccacatgtgaatatgtgctactactgctagttgctttatactatggcaagtgagtgaccatcttgccatcaattattagtactgggattggtttatactatccctatatacaatatcggtctggaatcatagcacgaacaggccgattaatcaaggtggattatgacaatcgacctgatcggcccttggcgatcaggatctatcagcgatcagatattgaaagctataaccgtagatgcgaaaaaaggaaagcgttcactgggctgtttgttttcacagatttttatgcatgttgatgttctgttttatggcataatcaacactccatgactaatgtgaattaaaatatatggtactctctagcctgtttgttcagtgttgtgcatcataaagaaggttgtccctcagatattttatttttccttttgtttttgtaatcctagcagatgaattcattacttggaaaacttgctgctaccacccaggagttgtcttattatcattcagaagctggtattcctgctgtctttcacatgcagttatataaagattacattcatcttatcagactgcattactgatattaaaatgtgcagaaagcctgataactccattttgacttgcatctatgcacatagagatactgaaataaagctcatcatatgaatccgatgcttgtttttatttcttattattcttctgaatacattttgtcttccacctttcctcacagatattggaatttacctatcatacagtgacttccagtcttacataatccaaaatttggcttgtatcaaggaactaaacagatggttctccaagaagtttgagaaggtattaacttattttatgcctaaagggacaaacatagtgttggactgttgggacgtatcttgatacttgaacatgcaaaggcgagcttatttgatcctacacaagaattattaaagtgaactcaaggtcattgtcccttatttttctatttgatgtgattcatatctcatatgttgataaatactataaaagactgtagtatgttaatttgttttcttatacagtaaattaaatgtggaattatgataaattgccaaagtaaattaatcttaaattcacaatttagctataacctttatttatcatctgctgatttttttttgggtggggatttgtcaaccagggacctctccaatttgttgccaaagaagacatgtcaagaggtgagggtttaattgtttagtagtcatcatgcatgtagtttctccataccatacatttcacattcaatacttgttcttgtgtctgcataatgtttttggagaaagataccttgattctcagcaatatattactttttatgtgaaatgttagaagttcaaattttgcatggacacatgttattaaacaaatgcgaacaggtcctgttattttattcgataactcaagcttcctggtaaaaggatcatgattaggtaaccatatagatttcctatttttgtgcctgaagaatttgtgccgttcaattttaccataaaaattctgtcttcttcactgagtaagctaaactggcttaaattgaccttgaaccatgataggagatattatgcatgtccttaaattgatgttagtatacatatttgtccaactgcttctcttaaaaaattgaaaatataagagtggtctttctcccttagagggtgcaggagggtcattgtaaacgaagggtttgatatcgttcttctccactggtttcatggttcactttgctgctatgtactatgcactgttgatatgtttattaatatgtatacttgggttaggtattcaatatgaggtttaacaactttaggcagagatgaattagaaaacagccaattttccattcatcttgtttgcgcaggagattatgaagggtcacaccatctttctgttgaactgaagcgaattaattccatgtaagtatttattagtctttggatgtcaccgttctacccttttttgtctttctattgcatatcacttcttcatgttacaggactatcccatttgtctttccattagggaaaaaaaaactacaaaaaaaactgtgccatgggtcgtcacctgtcctgcctctagagattcaagtggcccacctaatgtcttatacgtgggtcagtgggccagcccacctgcaggccacaaccctactctctgtgttaggacttctttttttgaatattagttctgcaaaagtgatgcaaattcattatgaaattcaatgaactctgccttctgatgaatacaccttgtgttgttgtagttctataaggtatttctttagctcatttattagttagttcttcttcaaatggatcaaccttttgtttttgacaaaaacaaatggatcaaccttccaaacacccacttcccaaactttgttaacaatatgcttaaggtagaaaacttctgacctgattacccctattaaatctgttttatctctaatttagcctccaagtctccaacttcctcagtcattcaggtgttttggcatggcaggcagcttcatacgaggtggtcaagctcaagggcattcatatctattagcatttaataagggtaattaggaaaaaaagtacctagaaaacctaaaaacaaaatctattttaggaaaaaatcaacatcgtaaaaagtcataaaaaacggaaggagtatttaggcatagcaatcccccctatcattatgagagttgtcttgttcatttatctttcctactttgttgtaaagttcataaaagagttaacataacaatgcatagaattacttaatatgcttcatatagtcacataacatcatttttttacattttatttgatattttaagatgcatgattattgttatgctgatgcttggttatttgttaacagattcgctagaagcaaaagacagtacatagaagcacaagcagaatatgctaaggaggaggccatactctcaacgcttagaacccaattggcatcccagcagtcacttgttcatcaggatgttcattctctaaggtatgcaagacatggataatcatagctactttattattttctaaaaaaaaaagctgtactgaaatagcacagcatcattattttgagctgaaacttttgagaacatggtactatccttatgggacatctctaaatgaaacagcttggttccattgtattataatgacatatatttttttaaaaaaagtagattgaacgaaatctaccagaaagcgcttcatctttttatgagaacatttaggttgtatggattgtttatttattgtatggtagtacttgaacaaacctttgtacatgtgatgtttcggaaaattttcacatttcattaattaagtatctgcttttatttttcttttttttttttggatttgccatgtcatcctcaggaggagaaactctgagtttgctgaagagcttagggatctttcacttcaagtgaagagatgcctatctgaggtaaattattatgtacatgaaatttggtttttaatgtaccatggataagcaaatggtttatctcagacgcttcagagttctttaattaattgcattctgtgataccttgggtcaatgatgtattcctatgaagcacactttatcaacatggtgtcacagccccggcaaaataataaaaagaatgtacagttacgctaaagattgctccaaaaatgcaaactacagaaaactgacatgttcactggtttgtctttgcaattatgtatctgtcaccccttcttcaatttactctgttcctgctgcttatagccaattttaatgtcattttcatccgtttggctatcttatgcattaactgtgacatattattttctttgtgagtgacataaaaaaataatgttttttttaactttagattattacaagcctgtgtgctgaccttgctcaacttgagggtgcaaatattttgcaaggtgtgatcttctcatgaatcatcatttgaaaatgctttgctctgttgcggcaatataattgcatgttccttactgtgaccttccaggggatcataatttgaaggttctgcgtcaggaatgctacataagccagcagaaaagggtatcttttgaacagtcagttgttttggtgcaaaccaatttcctacataaataggtagtcactgaggcatttcttcattcttgcagttcatcaattatctggttaatcaacttgctgctcatcagtttctaaagatagcttgccagattgaaggacgggcaaaaatgtcaagtgcctattcactgctaaaagcagcagcaatggagctgcagggttacttctcagttgttgatggccgtctggtattgctttctgatgttatatttttatttgagagtacattttgttggttagcctcttattattatccactttgtgtacattcttacaaaatatagtctgtactgcacaaatgcataggaccgatatcatttaattggtcaagctgcatctgtaatgcttgaagaaggatctattgatgatcgtgatacttttcttcatgctgtgagggatattcttagtactcactcaggtgagcacacataggttgtaaattgtatccacattctgtaccagaagttgaacaattcattccccttccaattttctgcaggtgctcaagcaatgactccatcatatgtttcagcatatggtttagttgagcagatctcagatctgcaaaatgagctcgagtatcttcatcatgagcttgaaaatgttcttccacgtgaacgcaaaagatgtatcgatgaactgtgagtaatattcgcatattgtttcctgaaacttttccccttgataaatttgaccattttctgtgcactgtgtagttgaactgttgaatctcctttactgtgaattatcaacaggagaaatgtgttaacgttgaactttgcattcatcaacacctattgataggactgttagatctttggttcaatcattacccatgctttctccattcctttgcagatgcaggatgatccaaacactcgagcaaattctgtctgtaccatttacatatgtgcaaccaacattgacaccatgggtacattccttctcatatgtccctactcttccatgccacttcgtagtttgttctgatgtactactttacttgtgcatgatttatcacagcctgtagcacaatcgcttgaagaattggaaataatcaaccagcaagtctctgcttgtgttaacgaagtaacgatggctcgagataaaaaggccaaggtacttttcatctgttacttcctcacattggtagtgttcaacagctttaggtagtttctgcatgttgattgagaagtcatgctctcaaatttacaaatggtttgcagatgttacaacaaccttcgcgcaatgtgcagcaggaaagacgagtatttgtcgatttcttctgccacccaggacggcttgagaatcaagtcagagagatgagttcccatgttagagcactccaagagtgatcttcgattttgctgtgaagaagggcccaataaataattcttttgattcttaaaaaatcagcatcgtgcaccctgtcttctgttggcagaatgcaggctttttgcagttgtatatcctcagcataaaaaaatttagagttatggtacagattttcttctatatcgtccataaaaatatacgcagcctagtgcttcaagaataactgatgccgtgtttaagatgttcggccaaaattttacatatttcgcctgtaaagatgctaataacaaaacaaattatagattctacctgtaaactgcgagacgagtttattaagcctaattaattcgtcattagcaaatgtttactgtagcaccacattgtcaaatcacggcgcaattaggctcaaaagattcgtctcgcaatttacatgcaaactgtacaattgattttttttcgtccacatttaatgctatatgcatgtgtccaaatatttgatgtgacatttttggccaaatttttttggaatctaaacacaccatgaataacaaactaaaaagttgtatataattactagttttctcaaaactctgttcgttagtacttttgtggtaactaacagtgtagccttttttttttagggaatggcattcggttaggtttattgatccgaaaacatagttaaatcattattgctattgccattctgagcttggattttgtcttaccccgtgtgacaaactgacaatgtatcatcttttctggctattcgaatttaaacacatgatgcaataataacttaacaaaaataaatcaatgtggttgcaactgaagttactatgtcacgtcacattgcgttgcatatttgcatatccttcctatgcaatgtatatttgcatatccttcctagcacctcttcatagcgaactttaagtttttgttcttagtttgtgctaaattgctaattcgttgatctttatacgcagaagttttgcaggagttagatccaattcaaaaaattccattttccagatttggccaaatggttctatttttcttgatttctgttcgaatttgactgtgccaaatgattctgggaaattttgctacgctctacggttaaaaaaaatactagaagtttaaaaaggaaataacatttttatactctctagttcttcttagaaaataatttgaataatttcatgcaatacagaaaaaaaattagtagtagtattttattttattttcttcgaattcagaccgagtcatgacagttttcttgagaagatagcagctccacattccctttagctggtttaggctgtgttctgcactacgaaattgtttggttcacaataataatttacctcaccataccataacttaagttaggcatgttttactaagttaggcgtctgtttagtttgtgccatacttaaggcaaaattcattcactgtgatatgagtttcacatgtcattggcatataaaagtatgtcaaatttgctctcttatagctaaagtgtggcttcaaatttgttaagcacatgttaggcgtgttagctaacggaattatggcaaactttggcaatagtgtatcccaaccaaacatctctacatttcacaacttctgctcttttattttctatacagaagctttccaaactgcgaaatttgatgtatttttttagaaaatatgtaaaatagttgttttaataaattatattaatctatcttctaggttttttatctaactagaaaaaatgcccgtacgttgcaacgggtaaatgctattttaattttattattattatacggtttagttatggtaaaattcattagaagatcgtgagctatatttcatctttaacttagcatgagtttttttaaagagatttcttatatgactccttttgtattttcaaaagcaaacgagtttaaaatccaactcaaacacagatctgtatttttaaaagtaaacaaacttaaaaactaactcaaacacagataacatattaaaataccaataaaaacatcttcaattctattctatttataatagtagagatagagatattaatctaacgcttatctagcaagtggaggggaaaaaaagtttccaacccagccaactggggaattaatgtggatccggtccaccgaaagcggccatcgaccactggtccaccgtacaacggcttcacgcaaacgcatcctccttctcctccacggctctgagattcgccagcatcagttgaaggcggcagatccagccgatagctcgcccgcgccatttctcctcctcctccaacctccaaatccgttgggagtaacattatatgattatatatgattatatagcattcaacattattaatctttatagcattctagattatgtttaacaaaaatatttttccacttcttagaaaactagttaggtaccttatataattacaatattattaacaaatataataattattgtttactcatgtaaaaacatagataatatatattacggagcacacacatatgagttagatgctagtattcatgtgcaagtatgagtgctgattgtagcaatattattatcaaaaccatgtgtgtttgagctaatgactaaacctcttttttttattaccttcttttgaagttctcctaacgcgtttggtaaaaaaatgttttgttttgaataaaataaataaacttttttgactagattattttttaagagaatccactgtgtgccgctgactttgtccttgttctataatatggcactgagtttgttaagttatacaatataccatcgtattttgcttaacctctataatataccgttggcgtgcatttaaactttcgtaaccctgtataattttgttttaatgaccgaaatatccccgggatagaaattcgaaaatttggccgaatattccgaaatatcatattataaacaaggcagagaagatatccatctcaaactttggaaattttacaatctggtatttggaatttttcgtcccatggctatttcggtcattatgataaaattatataatactaacggaagctaactagacgacgatggtatgttatagatgttaagcaaagtgctatagcatattagaacttgacaaacctagtgacatattgtagaataaggacaaaatcaataacacacgatagattctctatatattttatggttgtttagttcattacctatctactatcgtgcgacatttttataaaaagttaaatcttatactataagttcatatcttacacattaaattacatacacttataatataattttgaaattatacaatgccctcttcacattttataggagaaatatgaaaaatgatttattatctatctaattatgagaaaaaatattagtccaaattaatgtatatgtagaaaaaaataatatgaaagaattacggaaatatctacaatcgtatatcatgcagtgagaaaaggagaccataatcgaatgctttattgctgagcaaaattgatggcattaattttatctttttttagctgaatctatcttgccataattaatcagcctgtgttaatagaagtctacatcttcatgcgtcaacatatcatgagactattagtaatagccaagtacactgacccaacaatacttaatatatcacaagactatcgggtaatagataactcatctttagttgtgcttaagacttagtatatcacagaagtatcgggtaatagacaactcatctttaattgtgctaaagaaaaaaaagtaaattacagttcgtacaatgtattcttaaaaattttcatattatgtcatcctttaaccattctttttatttacagaacaactaactgtacatttcaatttggaccaccttatttcatccatctccaagtccagtgactcagcaaccacacactaactctctctctccattttctttttccctctgacagggaaccgctagctccagcaagaaggagcctgaatctagcgtctccgcttttcatcgggtcgactcctgcctccgtgagtccctacaatagtgtgcatgatgagagggagagggaaaaaaagtggctcatgcagtgtaactagagggtgcggttgcacatgcaaagacagtgatgaggaacgatggtggctcatgaagaaagagcagtagtggcggtgcgtggaataacagttagtggttgctggtagtatgaggagtttgctgttaacacaaatcgctaaccgatcgctaaccgagtttgttaatttttagaatgtgggccactagtcattataaagaaatagctagtcttaaagtagtaaaatattgagataaaagtgagagtactcgtctgaggcttttaaatttttgccacttttaaaatggtactccctccgtcctgtaatataagggattttgagtttttgtttgcactgtttgaccacttgtcttattaaaaaaattttggcattattattcttttttgacttactttattatttaaagtactttaaacacaacttttcgtttttttatatttgcacaaattttttaaataagacgagtgatcaaacaatacaaacaaaaactcaaaatcatttatattataggacggaggtagtaattaagaatttactactcaccgtctataatatgaattgtgtcctacgtgtgtccttattagtatatgacatgtgtgacagtggcaaattcttaattctcagtagttagagtctcgagtgtcttcccttccctttgtgacgtaaaagaaagaaaatctcccgtctcctgccgccaagacgagtcgcggctgaacaggggaggggcggcgatctccatctggcgagcagagcaggggagaggattatggtgagcatccgcatcctcttttctgattcatctctctctcccatcgggtctggaatttgcttgcttgcgttcgttcgttcgttaaccctagcttctcttttagatttggaagaagctctttccttatttcagagccttaaccttaatacaactatacaagtaacagtttgtttgttggatccgcccctggtgagagagatgtttgattctgcggtgagattagtatagctagcatatgcatggagatggaggtcagcgagtcaatgtcaaaggtcaaatgcggtatttattgtggtaaagagtactggtttagttggttgaatctgtagggtgcagtatagtacagtagtgtgcaatttgtgaggaagaattgatcaatcttcctccaatttgccatttgccgcgagcattttgcttcgcagctttggtaatttcagcttagtgtcctgggtcctggaatggaaaagcttcagttctctcaagctggtagcatagaaagaacacatgctagcatactagtatactaccgtactgccatacacataaataaaaaaccgtactacaacgagtaaaccaaattcaaactcatctccatacggtgcagctatgtgtgctacaatttgtttttccaaactgatgatcatggccttgtgatggtctttgtaggatagagaagccaagaaagaggcgttcagaaagtacctcgagtccagtggtgtgcttgatactctcacgaaaggtttgcattatgttccttatgtgtttatatcaacaaattctagttatgccactggctagatacattatgattaagtccaccttatcatcttgcagttcttgttgcattatatgaggagaatgacaagccttcatctgcggtcgagtgagttgatttgactataagatggcatgaataattgattgtcctggaagaagccaacaactaaacatgctggtatatcccaggtttgttcagcagaagctgggtggtccatcaatatccgactatgaaaagctcaaagctgagaagttggatttgcaattgaagtataatgagcttttagagacacacaaggaaacatgcagacaggtatatatatagcattttaatgtgtttgcgtaaatgcattgctactcgatctattcatatggacagtagcattttgtgttacaaccttaatgccatgttagagatggagatctctatggaaatctaacatttacttgtctatcaagattggtgcttatgtgtggtcacttcactgcagttagttggctcttgcactttggtattgcacgtgtttaggatctccaccactcagataatacttcagtggtgtacttttcagtccgattaaactgtatgaatttaggtgcaaatacacaaatgaattccttgactgtattttgttagttctgtatatagcattctgtcctcagcgatgtttccttcttcatggttgtgcctttcttattgtcttggagttttccatcagcccataggatagctatagcatctgctgagtaatcggctggcacacagcaagctagatggtattcctgaatcctgatggacccaatttagatttctcattatgacagttaacatcttaagcacagttctgtactttcaggaaaaaaataacttatgaaaatctgataacatcatcatatctgtctgggttcagaactgtctctttttgttcctttttcagtttcatttggatagcttactttgaagtccaaataaaaagattgttttgtatagaaagagctgggcatttgatcacttactctgcatttctcatcgcagctggatgagcttaagaattcgaagaacgggagcggaaataacacgtgttgatattgtgaatgtgttgtcaagcatacttatgcatctgcatccatcatcaagtcgtatgaaatcgaaacaattgctggtttgaaccttgccatttgccaggttcacatccaccctccaatgtatcatatttttgctcgtcgcccttggcataccagagcacccatgagtctttcccatattcgtccagaagatcaaactccacactacctttcatgagcaaaagatgatcccacgcaacacgatttgaagagttgatcgacttgtggaaaacctgttgtgtggtaaatcaatagtatcatgtaaaatttgtcttatctcttcttttcttgtaacaacgaggttgtaatttcttctcttatttaatatagtataatctaccctgtctcagagaaaaaaaatatcatgccaattttgtggcctaataaaacaattggtttactgtggaagcattttcatgcagaatcttgtttgcctctcagtttataagccgctactaaaatttgaattgcagaacttaattttaaggtttttccatcgtaattcttttttttagcattacctttaaaatcacggataacacatatataaatatatgtttaaaatttttatctataaattattatttaagtttattctacattgtttttacgattggtcagctgtaggccaaatctgttcttgattgtcctttcgccactcaatttgactcgcggacttctgcttggatagctttgagcctttggctcttggtgctgaactgctgaacacagctccgctcgtacaaaaagggctcgcaagtcgctcctattttccgtttcttcgttttgcttttcccgttttttttgcttgctgcctcaagtttgctctactgtactgtacgggagtatatactacatctgtaccatattagttatcgttttgggttatttagggtctatttggatggctactccaatttaccacgtaacaactcacaagctagcccatgccacaagtcggacgaatgatttgagcaccacaacattagcgaagaaacaagtggcgaagtggttcatgagcatctatcttcttacggtagactaatgtgcgttaagcaaccaaactatacgctaactacagcacctatccaaacaggcctgcagtattgattaggttcgaggaaaaaaatattataatgtctcttattaaatgatttatggttagatatgagaggatgattggaagtaaaaaagaaaaaaaatataaattattaaaagtgattgatgaaacaagtaatactgcgttctgacatctaccgtggcttctgtgccttggttctacagtacttcattttgttttacgttgagtagtgcagtgatgaggccaaactggccaagccatgagctgtgaattgtgatgaacagaacaccaccgagagagatagagagagagagagagaggcctatgcacctaggcgcctacctgactgctaccgaagcgaaaggcacagtgaccttgtgggtttggtgcagtaagagtaggtataatagcaggctataagccagctataaatatattttaaagagataaatgaagagagagaagagcagcgggctacagatctatagccagttgcagcacaggctccaagacgtaatgtgtgtatgacaggtggaaccagatattaatagtatagcaagcaactattatatgaattagctactacattgactgatttagagctggtagtgggctgtactatcaaacttacctctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaataaaaacagagtggtgtggtgccgtaccaacaggcaacagtatcgaggaccagtggaccacggccatccatccatccaacggtcagtttttcttgcagcaacgccggagccggatgtcaagcgcaaaacccaaaaatgaacaacggaaagcgcacgcgacgactctccgcggcccatccactacccccagcacccccaccacccatcgccacaagtccacaaggaccacaaccccctctctctctctctctctctctgtgtggtgggtgtgtcactgtgtgtaggtgctctgtatctttgggtggagcaccgaccaggaccaagtctctattcggtagtacaagttaccaactcctctgtctgtttttcacgcgcacgttttttaagctgctaaacggtgtgttttttataaaaaaaaaatttatatacgaaagttgcttaaaaaaaatcatattaatcaatttttaaaacaaatagctaaaacttaattaatcacgtactaaaacgctgcttcgttttatgtgccgggaagtctcgctagtagctgacgggaacaaatgcaatgaatttattttcttctttatcccaatttgaaaagatttttgtgatctttttaaatttatcatcatttaaccggtatatactcatttatttgtgtaaaaataaatgacatcgtagtatggtatctaatcatttacataatgagtaatgcatattagtattctaatgattaaattgggatggagagagcaatacaatatttatttagtatgcaaatttatttatgttaataccttataaattattttaaaagttattgataagcaatacagataagcatatgtataagcaaaacaatgaaactgtaaaaagcagaacatgtcgtttggatatatttcgagttacaactaggggtattatatggttaaataaactacatggtcacatggagtacaaacgtttacctgctggctaatggcttgaggcctttcgttagtcatcccaaattaaccactacatagaaaacatgaacacggtggattgaaagataataaaaacttaacgtgataaccacgtacgtaacccaaacgtagtaagctaccactagtagcgctacggatgtgctattttactacggaaaccaagcaacttgatgttgactttgttcacgatgaatagattaacaggctctcttcctgaacttctaaacgtcgtaatattctttaggcaaaactttctgtgctttagttgtttgtaatttcaagtaattaccacaaattatctacttattcatcaccgatatctgatggtgtaacaatagagtcgtgggtatgcgagggttcaaatccaccatttttacccacacataagtaggtatttaatgaaattttaatgagatcagacatgcgtagttggtttccatttcattagacatgtgcttgagggcgttttcgtgaatatgtgagagtgtgatgttgtgtatagtggtgtgtatgtccactgtactatacttaaaaaaattgacctaagtaagaattgaaaactaaagggatagacttttcccggtcgggtaaaaacgctactccctccatccctaatataagggattttgacattttgcttgcactgtttgccattcgttttattaaaaaaaatagaactattatttttttaattactttattatctaaaatactttaagcataactttttgttttttacatttacataatatttttaaataagacgagtggttaaacaatataagtaaaatattatgttaaaatagcttatagtaggggacggaggctactattactaccatgaccatgtaccaacggtcagcttcgcaggcagaaaaataattaaaagccagcggggacgctttcctcctccattgaacgttgaagaaacaaaaggtgcatgcgaatgcgaagcattcggtgaagaaggcactcacacgcgaggaccctccgccgaccgccgcccaacctctcccatagtcccatccccatccttttccacaacgtgaggtgagagaaaaatcgcaaccacgcagaccgacgcccgctttgacatcaccctcctcaaccactctatcagaggtcaggtcatactctatctcgcggctccaaaatttaaaatgtagtcatttttaagcatggtgataaatcaaatttttaactgtaactattaattgcaacaaaaataaaagagtaatcatgtaaaattgatgttactagatttatttttgaacaatctatcataatatacaaatctttttatttaaaacatcttacttttatatatattgttagtcaaaaatagcatcttggagaccatatcagagtccaaacgtacttatattttggcatgaagggagtacggcttttattccaaaatatttaactagtactgatagttactccttccgtcccaaaatatagtaaattagcaacctttgagcgaatgggacatatcctctagatttatagtactgggatgtgtcccatccgctcgaagattgctatattttgggacgaaaggagtacttcatattttagaagaaaaaaaatattgattctttactactcccttcataaaaaaaataacctaagcgaggatttaacaccaaatagaataacgaatctggacaacctcatatccatattaattatcctaaattatgttaaatcaacatcggaattatgtttttcttgaaatggagggagtactctaagcttgccaaattactggttaggtttcttgtggtggaaccaatcctctcgggttcaaatcctagaggttgttcatatttataccatttttaaccatactatttttttaaggctataaaaaatacctacatttagtggccaacttgccaaaataagatttattttggctacaatataaaaaccccctagatttaacatgagtgcttgtatttacgagtaatttttctttcaatggtaagcgacttacccatcgacagtaagacgcttcatgataactcttagagggaggttgtacatgtattgtggacgcttgcgtttgtatcgtattttaagaaaaaaaactaatccagccctcaaaggtactactagttgtaataaacaaattaacaggagttagcacccagctgcaagcaagaatgcaaatggattacgtatgccactagctgctgcgtgagggtatcacgtcatgtgccgtctatgccttgcttgctgaatgcggccatactccaatgtctcacacacagtcatcatgcatgtgtgtttctgtctaggtgctctgtctttttttgcctcacctacagctactaccggccaagcaaccgtagcagcagcagctgtgacggatgggagaaaaaaggtagagcaaaaacaaaagcatattcctcctcccttcctcttgtgctcggcaagtcaggttcacgggcgagcaaacgcagcatacaaatatgcagctggtaataacgttatcatggtccaaacatgctgatctgttctctgttgtgttcatccagaagataagggcatgtctagatcccactctaaaattttacaccatgtcttatcaaacgtttgaacacctacataaagtattaatataggctaaaaaataactaattgcacagattgtgattactttgcgagacgaatgtttaagcctaatttctccatgatttgacaatgtggtgctacagtaaccatatgctaattacggattaattagccttaataaaatcttcttgcggtttattaacgtatattgtaattagttcttttattagtacccgaacaccctatgtatcgaagggtgaactcctcaagcgggggacagtaaggccccctttgttagttcggtcgggggcagcgggtgaaaatcaaggactcggtggaagatgtgatgtagacggggtcggggccccagaaacgatgagacaaaaggggtttatacatgtaataccctactcctgtgcttggttgatcgagtatggaatacacgcacttcaatctctgaaattcaagcgtgagttagccaaagaaccgatctctctccctcaccaagcttggacctcctttttatatcccaatgggttgccacatgggcgtagaagtctacctaagggtgaaggaggacattgcatgtcttgttgcttgacttggaagccacacacagacgccgcggcatggggccgtcatatccaaccagctgacacgggggacacccatgccattcaccattaaatgagtgaagacttctgagtcctcacttgcaccgagaaatggaaaccctacttttgactaggttggatgaactgactccggctgggatgaaaggctaaataacctctcatcatcatgacgtgagggggcatgttaggcggcacgccgcctgacaagtgagcagcacgcaggcgcactactccggtctcatcaatcattcgactggtcacaaaccggtcgggcgcacaacgcaccgcatttaatgcgatgtggcgcgcctgctcatgttgccttaaatgcggttaggtgggtgttgggggcgtccacttaaccccgcacacgcggtgtcatgcggagggggtcagggcagcccgagtgctcgacccccaggcatggaggggcggccgcctccccacctcaggcctaaccccctcggaggagtgccacgtgggtatcgggggcagcctcctccctctggtcctgattccccggcccatatcaccgacactatgcgacaccctacataatagccgatgtgacatgtcaaaactttacgtccctcgatctaaacatccctctaacaacaatacataggtcttgcttggagtaacagagttttttatttgtagtgaatcaaagcgggaagggatgagaacagtcgaaaaccatattgtttgtaagggaataaaggttctgtgttggttaggaaattccatctatcatacagccatttagccttcccgttaattatttagtgattagtgatgattgcaatacggcattggtaaaatatagaagaaaaaagatcttatatatggctagaggcaaaaacaatacaagttttacggaaaccatgctccgtcagttatgaatttccgtcaccgttttcgatcaagaaaactatggagcacagccttgtgttttttttttctttagaacacacagccttgtgttcggtggcatatgcctggttgtactccacaaaagttccgaagaaaatttactggattttgggtggtgaacgctcgagctgtaaacttgatactaaatcctaccatgcggagatgtggtgtaaaccgtccatatgtccaaaatatcaagtgaagaaaaaaaagacgttggtagcagtttcactttaacccaatcgtttgctagagaggatacgatatactatcaatttacccgtactccttttgttaaaaaaaataaataaataatttttcatcttaaaataaataattttaagtaaacaaataattttttatcttaaaataaataaatttaattacggtttattttgagatggatggagtagcaagtaagtactctatatgatgaagtaaattggtgtggcaccgcagaatcgccgccccgccggcctacccctagacgcacaacatatgtgcgacgtgagatcacgaaaattccaaaaatctttccttccccatataccacccgtatcgtatcggcagatcggttggcaaattcatttcatcaccgcgaccacacagctacagctaacccccccgcgccgtgcgcaccaaaacgctcgtgtgtgaagctagagctcagtcaaacagttttaggtccatcgaaacaagttgggtggagctctctccactaaaactgagagtggagctggatagagctctctcacaagataaactacttcagactcaactccttaaattaaatttaggagtcttatagctataccaaacatgctctacagaccagcaactcagctctccgcgatgcttgggctctgctctgcccacccaaacgcgtgccccccacgcacacacgaattcggcgtgaatttaggcacaagcaccaagaaatcgggggaaaaaggtaaagatctgcgcctctggtggtgtcctgcgcgcctctcgtttttttttttcttgtttttatttttggtggagctttcctaggattcggtttggttgagattttgattgcttagcttgtgacgcgtccatcctcagccgtccataccttttcttttttgttgtattttgaaaatatttgtccgcattaaaaaaagatagtagtagtacgaacttaaatgaaaacaaaaagaaaatcacgtaaatatcaaatcattccattcatttcatttcactccatcaataaaccaaccaatctccaagtccactttgttttttttcctctttaaagaaaaacaaaagaaaaatacattcctccatttccgcgtgaagcgtctggatcgagagtctagaggctaactctagacgacggcgtagaggatgatctccgcggtgtcggcggcggcccggggcatcctcttcgcggcgaagcccgcgcagccgccgccgccgccgtcggccgaaccggcggcggcggaggaagacggcgacgaggaggaggacggcggcgggtggtagtacatcctcgccgtctgcgggcagtgggagtggaaccgcgcggcgatgcgcacccccatgtcgagcagctccacgtacttccccatcgatctatattccccttcttcctctcggatctccttccctgccaaataaaatcaacgaatccctccctggcctgctcctcctacgaatcagcagctgtggatgcgagcggtgggtggcgctattgccttgctgtggttgcttcgtggaaggaggtgtcccacgagctgggagctgccatgggaggcggaggcggaagaagaagcgatttctttggggaggagagagttggaggagaggagagggggcttttataggggggaggagtcgcttgaggcttgacttggatggaagatttttaatgcggtgttgattatttgccgtgtttacttcttcctctcgcttgggctgggttggcttgggttggcgttcgtttcgtttggtttctctctctctcttttgtgtgattagcaacgcgtggaagtgctgcgtgacagatgcgtttcttcgcctgcctttcagaaagaaaacgtttttgttttttttattttcgtttcttttcgccaactagggactggagaggcatgcgattcccatgtttttatttcaaaaatccaataagagagcatgatttttcattaactctagaatatactccctccgtttcaggttataagacgttttgactttgcttaaagttaaactactgtaaatttgtctaattttacagaaaatatattaaattatagatttaatgaaacaatgctggtgttgtaaatattaatactttcttctgtagaattagtcaaatttaaaatagtttaacgtcttataaccggaaacggagggagtacattttgaaaaaaaaaacacaccgcatatctttttttaaaagacgacatcacatatttaccacaacactgacgtgaggtttctttttctttacacatatgggccatgcgggaacctagaaatataggaacaatggagaaatattatattaagatatttttttaaaaaaagaaagattaggagctttcactgtggactttttcaaatacaagttttatatttaagcgtataggaatgttcaatgcatatggttctatagagcttaactaagaatgaatgatgtcgcctagcacatatggtttgttctgaatctggactactttcgtgtgtttctaattgcatagagaataaactagagctcttacttggtgaatttttcttttccaaagtcgattgtcccactaatatatattatctcttcaaaagtacttcatccgtttcacaatataagtcattctacaattttccacattcatattaatgttaatgaatctaaataaatatatatgtctagattcattaacatcaatatgaatatgaaaatgctagaatgacttacattaagaaacggagaaacggaggaagtattttctaggaatgcaagcgggcagcatgctatcatgcgtaagacatacacatcagtttatttttcacccactagtatataaacagataaaaaagataatgacaattacggcttagtgggcctcaaagcctacaaacccgcctcacttgcatctctaatatttcttttccatcaaagcttccggtgttatttttttttaaaaaaacaaatgttgtttttctaaacaaaccacctcactgtacacatgtacatgtgattgaattttacatgtgttttcaatagtgtgtaatagtattttgtttttttcctgtttcttaatttgcacttttcaacaacaaaagaaatatatatattttggttgaaacacaaggttgctaccaataaggaaagaaaaaacaaagatcactagtggatccagttccaagctagcaaagcagcaaggctagaggccgatatgtaaacatgacgaaccaaaataccatgaaatagattatgagacttgatttatgttgaattgtcgtctcatgtcagctctcctcgccaccaatgaagctcaccatacatagagggtaaaaaaaaatgatataatgcattctaccagtttcttttctcaaattaagttttcgttgaaaacgactcaactgtaacaaaataaaattcccaacaattcctacgaaccattccttcatcaataaaatacaagtcttctagcccctttgcacattcacatccctataaaacacacgctgtgcttactcatcgtcacagcagcatctaactcccagtacattacaaaaaaaaagtaaatattactcagttttcttttaaaaaaaacgtattcgtaggtaggtatgcggctggtacgtgtttgctgggaagattccaacttgctccagttgcgataaatttccatgtttaaatttctcgtgtcgtgtagcacatagcctttttaattttcattcgttttttgtcagctacggcctcgcccagatgaaacctagcttgttttttaggcgatttttgaaaatggaattttatttggcaatatgggcttttttttcgtggcgcatatgcgcgtttggtccacgaaatatccggctcgtggggttccgttcacacgcgggcgtcctacgtggcgcgtgctcagggttcggtgtactggactactggggtggtggttggtgcggttggcagttgtgctctcatctgggccgtccaaactgggaagccatctcatccactccatcccttttggcttcttcgtgtcattccattctccaacacaacagtttgttattaaaattggagttttaaaagaaaattaaaatcaacggcttgttccctttgttattaaaatttggtacttactccgactaatgttatgagactttctagtattgtccacatttatatatatgttaatgaatctaggcatacatgtgtgtctagattcattaagatctatatgaatgtggccaatgctagaaagtcttataacctgaaacaaaggtagtactaattttcatacctccatctgatcctaaatatgataatttctagctatgtatctggataggggcatatgcatatacataagtagaaattgctatatttcgaaatggaggtagttcaattttgtgttatcttgaatctattttaatttagagccttatcgtattttattaatgtttttatgagagagtttctgaaactactcgattttactattaaaatttaataggtttggaactaaatcttactattaaactttgataggtttggaagtagcaatgatgtgaacacaacccaacagacagctgctggtgattgatttgtctcgagctgaactggtgctaatcatgcacggtactactccagtagtgatttttgtacagccagctggtactaatttcctcctaaacatagggttgttgttagcattttgttctctcatcagcttctacctgctcttgaaataaaagtaggactgcaatctgttgtaccttactatggctgtgtttagatttaaagtttggatccaaacttcagtccttttccatcacatcaacctgtcatacacacacaacttttcagtcacatcatcttcaatttcaaccaaaatctaaactttgcgctgaactaaacacaacctatataaaaaagctctgcgttgtgtttttccatttagagaaatcaatggtgtatatataagagtacagtttagttggactgtgtatgtatgttcgtggaataggagcctgcttagggcccctttgaatcgcatgattgaaaaaaacgtaggaatagaaaaaacgtagaattttgatatgaatgtaagtggaaaatagagcattgcaaaacacaggaaaaacacaggaataaccgtttgattgaaccgcaggaaaaacgcaggaattggatgagagagatagactcaaagaaaagtaccaagaggttgaagctcttggtaaatttcctccaaaatctctataggattgtccattccataagaatttcaaaggattggatagaattcaatcctttatttcaaagggcttcatagaaaattttcctatagaattggaatcatccaaaattcctatgtttttcctccaatttagtttccaaacaaaatttttcacgttgtcacatcgaatgtttggacagtattagatgcaaaaaaaaaaaacaattacatagttcgtcaggaaattgcaagacgaatcttttaagcctaattgcgccagtggcgtagctaggatttaaagtaaaggtggtccatctatatgtaatatgccaattaaaagggtggtccactatacaatttttattatattaactagcacatatactataatttcaaattcttaggtggtccatggaccacggtgccacctagctggctacgcccttgaattgcgccatgatttgacaatgtgttgctacagtaaatatttgctaatgacggattaataaggcttaataaatttgtctcgcaatttcctgacggaatctgtaatttgttttattattagattatgtttaatacttcaaatgtatgttcgtatatctgatgtgatatggaggggcaacatttttttttgccaactaaataggccctaacctgctcgctgggttcaaaatattaaacttagggcctgcttggaaggtccataattgatccaaaactggtgtaaaatacaggcccgaaagattttccggtgcacgtggggcttaccacatatttttgtcatatctcaatgacatatcatatgtcacatatggacctcacctgtagtaaccgtttcccgtactattgaaggaatcgatttgcaccggttttcaaagagaaggaatgtgttatatccgattttatggttgagggagacaatttaagcaagagtacataagatgaacgacaaaaaatatacttattccttgcttcaattacttctacagtcgaattgagtttctttagtccatagctggcccaatctctcccagactcccacaatttgtcacccaccagttctggctagcccgagtgctcgcgagcgtggattggagaaattgccgacttggaaatctttgggcaaatccaaggcctatttttcttttctttttcatcttattatgcatgtggatcagtggatctagtgtttaattgttccaacttgcaagccacatcttcaaatcaagtgagaaaattacaattccggtcgttaaaaccactaaaaaaccgaaggatagaggaaagcagagccccggtcgccttctctttccctcagtatgtagtacccctaaattttgggctaaccccgaagacgacgataaggcccactcagagacgggccgaaccatttagcccaacaacaactcaacatgctatgactcctttccctcctcttccttgatagattggcaggcagagccctgcccttatataaacaaaactgaaaaaaagagactggttttataagcaaagattccgaaatatggatttttaaaagttgattttgatttttttttgaaattatatatttgaagtatttttgtttaaatcgttaaggacaaataaagaaaagttttaccataaattattattattattatttccaatcagccatatatatggcttgccaaccgatggcagcacaaatctttcgcgtccgtttgaacccattcttcaaacttgaagttggatttggacgtaatagaaggtgcagttgttcacttgttcctggcatcaacgtgtacggttgaacaaatcggtggatctcttatggttaacgtgccctgttgatgtctgaaaacccatctgttctttgttctaactcctatcttatcctctcattttttttcgcttggtctcaacttcgtgttctactagttttgaacgagtcactcactcggactcgagagctctgaacttctgaacaagccaaaatgctgtctgaaccgagatcttcttggcgctgtcagcctgtcacaaactcgcaatccaattgcacttccagcggttgagcaggttcaattcaacatgactttcatcaggagatggtaagttaggaacagattactgtcacaactcacaacagttattactactatcgcaacaaatgctagctgtccttatcctcatcgactggatacttcagaaacaagcataacagtagcattggagcaaaggacacagcatggctagaagtagatgctgctgcctagagatatcatctcgaattcatggcatgaacaaacgtcgttcatgcagccatgcaggaataataagctcagaacaggattcaggacaaattcaagctatctacaagcttgccagcatcatcatattataataattgctttaatagtcagcaaactcgtacagaatagccagatccaaatttccacaaactatatatcatcatcaggaattttaaaaagagaactcggaatcgatttcgcatgatattcgaggacacccaagccaaactgacgataacgatgactaacgctaatacctactacaacaccaggtgctggcccttatttgataacttgcgcctgcgagaattcttaggcagaagcagatgcagcagtggcaccgacgtgcttcacgatggtgttctggaggtcatccttcctggcgccaacgaccttgtcagcctcagcaccatccttgatgaataggaaggtcggcattgcctcgacattgtacttttcagcaacttcctgttggataaagaaaagcattactcactatcacaggggtgacaaaaatgtttttggaagattgtgggcaactctgcgcaccttcagctcatcaacatcaaccttcaggaagacagcaccagggaactttttggcgtattcagcgaacactggggcgatgaagcggcaagggccacaccaggaagcagtgaagtcaattatgacctgtagatcaaacagtccagaaaaggccatcattagggatggaaacatgacatgaacaaatggtcaattgcgcagtaagaaagaataacggtagcctcacagttattggcatgacaagcataagtaccactagttcagaatttcatactagataaatattctttggcaaccttgttgttgttgcacagaaagaaaataaatccaagaaccattgataattccatagacaacaatatatcagcctggtaagtgctaactactcttgatcagaatcctcgttgatgccgcacagcaagaaaccaaatctaatacagttcaaatataatactcttggtcaaaatcctcgtttatgccgcgcagcaagaaaccaaatccaatactacagggcggacgcttatctgtacaaagcatcacatcataacaatgccaagacatgtgaagtggcaatctattgtccataacaacaattgaactagattagaaccagatttccttcaactctggcgaatcatgtcaaattatagtactatttaagaatatatctatatatttaaacaaagcttatactcaaattagagaatcatcagcatgaaacaactggagcaaacctaaacatcacatcacaccatcccatcttacggtaaatttaaacactaacaatttcgcctatggagtcaaatactatacagatagcggatgaaaattcgcttgcagatgtaagcatcaaatcgccccatctcatggtaaaatccaaacatcaacgattaatcatgtcaaatacagagtgccctgtaattactgcaacagatttcttttaaaagaattgttcattatatcatcctaaaatatattcatgaaaatctactactaaaatctcccccaccagaatcggcaatccccaaatccgcgacaaccctacgccccaatcgccaaaatagaaacaatcgatctcctcgcgatttcaccacatgccacaaatctcagcaagaaattaaatcctaaatttcttcaaaatcctatcgatctaagacgaaccgcgaccccctggtgaacaaaacccccaaaaaaaaatccccaaaattctgcgccaggaaacttaccactttgccggcctccttggccttggtcatctgggcgtcgaactcgtccttgttgtggcaggcgatcacgactccctcctcggcggccattgctctctctcctcctaattcctcggcgacgagatcaaagagaggggtttcgatttgaataggattttttttcttttcttgcgatgagattgcgttctttcgccgcggcgcaggtggcaatttataggccaagagaaggggtggagaaattaccggagtgcccttgcgttccgaggacgctgacgtcgtcacgctcgtccgcgtgttgcagtggaacgcgtttcttctggaactttcgcggcctcgagtgttcaaatttgcaagaacatgctatatgccacgcgtgtaaagattattccgttctgataagcaagatgaacagacatggcaatttacggctttaacttttgcatatgtttattagcccaaatttaaattttcagtgttaaatttaaagttgattttagggttttttattgaaatttaaattttcagtgtttatttagatcgctacacgtatataaaagttttatttacaaattattttgtgttcgtaaatatgtcgtttcgcttagcatagaagtaggacttgtttggtagtgtcactcttagggccccaagcaaaagattctacgttgtaatttcatactcatatataactttttttctacgtggttatttgatttaaaggattgaaactttttaaatcatatgaaattcctatagaatggctcattgcatatagattttggaggaaacttagcaaaaactctaaccttttagaaaatttcttttaagactatctctctttatctaattcatgtatttttactgtgatccaacaatcaaacgatcattcctgtgtttttcctatgttttgcaatcctttattttagacttgcattcctgtctgaatcctatgtttccctatacctttgttttttaaatcgtgtgattcaaagggacacttaattttagctctaggagttaggtttggagtggagttgtgtagccgtttaaactcaactccacctcttttattttgtgataatgtttcatctagctctattcccattttagatggatccgaaactgtttgattggactccaactcagaaaaagaaagctggagctgtgccaaacaagcttgtagtgttttcttaccgtttaccttttgtggttgaaaaggtggtaaaccgaagcaatgagagtacttttggaataaaactttatacttttaaaaagtaaaaaccgatttgagtggccaatttttaacctaattaagtggttgaaaatatgtgaaaaacctaaattatttttaaaatattttctgaagttaaaattgctcttcaacttatcagcatcaatcacaattggaatttaatcttaattttaaagttgattttgacgttttcatcatagttcacaacatatgtatactaggggttgttcagaatgatgttatttttaaccataacttctttttaacaagattgccaaaaaaaagtgtctacatttagtttgttaccaaactttggtaaatatataagaaatcctatcaaaattttaataatattatcaacttgccaaaattgtaaggtttattttggctataatatgaacaacctctaattttatctatgtattacttttgtttgctagtaaatgttatggcttataactagttataggcgaaatgatggattaatagtttaagggagtttgagtatgaatagttttggatggttaactgagttttaggtccgcgtcacttatttgtataaacaaatttgttttcaagacaagggaaatataaaatattcttgttggaccgggtatatgttgcaaatcgactcaaatgattgatttccattgtttttttccccattcgatattaatgcatcggcacttgttgctttagaaattgtcccatattagaaattgtttgctgccaagcgtccatgcgcaatagtcaatggaataagtgtccacatgttgcgacaccattatccaaattcgatgaaaggtacctcaacgttgaaatagtgggggctttggaggtggccatcaatgtgttcacttttgttctcaatgtgatgtgtaagaatatatctttggaggcatccaattgaggtcattctcctcttttgcattgagatgcccaagaaaatgcatggcctgaattaagatgtttttttcttcaacaaatgtcactagagtaaatgtccaatgtgatgcggtatatgtgtcttatttattatcatatataataataaaaaagtagaaacatgcaacttgaatatatgtacatatcactccacggaaaccttggaagtccattgaaacggctttaagttcttgaacttgttagggtctcgttattttgtccaacaagaattgaatgaagataaaaaattttgtgatacgtttttcaaactgtgttaaactgtgtgtttcgtgcgaaaactttctatatgaaaattgctctaaaatatcatattaatctatttttgaagtttgtaatagttaaaactcaatcaatcatactttaataccacctcattttgcgtaaaaaaacttaatcttcatcttcgggagaaaaaaacatcatctaagctctctttattactgcctctgtcccatattacttgtcgctttgactgtttgcttgcaacatttgaccattcattttatttgaaaaattagtgcaaatattgaaaatgataagtcatacttaaagtacttttgataataaaacaaatcacaaacaaaataaataataattttaaatctttttaataagacgaatgaataaacattacaaataaaaactcaaagcgacataatatgggacggggtagtactagtctagtacttccaagaaaagcttcttggctaagaaagaagatttgctttttatggcatttgtgcactgctatcattctcatgtcctgaatatcattttctcctcttggcaaagaaattaattgttttgtccatgaattgcttctggccccaaaccccactgctcattattaattcccaaatcagcgttaatagtcatgtgttctcgcgcataaatattcgtctttcctgcaactagcttgttggccacagaatcaaattccgggcaactgctccacagtgatacactagttatgaagtattttggtgatgtctccttgactgactttgctgcaacaattatgggcatgtttagcttgcgaaaaaaaaaagatatcacatcggatgtttcatcggacgtcgaaaggatttttgggacatgaatgaaaaaactaatttcataactcacctagaaaccgcgagacaaattttttgagtctaattaatctgtcattagcacatgtgggttacttagcacttatgacaagtcatggactaattaggctcaaaagattcgtctcgtgattcccccctaactgtgcaattaattttttttaattctatatttaatgctccatgcatgtgtccaaagatttaatgtgatgtttttgagaaaaacattttgggaactaaactaggcctatgttcataggctgatttgtccgagctactcaattgcacttataatcgacactaatctggtggttcacaaaaaataattgccctaaaaaattgtaaattccactgaaactctttttttaatcaaaaccactcttgattaaaaaaacaaaacccgctgcaattagtggtagtattttttttaagagagtggttactcctaccgcttgaactagacacccaagatttccaaatacgttgcgacaaaactattttggcatccataataaagatcatgatccaaccttgttcattagaaaaagaaaagaaaagcaggtcttttttttttccttccgatttactgcatgtcgtgcacgatgaggagcatttccctgctgacttgacccagcgaccccatcgtgagtcatggcgtggcattgccggatattctgcgaatgtgccatatgtacaatgcgatgaagccatcccattttgttaaaaaaaaagaagctcaaaagttacagaagagtttccatgcgccattccttgtggcttcagatagttcagttaactagaaggaaattaacagagcagaacagtgataatctgtaataacagttttgacaaagactactaatctgcctttctaaaagaacaattctactgtatgagacattaatatatgattaattgagtattaactattttaaattttaaaaatagattaatatgatttttttaaaataactttcttataaattttattttacaaaaatcacacaccgtttaaccgttcgaaaagtatgcacgcgagaaatttcttacaatcctcggctgccgaacacaaccaccacgacatgctcctgaggcctgcatctgtgcagtggtgcggcgtgcgacggcacttcgtggctgttgggccttggtccactcatcgttctgggctagacctaaggggatggatacccaggaataataagattcataataagattcacattgactcccttaactagtggcatatccctgagttctcgaccaatcaactattaaaaccggtgtaaattgactctcttgatggttttagagaacggttttgttgacgtgacgtccacgtgacatctcagtcaacaaataaattaaaaaataaagtaggatccacgtgtcatcctctttctctactactgtcagggttatggataccacatacctaatagtagttgactaaatctcggcaggacccaccacataccatgtcctatatggaaacaacctgcggatatggaggaagttccggataaggaaagacaaccagagttctacatggaaacgacaagaactattcggattatatccatattggtttccctagttctacttgaacaaagggacacctatgggtataaatacaaggccctctaggaggagagggggacggacaacacgaccacctcaattgacacccaccatagactggagggaacaacagaggccacaacatacaagacaacatacaccaagacaagacgccgaatatcgacttcagggatagacacggctagtcccctatggtgtctctggatactgtcagtagagacgaaagcgtttctcatataatcaaggaatggtatatatctaaatccaatctaatttcacctataaaaaaagattactattccttggtaatctataggaagggattgtctttttctctgatatcgccgggcacggattcgaggaggaagactaccctgttgtcgactacgagtcagaccttcagaccgccatgtcgacaacagttagataggctaccccacatattgtactggtgtgattatggtgaataagagcaataccggcttcggccaacaggatatagggttattacctgataattcaggggcccgaacctgtataaaagtccctgtctccgtctcttttacctcagtctcgcgtatatcctagcaccgacgatctccatactatgcaaataccagaattgcgacatcaaacgtcgacagtggcgcgccaggtaggggtgttttggtgctctaggatttcgacgagatgggttcaaaagatggattcttcgacaacaagataggacggcggctgacagcacaagcacaagcgccaccgccaccgccaccgccaccgcctagctccggcggccaccgtgcagcagcactccaacattggccgccgccgctactgttcctcttttgtccccgtcatcgttgcctccgcctcctccttgtcctcctctactaccggcgtggtggtggataatgttggagtgtataaagtgaattgactgtctttccctatcagcttaggtttttaggtgcaactncgtgatgcatgcaacttaatatggtatcannnnnnnnnnnnnnnnnnnnnnnnnnnnnnnnnnnnnnnnnnaaataaaataattgcagcccactccaatattccacgctgagacttgagggggtctcgtgtgaggaagagtgttgaagtgtataaagtgaattgtccacctttccctatcagcttaggcttttaggtgcaacttggaggctccattgccatacgaaacaggtcgaaagtgccaaaaattaaaatgacttctcattgtgaaaggggacggaacaaacctgctggtgcaccgatcgagctgcacaatgtcagataagaatgggcaatgcaactataagcatgagataggttaactataaaatgagatcaattaattaacctgttcattaagttaaggcaggtctagtttcatatatagtgattttgtgttgaagacggagttaaagagccaaggctcatacagttgtacccccagttgagtttttgcttgtggagtggagctgaaacctcgttgatgaggacatcatttcatcatatacgcatataacttcacacgttccaatgataattccacgtccaagtctaatttagcctccggagataacactgacttcaaacgaacatagcgccctcatgcctactctgatttagatgatcttgagcttgatagaaagcttatctcgtcacctttcaaacgcattcggtctaggggtggcaacggggcgggcagggccgggttgggttggaatgccccgtcccctgccctcatgcgggtatccccgccccgaccccagaaacgaagtcgagtgaaaaacatcacccatccccacccccacaggggacccgacgggtgaccggggtcctgcatcagccggatggagttaatactccatacaaatattgcaatacactgaataatagtatgataaaatttcaatagccctcggcggtgcgggttggttcaaggaaggaaagggattacggttgaggggaactagggtgttgagcttttatatgttaatttgaatgcgattgttgggtctatataggggtgaaaacgggacggatatttcctgaccgcccgcccgaccatattatttcgggacaaattcgggtatccggatgttttcacaggtagcgagtccgaatacaactatttattgtcggatatgggatcgggtttgggagcgtggtatccgacggatacgggttatccggaaaaaatacggatattaccctgttaaatatccgggtattactcggataatctaatacaagcctaccctaataaagccaaaagaccaaccaccaacccactaagggtgtgttcggcaccctttttctcaactcatcttcctcgttttccgcacgcacattttttaaactattaaacggtgcattttttgtaaaaagtttctatacgaaagttgattaaaaaatcatattaatctatttttttaaaaaatagcaaatacttaattaatcacgtgctaatggattgctccgtttcccgtgttattccgggttaggaaccagctgcgaacacaccctaagcattcaccacaaggcccaataacaatattgactgtctaacaattactaacaataatattgactgtctaggactagaagagagagttagagagatgactgtttaggattaggagagagaaatcgagactttctgtgtgagagtgaggaattgcccaacaacaatataaaatgatttttaactacgataatactatgcttaggtattattgtctagtacgtgtaatacatgtttgtctcaataagtactcgtaaccgatagcgtatgtatctgtattggtacgtattcgttctatatttatacccgatattatccgagtttatatccgtatttgatactatccgtgtccgacccgattccgattataaattgtgggttaggatatgggaaggatgagatctgaccgaacctgacctgttttcacccctacgtctatattattgcaatgtgcaacttttatagaaataactcatatccggggcccctctgggtcacccgcgggttaattccgattcccgtccccatcgccggaattatgcggggccctg

SEQ ID NO: 2199 - DNA, 31038 bp, Oryza sativa
  unsure (1)..(31038): unsure at all n locations
tccccggcccaacggggaaattgccacaccctaatccggtttcatccaaatttatctcgagtcaatgggaatcatcgttgttgctgaatctgaacttggccttaggccttgtattagactagggccatctcggaagtgtctcccttcagctccacgaattaacctctataaatgtttatgtagaccctctaaaacaattggattttgtttagttgaattttgcaaagtgccattcatcatgtctctagttctcgctcaattagtcggcgactatgcattgagagccgccaatagttggtgtgttgatttgcctaatcgattagatttaccacttcaattacaactatttctttgtgcttaatcacctattcacaatatttagattacatcctatcttgttcttaaaatgttctctcgttagcattgcagggatcatcaaccacgcgtcacggttggtacgatatcgtttgtggggtagcgattacacgacgtcttgaacttgttctggtcgtagccacatcgcaaacgtcgcgcttgatcaaagagaaagctatcccctcaccagaagattgggccacgagagagagcgtcatcaggatcgctccttttccgccactactttctttttagtgtgaggattaagtgtctgtgctgcaagtatttacgctttatttatatttcgatatgtataaagatttatgatattattacctggcttgattcctggacaagaaattatacacaaaatagtctgaaaaatttggctaattttttggggcgtgacacccacaagagatctagcgaacgtcgcatgctcacatcccttgatagggaatgagtcgttgacacgtgggtcccacgtttcgtttcagcataaaaccacttacgaaatcttcaccgattttcgaagatgaagaaagttctcagtccggtttgttttgcggttgagggagaagtttcgattagcagaaacaaataaggaaggcagaatagacttgttccccttgattgctgcgagccgcggttccatacttccatccgtgagcctcagacatcgccgccgtgagccctagcctcgccgccgcggcgcgtcgatggacgtcggcgagggcaaggggttcggagccgtggttgatggcgtcttgccaccggagatgctgcacgaggtcttgcttcgcctccccgccaagcccgcgctccttcacctccgacccgctcttcgccgccgcgcacgccgcccgccaccccccttcacgccgccctcctcctcgccatcggcgtgcagagcttccccagattctgtgtcgatcttgtcgacctgtctggcgacattgtcaagcagctgatcccaaaaccccaatcccaagtggggagaggcatggttgtgagtgcgacctcagacgacctcgtcttcctcgacggtaaggagcatagcattcacctgctcgaccctaccaccggatccatctccgccttacccaccaccgaatccatgtccgctttaccccactatggcgacgtcagtacagactgctcaatgctagcttcttgcctggtttgcatttggccaggtagcatctcccacatgagagcgtaagctagttcagattgtgaagacattgagagatcgttacgtgtccgaggttatcaccgtcagccgccgcggcgtcggtggacagcagcggaggaaggtggagaatccacctgtacagcttgattgtttctgcaccgatggagttgtgttcaaaggggctgcttacttcaacttcgatatcctccaatgttcgccctccgttctagaggcaggttgcctgccttccttcgacctcgcgatggagcagtggagtatgaccctctaggggccggcgaagagcattgttgaggaagccaatgacagacttagctatcatgaccttgactatcattttatgttggctggaattaaagacactttgtgtacagcgcattgggattatcatttttatgtggtggatctatggtttctaactgattctgaaaagggtacatggtccaaagagtacaggattaatgttgatccatctttctatgggattggagattgtgtgaaagtgcatccgttgcttgtgacggatgagggaaatgtagtactctggttgcagatgccatcggaagggatagtgcagatttataatccagtaactaacactttctgggatataactcaaacgagcatctataccggagtaggtgtgtacactggaagtttattatgtcgagggagtgtgtgacaaggtaaagattggtctcacatcatcatatagctcgtatccatggaattgtttggttatgtttgtgcgctttattggtttagccacatcaacttcatttggttatttatttttaaataacaagagcagttttattagttccgtttaaattttcatcgtcttagttgtttttatgatgctaaaaacttccgtaaggtcacaaaaatatgatgatctccaactccaattaggaaatggcctttgatgacctgtttcatcggaaataaaataaaatccatcattaatcataatgattcatattcattgccttagttgcttttatgatgcaaaaaacttccacaaggtcacgaaaatatgatgatctccaactgcaattagcaaatggacctatataggttgatggtctttttcagaaataaaatgaattcagtcagtaattaaacacttgatcatctattcattgagatgtattataattatgaattgctggcaagaggcaattcttgctgaagttgtcgcttaaggaggattgagccgagcgaacatatttcttctccatgcgttgattagaaagcataataacccgggtctttgtgtaactatcgaggatgagtgggaggtgtggagggtcgcgggtctgttgcggcctcttggttgattgttgattgttgcttgctgtatgttcttagcagtgctgtgagttgagctgcctgtgctctagtgttggttgctcagctgtttgcttactgtaattttgttgttacagttgttaaaaccccttcttttcccttaataaacttcagctggctttccgctgccccgcgaaaaaaagcacaataatgggagggtcttttgagtctgttatgatctgtttacaacagaaactaatttgcatttgaaaaaaaaacatacataacatttgtatcagattttcatatattcagttaatatagaaaatggattgttctatggtcttatctcatgtagtgaccaagaaatgctggaagtcacaaattgcttcaccaaatagtgaacttatgcagaagtggataataatacagagatagttgaaatgatcagtcctagattaaattgtcaattgttttctcaatggcataatgctagggagaaaagttattggctcctagcagatagctgtgaggagaaatattcagtatcctctgtcgcaaaatatgggaaaatattttcccgcaaaatatagctacttttaactatgcatcttgacaagcgtgtcataaacatagtgtcaattaaggcttatgtcattatttggggaactgaaaagaacactgtttctttttggcaaaatttgttctatatctggtgatatcatacatcggaaaggtttttaacacatgcctgtttggtatcttgatgcgaaatgctttcagctacgtacattaattccataaaacttatccacgactatactagtgtctcatttatattcatttctttgtttgcaataaagatttgagacatgcacttgaagattgtgtctgccattgtattgggtccaatttgctgtatgcaattcatactatccatggttcattaatgtcaaatccgtactcaagaaagctctgaaggacttgtctcacttggacacatggacgaatttaaaattaattaaccttatgtatcttttggtaatgcagtcaataatgcttaagcacaaaaggcaaagcttgagataagatactatgttaacatgcaagttatccacagttccacaccacctgtttactgtgcctcttcgcttttttttttttttgtctttgcagatggttggatcagagattggtttctctattctgatatgatttatttcacccttcagcacttagtaatacttagggtgcactaactgcagttcacttcgcagtaggttgtcacctagagaagcactgaaattgatttagcccaacccttgctagttctctgttagaatgtctcttttttagagagtgtgagagagttttttttgtcagatttttcagatgaactctgctctgctctctctctctcttctctggagtaaaaaaataattcctccagtttactgaactgactgaagccacaacgaacggtcatgcaattgttaagaacaacaatggcagccaagttgttatcacaactcgaatcgaaattgtggcatctctagcagttgcagaccatgaaattctatggttctaccgaagcaggaaggctggactcttttctatgtaaaggctttctcaaaattggatgacagaaattgcccccttaatctgaagactgtcgctgaaagaatcacggagaaatgccaaggtttgccactggctcttgtagctatagggagccttttatcgtacaaagaaatggaggagcatgagaagggagttgttctataatcaacttaggtggcagctgagtaaacaatccagagctgagctgggacactagtgttctgaatctcagttacaatcaacctggttttacctcaagaattgctttctttactgcggcctgttccctgaagattatcggatcgacagaaaatggttaatcagattgtgaatagatgaagaaactgttcaggacagagaacctgagacaacaatggcagatgtagcagcattgtcacctgaaggaacttgctagtcgatcattgcttcaggttttggaaatgaatgaatatggaaggaaggccaaagagattccagaagcccagatgcatgatcttgttagagaaatagccctaaccatatccaagaaggaaaaaattgctaccatatgggactgtcctaactcggatggaattaccaatggatcacagtgtgcttcttacaaaaggattatggcaatttagtccaagcagcaaaatgttcatctcagcttcggtccatgttcgtgttttcagaggaaatatcatcgtcttggttcagactgctgcctgagaaattgcaatattcagaaagtgccaattgttttacttgcactacctaaacttcgggtacacaaaactgaaagacataccgagattgatagggaagcttagcaatctgcaaatgctttatctcaatggttctgtactggagttgccaagtgaaaccacaatgttaactaagcttcaccacctactcgtagatgggcggtttgggatgtcagcaagtagcaaaataagtcaactgcaacatctacagtctctgagaagcatagaagccaacagctacatggttaaaaacattggatgcttgacagggatgagatcatgaaggtactggagtcccacaacacagatctatgggcctcaatcagacatctctgaattcattgtccgttttcgcagaagatcgcgatcgatatattcttgatctatggacaacttgaaacctctatctcacctggagaagctaatgataagtggcaggatacataggcatctgggcttcaaaaccattacaggtaaaaatcaacccagtcaaccttttctctcttccttcttaatgaaacagcagagctcctgcttcagtttcaaaaagaatagggtatgttcactttgttgggaaaaacatgccaaattttaataatatagaattaaggttgggtggtgtttggtttgatgtcttaacaaattttactaatttttaagagtgggtaatttcaaaattaacaaaatttggtatcttaccaaaaattaataatgtcaaaatttgatacatttgacgttttgtagcattgaatgtttggtttgaagccttgctaaattttgatggagttttttttataaaaaaataccatttttatagggtggtccgcaatcatatagtaggccttggcttaacgtgagagttttctacttccgtgtcctctttcggcaacttgttggtgttaaggaattcgataagcggtgttcactagtcctgagtggtctcgatgtctgtgacgattttgtcaatctaagtagtagccctcgagccaacgtcggtggtgctatcgatgtcgtcgtctggcgaactcttgacggatggactggttaatacttaatactctaggaacatgctggattccaccggctttctcctggaagctcgtcgggtgaggttgtcgacattggtgttgtctttgcgatagacatggcgcacttcgagctcgtaatccttggacaattagggattagagcctccgtaatccttatgcacttggttggcgactttctgagtcacctttcacaatcagtcattttaccctgagtgttgtggctgcttgtagtccagctaggagtccttcgtactcagtagtgttgttggttgctcgaaaatctaattggtctacatgtaaccaagaattttgtaaaattttcttactgaattctagaagagttgaattttccaaaaataaaaatttgggtattttacaatgcggatgctgcagttgtcatcctcatccttgaggaagacatggtcgaaggcggagcacccgatgaacaccttgattgcctttccccaagaggatcagtttgacgatgttgtgggataggtcgacgagatcaagacatagttgttaacgaccaaatttggtaatctgagtatcgaagatgaagatcagatcgaagcggaatccaagtccaagatcgtttcggaaacagagtaaggatcggctgaagttcgaatcggctacgatcaggatcggtagagtccgagttggacagggttagccgatcaagccgaatccgacaatatgacacggcatgcgttgttgggttgggttaatgtgcttcatgatgattgccacgtatggatagagtcctgagaaggcaattgtatctattaattaggatatttcatgtaattcccttagagatatgtttggacaaaagtctgccgcaaagacttatggtatcttagagtttgttagagataaaagtcgtgtccgacacgggcatattttgtaatctcgggtataaatagaccccgagccccatgtaatcaatttaacacatgttcaatacaatctcggcgcatcgccacccttttactttcgtttcgtttcgacgagttcttgctttcgggttgagctgcatcggtttcgatcttcaactagaggtaaaacttgttatggcggcctgcgttctcaggattagtgcttccatctttatgatactctaatcttatttatgtaattcgtcgagttatcatatatctcatataatctccggcaatatcgttatctaacctccaatcggctaacatctgttactagaaggcagccgattaggttaagtagtgacgttgacatagattatataggatatccaccactctatgaaacatccaacggcttgattgtctagatattgtctttcttttcatacttatagttgtatcagttaagtttgaccttataagtcgtgattaggatctcaatctctagcctgcttttggttgccgattagggtagcatcggggtttcagccaatcttacctaatttaactatatttatctcatatgcttgattgacatgttaaatctgccctttatgttaagatcttgctgcatttaagtatattaggcttttgtttggtatattttacttgctttgatatcttaatatagagtggtatcggagtattacccaagacacgctagatctatctgatcggctatgctatgaacatatatagtcttattgttaatatatatttcgatctaagtgatttatactgtctcggcatggcgaccgatctatcccaatcacttgatttaagtatatatcgacataaaggctacatattgttaatatctacagccgatcgagtagatttagttctttcttacttatttatgattgccgatcgatctatatgtgacatcggcttaaaaataaatgatatgtcatcggccactagccgatcggctatcgtttatagatttaaccgcggtttctttgtctttatttcttgttgattgcatgatcaaatcaactggcatgctcacgaacctaaaggcaagcttttggacctgcactagagttaagcagatttctcaggccttgtgtttttacatcaacaatagtctaggaaaggtctgcacgtcgacagtgcaagaagcgatccagggtggcaagcgacgtgtgcggcgatgaagagcgtgtacaaggtgaagaatagccacgcacgggggccggggcgtggagatggcagatcgacttggtagggaggtgtagcaggacctcgagctacatgtctggaagcaagatgcagtccactgcggcggaggatgacgtcattgaggatgaggagttgagactagcggtgaaaacaggatgtgtactttggccagcccgcccgactgactatacataattcaacaattacagcttgcacctatttattccattctaaaactataaaatttgcttaaaacaaattttttaccatgtagaccacaaaagcatttataaactattatattgaagccacatcagagtgttctattatagctgcaagtagtcttggcatcgggggcatatcaagctcatgtagaccctcaatggcccggaccacttcacccattgtcggccgatcagactcaatttcttggatgcaccaacatgcaactttgcaaactctttcagcctcttccaaactgaagtcgtcatgtaatcgtggatccatcaaactatgcacatctcccacatgaagcttgttaattgctcgcacaggaaaataagcaccatgatagctgttgctagcagatactttaggtgaatttctccttcctgatatgatttccaatagtaccatgccaaagctgtaaacatcaacttttggtgtaatagcaactccgctaagccactctggggcaagataccctacagtacctctgaatgtagttagaactcggctaaaatcccttcctacaatcgctgccatcccaaaatctgcaatcttaggaacaaatgattcattcagaagtatgttttctggtttaatatcacagtgtatgatgcattcgcgacaactctggtgcaggtagcacaatcctctagcaactcctatagctatttgatacctggtgctccaatttagaacggtagcattgctctgaaatagatgggcgtcaagagacccatttaacatgcgttcatacacaagtagcctcttatcaccttcgcagcagaaaccaatcagtttgattaggttgatatgttgggtcattccaattgagctcacttctgccctgaattgcttctctccctgacgagcaccatcaagccttttcactgctatagcagtctggtctcccaacattcccttgaatacagaaccaaaaccacctcctcctagcttctctgagaaacatttagtagcacgaactaaaccggtgtatctaaaggctataattccaccatcattaccttgactgccatataatggcacaccacaccacttggatttgttaatccaaatcgttaacaaaagcatgagcattagtaatccaaaactaacgacaatgcttacaatggcaacaactcttggtctccgtttgttgttcttccttaaactttgtgaatctctggcggcgaggcgaaggtaaagaacattttcagaatgattatcaatgccatcattctgattcacacttcgcaattccccatgccagatagagcatctgttaccattataggtataagcagtgcaagcgcagtcatgaagacaagcttcttcgcaatcgctctgggtcgaagcatcttccatgctttgagggtacaagggcagtgtaacaggagctatggggtggaacatgtctgttgaacttgtgttgttttgtttaccagatgcacaatctaagggagtatctctgatgcaccctccaatcggatcaccggcatcccaatcctgcggtgacttgggagagaagctctccatacatccacagaatgggactgaattgccattgcagaccgtgaaaggtccacagacatcgtgcaggctgcatggatcagatggttctgcatatatggtttgccaagacattttgggttgtgaccaaacattcagcttaacctgaccagtgatgtctatggaaacgaatacagaagccgattcatcaagggaggtgtacgtgaagtactcctcctcattgttgtggacatatgcaggtttgagcaagcctttggtccgtggatccatgtctagcagctcattgagcaatggtacaagcgtatacgccaattgtccggatgaccaagaccaatacaccacgacgggaggtttgcgacgcctaaggcgcaacaccgtgtttgtgtccatctcaaggatgtaagagccgaggcccatatcaatgaggctcttcttggcaacgaaccgacggttcaaaccggtgatcttgttcctacctaacttagcacccggaagcccaacatctgcagggtagtcgaagctctgccacaacacaacattgctactagccatgaggagtaggtttccattgttcatgaggagagcactggtgtttgtgctggatgatcctgttgtcctattgacaatggtgtgagtgctggaccagattatggactctgaactggtgttgttgttgttcaagacgatggcaagattgccatctcttgagattttgagctgtgcttgcttcagctcagggccagtgatgggattctccctattagcaacccaagctgtagtaaaaacctggatcttgttgaaccatatgccaagataccagccaggcaatgtgttggtggtggtgttaatggacttactgatgcctgcagttggttgtggctggaagaagccgagcgcgaacttgccgttcctcgagacgagcttctcgccgacagaaagcgcttggcctaccatgagagtgtcgccatctgcaatggcggcggaacatggaggagtgtgcagggaggagaggagaagcccactgagtagtagcaagacatagagaggaggtggcatggctggagaagataggtgaataatggctgaattggagaagggaggagtatatgcttagtaacggtttagctatgtagtgctggtatatgcttttatgttttatttggacaagtaagaggaatgcatgaggaatgcatgtatatacagagaacacacgcgggggactgcatcagcctatccatctatcatggggaacacatgaggtttaatgtaattcttccatcctaaaatatatcagcctagtatagaataagatacattctaatactatgaatctggacaggggcctgtttaaattcgtattattagaatgcactccgttttgtattataagtcactttgaccttttttttctgatcaaactttatgaagttttactaagtttatagaaaaatagtaacattttaaacaccaaattagtttaattaaatctagcattgaatatatcttgataatatatttattttgtgttaaaaatgctactatatttttatatgaacttagtcaaacgtgaagaagtttgattaggaaaaaagtcaaaacaatttataatatgaaacataggacgtatctcatatgttgctatattttagaacgaatgtagcataatagatgctgcaggttggagtacatgcatgtttaatttaggcagctgacaggtagaacaggagctgcaaggaccttccttggtcatgtttgttcactctcatagattcagagtttcagacagcaacttggcctggtagaggtacaacggtactcgacacggcaacgtacgatgctgcgggtcatgttggttcacatgtctactaggtcctgcagatagaagagcagagcacattcaagtcggcatgatgattgtgaaaattaatttgttcaagaaactaatggttttatacgacttcgaatcaaaccatgacctctgtatttgtgtttccacataggacacatttgctgaattggctttatgtgtttagctcacatcaaaattggaagtttggttgaaattggaacgatgtgacgaaaatgttgaaagtttgtgtgtgtaggaaaattttgatgtgatagaaaagttgaaagtttgaagaaaaactttagaaataaacacggcatgaaggagagattctttgaaatcggaaagatgaaattagcagttcttgaaaagaagaatggatgagctctgaactctctgttcgtcacaactatgttttatgccgaccaacatcatcttgaaggcttttgcagctgcctgtctttgccttgctgatggcatccacaatgtggatgacaagtggatagtaagaccccttactacttactttaccattgtgaaggactggaggtgggtagtctaccctataattcaccaactcactcttacacctacattactcattcatcaaatctaacggacagtattcctcagtgcccgatctaacgatcatcgcgtccacctcagtagtgtactgccgaggctgctgtaatcgcgtgatttatttcccatcaacgcgcgcgcctcactcccgaaatacctgccaccatctcaatctgtcgatccccttcctcgaatttcggaatcctgaagcgcgagcagtcggcttccgcacctggtgccaacggcctcgtcgatcacctgatctcttcactcgtgcgcggtcgacgttctcgcacgcctgcgaggtcttctactggtgaggaagcgtccgtagaccgctcgctaccgagaggatccggctgctctgtcgccgagcatgcgtccccgggtccctctgccgccagagccagggccacatcccgttctagcggttggcgatccttgcctctttgccatggcatgagagagctctgcagcgatggccacggcatgagaggggccctaccgtttagctgctgccctcttcgctgggccgtccacagcttctcttcgcccattaattgtgacgctgcgcctgtttatctcctccctcttgatcactcacggtcgagaattaaggctgtggcgaagtgggcggtggataaccttggaaggctagcgaccggataatcctgatacattatgcatgtccttcccaaaggagctctgctgccaagcaccataatctctacaagagcacaggctcatatatgcagggaaatatcctttttttcagttacttcagaaaggttaacaggtttgtagcggatctatcgttgctttctgacttactgtttctctgaacactgaaactttggttcctctgctggatttcatgtagatgaacgtgcaggcaaggtattggatcaaccccaataagatggtactggagatcctgcatgctgaatccaggtccaagcaggaaatggctctgctgctttgccaaaacttcatcactatttaagctctccactctagatgttcagggttctgcagatatctaggctggaaagggaagaatatacgaagtagtacaatcctaacatgctacattgtgttaaaaacaaaaactacatctgtagaattgaattgtatagcagaatttacataaattatcatcttagttcaaactaaatattaatacgaagggatattgtccaaactgataaaatgttcattatagtaacgcctgattttcagtacgacttgcctgaacctcacactaactgatcaaaatgtgcattcatgactaaacaaagaagaggctgctctctgtttctcagtcattcaacaaagaggtcggctgatcaagagttgtcttattgcaaccagccaatcttatagatattctcttatcgttttatgcatatgtatggcacaaagttatttagtgaggtgaagtctgatcctaaaaattggggaagatagtttttagatgagttgatgtcactatatcatataatttgaaaccataattgaatgtaatattttaatctgtaattgtccctgtatgctctttttgtttgataatttgagaagtcagattccttgggtgtgcgcaaacgcgcctcataatctaatgttgagcagtattcatgttaatcaatatatagtaggctgcttgggctcatatgttcacacttttggctagcagctacaaggttgcttctatcactttgtccgctgtggataatatcacgagtaaagcagcaccatcaatgcccagtacaagcctacaaggtaattttatcgtcaatacaagtgtcagaaaccatataatgctcaccaatttgtggtttatccttttagacaaactgacgttttggtttcttaccgcataaatggagcagaccaatgtcctctgcaaattttattcataatctgcctattctatataattctatatccactgttcattcattcttcttactgcacaataatcattttgtacaaataaatatgtagtagctttttgatgttcctgcaatatttgaatagatgagtgtaaaggaatatgtttattctttgcagcaggcagctaaccactgttacatcttgattagtaaaaaaatattgctttatttgcatttcgcattttttgaaaccctaggagccatttattaggtttttgggcagcacatgcttttcatgttagatttcagagcaaaatagatggaatgctacaggttggaaaataaatatcaatgccctcagctaaggccaccaatgttggcatcaattgaagctgcctaacaaataagaaaaactttgtagtgcaaaccctatatataatataaacctgaaaactactgtagaattaaaaattgaatctttggttcacgtcatcttgagtaaacttttgctcccagttttaaccatgagcaaaggttttattaggattaaaagttttactcaggatgaactggatgcatctcagatgttcatttttggatcctacaatagtttcccgctttgcactacatataaggtttgtaatacatatttttgcaacaaataatgtgttgtatttcacaacagttatgtattggtctattgtgacatagttctagcaactttaatgatttcttctgctgcggtgtaacctgtaaatatttttcttcttctcagccaaatgttattccattagaggatttaatttgtttattcaaatatcttaaatacaattttttttcatcattactctgatacaaatgacgattattgatgaagcaatagaaaaacattaagtgatgtttgtttatgcctaaagaaattgctcccacttgattgagaattgaactacacaactaaaagctgcccaagtttgtgatagttataataataattaaattagcatggatgttgacatatataaattttttatgcatgcttactaaatatcgccgtagcgttagcacgggcctgctactagtagaggaggtaataactataccgggtaatagcactgctacctggtaataggcataaaaaatattaaactctctcctctctcactccctctcttttttctacccaatcattactttacacgtgggttatatcttactatccacacattatagatggccaaaaggcccgaggcccgatggcccggcccacggcacgacattttggcccggccgccgggctttgcctgggcccctccaccggcatgttgggccggtcggccaggcccgacaaaaaaataatagggagcaaaaatagacatattatatgtcacagttcaaagaatagggacgaaaaatagacttatattagctatatatatgtcagcccaatgaggagggaggaaaaatagacttattttagctatatactagaaaatgagcgtgccagttggcacgctagctaagttagttaatagcatgtgtgtatttcccttcagaaatcatacatttgaaaaggattgttgaaagtccattcccttttatttttatgtttgtgaacaaactaagatagaatagtaaaaccatctagattagtggtattatcatgctgaacagactatataacatcgagaaatgactaaagatgatgtacattaataaaatacatgttttactaatatccaacacaattctcatatagatgtaagtcattgagttcgtattagtaggaaatacatatccgaaataaatgtgtcttcgattactattttttatactaatttcatttagaaataaaggacgatgacatggtaaagacacttattttgatttcatatatccagatatactactatgtagagctcagctggtcaggttctctacctatacgagttaagttctaaacttagcatagacgcttgtatttacggctatttgttttttcaatggtaggaaacccaccattcttcatcactcctaagatatgcctgatggcccagtcttcgaaggtgcttgtagtgattgggtttgtatgtgtgcgtttacaggtgtgtatacacacgtgtatatgaacatctatatctactgtgtttcgcgataaaaaaaatagcagtatgattgttgttacttaccaatgttccaaaataaatgaattcctagcataaaaaagtataatgtgaggagaaaaaaacaaaaatactctgaattaataggaaagtagttataaacttctcggttcacatggaaatttcacttctattccttccgttctataaaaattcaggtattttcctcgtttcaagtaaaccttatctgaagatttttaattttcctaacgcaatccttgctgtcactatttgttttcatttgatttaactatttatttattttattctcttgaaacacatgatattaacatgaagtgacttttcctcattccgagtaatctgtagtaaattgcatttgttaaaagattattatgcaaaggctaaaaatcctattatttttttctccttttctttttattcatattattttattctaaactggcttagtaatatgtacctgtatgtgctagcttcacgctgcatgaggaccatgcgcagcagcgcaggtacattgtggagaaaggccgtgcggcgccaggcccaagctcgcatggccttgcgagatgcctggcccacgttgcaagcgtatatacgcgaacgttttcccgatctctcgcgaagtgaataccgtcactttgactcgtggcaaatttttggagggggtgtaaccaaatttttagggagccacgtggcccaataaaaagccagatcccctgatttcggtattaaagatatgccacagcctaaagaggagggaggaaaaatagacttatttttcaaaaggcacgatggaccacccgtgccttcgggccggcccggcacggcccgactgctggtgggccgtgcctgggccggtggtgcagcccatgggccagcacggcacggcccggtgtgttggtcgggctatgccggcccgacagattttggcccgagcacggccgtgtctgggccgtgccgggccgggccgcccgaatggccaactataccacacattggccgtgtttagttcccctccaccaacttcaaactttcaacttttcatcacatcaaaaactttcctacacacataaacttccaactttcttcaaacttcctaatttttccaccaactaaacacagccattgtgagaggtagaaacaactaaaacctaattatgtggatcccatcttactacccacttgataaaagaatcaatttacagtggtctcgaattccggtgaactaatctaacttaatttgaaatgcttaaaaacgacatctgaaaagtcagtatcaacgaatctgtatcgacgactgcggtgcaggggagccaggaggcagtgactactcgactgatggctgccgaaagtctttagtaatttttgccaactaaacaaggcattaactgaggccgagtttagttacaaactttttcttcaaactttcaatttttctatcacattaaaactttcctatacacaaacttttaacttttccgtcacatcatttcgggcttgtttggtttaataccctaccaatatattggtagtgccaaactctaggcaagctttggcactaccaatattttggtagggtagaattgtaaatgagtgtctttggattgatgccaattgagagccaaatttcaaattatggtgaagaacattctagaattgtgccaaattgagtataggcatttccaaatatttggctttaaaccaaatcatcacatttactatttaaactaccaaaacattggtatggcaacattttggtatcaaaccaaaacggcccttcaatttcaatcaaacttttaagtttgacatgaactaaacacagcctgacttggatctgaacttgacaaattttgtaccaatccgatgtagcagaccatggatgtagttcttttgtcttagcgtctgtccacctccaagcatttgcttcaatgcttagaaaattatgacagctcacctctatccttgattgcaaaatgtgctgcccttatgtagattgaaaaatttgaaactattccaaataacatccaaagtagtactagtaaagtagtaagagaaggtatttcatcgaactttcccaattcgcttcctccccatccaaagtagtagtgaagtagtaagatatgtataggagttttgccctctgatggcctctgcatgttactaatgaccaagtgtatggatagctgagatcattagttattattagttattgattggttgaattgaacgtgcttaggttgcactaactgtaatctttttacttatggcaataaaatgtttacctgattcatttacttgcgccgtgtttagttccaaaataattcttcaaactttcaacttttccatcacatcaaaactttcctacacacataaacttctaacttttctgtcacatcgttccaatttcaaccaaacttccaattttggcgtgaactaaacacacccataaacttccaacttttttcttcaaacttccgattttagttcacgccaaaattggaagttaagttgaaattagaacgatgtgacggaaaagttggaagtttgtgtgtgtagaaaagttttgatgtgatggaaaagttgaaagtttatagaaaaagtttggaactaaacttggcttacgtgtgtataaaagttttgatgtgatgaaaaagttgaaagtttaaagaaaaattgggaactaaacgtgggcttactgtgacacacttcttgctgaatgtcaggtgtatgttaaacatgtgttttagttgagattactattgattggttgaattgcgtgtagtctgaactaatggcaataaattagttacttgcttcatttgtttgtgccaaacgtgtactctgcatgagttggtttgagttcagactcttaagtctgaatttcagacaagttcagaattgagctggttgaatttcagagagtttagaattgagttggttgaatttcaaagaagttcaataaattagttacttgatatatttgtttatgccaaagtaataacaccagtagagttgattcggacaatgagggttttaatggtgtcaacagctggaattaccgaggaaggctctgtcgctgaaactgacgccggcgttttttttaaaaaaatattttgatgggtgatgccggtgattttggaacaacagcaactaatgtttctgttttatagagaatacacatgtgcatgcaccgtattgtttaacagctaggagcaatcttaaccggcattatatcaacaaggtttaggacgtgtttggtttaaaaccaatttttgctctaccaaatcttggtagtgccaaaatattggtaagttttgacactaccaaattgggttgtactgaatttgaactactgtgagtaaaatttggtagcaaaccatatatgcactttttattattgaagttaccaaaattttggtagtataataagttggtatcaaaccaaactagcccttaaactgcgtccaagcttttcaaacagctgtccttccattagctttgttaaaagttctgaaaaaactggtccaaggaagagatgaaggatctgaacttcagacttgataatttcatagcacctatccaagagaaattttaccgttcttgaggtaccacaacttcaatcccactgttaattccacaggggtgagatctgtatggggaaatttattgacacaaccaagtcctaatgactatagttggccaaatgggccgcccggcacggcacggcccaggtccggctgtgcttgggccgaggtgttgcacacacgtgctgcacacacggcctaggcacggcccaatacgactcgggccatgctggactggcccgaaggcatgatagcccatcgtgcttctccacagaataagtctatttttcatccctcaactatgtgggctatgttcatatggctagaaataaatctattttgtatttctctcctttttgggtgttgccttatatggttatttaagtctatttttcatccctgtactatttttcttcgatcgtgccatgccgggccaacccaccgtgccgagggtgcagcccaagcatggctcggctgtgaccgggccaaaatgacgtgccttgggcgggccgtgggcctcgggccatatggccatctatactaataatgacttaaccgtaacctgatctttatcctcatctttctctccagggttatcttcctttcacaacaacacggacacgcggtgatggaactccttgtgcgtggctcgctttaggctgtgttcggaactcaagttcccaacccctctcactcgtttttcgctcgcacgcttttcaaactgctaaacgatacgttttttataaaaagtttctatacaaaagttgcttagaaaattcaaattaatccatttttttaagaaatagctaatacttaattaatcacgtgctaatggaccgtttggtttttcgtgcatgggagatgggttcccaaccccctccaacgaacacagccttactcattccagcggcatggaaaaagaaggcaaagaagaagatggttctaacgtgtgggtcttgcttgtcattgagggaatagtgaggctatgagcttgagattggtccttctggaccagccttgctgtagcagaaaaagaagagaaatgagaaacaacagaatttacatatatattacgtactttttttattatattagtataatcacataaataaaaaatattcttaattgccaaaaaggtacaaaaattttcagaactcagaaaaacgcagccaaacctcacgaccaaatgtaatcttacatgaatacaaaggatggacatagctatcattatctgctctctacctcactttccgtgaggcaaatacgcatctaatggcatttaattcagctaagcatcatgcttacattaataaatgatgacactaaattccccttggactcccactctttggatgaactagtaaaagctaccaccggtgtcaggtgacaccgacgactttcggcaaaagttatgcttaaaatgcttattcatatattataacattatattctaaatataattagcatactataatatcgatagacgataccaaagatgattcgccaatgtatctagtacaacatatcttgagtatttttttataaaaaaataatgttacggcaccagtgcaccactgataaatctgtttgattattgaagaggttaattaaactaatatttaagtgatcatcatatgaatatccggataaaagaaagtgaaaatgaaatgaggtaattttttaatagaaaatggcagtactccgtccgtaaaaaaaaaatcaacgtaatattagatgagatattttctaatacaacaaataacacatcaaatctattacttaggttgattttttttttatggagtacagcctatctggagtagcaggctgaacggcatcgtaattgaaagcctcgtcagagcaggctggtcctcgaacccttccgaaccatccagaagaggagcctcccgacggctaggatgcatccacatccactcatcaacggctaagacgcgccctcctctctccgaatttttaccaacttttactgctcgcatcaaatggagcgcgggcgaggcgggtaaaaaaggaagcgaagaaatccgtggtatttatattttcgagacccaaaaagaaaaccacgaattcccaataaagaaataggcaaaattccccatctcctcgtctcctcccaactccaaaccctagctcccaccccctctcgccgtcgccgtcgcgtcccatggcgaagtcgcggccgcccaagcggatcctcgagtcctacaccatcaagggctccgacaaagtcatcaagcgtgaggctccccctcccacctccccaaccgctgctcccttcgatccggaatttctgggggtttttttgggggggattttttttgtgggggcgtgggtttcggtgggtcgcggtttgttgaggtctggaattctggggttttagctccggttagattgaatgtcgcggaaatgtttgctctgtttcgggggagcattttaatttccctgatgtttccgtgcgaaatgaaatggtgtttaggtctctggtttactgttgatgtaagctcgattcataatcagaaaaggaaaccatggtagggatatgtgagcatgttaacttaatctgttggagcgttaactctttgtggttttgattgttcatgggtttatctctcttttgcatgggttttaggacggttaatacagaaaaaaatatatgtgctattgagttatgttatgagtttaaactcatcttgattttctgttttagattatgtccagtggagcccctacatggttttgtctgggttgtgagctacagttttagcaccatgagctatgtcattttgctgatatagcgtttttaattgcaatttacgatcgccaatagtttggattcatatgttgctaatcccagttagcattatgatcattgtggtgcttatagtcgtgctgtaattcttgtagcttaacccctcgaaaaaaaaaatttcttgtagcttacgttgtgtttcagttctggttagtattagacatttgcatgaagaacaataacttctactcaatgtgtcttacctttgactttttatttaagaaaatctttatctcatggcttagaccttgtgttaagctaactaattgattctatccagttaggcatcttaagttttttttttgatagatagcgtgctttagccttaaatgaaaaacgattattttgcctagtttttctagtcttaactcttttttgtgctatttattcaaagttgatgcatgcgttctactaatcttagcttatgcaaaggtcagagatgccagattctgagatttctgacattgttctattggcacattgggattctttgggatggaaacctgcctagataaaccttaattaccggtatattacttgcaccaatctatgcaaacttaaatgcttcttctagcttgagcctccttttctatatttatggttaatatccagacgtgtgatagcaccgatgaaccttgatgcttcgattaccttgtgtgtgtgtgtgtgttttgagaacagattaccttgtgtttggtgaacttttgattaccttgatgaacagacgaatatttttcatggtttctaggagggtaatacatatatgtgctgttgagctatgttatgatcttaaatgcactttgatttcctgaattcctgttttagattatgggagttcagtctgtaagtagttttgtatctgtttgtgagctacaatttagcactactggcagaacccttctgctagatataatctagaatctgccttctgatcgtcattttgctaattagagatttttttaccatcttaatggctgtgttcatgtgttgcaaataccagctgtagttacaattgtttatggtgcttatagtcttgaccttctagcctatgttgcatctaagttctggttggttttgacatttgcatgaagactaatctctttctacacaatgtagctactgttggactttttactgaagaaaatgtttgcttaactgcttaaagttatgtaatcaatactatccagttaggcaccctaaagttttgttttggctagatagtgttctctagccttaaatgcaaaatcaatatgttgcatagtctttctagtctgaactccttttgtgctgtttgttcaaggttgattcatgccttctgctaatctaacttatattcaagttagaggtgtcagattctgaagttttgatatctgttaaattctttggtatggaaacctgcccagataaacatagttactacttacaccgatatctgtagacttaattggttcctttagtgtcagccctttgtttaattttataattcatatctagatgttgacagcatccatgaaccttgatgctttgattaccttgtgtttagtacactttgttttactgtaagcagattgcatttcctttgctctgagattatcactgtgatgccagtactatccaataccagctttacatcttgatgatgacccatgtcactattttttataagcataaaattatctcgatacctgtctgattctcttatatgtttcttgcagctggggactgtgtgctaatgagggcatctgatacatcaaagccaccctatgtggcaagagttgaggctattgaggctgcagggtcacgaggcacaaatgtgagagtacgggtgcggtggtactatcggccagaggagtccatgggtggaaggcgtccatttcatggtgccaaagaggtgttcctctcggatcactatgacgtacagagtgctgacaccatagagggaaagtgcaacgttcacagcttccgtagctacacaaagcttgattctgtcaatgctgaggacttcttctgtcgctttgagtacaaatcagccacaggaagcttcgtgcccgaccgcattgctgtgtaagaatttaatgcaacctccgctatgtgatagccctgaaaagaacttgtttcgtatttgcagttaattccgttgacatctgcacaatattgatctgttatgtcgatgacattttccatatttaaatatcatgttatctgttgattatgttttccagtcttctttagggatttcacacatgccttttatatttgatgtgaaatcccaaggtcaacaagttcgtaattctgatgagttgatatgtgatatatgtatccttatgacctgtctagattctataggcttcagtgcatcaccagttttatctttccaaagagtcacaataactatttccctgtgttgaagtggaatatgaagggatgcataaggttttgtgcctattttcagcttgccacatttgctgttattacttgcttttggagaaaatagaggcacagtaaaatgctcttacaaacttgagatgttcttttaccgaagagccactgcatgccatgatatattatgtggtatgtctatggtaggctcgtgtagtggtgtagcccatattgcacataagtaccaagacagctagaacccattgcttactacaccgccccaatttagtgcattctgcaccttgccccatttaaaactattcttttcgagtcacatgcatgatgcatcacggctggtagaaggcttatgaggggtcagcgtgccaggctcatggaagcagctcatgccgtaccttccatctagctgttggtgtttgagatgaggctataggttgtgctggccatagtactagattagtccggatcatgtagtgttagcgaggttagagataagattggttatgatttattacttctgcctgttagggctgtctccaatcgtatttgttagagacacgatctggacaacctggtgctctcatgtggtagggtgccagtgctgcagcctttttgtccatgaggggccctccttggactgcagccatagccgccacctagaagcttgaggatgagctgctcgaaaggaggggtgcaatgtcataatgtgagaggttatagaatgttctgaaggcagcagcagtagtgaatgtgcatggttctgtcggaagccgctgactggctaacgcatcaagagattaggagctggtgtgcacagtgcacgtgaatgtccaatgacatgttcaactcagataggtatcgaccaagtattggtcgattatacataaaaaaataattagttttcttctcaaatatgtggtcaacttttctctgatcgtatgcgacacggcccagcccacatagccaggatactcaaccctaatcccatccctgtgtgccctcaccaggctaatggaattttggaacatatgggcatgcattgagtattgactgaattctaggagctatggactgtctttgagataagttttccttttttacagcttgccatacattatttcagtgtcaaacaattgaaaataatgtatacataatatttttatttaaatatgtagtgtgtcaccatattgtcgtttccttttggtgggtgggtgggcgtctgtgttgtctgtgggtgttggggggggggggatggcgaattccctgtatcagtaccatgccatgtttacggtctgtatccatgcatcataggctgaagcaacagattgctgtcgtactgtcattaagattgttagctaacttttggataggcatatctcttatccttcctataagtttgacaaggatgtttggcgcatagctagcttatataaggacacgtgactgtgtcattagtattaagcaagaaataacaaaatggttccttaccttcgttcttcttatctccctgcccttgcgatgctgctgccaaccatcagcatggtcgtacctgttcggtagagcctgtggtgttgccaaatcctaagcatatatgacactttgtaatgctgtatgccactctgggtgtttccttatcatgttagttggtttcaattatttctttatttgaccatgattcctcattttacaaaatggatgtcttgtttattatggtagttctatccgaataacatgaataaagatttttggctgtagtggatgaactgcgaccatttttatttactgttgctacattctcaaccaaatatcacttatattgctatgctttgctggcctatgctatctattaaattgatttatgtattgcattaatatcatcattttatttgattttctcatccctttactaacaatatgacaggttctgcaagtgtgagatgccatacaatcctgatgaccttatgatccaatgtgaggaatgctctgattggtgagtaatgaaataattcatttaaattcatctttttcctgaactgcgctggtgtacattttatggttttatccctcttgccactgggtgaataggacaaccaattttttttacctattaatggatttgggtgtcttgcccttatcttattcttgcctattgggatgggcggcaactagttagccgtcagagaaataaatgcttttccattttttttacaccagaacaaatcactcattggctctatttattcacaatccccaaagagatttgtgcagatataaaggcataaccattgcataatgtctatactctaaattcctgagagcaaggctacaaagtgggcctctcaatatgcatggcatgtctttgttgttacatcgccatattaatttgttgaaacatgtgttttgggctgatgttttggccaataatgtaggtcgtgcttatatattgttaatgggaataagcactattacaattgccacactagactctcttaactctttccttgctgtggcaatgcagagacgaaggaaaaaatttccttgttcgcttgtcctaattctaatttaaaataaggaaacaattaatgcgctggtaaaaactatagagagatatatatcctagcaaacataaggaaacaagctaaaccccatatggcctactgagttattgttttttgctagctgtagaaccttggcggttatagtactctacacaccccaacccccacacgctctgaaagaaattcatgacctcaagctacatgtccatggaatccaccatcaaaagttaatagaattgcttttgagtaggcttcacatttcatatacacttttcagtacaatatatatatgaacaccaaaagatgaggaagggtttagcaagtgaagaaagaaatccactctactctaaactatttctctggagctcttaaccccctaatatatatatccagctccacctttcctagacctggagcccaacgaaacagtttcagctccacctaaaaggggagtggaatgggctggattgattccaaaaaatgaactagatgggtgaagcggggcttgggccgctccaccgctccactccagattccactaggagttggagccttgtcaaacaggcccatattcttttgttcattgcacatggcaaactattaaaactaggccacactactactcaacatcatttgtctattttgtttttcttgtacaagtagtaactttgaggtatgacagattacttcgtactattgtgttctataatattttaagatttttcctgactatttcacttggttggaaacacctaataccggtttaaggactgagatatgaacttctatgcaaatgattattacaactttgaaaatatttcttagcatagaatatgatagtatcaaccatcgtggtttgaacttaaaagtactagcaaaaagaagttgggaagaggatggttcactggagtaaaatggaccttttcctgagataataaaacatttaatttgttttgtcttctgcttttacttttgcatgaactttcttatcatttttttgtcacaacaaatatctgctgcttttgctttccaggtttcacccttcttgcattggaatgactattaaagatgcaaaaaaactagagcattttttctgccagagctgtactgcggaaaatggaaagatggctgagaattctcatgaagctacagcgcaatccgaagaaaaggtaaaatatgatatgttgggattactgaattatcattaatgatttgtttagctatcagtagtgcgatggtaatacatcaaggccagggtctcccgggttcaccatgtcgtcttaataacataggctacacataattttcaatgatattgaggcatgctgcttaataatattattataatatatgagatgtctgtcctgttgtatcgctactgtagttgacaaatttccaatacttaatgacacaaagcaccagttgggaaacagtaccaatttattcatatggcagtanaaagtctggtgtgattttacaactataaaggattggggaacttttgcatgttgattactgtggcaattgctgtaacctttnttttggatactgcacaatttgccctactttagcttgtacagtttcactcttatattatgcataatctaatcatacagtaaataaaacccatccaaggtacatgcactatttagttcttttttaatttggtaatcaccattctgcgattctgaaagacaaacatttcatttggactaatctcttcagcaggtggagtcaaaaagacggagaaggtgactgccccccagattcattgacgagatacacctggatgtacaaagccttctcaagttggtgtaatgctatttatttgtcatggcaagtgtgtgtgacccacgaccacgagagtcccttcctgtaatgtcagtcgcatggtgtacataaacttttcaacctgagactgttgtattaggagacgacacgacctgttgttgttgcatgatgtttttagcagcgtcagaattagcatggtagagtcgggtgatgaagcccctcgcgggcattaggactcccgtatggatgttatcactgatcatacattgatactacattggatgcagttgagtctgtcatctgcgtttgtctttggagaattcttgtaccatcaatccatcatgtgaactttgattcttttcgagacgcttcgtaattaatgcaggcatttctgtgtgggtagtcagctaacgggggcgagaaatggcttaagaagtatggttgaaattggaacgatgtgacggaaaagttaaaagtttgtgtgtgtaggtaagttttgatgtgatggaaaagttgaaagtttaaagaaaaagtttggaaataaactcagcccaaatgaaaatttgacatcaccagccaaattttgggtaaggtagtactaatgtacaatcctactaaattttgttagttttgaaattttccactcacaaaagtctactaaaatttgtgaggtattaaaccaaacatcacctaaccttacttttatcttattaaggggctatttacttcatttctgaccttatcagttttgtgttaccaaattttattaaggtaacaaaataaacatgttctcatctctaccttactaaaatttactgtaagttttcgaagtttcctctcacaaaaacactaccaaactttaaaaagattacaaattaaacatatccaatgctatcaaaatttggtagcatcaaaatataccaaatttttatagtgctaaataggggtggaaacgagccaagccgagccaagccgtgaaagcttggtcaagaacaggcttggcttggctcggcttgataaatgaaacgagcaaaaagtgcagctcggcttggctcatttaaaagctcgagccggctcgagccagcttgtgagggagcgctgagcggcactgaggagggaagcccgaggcagcgcagggagggaagcatcaccgcggtggctcggggagcgtctagccatcgaccatcgaccatcgagcgcc

SEQ ID NO: 2200 - DNA, 626 bp, Oryza sativa
tgataccatattaagttgcatgcatcagccagttgcacctaaaaacctaagctgatagggaaagacagtcaattcactttatacactccaacattatccaccaccacgccggtagtagaggaggacaaggaggaggcggaggcaacgatgacggggacaaaagaggaacagtagcggcggcggccaatgttggagtgctgctgcacggtggccgccggagctaggcggtggcggtggcggtggcggtggcgcttgtgcttgtgctgtcagccgccgtcctatcttgttgtcgaagaatccatcttttgaacccatctcgtcgaaatcctagagcaccaaaacacccctacctggcgcgccactgtcgacgtttgatgtcgcaattctggtatttgcatagtatggagatcgtcggtgctaggatatacgcgagactgaggtaaaagagacggagacagggacttttatacaggttcgggcccctgaattatcaagtaataaccctatatcctgttggccgaagcccgtattgctcttattcaccataatcacaccagtacaatatgtggggtagcctatctaactgttgtcgacatggcgggcctgaaggtctgactcgtagtcga

SEQ ID NO: 2201 - DNA, 595 bp, Oryza sativa
  unsure (1)..(595): unsure at all n locations
tggcattgttatgatgtgatgctttgtacagataagcgtccgccctgtagtattggatttggtttcttgctgcgcggcataaacgaggattttgaccaagagtattatatttgaactgtattagatttggtttcttgctgtgcggcatcacgaggattttgatcaagagtagttagcacttaccaggctgatatattgttgtctatggaattatcaatggttcttggatttattttctttctgtgcaacaacaacaaggttgccaaagaatatttatctagtatgaaattctgaactagtggtacttatgcttgtcatgccaataactgtgaggctaccgttattctttcttactgcgcaattgaccatttgttcatgtcatgtttccatccctaatgatggccttttctggactgtttgatctacaggtcataattgacttcactgcttcctggtgtggcccttgccgcttcatcgccccagtgttcgctgaatacgccaaaaagttccctggtgctgtcttcctgaaggttgatgttgatgagctgaaggtgcgcagagtngcccacaatcttccaaaaacattttgtcaccc

SEQ ID NO: 2202 - DNA, 594 bp, Oryza sativa
cgtcctggtgcacctcgatccctaggtagaaggagagaggccctaggtcactcatctggaaggtggccttgatctcttccttgaacaacgccacctacgcatccttggtgccggtgatcaccacgtcgtcgacatagacacccaccagcagggcatttccaccattgccccatcggtagatggccgcctcgtgcgggctttgctcgaagcccatccccttgagcatggaatccagcttggcattccacaccctcggtgcctgccgcaagccatagagggccttgtgcaggcgtagcaccttgccctccttgctggggatcgcaaatcccagcggctggtgcacgtagacctcctccttcaaatcgccatttagaaacgccgacttgacgtccatgtgatgaacacaccggccttcctgagcagccagcgcaaggaggagtcacacggattccatccgtgccacaagggcgaaggcattgtcgaagtcgatcccctcccgctacacgaaaccgcgtgccaccaagtgagccttgtgcttgacaatggctccggcttcatccctcttcagcttgaacacccaattaagggtgatcg

SEQ ID NO: 2203 - DNA, 761 bp, Oryza sativa
ggagtcaaacttggtgaagaactcttgtaggccagtcatgtgatgggtggcgccggtgtcgaggtaccacccatcagtcttgtcgttgctagagccatctccgaggaaggcatgtgccttcggctcatcaaggtggaggagagccgctgcggccgatgccgctggaggtagctcgatgcttgcgtgtgccaagagtagagccggctcttcctcttccacctgtgcaacgtgggcctggccgcgtcggctgtcgacagtatttggcccaatggccaagcttgccacagttgcggcaggcgtcgtctcgtgccagcttgtggttgccagcggcgccgccctgggcgcctctgcaagcgccaccctcgacgcgtgttcgcgcccactgcagctggacacctccgtgcgccttgcgctgcttacggccgcctgtcgaggaagaggactcccccttcctctcgtcatcctgacaggcctcccactgctcctgagtgagatggagcttcccgccaatggtggtatgccccgagaaaggttgtggctcatcgctgtcgacgaacttgaggcgacctatcgcctcctcgatcgacatcgtggagaggtccagcaaagactcgatcgagcgagcgatctacttgtacttctctaggacgcaacggaaaatattctcgactactctctcctcgtcgtagttgtcgccgtcgtactgcaccatcttctgcagcagagtattgagcggagggaaaagtcaccgggctgcagga

SEQ ID NO: 2204 - DNA, 610 bp, Oryza sativa
tcctttgtcgcttactccttcgaggagcttcactgacatcctcctcagagacaagttcatgtgtatgttcagtttgttttggtggtgtgattgaactgggaattatttcaaagggttggttcgaaccactatgtgtatccttcattgggaaaaagctctcaaagaagatagaatcacgagactccataattgtaccaacatgcatgtctggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagcgtgcgattcttcctttcagcaatcccattagactcgggagaatagggaggcgtcctctcatgtatgatgccatgttcctcacaaaataa

SEQ ID NO: 2205 - DNA, 515 bp, Oryza sativa
cggttgtcagccattttgtagtcatgaaactgctccatgatatacagatcattgctagcatcagtagcaccgaatttagtattcagtgcatcccacaactccttagcgtcggtcatatgcatatacacctcgaccagacgatcggccaagaacgctaagaatgcatcccacaaagagagtagtggtttcctcgaattgcttctgctgttcagcagtaagaactccttcaggtttgccagtactcacctagaagcatttcatagctgtcagccacagagtgaccctgatctgccatctcttaaaatgcacaccggtgaatttatccggcctcagtgcatcggcaaaaccagccatagtaaaatcacagtgcctatgataaggtttttggattgttgagattatagacatataatgatttaatctattccataaataaatcatgacattacagatgaaaactagcacgaacgcatcattagatctacacatgtaactacacagtagggctgcaggaa

SEQ ID NO: 2206 - DNA, 614 bp, Oryza sativa
ggcatgtagctagctagggtttcaacaatgaaggccatccaagactatcttgctcgctccaactccaagtccaaggtccctcctcctctccgcccctacacattctgaattctcgcgcctccctgtattcattctagttcgatacagctagtagaaaattcatcagctttgctcaattgctcaataagattataagaaaatttatgtttctccttccttttagactaggcgtaatatacatatatgatcagtcccttaactcttgaaaccgggtaaaaacatgtacctccaacctgtttaacaggggttttacccaaactggagatgggacctgcttgatcatcgtttgtcgtgtgggcccaccatttatcctcaatgacaagtggacctcacctcctatgctgctcaaaaccatgtcaaacggggacaagatttatcctgttttgagagtgtgagctatgagttgtatctagtttttcaattaagggatgactagaaaaaatgcccgtgcgttgcaacgggaaaagactattttaatcttattattattatatgttttaagtcaggtgaaattcactgtagaaattcgcttgaatatatgtattttacaaaaa

SEQ ID NO: 2207 - DNA, 562 bp, Oryza sativa
atcttggaaggagggtatcaatggtgatggctgatgattgttctacagatgatacggttacggggctcttaaagcaaaggctggataccgaacaacttttgttaggtgggtctttgctgaacatgagatgctgcgcctatgtgctaagtagaattgccaatagttgcctgggtgtgatgggaggtgctgttgataggatccgcgccagtgttgatttctggacagcaacaactgaaagagatgtagtgtttgctgatgttgctcgtggtttgaatgttaatctcgacaagaagttgactcttgattgtaataatagatggtactctaccttatccatgttaaatgttgccataagctacaagcaagtctttgatcacttaaggcaaatagaggaacagtatatttgtgctcctgatgatgatgactggaaattagcaaaagaggtctgcagtaagttgaaactgttttctgacattgcagaactaatttcagagcataagtatgttactgctaatatgtacttccccaagatttgtggaattcgatggccatgaggagatgg

SEQ ID NO: 2208 - DNA, 1235 bp, Oryza sativa
ttcagagatcagaacatgaattcggtataatattatatatatatatatatatatatatatatatatatatatatatatatatatatatatatatatatatatatatatatatatatatattataccgaattcaaatgttcaatataaaacttgtagaagagaaaatattgttggtccctagtccaatgtaaaactctgataataaaagatatcctagtgtagaattcacaagaagaaatattattttcccataaatgtatacgaggtattgtttgacatgccactgttccatataaaacatactccctccatccgtgattgcagtggcgaaactaggatttgaatactgtcacgccctgaagttcttctccctagcaaaaatttaattaataaattgtcgcaagaaattatttgtttaaaggcaagagagaatttttcttggaatcggcatgtggaatttttcttggattctacatgtcaaaatatgctaacaggaattttagtggaattttcagagccttggaaataattttagtggaatcccaagaagttggaggatatacctatagtacaagagtatcctgaggtgttcccagaagacctcactacaatgccaccgaagagagaaatcgagttccagattgatctggcacccggaactgctccaatctacaagaggccgtacagaatggcagctaatgagctagcaaaagtcaaaaagcaggttgacgaacagctgcagaaagggtacatccgaccgagtacttcaccttggggtgctccggttatctttgtggaaaagaaagacaagaccaagaggatgtgcgttgattatcgcgcccttaatgaggtcacaatcaagaacaaatatccgttgccaagaattgatgatctgtttgatcagctaaaaggagctaaggtgttttccaatatagacctgcgatcaggctatcatcagttgagaattcgggaagaggatattcccaagacagccttcgccactcggtcttgctctcttttcccccacactagagttgaagtccttctcagttgaagatgtcacaaagaagttggtttcgtcgctaccgtcaaggatgcctgtggaatggagtcgcccactgtagaagtcaagtcttcaggcttagctcgtttttttcctcttttttccgctgcatttgtaatcttttatatttttgtaagacgtggatctgtatgtcaataattgtcgcttgtgt

SEQ ID NO: 2209 - DNA, 446 bp, Oryza sativa
ccactccccagcagcaagggtaaggttttggcactccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgcccggaagtacgaagatgtaccaagatctgaaggaaggatactggtggcccaacatgaagagagatgtggcggaatacgtagcactctgtgacgtgtgccaaaaggtgaaggctgagcatcagcgaccggcaggcttgctgcaaccccttaggattcccgagtggaaatgggatgagataagtatggattttattgttggattgcccaagaccgcaacaggatatgattccattt

SEQ ID NO: 2210 - DNA, 589 bp, Oryza sativa
aggcaccaacaccttggacctccattgtcctggaaatataataaatgcttgattttttgaatattccaaaacatgatgacatatactctccctgttctagattataagtcactttgattttgctcaaggttaaactgccccaagtttgattaagtttgtagaaaaaatagtaatactttcaaccaaacgtaaaaatatattatgaaaatatattcaattatagatttagtgaaactaatttggtgttgtaaatattattattatatttgtctctaaactaggacaaacttaaagtaatttgactttgaccaaaatcaaaacgacttataatctgaaactcaaacggatggagtactatggccctgtttgggggagcttctcccagctgcttctgctataagctgccctaaacagtccacagcttctgagaatttgtagttacagattctaaaaaatgaactaagaagccagaagctggagaagctgggtttcagagcttttccagattctcataagctggctaccaaacagctgcttctcaaaatttaaagctccctcaaacagggcctatatatatcaagtgaaaacc

SEQ ID NO: 2211 - DNA, 625 bp, Oryza sativa
acccggatgaactgaacttcatcaccctgatcaatccctcgtgtgcctggatctcctggcacatgtagacgccagtgaagtccatccacttcttgttctgctgatgaacttttgtcctgtacaatgtgcctgagttcaatcctcttggttggacatgtacatcatccatggaaagtactctatctgaaaccttcttcctcatgaagatttcccacaagctcttgaattcgtttctcttagggccgtgaccgaagcgaatgcgcagtagttttcgcattagtttagagaatccaggcacaatctcaggcgcatttggagtcaccatttcatcagatgatgttccagcctcctcaacaatctccgagaggacatcgtgctggccttgatcatgagatgttgtgcttctccttccactactgttataatccacatcccttgtgcagttatcagcactatcattagtattgtctgttgctgccaaaatactgtcagagaagcaagaacggaaggaagagcagatgctactgatcctctcctcgaaatcgtgaaatgagcagcaatccgttgttgcgatttctgccagccactgggggaaggccgtcccggtaggaccggggctgcagga

SEQ ID NO: 2212 - DNA, 238 bp, Oryza sativa
tcatattatgcattatcaagaggaagcaatgaattttcagaagcaaacttgcttggcaaaggaaaatatggttctgtttataaatgcactttacaagatgagggtgaacctgtagccataaaagtgttcgaccttaaacaattaggatcttcaaggagctttcaggctgaatgtgaggctttgagaagagttcgccatcgttgtctgacaaagatcatcacttgttgttcaagtattg

SEQ ID NO: 2213 - DNA, 1381 bp, Oryza sativa
  unsure (1)..(1381): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttggtgctagttttcccttaatcttaaacctttttgttcccctcatcggagaaacctttaaataaacgtaatctccttccttaaattctaggtttcttcttcgggtgtcggcataactcttttgtcgtgattgtgctacctttaaacggtcacggatcaagcgaaccttttcttcggcctcattgataatgtcaggtccaaataccgcccgttcacctgtcttagaccacatcagcggcgtccggcatcgtcgaccaaacaatgcttcattgggggacatcttcaggcttgcttgaaagctgttgttgtaggagaactcggcgtagggcaaacacctctcccagtctttgctaaaatccaacgcacaagctctcagcatgtcctccaggacctggttggttctctccgtctggccatctgtctgtggatgataagctgtgctaaaagcaagataacttcctagggcttcatgtacttttcccagaaatgcgaggtaaactgtgtgcctcgatcggatataatcctcttaggtataccatgaagacacactatcctggtcatgtacaactcggcgagtttagcactgctatagtttgtcttgacggggatgaatcttgccgtcnnnnnnnnnnnnnnnnnnnnnnnnnaaatggaatcatatcctgttgcggtcttgggcaatccaacaataaaatccatacttatctcatcccatttccactcgggaatcctaaggggttgcagcaagcctgccggtcgctgatgctcagccttcaccttttggcacacgtcacagagtgctacgtattccgccacatctctcttcatgttgggccaccagtatccttccttcagatcttggtacatcttcgtacttccgggcaacctccaagagtaacaagtctaggatgcttgccgaggatgatcaagtgccacactagctataacaatgaagcaatgcacttggattggcttaactcactctctaacacctcactagataaactaagtgcacaagggtgtgagag

SEQ ID NO: 2214 - DNA, 390 bp, Oryza sativa
cattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgcccggaagtacgaagatgtaccaagatctgaaggaaggatactggtggcccaacatgaagagagatgtggcggaatacgtagcactctgtgacgtgtgccaaaaggtgaaggctgagcatcagcgaccggcaggcttgctgcaaccccttaggattcccgagtggaaatgggatgagataagtatggattttattgttggattgcccaagaccgc

SEQ ID NO: 2215 - DNA, 1072 bp, Oryza sativa
aagaagagtatggcaggcgggtcctgcattttttaattaaaaaaacgctaactggattgccacgtgtgcgccacgttggacaaaacctctctgaattggttcgaggggggtaattcgtccggtttgcatagttggggggtgaagaatgtccgtttttatggttcatggggtaattcggacgaccgcgatagttcgggggatagggggtggggggttattcatactttttccatttatttttaacggcagtcttttgtctatttggcaccttgttaggatcgttcaaaaacttgtcacgtcacaattcgagatttcgatagcaaaggacacatgtacgtttttttagaagccttataaaaaattgttataaataacacaataagatggtgaatatattagtagtagcatttttgtctatggtgaagttctggagtagtgctttctgaaagataaacacatttgcaaacacatcatcgcctatgcgtcagcattgcaattttcttagtcagtacacacgtaaatgcaaaccaatgagcaaatgtaataatatatgaatgttccattgcacattccgaatacacaactgatcatgttgcaacaagttaccaagaaagaatatttaaatttaagccaaaaatttagtttcggtgatatatttggcccctctttcatctacatagtttaatactctgatcccttggtgtattctgatacaagtttcgaaaataacgatgaattgtcttccagaagttttgctggcgagtcatcctctgcgattttacctgtttacaacaacatggaattaaaacgggagaaccaagctattaaccgttggctactaattaaacacaaagcacatgactaaccattgtccagaagaatgaccttctcactatcaagaacagatgcgatcctatgtgctattgtaatcactgtgcattcgaaaaattgttgcttcagggttttctgaatcaaattgtcagttattggatccactgaagaagttgcttcatccaaaaccaagatctttcgcttctttagaactacccttcccaaacaaacaagctggcgc

SEQ ID NO: 2216 - DNA, 1718 bp, Oryza sativa
  unsure (1)..(1718): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgcaactctcgccacagtagctgttgccgtcccgacctcactgcagtaaccgtcattgtcaccgagccatcctccgctagatctagtggtggtcgttagccctctttgttgctaccgccgctggtggcctcctcccctccgaccagatctaggagagggatgggagtggggaagccgacaccgctgctcactctgctactgccactgctagcggccttgatcccctttagccagatctaggagaggaaagggacgcaactaagccggatcggcctcaaatctgtgtccacgacaaatttgtgcaaatccaactggtggagttgcagccaactcggagtgaatcaggagattatttacaagaaaagaaatacattgtttacaagtcgacgctgccaagaatagagaaatcttttacactctcaatgattgttctcgtgttctagcctaccagttacaaacagagaacgggtacacactgatctcatcgctccaggcctccagcaagcaaaagaacgtggtgagagctgttctttcagatgtatgacgcctctcatcatgtcaggtcacatcagagattaacaacaagtaaacatagattaactttcggctacttgattaaatactgccatcaacttggccagaatttggttttgtgctttgtcaaattcggagagcggcttgtccgacgagcctccatagccaccggccgccgcaaccttgattatatcctccacttctctcaacaaatgtccgaccacccgctctagctccgccgcgtcgggcggcaccggcagcggcggcgcgtcgccgtggccgtgctgagcagccaacggatcatccgcagccggcgctggggcggcggcgtgttcgccattgttgatgggcgcatcaattcggcataatcccttcgcatcagccatcaaatattcccgcatcttgtccaagaacacgctgtccactgccggaactggcccgctgtagtaccgggccggcggctgcgcagccggcgcggcgtcgtgctcgccgtcaccgttgttgttatagatcatcgcgccgccgtcgttgaggccagccggcgccggctcctgatcaagaaactgctgcggcggcgtcgcaaagggttgttccaataatggcgcgccaccagcggagctagccgatgccatggcggactcccctgctccgtcaacatatgcattttcaggtggctcaggcaccaaagtttccaagaacacgtcgtgcaccggcggctctgtagccggcgcggcggcggaggcgtgctcgccgttgtcggagacgacgagaccaccaccgaggccagtgaacatcacctcgtgatcctgaccaagaaactgctgcgaagtcgcgaggaaatctccatggaagagatgctgttgctgctgctggtatgcgtaatcctgttcttggttgatcatttccgtatagaagtaatcttggtcggtctgctccgccgccgcgacgtgataatcttggaaattctgctgctccggtgcacagtattcctgttcttgatcgctctgctccgccg

SEQ ID NO: 2217 - DNA, 1987 bp, Oryza sativa
tgaactcctcccaccggaacgtctcgccgccgaacaccaccaccggctcctcctcccctctcggccgctccgtcctctgctttatccacttgccgccgccgccgccggtgacggtgcggctcacctgctgctgccgccggccaccatggccgtcacctgcgggcaccggcccgatgaagtaggcctcgtcctcgccgccccggccgtggcggtggagcagcgcccacggcggcgcgctcgccgggtcgtcgaggaagacgacgccgtcgacgaggaggcgtcggtgctgcaagtagggcaggaggaagaagcagagaagctgctcgacggacggattgaacttgaaccccggggagagcccctgcgactccgccgccgtcgccattgacgcagttacaaatcgctcccgcctagctagctaggtttgttttttttttctttttctttagaaaaaaaatcatggagaagaaataaccgttatatcgggagaggttggacttttcatcccgattcgggctcgacccctcgtcgttccgactccgaaaccgtccatggcccgtacttttacatctcggtcgtctctcatctcgtcgcccagtgagagcagcccacgccacgataggtgtggatagcttttttcgtaatcctattttagccttatattgcgttcttattttttaatatacgatgccgttgattttttatatatctttggttatttatcttatttaaaaaattatgtgattattatttattttactgtgatttgatttatcatcgaaagttctttaagcacgatttaaatattttttatttgtacaaatatttttaaaaaggatgaatgggcaaacatttataaaaatacaacggcgtcatatatttaaaccggaggtaatataagtttaggttaaaatgaataaaaaaaaagcccactttatttttgaaataactcaattttgtagcctaaaaatttaggctctttaccacccctagcacacgatcaactgaatatgcacacgtgcgtgtagcctcgcgtgggttgagcataaaaccacaatatattatttggttgctcgtattcacatagttggactcatcttacttacttacatgtacacttcgccatgttcactaaaagattattgttttagctaatcaaagatatattaatcaagggattaaaagataaaaacattattaatcaagagattaaaagattgctatgctttcattaatatgcagagaaaataagttcagggagaaaacgaggaggagagaatatatatatatattgatggttagaacgagaaaaaaaaagttctacaaaaatagtatacgtgggacaattcttggataaaaatataatcttatattgtctacataccgcagaacggataaaccatcggtctcaagtcgaacgaccccctaatttgaccatcagcctcaagatatgtcgctcacagtgaatcggcaaccagacactggtggagaagtggtttttactcccggttcgtaacccccctttagtcccggtttttcaaccgggactacgaatccgggactaaagatcgctatctttagtcccgggtgaaacagccgggagtaaaaatcgatctctagtcccggttggtaacaccaaccgggactaaagatactttatctttagtcccggttggtaacaaccaaccgggactaaagagggaataacagcagtacagatggtcctcttttttcttttttattttctcccgaatcaagtgggatgcatatccccaaatcccaaatcaaagtaacatcccaaatccacatcacaaatctttaagttacttatacacataaatcaaatacatcacaaatcctaaaaaaaattacacaaatcaaattacatcacaagttctacaaaattcatcgcaaatacatcacaagttcacatcacacacaaatcaaatacatcacaggatcatgcaataaatcacaaattcttaaa

SEQ ID NO: 2218 - DNA, 4244 bp, Oryza sativa
gagtaaatttttacttaccatttataaaagtggtaaatagttaaatactagtatgtcttacgatcagattattactgctcgatcgggtcagtcactttacatctaaagagaaaaaaaaggaaaaagataaaaacagagtcggtcactttctcggtcgggttctcgggtcaccgtctctccgcctctcccatcccgagcctctcgcaaaatccattctcccacgcccagatccaccgccccccgccttgcctcctccgcgtcgccgcgccagtgcgccccgcctcgccgccgccctcctcctcctcgtcgtcagggtaagccccccgcccgcctcctccgctccgagcttccccggtttccgctcgaggtggtttcgccggacctcttggttgccggtttctctggatggggatcccgatttagttagccatattctgcgttttgggggaaccgggacgtcgcaaatattgctcctggattggcacctgttcttcccttgtttgcgttgcgatttctttctactagtattattattctgtattactattggtctgcagaagaggcccttgctggggattttttttttatggaatatgacgatcgtaggcattgtgttcgtggctcaatttcaaattccgagtaggaattgggcgttttttgtatagtcggcaagtaaggtaatggcggtggcgaccattctgtctgaaattgaatacacagatgtgctagttagtttcatgagatgcaaacggcatggatttgtggtgctccttggcgcgctacccggatgttctagtttcatgccagtcatgccgatgctgctaaactactatgtgcaagtcaacatcgtatgtgcatctgtttttaagattatttttgttagccctaaaaggttcaatcctagggtggttgatgtaagcatattttggaagcacctgtctgttagcttatgggaatcattagtcattacactttttagaaatggaggcttgtgaagtatgtgagaaatataaagttggtacaggatagagatggtgccaaattccttatctagaaagatttggtgccaaatgcctaaagcaaggagctgtcaccatgtgtattaattttagcaacatctctcacaggattcacaaaagtgaatatttaaaaaaaccaaatttgcattttagttggagaatggcttcatcccttcacggcttcacctgatgaccagctttgaacctggtcttttacactcggtgaacaaaaaaaacttatcttttacacttcctttgatcattctcatgcccactaagcactgaaatgttggaacaccagttaccttatgccagaactgtcaattgctggactttttatttagtttcattccttttttctttgttgatgtaagtctcactgagtcactgactcaatgtcagtgctttttgcttgtacgaatacactggttaatgattataagacagattatcagatgtagtgttttcttgtgatttgtttgtcacgaatggaactcgttgcatgggagagtcttgcgttgagaattacttccagttgccaaccaatcatatgaatgctagtgtttacctgtttcaccttgtgctgaacagaccaacatagatacttcgaactaccctaaggacttatttgcctgctctttagtttatttattgtttaactaccacactctcggtccaaagtagatggcatttgaatgtgaccacctttgtagctttttcttgaggatttcaatactttcatttgttgacaccagtatcagtttttatgtgctaattttttcttaatgtttcagtgttatgtttttcatcactataaagtccaataaagtgaagagtgactctgcatagccagatggctgtggacagagatatctttggtatctcaggtccgacatatctgaatcctgttaattggtacgtgctcctgttgtgattacagtgttacatgacatttcctggaaaattttgtgattcttgaattattatgtatgtactatgtagagatgctgcacttaatctacgtttttaatttttatgcacatgcatgcacagaactaaattctgttaaatgtcttaaggttttggttggttcttatcttttatttctatgatagataatattaggtctatttaggcatttattattacaaaagcttctcatgttaacaaacttgtcacagccatcatttgtattttttttgaagagggcattagtcataattggtatgtcaatagttaaagaaaaaaatggcatgtcttacaatatgatgcatgaaagtgtgcagacaatctttttggagtttcattcattgtggattgagcttcatatttatgtatgtagtgttgacaatgaagcatgaatttagggactagtaatcaccttgatcttcatcgatgatcagcaaaaccagctgcctgttggagctattgccacagagtgcacatatatgattattttgctaggagtacagatgtgatgaacagtttccgtagtgcattaaattggtggaagtaactttttccctcgtttatgaactctcaaaaggaactgtgagcataatcggagatctgtggctgcatgcttagttcaggctgtatatgttttggagagggaccggcaactaggtcgtcaatctgttgaagccttgggacctccttggtgggaattcttccattttgagttgatccgcaagcttgtcgatgatgctgacttgtctattttcggtgcaatatttgaattcaatcctccttcaagtaaagaatcttctgctgataatgcaccgagatttgttattgccttcagaggcactataactgagaaggaaaccatctcaagggatatcgcccttgacctccaccttgtccaaaatggtctccatcggacctcaagatttacaattgcaatgcaagctgtccaaaacgtcgcctcggttttccctggctcaaacatctggctagctgggcactcactgggcgcaggtatggccatccttactggaagaaacatggttaaaaagggtgtgcttttggaaagctatctcttcaacccaccttttgttgccgccccaatcgagaggataagtgatgagagagtgaagcatggtttccgcattgcaagaagtgtaattactgctggattagccattgcaatgaaaggaaaaggcgaggggagcagccagaggtctgttgcagaagattctttccacattttgtcatcatggacgccatatctgtttgtcaatccaggagaccatatctgttcagagtacatcggctacttccagcatcggaagaacatggaggatctcggtgctggatttatcgagaagctcgcaacccaaaattccataggagatctgttttacaaggcattaggatgggaatcggaaccactgcaccttcttccatctgcagacttaattgtcaacgtaagcccttcaccggacttcaaatatgctcatggcatcagccagtggtggcagcctgagctgaacttgcagtgcagtaaatatcggtactctgtaggtgcatgacattggaaaaatgtcttaggagacccttcttacactttcgtttattcattgtggttcgttccactctattgtagctgtcaatatgctgtaatagatgtttcttgaacctctgattctgttgacatgaaaaaaacttgtaatttcgtggagcaacgatctgtcagtctttacacatatgttcgtgttcatgtagctcttcgttatttgatcattttctggtgttgggtgagcatacctctctcttatgctcataaattgtttttttttcctacttggtttgaaccatattaactgttttaaatatataatgtcattaatgtagaactcgcggctaagcttttctttaaaagccaaagctacttttgaattttaaagttgatttttaagaataatcctaagtagattttttacatggtctgataacaatcatgaaaaaagggtaggcaattgaagtggcgaagagaatctactatagttaattctaaattcaaaatcagtgcagcttctaacagtatattggaaatctccttataggaagcttcatgaaatattatccctatatttcctttgctttccaagagaaagaaaattaaagaagtggaaggggtcggagcttcttatatttggtattcggggaggatgggagaagtaggttcgagatggtttttttaagagtaaattttagaaaact

SEQ ID NO: 2219 - DNA, 4441 bp, Oryza sativa
ggtaaaaaaaaaggaaaactacggtgaaaaaaaaaggtgggctggtctgcctgggctatgccaaacggaccttgcaggcacggtccacacgccgacgtgccgtgtttgggccaactgtggtgaagtcgtgcctgggctggcatgcctttgtgcggtccatttggtcacctatactcgacctacaaagagcaatgcttgagccaagcccccacgcgcgatgcgcgcatgctccgcgttggagaccccctccacaattctcgcatgagtttggtgtggtacccactagcatgcattaattgctataaagcaagcctcacagtgagccacgtcaccatgttatttcagtcattggatcaacattgtgccacaaagatcaaccgttagaggaataagttcacttgaggtccctcgatttttcgccgagttcgaaattcatcccttgagcgcaaaaccagatacaacgcatccctcaacttacaaaaccgtgcaaataaggtcctagacagtattgtatccggttttggctgatgtggccgcatacgtggctcctttgactaggtcattgtcccacatggcattgacgtagcgcttatgtggtaatttgatcccaaaaaataaataaaaccatgggacccacatgtcagctacacaggaaataaaaattggtggggccccacatgtcatcctcacttcttcctcttctctctatcccctctctcctttctcttctttctcatccttcctcctcccttcttccagcaacacgccgccgctgggaacctgcctccgccgcgagcgcgtcccgggcgtggtcctcctcgagctccgcgaggcgtgttgccggcgccggcggagcaaagtagtcatcagggagctctcgcttgcctccgcgaagccctcgcctcgcgccgccgccaccacggcatcgtcgtccgtgtcctccgcctcgtcgctacgggggaggaggaggaggagggtggggggtggtgtgcgcggcggtgtcgttgggggaggaggagggtggcgggggtgcagccgctgatggaggcgctgccaccggtggcgagagcggcagcggcggcggcggcgtggtacgaggtcaggctgcgacggtgctcggggacaaatttcagttagtgggatccaaactgaggataattaggcattgaatcctttatttgatcatttacatcaaaattcaaatcagatcgacaagaacaatcagacaaggattcaggattttgctttacctcccgtaggagaggcgccgggaaatttctctgccaaggaaaaagagatcgaattatatacatagacaaactataaaattgatctataactaggtactactatataaagggaaatgtaaaaggtttactaaccatagtcacccaaaaagaagaacaaagcgaaaaaatttttgaagaaaaacagagacgaagaaacaaatcggagtgagttggttgtactgactgttgcacttgctcagggcggagaagttgccgccgcaggcggcagggagggcggcgacacgggtgtagttgatcttgatgccgaagtccaggccgagcgcgccgcagaggcaggcgacggcggccgggctacccagcgtgctcttcacgccggcacagcagtccttggccggtctcgccttggggctccccggcgtgatgtacgtcaggcaccccgccagcgccgtgatcgtctacccgcagtctgacgacggcccgcagctccggccgccgctccctcctctcccatctcccgtctgccgccgcgcacagctcctctggcatcagcggcccggctgtcgccccctgcgcttctccccgccggctggcctccccgatcgatttttgtcgtgccccgcccttctccccgccgaccggcagccgccgcgcttctccctctcggcgcgcctagagagaggagaggggaagagaggggagatgggtagagaggaggaagaagagaacgggtgagaatgacatgtgggccccaccatttttttattaatttgtgtgtgaaacgggtcccacggggtttattgtttttaccgaatcgaattgccacgtaagcgccacgtcgatgccacgtcaaatggagaccgagtcaaattagccacttaggcgtcacgtcagccaaaaccgtcttccaaactgccgagggacttcatctgcactggttttgataattgagagacccgttgtatctggttttctagttgaaggacgaaaattggatccgttgacaagttaaggcacctcagatgaacttattccaccgttagatcttcatttcactaccaggcctatatatgaaggaaaaagtacaccaaaggtccctcaacttgtcaacaggatacaaaaacatccttaaacagcaaaaccagatatacggggtccttttaactatacaaaaccaatcaccagaggtccttcggcggttttgatcccggttttgatctacgtggcggctgagtcagcgtgggacccacgtgggccccatatgtcagtatctcttttccctcctctcccttttctgctgtttctctctcacacacactcttctctcctacggccgacgatgcagcacgggagaaggggagggcggcggcgggcgaacacggtggcgggctcgccctccccgatctcactctccggcatggggaaggggtggcgcaggcggcggaccggcgggagaccagcggcaggcggtcgtggatgcggcgctcacgcggggctggctggccgcgcggtcgtggttggcggcgggtgaggtgttggcggcgagcgcacccgggaatcgatggggcagaggcggccgcggtcgtggcccgcgagtccaggcagctgcgttcgttgtgggggattggattcggtcgtcagctgcgttcgttgctttgatggaaccaaggccacgcgattccgttctgatcgacttgttccatttcatctactgtctcaatcagttcagttgttgaggcgcatttgatttttgatttgggtcgaaaatttgatggctcaatctgatctgagttttgggatgaatggatggatgcgtgcagagcaacggaggacagggagaggaggagatggtgagccaggggagcgcgggagggggagtggcggcctcctccggggtcgtcgtcaacatcaccaccgggcccatgacggagacggaggacgacatggccgtcggcgaggaggaggaggtggtggcggcgtcggcggagacggaggagcacgtgcagcgaatcctcctcgccatcgacgccttcactcgccaggtccacctctctccattcattaatttcgctatttgtcattctgaatttttcatcgatcgatgagattgcaatgccaatgcaggtgtcggagatgctggaggcggggcatgcgctgttcaagaacctcgccgccgacttcgaggaccgcctctgctcgtaagaccaccatccatagccatggccatggacacacacacccgctaataaaataattggtttggttggttgcttgatgacgagcagcataatcaatcgatgcaatctggtttgtttgtgaatttggcgtgtacaggatccacaaggagaggagagggtggagaggtgggaggacgagatccgggagctgcgcgcccatgacgccgccaatgagcaggcacgctccctccgccgccaccgctctcgtctgccgacgtcgcaccgttccagcccgtcgacgccgcaccgctctcgcccgccgacgccgcctctccgcaaccgtgctcgcccgccaccgtcgccgcttcgcctgctctggccaccattctggtgcggcgacggctccttccccagcggcgacggtgcccggttgaagaggtgccccttgggccgccctgcgccgtcgcctccggccggcttgcctagtcgccagaagataacagtagagtgagagagagaggagatagggagagggtgatgacgtggccagctgatatgtggggcccatgtggtcccacgctgactcagccgccacgtagatcaaaaccgggatcaaaaccgtcgaagagcccctgttaaccggttttatatagttaagggacccagcatatctggttttgtggttcaaggatgatttttatcccgttgccaagttgagggaccttcggtgtactttttccatatatgaaaacaaggcccaattggatgtttcagtccagtcgaaccccatcatcttcccgtcggccttctgccatgaattgggaaagacaccatagttaattcaatttactcttttgataagtcttttgcaattcctcatgcaaaccatgctaatcgtctccatcatggtttgtttcctcttcaacaattgtaaaccagaaactgccattatctggtgtcatgataaatctcattgattctctttataactctcaattcctcctatataagtgtgca

SEQ ID NO: 2220 - DNA, 11375 bp, Oryza sativa
aattatgttgcattttgtttggtcgtaaccatagtgatctccttttaattgtactatgaaatctgactgttttagcgttcgttttatgtcagaagaaatatacggtctcttttttattaaaatatagttaacatagaataccctagcaaataaactggagagaaaggagccacaacagagggtagactgacctctaatttaaggattaggaaaacatggtcaatagtttttcttatgtacgtatatatgcatgttttttttccctctcctgtacgtgcatatatacatacatatattttctccagatgaatagcatatatttatttttctctcttacaaatacacattagattaggagagagggattaattattttaatatgatttgatctaatctaatctaatggttcaaaataataattcacttgtacatgcgaaaatcaattgttatatatttatttttccctcttgcaaataaggatgagattaggagatggattaattactttaatctgatatgatctaatctaatataatggttaaaaataataattcacccgtacatgcgtaaatcaatggttcgatgtttagcttttatttttttagaatattttggattttattgatcttaagttataagtttaattctaaattaaattatgaccatttaacttaccatgtttgtgttaaatttctagctataaaatagggtgtagagagaaggaggagatatatatgggctgcacgtacatttataacctttttttgcacggtacgtcactacgtacaaagggaaagagttacgtgtgggaggagagggaggtggatgtggaaagatattttagataaatctgccggtttgaaataatgggtccaccgatttaaatgaaaacagatggccaatggccagatgttttgttttttttcttagaatttctaagaatttctattattatttattagaatgccatgtgacagcttaggagcgtttgtaggatgccacgtggcggtttgagagcgtttgtaggaagtttggctttggagcgtttgtatgatgccacgtggcggtttgagagcgtttgtaggaagtttaatggacttttagtatataatagatagatagtcaattatcactcctgatgaaccatccagagactaaaaataattaagatgatgtgtgatgaaccatctggagactaaaaataattaatgtgatgtgataccataagagaatagagaacaaacattattaactatacttaacgaggatgtgctttataaatacatttaggatttatgggattacacgcgaaagtgattaattactaacggtaattaatgagcgataattaattaatcaccgcgagcgtgatttcaagccaaatcgtaagcaaccggcttgatgaccgctggcgcgaggcccgggttaacgccaactttgagcacgagcttgaggtcgtcgtgttggtcctccagcgcgtccctgaggaaggccaccatgaggccaccgatggtcctcctggccacctccttggtgtccccgaggttcctcatgcacatgcagttgttgatggcgtacggcacgccgtcgtccagcatgtccaggtggccgttgtcccgcagcacaaagtggtatcgcggcggcgcgcactcgtcgtagaactcgcaatggttcacgcccgccggcgcgcatggcgggccgccgacgtgcctcgggcctaggccggtgccgatttttttgtgtttttagaccgtagagatggaaaaggggtatagatgtcggtggtaatactttcaacacatatgtgccgatacctatttaatattttatagtaatgcgatgaccatcaccgtcaggggcggagctagagaaatatgagggggttcctaagagcaagttcaataagctagtttagccgacgataaaactgccacatcggatttgtcaatgagctggacacgagagagcatgagtcggggattaaattatcaccggctacacacacatcccaacgcaagtgcagcaacactaggctagctttgactggggcatgcaattgtggggtccacgcgagctggtgtgatgtaggaatggcgagacgaaacgacagcaacaagattaaaaaattggatgaggaagctagctaaagattaaaaaattggataatagtccatgtaaacctgcttattgtatacattagctcttagcaatgtctatgctgatgtggtcatttttgcagccattagcgggcgacactattgaccttgctctaactttctttatgtaaaatactgacatgcatagttctagaacgatattatactaaatagttacgtacccagtacatataagcatcatctgtctaattgaaggcaatatacaacaagaaagtgcatggaaaaaatttaaaaaatgcgtaccataaaaccatgccggattgaattttccatctttgttggaaataactgatatgggaagtacaagatcacgaggttggcaagacccattctctaagtactttctttttaccttgtctctttggttgggatgataatcatcaatttcttttcttaagcctggatgatattcgatcgtctcttggcatcatctagtcgaagggatgaactcttcacattgttggtacaatccattacttttcttttaagaaatttctccatagaaaccttttagagatcaaataaaaattttcaagctttatattgatacaacaaattaaatatgaaagttgagagaaagcgctcacgtactctaaggctgcgttcgttaggggtagttcccaacacctcctcctcatctttcgcgcgcatgcttttcaaactgctaaacggtgtgtttttttcaaaaaagtttatatatgaaagttcatttaaaaaatcatattaatccatttttaaaaaaaattagctaaaacttaattaatcacgtgctaaacgctgcttcgttttgtgttccagagagtgagggttcaaccctcactcccgaacagagcttaagtgttggttaacggctgtgatttttcatagaagcacaatcacttgcaaccgttctactccggtaatcccctccgttgactgcaaacaacaaacaataacctaatcattggtagacttgcaaaattaaaagaagggagcggcagggtgcaaccacgcaagacttaccggccggccggcgttggagacttggagttgggctgcttctgcttcactcactgcttgggctggtcggcaacagcaaggcgccaaggctgtaagggcaggctggcagggcagggcagccaccaaccgggcagggctcaggctaggcagctggccgccggtgtctggctcgggcacgccggcacggccggattggcgcagtgctgtgccgcagtgggctgggcagaacgggaagacggcgtcacatccatagaacgagaggtgagaaacaatagcgatttttgatttttggaagaggaaacgtcgaactcgaaacggtgccgccctggcgccttgattcccgtcgccgcccagccctacctctgccgcgcgctatcgatctatgggaaacacgagcgaattctcgtatcctcctctcagttgggcctggtagagttatagttttgggccagagttttggatctttggggggaggggggttccctggtttggactggggactgtctatatggtggagaatataggggtaataagctatttagaattttgggccgggttcttgagcacccccctggcccattgggctccgccccaccgtcaccggcatccccgggtggagggaccatggcttgaaggtcaagcgacgagggccagcctggagaggtcgggcttgacgccggggaggttgaggacgctgccgaggacgtaggcgaggccctgccgctcgtcggcggcccagcatgcaaccttcctggtggcatcgttcaagtcgagcgcgatgccgtagagctacggcatgacggcgatgaagccgtgggaggcgacatgcgacaggaggccctcgtacctaggggcggatccacccattgggcagggttggacggccgacccagctacggcccgcaccgccccaccccccaccctccttggctctatcaacattgggcccaaaatgagcagccgaagcgctagtgaccagtctaaccgccgatcgcataagccgcacgcgagcgacgcctcatttctttcgacctggatcggcgccacaccatcaattcgccttcgcggcttcccccttcagccttcaccgagacaccgagtcgaccaagcgccgacgcagcgacgccagcatgccggtaggtgctagccctatagggagtaggcgcgctcccgcgcactagccgaaacggtcccgtcgcggcgccgcaacgccgctcactccattcctcctggctcggtggctcatgcaggatgtagtcctactgttctggctgcctggttgacagccctaatcactaatcaattgattacttccatcaagtctgaacggtgaaccacttggctttatgagttgtctaatatttgcaaattaaggccctgtttggaagattagcccagagctaatgttgggagctcatgtttagtcatgaattggtaggctcaacattagcctagggtggtatgtttggatcgataggctaattcaaggctaaaaggtggagagagagtagaaagagaggagagagaaggagagagagagctgctttttgatggtccccacacaaaattagccccattagcaccccttggaggggctaatgttttgaggggggctaattcacattagctcaaaattagcccacctgtttggatccttgagggctaaacattagcccatggaaccaaacagggcttaacacgtcaactattatcttttgttgtataatgaatcatatatgacacagattattaatttattttaaaatgtttttgtttcccttaatttattggttacactatatttctatgtgattatagtataaatatgatatttagtgtgtttagctattcttatgaaacgaccatctccgctagagatacaagtgggtagtcccgttacccgtataaaaacctgtttactagttcatttcttacatggtagtgcaaaatttagaataaaaaatgaactagaagtgagataaacgggctaaaaaaatctgcttgtccgtccgcttgtatccatagattctccgtcctatctttattttaatcctgcttccgccactgctcgtaccagctgttcaccatgttgcagccgtggaggaagatggcgaccgggtaggtcccggcgttggcgggggccaccaccatgagcggcttggggcaccaagccttgggcacgctcgggagcacgctgtggtcgacgtgtttggcctccacgcggtgcggcgccgcatggaacaccgccaccatgccgagcgcacagccgatgtgccatgtatgatatattgatatgaggtatgtatcttcttcttctttttctgttagtgtggtgattggtgaacagggtttgcaatctcgaaattaggtttttggcgccggggggaggggtggttgtggggggtgttggtcttgaaagaaccaaaattttagaaatttcttggccgaaattatttgaaaatttgaaatttttttaatgaatttaaataaactttgactaaattcaaaaaagaaaaagaaccaaaaatttcggatgagatttgtgcttgccggtggggggcaagaaacaaaattttaataactggtggtgaatgttgagacgaggaacaggaggcgtagctgcatgctaacctctatttaaatatactgcagcgacgcgcgacagtaccatttgcggtgtgaccgcactatttctttatgagaaattttattacgttaacgaggtatgttatagaattgagatgtggaacaatacgaaccattgattagagaggaataaaattatcataaacaatataatggcttccgtatcaatcgtccagcaggttaaatgcacaagagatttgtaggagtgattgccatgcactgatgcatgcacttcctgaaacaccgcggcactgcatattggctactcagtgaggcggttgacgacagcggtctccggcgatcgaggagaggacaattgtatattgcgatcttggccgatttagatggatagcaacagcatttggcgatctgcataattagatcgatgctagtactatactctaccatctattcgcgctcgtcatctgaaacttggccatctgaaatatcaattaattaacgtcagaataagaaagggcaaaagatcgacaagaatcaattaggagcaagcttagcaagcatcacatgtacctccgtcaatgctaatgcttggatgattcgggtggatcttggtggcacgcctcagcgcagccttcaattcgttcacctcctcctcgctggcgccttcacaatccaacgagacattgacctcctggagcgatggcaagctccccagtcccaagtcgagaccatcgtcgccggcaccggcgacggcgatcgcctcccgcacggagaaccgggagcgaagcgttctgagcctcggcattgctcctcgccggaacaccgccggcccaacgaatccccacaacccacagcacaccaggcacgcgaacgagccagctgatccaatcaccaacaccaccccgcggattccgagctcctcgtggtccacctgcagctgcagatcgcggagagcaggcagcctcccgagggtctcaacgtcggcctgccggatctccctcacggcgatggatagcgagcggaggtttgggacatgcgacggattcgtcatccacgccggcagcgacgagaaccagcagatcttctctgtatccagtgcgacgagatgccgaggggcgacccaggcgtccaaaccacccatgttctttcgaacattgttcatgcagacgtcgatggagagacgctggatcttctgcaacttgtgtaggagacccaccagtttgtcgttccatccgtcccagaagatgatgcacagcaccctcagctccgttaggttgcccagctcttctagaatgcccacagtagcacaatcgatcaacacatatgctagatgttcaagccttgttaggcttccaatcccatctggcaccctcgcaaacccgtcgaagcatagggacgtcaaatgtctgagcttcacaatattcagtggcaagtcacaaatagggtttgccctcaggtccaaagtttgtagaaactgtatgtttcctatttcttctggggcctcccgaatatctgtgtcacgtagtcctagatacctcaagtgaaataaattcccaacatacttaaggctgtaaccttgtgaaagatcacaaccttgtaaatccagtacacgtaaaactcagaagctcctaaggacaggtactagatcagtggcagatggaaagacaagagctgtccttgcttgctgcaagctccgagttgctgaagtcatagcatgatcttcattgccattttggagggacaacctccgaatcgtgtatgacagagatccttgatccctaccatttaatatagtaacaaagttttcctcacttgacaatgagcagataagatcgaggaccatatcgtgtacgcgacactcagataccatgtcagtatacatatcatatatgggttggatcatatttctatttacaaggtcattgaagtaactctctccgagttcaaataggctcctcccttgtttcccacactggataaagccttcagctacccacatccatatcaaacgatctttttcgattttgtaatcttccggaaacacacttaaatataataagtaagttctcaaatggggtggcagatcataatagctaaatgacaagatctttctcatattcttaacatccagactattctcgagaccagtaccaaccgagttgtacaccttgtaccactccatcttatttcttgctttacaagccagcagactagccattgtaatgatagctaatggaacacctgcacatttctttagtattctctcggatacttcagccaactcctcatcaggatatttttccgtgtcttcacagttaccaaatattcttccatatagtaatcgtcgagagttatttaaagaaagatgtttcaacttgtaaacaccaccagctttttcagcaacctcagaaatacgtgttgttgtaatgattttgtatccaacatcattatcaggcaaagcacatttaatcattttccatattgagatatcccatatgtcatccataacaatgaaatacctgcatatagattaagtccttaattaggaaaaaaactaatgaaattagaacgggaagttcaaatactggggccaggtagattagcaagttcgtaggcaaaactagtctagctattgtgaatctttgccaaaacagagataaattattcactcaagaaaagaagatttggacatagctatttaattccgactcaataacgatgtaaaaaggcttataagcagttgtagttttttttatttaacccggacatgatgaacattctcaacaattaacagtatgtaaactgctaattagtacttcctccgtttcacaatgaaagtcattctaacattttccacattcatattggtgttaatgaatctagataaatatatatgtctagattcattaatatcaatatgaatatgagaaatgctagaatgacttacattgtgaaacggaggaagtattacgaaatggatggcatactagcaaattattagttgctgagaaaaaacatcatatatatgtacagattggtggaaggaatgtgcttccatatataccttttctgttgaaggaattctctgagttcattgatgagctgcacctcatccaaatccaatggtttttcattgagatctttatatttctccttgtcaagttgataaatgatgtccatgaacaatttcttcaagtcaggagtttgagacactgatacgaaagcacaacaatcgaacagtgatctaatcttttcatatactacattagcgagagttgtttttcccaatccccccgaatccaacaatggaaaccaccttgcctgctcgctgcatggacactccattctcttccgtcagaatattgatcagctcatctctcgtctcaccgatgccaacaagctctttctcatccgtgtaccgcgtgaataaacgagggtcaattgtagcagtcttatcaccaccaccagcaccaatgttgatctcatacctgcggcgacgctcgtgaacctcgacgacgcggctcttgatgtccatgatctcagaggcgatcccatggcgagccttggccttcctgaataggccgacacttctatcgattagcttgctgatgccccgtggtttggcctcaccgtccccgttgtcgttgccgatgtcgcgcacgacgaacgcgtcgatggtgtcctcgatgtcgaaggagagctctctgagatccctggcccagatcttgtcctggggatcaagctggtcggccggcgtggcggagaccttggcgagggcgccctgcatgctctcgagctcggattggaggaacctgatctccccctttaccgccttctgcagattgtactcgccgacgagcagatcacctagcttggcgatgacgcttggcagtgcacccgtcgccaactccatggatcaagatcttgtcctcctccctgggtggatactggatggtactgacaaagaagataagctcggagaggatgagactcactcgtcacccggtggatcgatcgtgggtgaatcgcctagtccagtcccctgtcgtcgctgactggatcgatagggcgacgctctcgattgattcgaagtttcccaactcgatcgatcgccctgcgctcgaacaggaggaagagctcgatgaggttagacggcagtttgaacttttgttcttagacttttcgatttagatgagataatgattagaaatgaaagatatcgttgctgttgggtcgctatagtcctacttggaagattccgagtaggtaaagttgacctgctccatacatgtgcttctgttctgacttgtgaccatgtctgcgttgaaattcgagttgcttcgccttcatcaaaagaacaattcagctgcaagtgagtttcaagtatgttttccaaatcttcttttccatatttcttgcccggctgcattgaccatccaacttggtcgttgggtcacagatcatgctttggcctcccatgcttgtcttttcctttggctcctagcgtaacaaagcgtaacaagtctggattttctacattttacccctttttaaaatcttattttgcaaatagatctctagaaaatacttattttagcaatggaccatttttctccaactagagttgttagcgccaaggttcaatgtcttagcatcaagcactggcaccaacaccgtcgccttctgtggcagctaaatcactgacgttaagggagtcggtgtcaaaaaaactgaaacataagtacctatttgtagaatattttttaaaaaaggattaaaatataaatatattttactacaacatgcccttagcgcaagtctcttttgcggtaatggtctattgtaagaaaaagtatttacatttcaacctttttcataaaatttgttctataaataggttattggttctagtttctttggcgcggatctcacctagatcacttgcgctaagaaaaagatatatttgtttgtctaagtgtatatttataaaaggaataaggctgcatccgttcctccttgttcccaacctctactccctccttttccatatgcacgcttcctaaactgctaaacggtgtaatttttgaaaagttttctataggaaagttactttaaaaaatcatactaacctatttttaaagttttttttagctaatacttaatttatcatgcactaatccatcgctccgttttccatggggagggttcccaaccctcaccaaagaacacagcctaagtcaacataaccccccaacctattaccaggtgattacttaaccccctcacctaataaaccagctatttaaccccctaatcttgttgatacagtttaattaataccatacagtggttttgcactctggttttgccccgctggcgggacacgctcgaccagcctggcacagtggatcgacaggcgtgtgggggatggggtgaataaaaatatgagcggttctctcctcgttctccttggaacctcctctctctctctctctcctaggcgaacaacctgctgatgacagggagtagatccatttgattggattgcaaggtgaggtaaaggtgagtctccacaacctgtttctatgtttt

SEQ ID NO: 2221 - DNA, 2360 bp, Oryza sativa
gttaaagaaggcactagtgaagtacgggctgacaacacacagacatattctattcccaaaggatgaaagggacaaggttagggcaacctgctattgaccaggatgtaaatggctaatatatgtgtcaaagacaagtaggtctaaatggttccaagtggccacttttaataatgagcattgttgtccacctaggagagataacaagctagtcacatccaggatcatcatgggagggctgggaattctcgaaatggaaaaattcacatctacgcttaggctacgatggttgtggctgtttgatacaagcagaccttgggagctgatggagatgccttgcaatatgcgagatgtacaactcttccaggcatgcacaaaaatcacagtaggagatggcaaaaaaaactcttttttggaaagacaattggttaccaggtttgtgcccgaaagatcttgctcccaacctcttcaaattggcaaaaataaagaataggaaggtggaaacataaatgatagacaacacctggctacattcttttagacagatcactaatatagaaaccatccatgaattagtgcaattgggatccctcctcaatcaaataactctttctgatcaacatcatgatgaaatatcttggacaagaaatgcctcatgaatcttctcggttaaaagcgcctgccgcttccaattcatgggttcggtgattgatcatattttcaacctaaattggaaggctcattcttcatcaaaaggctcttacagcagaaaacctgctaattagacactgggaatgcgactggatctgtactttatgcagagaagcttttgaagatacagaccatctgttttgccaatgcaacttcatcaagcaggtatgggcaagaattgccgctgaaaaagggattattcccaatcctaacatttccaccactaacagtggatgtgttctctagggtccactggccttaaaagccaaaccaggtcaaggatcggaatcctgttaaagacatggtggcatgtttggttgcaacaaaacggaaaaaaaaatcaattcccaagccccaagtctacaaagaacaatatcactcatcctcgacgacatacaggagcaggatatggttttcaaacctccatgaagggagaaagtcctgtactcattgctagagttggttgttttaagaatattttgtaatctcaactttgtaaacttggctttctaatctcctaaatatatctggctccttgctagagttggttgttttaagaatattttgtaatctcaactttgtaaacttggctttctaatctcctaaatatatccggcaaatcttttgccgctttcacttcaaaaaaaaacatccaggatcatagtaaataaatattttgatgttatcaaggataatccgacatggaaagtggaacatattaagaagtcagttctaaaggacatgcttgttgatgtgcccatttcaaagtgcaagcgggccaaagccttagtgctacaagaagcattggataaaactaggggagagtctcaagagtgtatgattatcaattggagttgttaaggagcaaccctgggagtattgtagttgtgacccttaatccagatatacttgacaagaaagtatttgagaggttttatgtatgctttgatgcttgcagaaaagggtttcttgctggttgtaggagagtaattgggctagatggttgtttcttcaagggtgcttgtaatggcgagctaatatgtgctattggaagagatgctaataattagatgtatcccattgcatgggcatcagtggagaaagaaatatatgattcatggtattggtttcttgggtagctaaaaaagatctcaatataaatgatggaggtgaaggatgggtgataatttctgaccagtaaaaggtatgctttttaactatttatcttttaacaaaatgtgcaatgggtcctaagttgtaataaatattttgaattacctgtcttgtagggactcataaaggcagtggctgagcttatcactagagtagaacataggatgtgtgcaaggcaaatatatgcaaactggagaaaaaaggacactgaccagaagcttcagaaaaaaatctaaaactgtgcaaagtcatcttgtagggagcttttcaactataatagagcaaagctagcacaagacacccctcaaggagccaaggacatgatgaccaccacacctgagcattggagcagggcattcttccagctagtgtcaaattgtgactccgctgataacaacatgtgtgagtctttcaacaactctattatggattcaaggttctttctagttatctctatgaatgaagccataagattcaag

SEQ ID NO: 2222 - DNA, 3277 bp, Oryza sativa
  unsure (1)..(3277): unsure at all n locations
ctactgtcatgtggatatgaaagtgaagtttgtgataggtgattcccggacttcatatgagttgaaatagaaatgttaattgttcgtggacctaaatcacaaggatgaaatgcattgacctaaatcacatctttctctctatgcacatattgatatattcatatataatattttcatgtgattgacatatggatttgagactaatgttttgttgagccatatcttgtttagtctcttcacattgagaatatggagatgatgaaggtatgcttctaccttaatgtctacatatgataaataccttctattcttgtatagggtaagctcacgatgttttatctctagttatgcatactttttcttcacacacaaaaaaattgtatgcatacatttaggggggtaaatcctataccttagttatgcatgtattttgtcacatcctgattttcgtcttaggatttataaattatttaataaattattattagaatttatattaaatgttcattaatttacaagtgaagttaattgtggaaaataaaatttcctaaatataaagcatggatgtatttaatttttattaaattctccatggttaattatactctctggaattttctcggattttttggagctcaactcttaattttaatcatacaaagaacaattcagtaattatccacatattaaattaatcattaaatggtctgattataattttgttaagtactttgagtgtccaagtattttcaggatttttcttgaaattatttgagcattggaagtatttttaacaattcaaagatcatttcagtgattaatttaattggaaaagtaattaaaattcaccttttccttttcgggccgaattagggaaagtcctctcactctcggcctagtctcctctcagcttgcagtcctttccctctctttcccgaagtctgctttgtgtccctcctttaatcagtccttggaagtagaagcccagccgaaagtctagtttgcttccctgggcactgttcatcttcaagcttggacagaagcctgagccagccgtcctgtgcctggaatcgaattcgtttttgagtttatctctccaactaaccctcggtttttccggctcaaatcctctcggttggagtccgatctcttcaatccaagcctatacatagcatcccctagtcgccctctttcgtttgccccatctcccgagctctctcgtgcctcgtaggccgccgccgcgccacccaaaccgccgccgtcgccggccggcgaacagccgcctcgggccgtcgttttagcggtngcngccgcctcctcacgccgccgtcgggtgcgcgtggaagaggggaagctccgccgcctttcgccgtcgccaccggtcgccggagagccgccgccgccgtccaccgaaccgccgccgccgcacaagctcgtcgccggtcgccatccgtggtcgttcgtcgcattggttagtaccggtgagatcgcgttgttctcctctacgcgtaggtgccctccaaaagtccggccgagtcccctagcgccggcgaggtcgtcgccgatgacgagtcgacattgatgacgtcagcatgacgtcataaccttttctttttagtttttttaatagatgcaaatagtttaaaacttcggaaattcataactaattcatcgtagctccgattcgagtggttcaagttgctaagtttttctaaaatcaagatctacatgttaaaaatatccacatgtactgtttatgattgtttttgtactgttttgttgattttgttcatttgctttagtttccgtcgttccggaggagagcgttttcgttgaggaaggttcggaagtgtttgcggaagctcaaggcaagtcacccagatcccaaacaaccctttgaacatgttgaacccgtttaaagctaatgatttatttcaacttatgcattattttcgaatgtcatcgggtgatgagcctttcccaattaaataatggccgaacatgactttattttcctatgggttataatttgattagcttggaccttatatattggattggttcagctaaatgccatatgtatgtttgcttagtcatgcttaaacattagctaattaaaggggattaaatataaatcatattatattattattaattacggttatatttaatggtagctcacgatggttaatcgtgttatgttatgtaaattaattggtaattaaaactggattaaggtgggttgtgagcacatggttttgaaggtcgtgctcatgacaattaaggaccggttcgcgagctactgttgtgaaacatttaccgtgccaaccacaagccagtgtgagcaacggctttaccttttgtatagcatgattcattacggggcaccagactgtgaagcggcgagaagtccatgggggtcgctggggagtccattgcctttggttttgagggggagattatgatccaggaacggtgcactgtggtgagttgtgttgtgcgaggggtattgtcacagttcctttccgaggtaccgtggtggtgctaaggcgcatggtgacatgttgtgggattgcgtcttgtgggtacagtggtacacctctgatcaaagtaaaactattcgaatagccgtgtccgcggttatgggtgagttgagcaatgtttttcgtgattagtcccacattactcattaatgttaataatgtgataattaatttgactcctggtttggaatggataattcctggtttggaggtttgatctgtacgaccggggttggctgttcaggtttggttgggcctgtgcagcattggggtgctgttcagtgtcgattaaaattgatgattaattactctactgatttacttctaaatgtttgcttaatgctgctttcgcaaatgaacctatattatgccatcctttggtatccttgtgcatttgcatatttgctgtgtggcttgttgagtatgtcatatgctcattcttgcaataatcatcaaacctcagttgaagaaaaaggatccagaaggagaagatgtttggcttatactccagttgagctgcctgtgggagtggagctgaagccatcgctagaccgttaattccgctgctattttccttttcttttgtaagtatgtaacattattattatgatggatttgtatattaaattgcagtttgtgtacctcggctgattcctggacgaggattttatgcacaaattagtttggaaattactagtgaatttctgggcgtgacatatttgatccaagttttt

SEQ ID NO: 2223 - DNA, 2913 bp, Oryza sativa
ctcaatcgatatcattacagctaaaatactaagaatgagagtggagatattgaagatgcggaataggaagtggctattatggcaagacgatcttaaaatgattgatgctcggtcgcgatggaccatgtgacagtgaagggcaagcaaggggcttggcgccgaagagccaaatccggtggtgaatggcgagtgacagctttgtcatgatggaccgtgcgagaccatttgaagctacaagtaaccgcatcaattatttgaagaatatatggtgaaacggttttggcgttgctgttccttaagacaaaggaatgaagatgaaaagaaggcattccaattggtataattctcttcctatataaatttgagtatagtaatatcgtactatcaagagggatgcagcgtcgatgtgtttgtgtatgtttcggtgctcaaagtgaccaatcatagtgctaccttgagagacactcaagctttaacatatcctttgagtggttttaactttgtttttggttgagttaggtagtcctctaagtgagcttttcatagagttcaagatcatcaaaaacggactcccgagcgaaaacttatggtcgttttatcctgtgcttttcggaaattctgaaaatggctgcgaaactgagataggcttctgttgattttttgcacttgtccgaaaatgcattttggaaattccgaaaattacagtcttggcctccaacggctagttttgagaggcttgggtatgtaaactcttccgccctttaagtggctgctgttctggggcaatattagacacatctaaagccaaatagctttttcccatttccgtacctttgtggtgcctctttgtaagagggatttgagaaggggacagagttggattgagagagtgagaagttaagagctagcgagtttcactccatactttgagcacttgagttcatagcaaacaaatcttcagttgtgttagttactcttggggactaaggtctcctaaacggctaggtgttgccagtgagcgcccaagattgtggtgtgcctcgaaaagtttgcgaaggctttgatttcgcctctgtaagggaagaaatcaattgtgaaatcaaggagtgcatttgcacaacctcgtgaggaaagggttaaaataaacctagcctttgtggcccctcaacggagatgtaggatccgtggatctgaacttcgagaaacatatcaatgtgtctcctttcttgctttgcttattcttgtcatctctcatattgtgcttgagtttttttttatccaatcacttgtattcttaattaatatagttgatgaccttatatcttgcttcaatctcttgtttgtcaccttttgattcatatacattttatttgtttgagctacaagttcatagctagtgtgttgtttcgttatccgctgaattttcggttgaaactgaaactttcaatcccataccagaagttccgagttgaaccggaagttctcatcattctaatatattatgaagttgtgataatttttttaggaacgcctgttcacacctcccaggcgatatcaaggtccttttacctttccttaaaaaaagacgttgtattcatgcatattttgtgacagtgcattttcagaatcatgtgttccacgataactctgaatgctgaatataatgagttttatagctagacacggttattaacaaagtaggtagaattaaatagtggaagattgtgattggttgagaagtgaaggtagggaaattgaatggtggagggttgtgattggttgagaaggatatgttggtgaagatgttattatatttaggaacaaattatagaggctaaaagtttttatattttaggacggagggacgagggagtactgacttttgtaattctcttgtaggggtgaccaaaagagattcataatatgcagccacatcggacgtacacaaaatataactaaacttttttactgcagagcttataatatgcagtctctttggacagaggagtatgatttttttcttaaaaaaaatcatagctgccaaacaccaccttattacagagtcacttattaggtatacacgcatgcaccgctcagttattagtaatgaaacaaagcatatccagagaccaccttattacagagtcccaattcccttatggggagtcatccttaccaaaaaaaaaaaaagaaatatcgtggctgatggaaaatagaaccttcatttcaggatttgcagcatcggcaggtttggcaatgttttttttctttttgaggtttggcaatgatttttagagtgaccatataagctgctactgacatcgtaacagttaaagcgaaatgtgccagcttcgaagccttgatagatttggctcggatggctgcagctatcctgcagaaacaaaaatacatgacaaaataaattagtctttccattacgctctagtaacatctacaccttcatagctctgcactaataaaaattatttagggaaattaaatgacacaattgaaagagcatcgatctcccaagataaattatcaaattaatagtaggcccatttcaactggagatagccaagaaacgagatatccccaaaaaaaaagtaaattttgtacatgagtctagacaactataatatccagattaatatacaaaaaatattttatttagatgcaaaagggtatgtaacctagttgttgcaatgaactgagttataccccaaggtactgagttccccatagtaacgaatttcaaattagattatttgaaagaccaaattctcatttttttaaaaaaaattaaaaaaaacatttagaacggatttacggatggagtactgaggaagcacaatacaataacatatatagaaaagcatggagagcgtgtccaaggttttacaattaactact

SEQ ID NO: 2224 - DNA, 3485 bp, Oryza sativa
tcatatcagtggtgcatctgacagcagttcatctccaccgcccgagaacccagcggtcactcagatgatgacaatgatgatacaacagatgcagcaacattaccatcagatgttgcagcaggcgcagcagaaccagcagtctggtcctccatcatcacacctgtccaaactgttagactttcatcatatccagccacccactttctcaagcaccaccaacccaatgtaggccaacgactggctccgtgcgattgagaagaagctgaaccttctgcaatgcaatgaccaagagaaggttgcttttgctacacatcagttgcaaggtcccgcttctgcttggtgggataactacgtggtgacccgtccagattcaacggaggttacttgggcagagttttgtcaaagcttcaggaaggcacaaattcctgaggggattatggcacaaaagaaaagagagttccgcgcactgcatcaagaaaccaggatagttacagagtacttgcatgagttcaaccgccttgcgcgctacgctcctaaggatgtgcgcaccgatgccgagaagcaggagaagtttttgtttggtctcgatgataaattgaccaaccagctgatctccggagtctatgatgactttgagaagctcgtggacaaggctatccgtcaggaagagcaacgcaacaaaatggaccgaaatagaaaggtagctcagatcagctttcctcaggggaacaattagaagcctcgcttcatgacgggacagctaggtgagccttccaccctgatcatccgtcagcaccatccttaccacccgagtaacttcaacaacgactacaacggtggcagtcacaacaacagtaagcagcataaccacaactcgacttcacccccattaatggcaccagctcagtcagatccgccagctatgtcagctcagtcagaacagctcaagaaggagtctgcaggaaagccaagaccctgcttcaactgtggcaagcacggccactttgctggcaagtgtccgaagctaaagcgcgttggacctaggttcgtccaggcccgcgtcaatcatgcgtctgcagagaaagcacaggcatcaccagaggtcgtgctgggcacgtttccggtgaactcatatccagcaacagttctctttgattctggtgcctcgcattcttttatatccaagagatttgctggggcacatggattatcggtagtggaacttaaaatactgatgcaggttcatacccctggaaatgacatgaggacagcacactactgcccctcagtgactatagagatcaagaggtcacggtttctatccaacctcatccttctcgaatccaaagacctagatgtcattctcggaatggattggttgaccagacacaagggagtgatcgactgcgcaagtcgcactatcaccctaagcaacgacaaaggggagaagatcaccttccgttctccagtgtcacagaagtccgtagcgagtctgaatcaggctgttattgaggatcagacagaaatagcggaaaaaaatcccaagaagttggaggatatacctatagtacaagagtatcctgaggtgttcccagaaggcctcactacaatgccaccgaagagagaaatcgagttccagattgatctggcacccggaactgctccaatctacaagaggccgtacagaatggcagctaatgagctagcagaagtcaaaaagcaggttgacgaacagctgcagaaagggtacatccgaccgagtacttcaccttggggtgctccggttatctttgtggaaaagaaagacaagaccaagaggatgtgcgttgattatcgcgcccttaatgaggtcacaatcaagaacaaatatccgttgccaagaattgatgatctgtttgatcagctaaaaggagctaaggtgttttccaatatagacctgcgatcaggctatcatcagttgagaattcgggaagaggatattcccaagacagccttcgccactcggtcttgctctcttttcccccacactagagttgaagtccttctcagttgaagatgtcacaaagaagttggtttcgtcgctaccgtcaaggatgcctgtggaatggagtcgcccactgtagaagtcaagtcttcaggcttagctcgtttttttcctcttttttccgctgcatttgtaatcttttatatttttgtaagacgtggatctgtatgtcaataattgtcgtttgtgtaccctggctggtcctggacaggggtttaatacacattcagcttagaaattcttagttggtatcagagccgaccttgaccgtaggacaagccaactggaaaccctaagagtcctcttaaaccttttcatttgcacatgccttttgcacttggatttgtttcggtataattttggggtttgctcttttgatttgtgggaaaaatcttgatcgctatttaatcgtatttctcggctagaggcagtctagggttctagcaaaactttatttggaatttatttggccttcagtcgggaatttgttaggtgatatgcactaagtcgtgtctagattcgatgggcatttttatgtgtatattatagctacgcatctattttgtgcattaatttatcgtttagtcagttgcattagtatctttgtctgggttcatgaaaaatgttccacgcataaaaatcatcatgctcggcgagttatttgagtcatttgttgctttatttaatttggttttgagcatgtgttggttcctatccctctgtcctctttagatgtcagacctgttctctgatcgcaagcgctgctccaagcttcagagtcgccgcctttatccttaacattttcttagttttggctgcttgctagtttctgtgtttaggtttgttgcttgtgggttagtcggcggtcgatatcatgtgttagtggtatgactgccttaattaggagttgtttgctttctttttagttttttaatcaagattaaattaattgcacttaaatctataagaaagattagtttccaagccatctgttttcttcctttctcttatttctacctatcctcgtccagatggtgaagacagggaatgatccccgtgcctccaatgacgctaggggcagcgaagagcagaccgatggagctcatatcagtggtgcatctgacagcagttcatctccaccgcccgagaacccaacggtcactcagatgatgacaatgatgatacaacagatgcagcaacattaccatcagatgttgcagcaggcgcagcagaaccagcagtctggtcctccatcatcacacctgtccaaactgttagactttcatcatatccagccacccactttctcaagcaccaccaacccaatgtatgccaacgactggctccttgcgattgagaagaagctgaaccttctgcaatgcaatgaccaaaagaaagttgcttttgctacacatcaactgcaagggtccgcttctgcttg

SEQ ID NO: 2225 - DNA, 3210 bp, Oryza sativa
agtcatttttttgctagatagtatttgaagttttacatattttcattccattagctttgctagaagtttgaatgtttctgtttagaatgggttttcaaaccaattttttttttaaaaaagataatttttgttaaattttgattcttttcatgtacattttttaaagaaatttggagaattccactctatgaagcatatttgaaatgatttgatttctgcaatttgggttaaaaacataagtgggttgagcctacaacctgacatggggtaaagtcatctcttctgaattatctcacttcaattgagtaagaaatattaaaatagaggtcatgtaataaatacacattattatgttgtctataaaaaattaacgctagatggggtacaaattatgacgtaaaacacgatatcatttaaagttttcctctaatttattggtgacttcatagatcatatagataatttagactctatgatcatcttaagattatttatttatcttctaaattgatcattgattgataaaaaagcaccaaggtcatattatataggtaagtagcccccatatacatgttgagagaaattaataaatttgatagaaagtgttagggtctaacaggatataagtaatgggtcaaccagctttattaaaaattaaggtgggatattctgattttcaatgacgaattttagtatcttttttaatttattgttggcctcaagatggatgtgggtctagaatataatttttatgttagcatttaaatatagacaatatgaatattaatgtattgatttcactaaaaatataatagttcgaacagatcataagttgaatatatgatttgaaaagttataaatattttatttatattgttcctataagtgctagtaagagagagaaggacagggacagtgggatacatggctagacctaatatgtggaggttaatttgtggtttttcctccataaagattaatttaattttaattatcataatataaaaataagagaaaaggaacatcacaccgcacggggacgggaagggagggaggaggatgttttttcttaaaaaaatgattgatctaatgacctaaaataatgtgttggatgtttaagtcgaaaacaatggtcggatgttttgtttttaacttaagagagaccagtagtggtttagaaatatttataggatgtttaatgtatttaacattgcaggggccgagagtgaggaaataaggtttgtgagtttttttaaataaaaatctaataacaacctaaatgatatgtccatcgatttaagtcaaaatggtgttttgttcttaattttttatgattttctctaatttataatttaggagtgtcactgtgtggtttataagatggttaatgggctttaacgccgcataggagcgcggagggaggtttgggatatatttttttagaaaaagataaatctaataacctaaaataatgtatatagatggtcgaatgtttttttaaggttttctctaatttaagagtgctatatactcatcccgtcccataaaacctgaacttaaaataggatgtggcatatgcgagaacagcgaatttggacatgtgtttagaaatatttatatgatgttgattgaactatttatttattaggtgagaatataggaagttggctagatctagtaggttgatgggctttttaggcccataaaaaggtatttaatttaaattatatggggatttaaaaaaaggagaggaacggttggttggaggaatcgcacgtacgtgcgcgcggaggctcacgtccggacggagttatttttcttgtgaagatagatctaaatatgaaaattaatgggcccaccaatttaaataaaaatcaatggtcagattttactaattttttagagtgacacatggggacttaagagcatttataggataccacatggcagccttagagcgtttgtaggaagtttaatggacttttagtatataatagatagattatatgcaaatttcaatgttttctttaggtaatgatgcatcgtattaacatgaaaaacatattacaacaaaaaacataggcaggaagttatactgcatatacttatttatttatgaaatttagcatgataagaatgttgagcaaatatatcataagcggtgaaaatatcgaccgagataaaagtctagataaataggctttcatctatatcgattttgataaaatgattaacaaactatctatcttgcaagtattaaggaatatttagaaatttgagatggtagccatctaacgacatgattatgattatgagatattaataaaatgtagtattatacaaggaaaaggaaaaaaagaatggcatggcttgtgcttcttttggttagtgactaattaatcctacacgataaacataagaagctggaaattcagcatggcacacgatgtgatgctgttagctaagctgtgcatgcatcggcagaatcctatgacttgctctgactttgagtcactgacatgggccaactggatagagggcacacatatcagtgacacaagttagagaaaagtaagttagaggatctctatttggttgggttgtagtttaaggctgcgttcggtataggaagttcccaacccctcttcctcgttttctgcgcgcgcacttttcaaactattaaatggtgtgtttttttgcaaaaagtttctacacgaaagttgcttaaaaaaatcatatagatctattttttaaaaaaattagttaatacttaattaatcgcgcattaaatgctgctccgttttatatgccaggagtgaggttcccaaccctcactcccgaacacagcctaagagccttattggttgcctatattttctaataagccaaaacggcttattaagaaaactgtttaataaaaccaaaaagatgtggtggtttaggcttcagaatctataggctgtttaaccaagcccttcttgcccgtcaagcttggcgtcttatagaattccctgatatcctctatgcaagagttctgaaggcgaagtatttcccccaaggatccctaattgatactaccttcagttgcaacattttcccgacttggcgtgctattgttcgtgggctggagttattgaaaaaagggatcatatggagagttggtaatgggaagtctatctgcgtgtggagagatccctggattccacgtga

SEQ ID NO: 2226 - DNA, 12444 bp, Oryza sativa
tcctgcagcccgagatccctggattccacgtgatcactcaagaagacctatttctttgagaggtaattgttggctaaatgggtgtctgatttgatagaccaagatggctcttggaatattacagagatcaatagatgcttccttggtatagacgctgagatcatcccaactatctgtctgtctcctcatttggaagaagattttttggcttggcacccagataagacaggccggttctcagtgcggagtgcctacagccttgcttgtaagctggcaaacactgaagattcgtcaagctcatctgtagtgggtacacacaaagcctgggactcaatctgaaagtgtaagatgccacagaagataaaggtctttgcctgaaaagctgcctcaaactgtttaccaaccattgtcaacaaaaaggtacgaaatttggagtcgacagatacctgaatcatttgtaatcaggagaagggggatactgctcacgccctctgcaggtgcccacacgcgaggaacttgctgtcagccatgttcaatgcaggcaacatctctcttgatgtggaaaaatctcgtttcggtaatgagtggctatttgacatgctggagcaactccctgcccatgagcacgagatgttcttaatgacgctatggcggaattggcatgttcgcaatgaaatcacccatgataaagcagcccctccgctggaagtttcgaaaagatttgttgaaagttacatagccacgcttttccagatcaaggaatcaccgctgaaagatgtggaaaaagggaagtctgtagcgagtttgtctgtcactggcagggtaagagacagagcttctgatgatcatcgagttccgaatcccgtattgcattaggtgaaacctcaggttggttggatgaaactcaatgttgatggatcctttgatgctgccctatgtaagggaggaattggtatggttttacgggatagcagtgggaatacaatcttcgcgtcctgtaaaccgctgaacagatgcacaggtgctctcgaatcagaactgcgtgcctgtgtagaaggtctgaatctagttctccattggaccctgctcccaattctagttgaaacagattgcatgtctgtagtgcaactgttaaatgatggggaaagggatcggtcggaattggctaacattgttcatgaggctaaacgcttgctagccgggactaggagaattctagtcagtaagatccatagaagccagaatagtgttagtcacctgttagctaacagggccaaagttgactctgtctctggggtttggttggaaggaagttgtaattttatcttacgtttagtgcgtgaggacattttaagagagtaatatatttcttctttccccgcaaaaaaaaaaagaaatacaagttaatttatatataaagcttttatatatttgttcgtagcaaggtaaaagccaatgctataaagaaatttacgttgaaaataagttgaaatcaactttaaattcaagttttaaaattcaaactttagcttttgctttgtgttattaggccaaccgatgaggctctaagcagttgtgttgggggaggctaggccttctcccgccccctggcttcatcccttcgtgattgacaagtgcacaagcaaaacgaaagaaatatagtagtccctctaccccaatttgaccgtccactaagattttgaggttttttctaaatgaccatcatacaataagtgggagtaaatgggaatcgctgaatgcgctgcacgcatgcaaccgtatgcatgtaactagccaagattaatttctgatggtgtaactaggtatgaaaatggttcataaagtttcctatttcctgagaggtttttgaaacggaaagtgtcagtcagaattttatcggaaatttttagaaatggaaatgaattcagattttttttttcaaaatcggaaatgaatacggtgaggctactatcggtcgaaaaccggaatcggtcagaaactttccggagataaatttgaaaacttttcgaaaacagaaactttttatatatagcttattagcttcagccttctctactctatatatgtttagatttctacataatattgagatggttagttgaatgtagataattttttagtacggtgctttagatagggtccaccccctacagtagcaggctcccaatagcttctcaatagggtcccgggccgctcccttcctgtctccaaaggtgtgacctgagaaatcccgcgctcacaccgtgatctccgccggagatttgccggcgacagggagcgccgccgcgtcgccctagaatcgtcagtccatcgcctgacatactcttcagtattcctattcctttttcatatgacttaaaaatcgatcttatgtttactacaccatctaataacaataaaaatactaattaaaaaagcgcaaggagtatcatttaagagcgggttgtttcatgtgtggttgccaccacttccacgtcgctaacagacttattaattgtaaaagtaaggtactctgttcatcgtactccgtacagagtagcatcaatgatagaaacttcaccttttttttaatgtttgataaaatgggatgcgtcacctacggatggaccaacggattgttggtcgttggtatagcaatatcaatattattatggctcttagttgactcaactgacaagtctacgcctgctcttactatttaagaagcttccaatgcgctaacgcagcccagcgatctgcgcgtcacaactcacaaagccggggtagcttgaggtagtggtgccctggattctaaggtataccttgctatacactgatccttatgtaagttcgtctgtaatatatacacgtaactggtaaaatttgtccgtgcaattgcactagctagtttctaatattatttcatttcaagcaaattagttacttgctccggcctaaatatagcggcctaatttgatatacaaaggcagcaatattttaaaacgaaaaaaagtgcgtgatacatatataatataatttcttgatattgtttgttttttcacgtgccctactgcacatttatacctgcgaatatgccccctttagcacattctcaaaagttggaagccaacaggaaatctttggtgtcgctaaaattcttaaattctaggtgtgtttagttcgcaaaaagaatttttttagttgtcacatcggatgtttgactggatgttggaaggagttttcggacacgaatgaaaaaactaatttcataactcgcctgaaaaccgcgagacaaatcttttgagcctaattaagccgacattagcacatgtgggtcactgtggtacttatggctaatcatggattaattaggctcaaaagattcgtctcgtgatttccatgcaaagtgtgtgattagtttttatttttatctatatttaatgctccatacatatatccaaagattcgaggtgacgtttttgggaaaaaaaaattgaaaactaaaccatgcctctttaaaaaagttgtgtcaaaacctgcgcaattttagatactagtatttaactgtgattggtggcgtccatgcctcctgcaatatacttgccatgaatgtccacgaggatattttatattactccctccgatttcatattaattgacgttttagataaggttgaagtcaaactttataactttgaccatcaataattttaaaaatatttagtttaaaggaactagaacaatatatataaatttgtctttcaaaacaccataataaaagtaaacatatatttatttattatatatattataatagaaaaataaaggtcaaagatatattttgtagaccgtgttcttgtccaaaacgttaattaaaatgaaaccggagggagtatataaaaaagaatagaatccattccagagttttagcactccagaaattttggaagttcgattgtgaaatgccaaaactgtcatcaatttaaagctgccagaaaaagggtaggtgatatcaatatattgtcgtgccaaaaatatataaaaatatatggttgccctgattcctgtgtgaagcaacattttcactgcactgctccaaacacgccgaaggaggaatcaattcaccatgatccactctagctaggacccgtaaaaaatggacagtttggtcagcaggctactccctccatcctagtttaatcatcccctaactaaaggcgctaagaacaataacagcaaaatattcatcattcttaaaattaatcctctcatggattaagtgttccatcgcttcgtgtcgtttaaatataatataaattaatcttgtttggttgcaagtaacacattccaatgatacacatttagtactcttaatttgcacaaataaacgaagatgatgattattttgaaaaggccttaaaaatattaggggatgattaaaatgggatgaaggcagtagtatttcagagcttgcttctccatgtgaacattttgtcaagaatgagaatcatcggtaattcaattcccgtaagggctaatacgtgaaacggattccaacatatattagagttagggctccagggtgagctaggtatggagagggccaggagggacgctagggagagaaaaaaagagagtcaggagggcttttgtgctcagatggttcgggcttctaaattactgttttatattatgataactagctgggtggtccacgcaattgcgcggctagccaaaaaaatcatttttttaagtatgattttacttaaaatttattaaatagctatctcattgttaagactttgaaagaccaaaccttatcatcctcgtgtttctaattatatagttttaaaaatcacaccaattgctaccccttatgtcatcttctttatttgcttgctcgatctatcactatttctattcattcatcttggaacatttaaaaattagattttatagtttttagagtttattgtcacgttgggtttcgtttttataatttctagatgtcccgtcaaacgttgccattatactcctatacagcctgtccactatctcttctcttttattgtcattgagattttaaaaatcgaactgtgacgccccacacttttatctttagtgataaaagtgtgagaacatagattattatttaacaaccattattttgccaaataataatccaccatcagagatcgcaacagagaaatagttagaactacctttaattcatccctaggagcattaaggtcatctctactccatctagagtacactcataacattgaatagagtttgtagcaactccccgtagactcccatccaggagatagtcgtgaatcacgatttaatttagcactgcgcaggcttgtatcactgtacccatagctactcttaacatgtttgactgtcgcacttcactagatgcggcaccatgctaagagtacagaacttttcccctacttcaacttactacactccacgtttgtgttgagcctatcagccctccacaccaccgcgctactatatgcgcctggaatgcacttcatcggcattcatggggtttatatcatctcccatcctactactacgtacccatgtggagtataataaacttgataaggtaccaggtccagcccgtcttaagacgaatctatggtcgacacggtatatacggttctttgatacgagtgagggggtgattagtccttatatttatacaccgtatgtagggagagccctgacctgccatcatcatcaatcatctcatccctgagctccccctacccaccatactagtatcctgatgatctccatcatcatcggcttgtcaatcatatcatcatcgttcatttcattatattctagaaaatactttttgatgcaatactaggagaaatatttttatgaaatagatttttaagttgaaatagaattatcatctaccaacatgatcaaaagagagacttgcctgagtttctgtagccggtactatcaaatgacccaatttctgactctagccttttccctgcattttattgtatacattgattttcaattaactttcaaacttgaagaatataattggcttatctatctatattacagtgcacctaaaattctagcctgatgtacaatttctagcattccattaatttgtattgagtatatatattagttacttgatttaaactagacttgatttacagatttattgacagagttttgctaagcttaatgttagtgtagacaactagtgtgcactaagcaatttaacccttattcctgctctcctcacttatgtctctctctctctctctctctctctctcgcacatacaacaagctgcatctagttactcatccccttcttccattttcttggctgttgctgctgctaatggctttcttcttccccaactctgctcctcccttccatctacagcaccacccatggcgctgccaccccggcgcccacggaggtcgacgccagccaccaccactacacaccccaagctagctcactgcaaatccccttttctccccctcccgatttctcctcttcctcccatggtccaagccctaccaacagcgtctgctttctctctctgtgtgtgtccctctctctctctcatgctaccaaatggatgtgatgccactaatagtgatgtgaaagtgcaggaaaatagtgcctcgtgccatggctgctctatgaggtggcaagaatggcaagatttgaggggctcacctttgtctaagggacaagttcctccatggttgtgctcccgtgttcgtcctcgccaatgtgttggtctcttctcctccttgatagatcatctccttgtctagccaatttttcttctccccttcctagccgacatagagatggtatgagtatttggctgagaactaatttggctactaactattgggattgagggattggttcttgaaatggattgggcagaatcttgcattccgctgatttgtggattttgggactttggctattccctcctcgctccctattgctctcctcctcccctgatctgctcactcctcaccaagtgcttggggctcatatgcatgcatcagtgagcaaatgggcatggctgtagccatgctttgactgcttgactgagaggtgatgaggttgtgctactacctttggggccttgtgtgagtcctcctatgtgcagctatgtgattggtggaaaattagtactgctggtgaattgaggtccctttggtgaggttacttctttatatgagatgtgtgacttcttagtgttaattagccggagccggatgacgaacccaacttaagggaggggtgccagacggtattagccgatctaggtatctcggtgaatggttgaatatacaccacttcgtgtatgggtctgacggcaatatttatttacatattaccttttgtgcataaaagggtcaagctatgcatgtcctgtgcaaccgtatattcaaatatatgatgtattgtattattagtgtaagtgtatgtatatgctgactgtttacagtggcgtttgtttgtactatatttccaattatcactattatattgtggttgtatattggacattgtttgtttgtttaacttcgacgaatgtgaatttcataaattttgagtggcttattcttatttccaacaatttgctagttaactaattaattagtgatatatgccacttaatttttaatttttaaaatagcttaaatttccgggtaacataattatagtttgggtttatttttactttccaaaagtcccgccaaaccatcagcggttttgccattgtactcctctacggctcgctcgctgcctcccttctttattgccttctttattgtcattgagatttaaaatagaacatgattatcattggttttttttactttttagaatttctaaatctttaaaaattggacttgtagttttattttttataatttttagaagtctcatcaaacgatgccactatgcccctctgcagcccgtccgccgcctactctttattgtcattgtgattctaaaaatcgaacataactatcattacaattcattttttattttctagaagtcccgtcaaccgtcggaggctctgcaactatactcttatacaccccgctcgttgcttctcctttttattgtcattgagattttaaaaatcgaaaatgattatcaatgtggttttctttctttatactttctagaagtcccggcaaccgctttacttgtttacttcacggcatacctgatgtccctccttttaatcgtcattaggattctatttggtgttttattaataatttttatatgccgtattaaccaccaccaactctactactttatagccatgttacttaatttatttcgtcatgtgttttagatggtcttttctttcaatagtctttatttttatcacaaattttagttatttataaattttattcctaatataaatcttttttttctaatttcagaatttattttttctaaaaaattagttaatattgtattgtgttcttttaatgtttttattttttattttgaattttatttgtttcaaaattgtattcctacttgaactctgttttaaattttctaattttggatattattatatttttattcgaaattttaattaatcttgtattgggttcttatatggatttttctttcaatattgcttctttttaattacgaatttcagctaactacttgaactcttctttattttcttttgctaatttcatatttatttttatttttattccgaattttaattaatctcgtattgggttattagatggactcttcttttaatattccttatttttaattccgaatttcagctatttttaaattgtattcctacttggactctcgtttccttttctaatttggattttattttatttttatttcaaattttgattaatctcgtattgggttcttatatggaaacttcttccaatattgcttatttttaattccgaatttcagctatttttaaattgtatttctacttagactctcctttccttttctaatttgtgattttattttacttttatttataattttgattaatctcgtattgagtttttatatggaaacttctttcaatattgcttatttttaattccgaaattcagttatttttagattgtatttctacctggactctccttttcttttttttttctccgattaatgtgggaatttctaacccccacagcgaacgtggtgcctcctttcaaagctattttaataatataatagatagatagatagattaccgtatttctaaatacaccaatatttattatctatttctttatttgacccataatttagaagcccatcaactcctcaaccaaatatatgagtgcaaagttaaaagggagacaatttgtaatttgcatagtgtatccttgaattaattttcttatattatatggttatgcgaaataaaatgtgtgattttagatatttgttattgatttttgtcgataccaatgcattttcgttcatattgttctgtttttggtttccgatattattatactgtttttattttcgaatttaccgttttcgtttccaagaaaacaattgggatgttttcggacctttttcatcccaggtaagtggtcaaggcgcgcgattgtacgtccattacacgcactcggtaattccagatgcaaaattgatttaccgctagtttccaatttccaacgatgcaggtaagatccacagcaacgccatgaacacgcaggtcgacgtcgagaatgtggacgtggtcatcaagcctagaatggtacctgcccatcagggttggcagactagcctctgcgactgcttcggagacggctgcgaatcatgtatgcaaagctacgactgactggatttttctggtttggtggtacaatgcaatgttttttccgtttcatggcttaatttctcgacctgttggcagtttgtttgagtgcttggttcccttggttgtcgatttcctgcatcggtgaaatcgtcgatcaaggcttcacaggtaggggtcatctcctctcccatagccccatccaaagtgctttgctttggaccggttaccgataaaacagaagagcgtttggattcagatataaaattaaagaaaccatcaaactgaatttagatcgaattaatatccgctgatcaggtggttaattaattatcggtattcagtttcaaaattttgcattttcacgcttattattatatccggttacagatatgtatgtgaagattttttacatttgcttaccgatatgcatgttttctctcttgtcaatttccttttggtctcctcaccaattagagtggtgctgtatctgcttcatctacctcattgccgcttatttcggcgtgtggtgggcgtacgcggggtggtaccgcggaaagctcagggcgcagtatggcttgccggaatcgcccctgccggactgcctcacccatctcttctgccactggtgcgcgctggctcaggagcacagggagctcgccgcccgtggatacaacgtgctgaatggaacttactccctccgtttcaaaatatttgacaccgttaactttttagcacatgtttaaccgttcgtcttatttaaaaaagtttgtgaaatatgtaaaactatatgtgtacatgaaagtatatttaacaatgaatcaaatgatatgaaaagaataaataattacttaaattttttgaataagctaaatgatcaaacacatactaaaaagttaacggtgtcaaatatttaaaagggagtagtatactccctgctatatatgcatgtgccgctttagacgacactgccaaggcgatgcaaaccccaagatctaacggcgttttctttggcgattggcatatgcaggttgggacggccggccgcaggtggctgcagtaccgcctccgtcgcgtagtgcgcccgcagtccaggctccgatgaggcgatgaaccaggagcaaataaatagctcgctccgtccaccgaacgaagccataagataagtggcccagtgcgagctgtctatctaccaaaattataacaaaattataatagaaaaaatgatacctcgtgatatttttataaagactgtaaaattacttatctatatatctatatccaacagctgtgtaaagaagccaggcatctgaataatatttgacatcgccctagtttgataaactaggaagagaagaaaagcccgtccacataagcaggcatatgtttctcaaactttttattatatatcttaaatatgtgagatgtatatctatgtgtcttctttaagaataatattattctactttaaatttgttgtatttttttttctcactataagtttataagttttagattgctctaaacgttggttatggttttattgcaagtatccacgcagtggtggatcgaagaattttcttgaaactccgcaaagctaaaaatagataacaaatgtacacaatttcatactacttcaaaaaacatttactatgaacgtgattgtgattttttaagcatttgctttgctggtttgcttaagtacggtaattaagtacttcctactgttgtatgtggctggatggtaaataatcacataaatcaagtcctaatctactgctgtgtgcgttgaagcccgggcagctgcccatgtggctccgccattgtatccatggaacaaattctaaactaaaattgttaaaactacagaatcccaagactatggaatcttgaatttatgtaaaaatatcgtgttgcaataattctgttagttattgtgaaattatgaaactatagatgttcttttgaattttttagcatgcttctagaattcaagcttctaattccgcttcagagtgcctcgccagcatattctacgacagaaagtttgacgggtgtcaattggaaattccacattagctagggaccggattttccagccggcagcacggagaaggcactgatgatcctaggtcattggtgcaactataacctttgaggtgcacacgatgcaaaaaaaaaaaaaaaaattgaggcacacacgacgcaaaaaaaaaaaagagaagaggctcgattcggtcgaatccgatgctttgagtcactccccgttgccccagattacaaatcgaaaaaaaaaacaaacttctgtacatgctaaactttctgtacaagcttaatcacatttttttaaaaagaaaaataaactgttgcacatgctaaatcacaaattcaaccaaaaacagaacctctcgtcatcaaacggataggtgacgtgacatggaaagggaaggggagcatggcaaggtacccagatctagcggtcattgagctcgagacagcgccctcacgtcaccccaacgtaggggaagggggtgccctacatg

SEQ ID NO: 2227 - DNA, 12782 bp, Oryza sativa
caccgcgccacggtgccagtggcctgcacggagggtaagtgcgcgtggggtggggggggggagcgtcaggagtcacgggagcatgcgcacgtgggacgcgcatgctgccgcctccactcatgagtttagggtcgagtcgggagagagagcacgcgcacaaggggaggagaagatagggagaggataaggacggagagactcggtctattggctcagcttaacggtctaggatgcttgtttatttaaaacaaactagtacagataaagtgataatattataggtgccaaattttattaataaacggtacctatatcgtcacataggtattagatcttctaaacggcccatgggcatgtgctcgagccaaaaataggtgttagttatagactttctgacacctataatactatcttcgttttcgtttatgttgtagtgatatgaccaagttatgggttgcagagagctttacatggtgggcaagtcgctcgtcactgaggcagagaaaagctctaggtcgcctcttatgctttgcataacaaatgttttattctcttggttcaaaccaaaatgttggctccattttaaaataatatttaaaataattgctggtggatgatgatgtggcatacttgcatgttgagttttaaaagttagtaggtattgactttatagtaagatagaatatcataaataacacaccgatacaaactttaatttctaatgttgcagatcttatttcgtcatacgtatttgcaaagctattgacggtaattaggtaccaaatctaaccatcaatccctacataaaagcaaatgaaagaaaacatcaaacttggtgttagtgattattactaatcattttcacaagagttggtggatatttttatgcaagtgaattatggaaacactgctactcccgtcccgagctgaaggctgaagcactgccgtgctgccccttcctcgagctcgagcaccagcaacttcagcgctaccatcatgtgcttgaactcgagcttgagaactagtatcgtagctgaccttgtgctgatctactactcctcacatcccctccctcctgatgatcggttatagcataccaagaacagagtgcggtagagcataatagcaacaaagagagggagcacgtgacatcggttatgggctgcctaaattggaaaaaaaattgggggtaaaatatttcttggcctcagtccttaaacggcagtgctaatgttattttcgtctaatcgtgttcatggcttcacttggtaaaatagtatagccatgcatggaactaaagagctagtacctgcaatggagcaagtgatgcatgcagcgcaagattcctagcatggaggcatggagatatcttatatgctaatctatgaaggtagaaacatgtacatcttccgaactttgttcgatcatgtgctttttttatcagatttttttaagatggtttatctcatcgagagaatccattatatgccactgactttgtcacatgtctacaatttaccactgactttgtcacgttctacaatatgtcatcaacttttgtttaacttctacgatttaccatcaccgtctagttagcctccgttagcactgtacaattttgtccaaatgaccaaaatacccctacgacaaaaacttctaaaatttagataaaattatcaaaatatcatattatgaacacaagattgcaaaacatccaaaatttggtaaaaaaaacttaaaatctaacatttcagaattcttatccagattttgaaggtttttatcctaggggtattttggtcattttgataaatttgtgcagtactaacggagactaaccggacaacgatggtaaatcgtagaagttaagcaaaagttgatagcatattgtagaacgtgataaagtcagtggcaaattaatcgtagacgtatgacaaagtcagtgacatataatggattctctctatctcatattgctaggcatgtaaatacaagtcctcttgagatagacgcctacgcctaaacatttcaccatgttctttctagccttagtcttacaagttatatgtttccttccagggattcactcttttctgttgtggtatttatccatgtttgatatgatgtagctttttttttcttctcaactatagagtttaatgcttatggttttatgctcaatcatatgtaccatgacccagcatggctctttgtatgtgatatggttgccctaacgcaagtattactttgtatgagagttttcctccatagaatcaacttactacaagctttgttgcctaggcaaacattcttctaatgcaactaatttccacagcaacgtgcggagtatcttctagttaaacaatagggaagacaaattgatttgagatgattaaagggaagacaaaatgattaatcattagtacgtgcacacaaataattatacatagacgagaatagagtcttgtagcaacacacaaatacatataggatacatatccatgacactcatggatatgttacttatttttgaaggtgcagactcattgccacctatccattatacacttcatctgcaatggctttacggattgtattcatcacttcctcgctgttaggtgcgtcataccaaacacataggggtggagcctctgggatgttggggtacccattgtataacaggttttgtgtcatgaaatgcgggtctgaactgtcaagcttgaagttgtggagagcaaacgtacagtgtgtgatatttgtctgatcgttctgcccaggaaagtaaggtatttctctaagaattctccactaactcttgataactccaaagctctttccattgtgttacacaaaaaggagtgaatgtagttaaaagtctcttcctttccatgcggtagtgttgcttctgaaccctcaaaatcatccaagtggtatcgaacatgcgggtatggaggtaggaatccataccaactggcataacccgagcccacaaggagatatttgcttgcacaaataaaatattcagttaatacccctatatggcattaacttgtttcattaaaaaaataaaagtgttgcgaaccccatggaaaccttggaaatatgtagggatagcatagtactacttctatgagcaccctttagtcgtgcatagatcgtggttatcccgcatctataaatatgacaggattgtcccatccaataacaacaagaacattcctagatttgacatggtgacgattccgtgttgaatggaatcatcaaatgccacaataacaggaatgtgtcccatccactgaacctgccgcactagcaaatggctggaaggcctcatcttgcatgacacggttatccactctagcaaagttaggatctacatgcttatttatgtcaattgtaattgcatagacaacattaagcactctatggaaatactttgacacagtagatcgtgaatggaccatcctattatttgtcgaccgattagaatagccacctgccatgttgtataggaatattccaagtgcttccatagggtatatctcaattgttccgtgaaggttataccgattagtgagtagcccaaacaaagcatgaatctgatcagccctcattcgaaatatagcttggcactgagctgcattggacattgtttccatcattcattccatctcgaattgttgcgggacccgccttgcggccttaccacgcaattttgcctccaaactagcaaccaacatatcaagaatgcaatcttcctcttcactgaagtatccatcctttgaagcatttgttctttcagacgaagtgctcaagttcccatagcattatatgacaaaataaacatggttaaggtacaagtatgaatggtgctaataggttttaactttattatcgttcaactataaacttagtcacgatgaaaaaattataagacagtacagaaaatttcagaaaaagatggaatacggacaaagaacaaatgaggtacgaaatacttaaaatattagcacatgtcaagtaaaattcgtctcaacataatttattcaatcagtgcaactgatagctcaaattaatggtgccgaaattgttaaactaaacactcaaattaataaggcctagaacaatcacgtttctcgaaagaaatcgaacaagttatttaacggacatcacaaggaaaattagagatgcatgacaaagatcgcatggcaccagtacgataatcactgccttaagaaatgttaaaacattttaacattgctgcaccatctgctccaaccgtaccatcataacctctaggcccaaatccacctccaccatcaaaccagcctccaaatccattagcaccacctgagcatgttggtggtggagcaaacatagtttctacctggtagtgcgagtggatgaagtacacaccttcctttggtgtgatgcaatcatcaatgaagaactcatgcaaatacccatcacgaaacagcttcagtgccatgtggtacagaggaaccttcttggtgatgccatcagccttcagtagctccatgcaagctctagcacttttggcttgcctctgttcctcccttctttctttgctctcattggactgcacccttaggtcagccaacctattcagagcatctccagtggagtcaccgcaaatatgcttgccgctgccactagagacactgacaggggttacgatccttttttcctttaccgcgcctcctcattgaagaaggctctggagatgcataagtagtgccatctgcatgaggtcctcaacatcgaggatcttagcctcctaggacacctgtgactgtgccggcttggacctaggcacaccggagcggtttagcagcacagttcttcctctgtaaacaacatgatgctcagcgttgaatctgagcggtgcatttctgaatacacgcgctcctcttctaagctacacaaattacagcacatagttggtttaatcagaaaataaccacttgtatgcatgtacagatggcaggatatagaaatggcagcacatgtaaacatgtaagcatgttcaaaacagtagaatctggaatcaaatacacataggcacacatttgttataacaaagtatataacagtagcaagtgaaaatacatgtagtgcagttagtgtacacatggcagcaaccatgtgttgaagttaagaaaaaaaaaacggaagcatatcaccttctaccacaatacaactgagtagttaaaataagtgcacaaatatgcgttcataaattgtagatgcagcaagttggtacttaaaagataagttttatttattgttgtcattacatctaagataaattaaagttttgctgcaaatacaacacacaattcagttatgtggtttgatcacgttgttgctggaaatattgttttagatatgtaacacatgccaactttgcaaacaataacttcagctcctaaatctcttgcttaatacagaataattcaaacatgtgcaagttcaattatcagtaatcctcaacacatggcactaacaggtcagattttaattacaacatgtcatggctgatcgccttggattattttgcaacctatgcatgctgctcattgttatcatgataaatacagaaacattgcagacatgttcaaattaaatgtgctcttgtcatctacacatggcatgaaaagatcatagtagagagatcagaacatgtaaactttaattcagtaccctagacagatcagaaaacattcaacattcaatttaatttgcagaaaaaaatatcattttttgtaatccatacattgagctcatacttatcattctatgtacaaaaacattgcacacaatctgcagatgtaatatcagttgtgaactacacatggcatgaaaagttcatatttttctgtgtttttttgagtgaactacacacttacaagtttcattgtgtttttcagaaacaaatgtctaggtttgtgatgtatacattcagctcaaaattatcttggtatatacacaagcatttaaaagaacacacatatttaattatcaaatgtggtgtacacatggcatgaacagatcatattaggctgttttaaattaaggactacacttgtgacaaatatggtgtacacatggcatgaacataatatattgttaataacatggcataattaatcataaatgtagtttgacatatctaggcatagaacaagtggtctgtaatgtcatgtactttgggatcaacattccaaatatatgtatgatagttaatcatacatctatacacctatgtataaagttttgatacactggcatctagagtatatctataaacctatatatgcatgaaattctgctacaagtttcaatgtaattttcagatacaaatgtcaaattttgtaatctatactttgagctcataattatcttggtatatatagaagtattctaaagatattgaaatttaattatcaaatatggtgtacacatggcatgaacatatcatactaggttgttttaaattcagtaagactacacgcatgacaatgaacatatgaacatattgctgataacatggcataattaatcataaatatagtttgacatatcgctaggcatggaacaagtaatctgtcattcgaaatactttaggattaacattccaaatatatgtatgacagtaaatcatacatctatagacctatgtatgaatcatgcatgtagaggcctatgttttgaactatgctacatctggtctgtaatgtcattcatctggaggcctatgtttgttaaagctcctactctatatggctctattgatccactgatggtggtgtgtgaagcatctatgttttcaaatttgctacatgtaatctctagtgtcatgaactttaggaaaaattgcatggcatgcgcaaaatggaaaaattgcaaagttaaactatacataacccttccatctgctcccaccattcagagtttacttggatggagccagtgtagggatcttgccccagatcggtggccattcattccagctaggtccatgtttggaaacggtggcgacagtggtcccataagttcttcagctactgcttgttcatgacccttctcgtacatcttgttctgcagattcatgtatccttgagctttggggcagctggaggtgatgatgcagccctcaatttcttccatgcagctatccaggaatgctttcagctccgcctacgtccaatgggtgtgaccgccagccatctaacaacccaagtcaagcaagcaagtaggttgaaaataaaagctagaacttgtgctttacctttcttagggcctttacagtgcacctacgtggcgagttatcgttttccatctaggccaaactctgacgtggataaaaaaaaaggtggtggcctggtgggacccgtatctttgcaaaggtttgcatctcctaccaaggatccggtttcctcaggcccaaaaagaaactgtgagtggtcccctctcccatgtcgcgtgctactactctcaattttcccgattattcccctatacgtcatccctctgcttggctccaccgacctcgtcgtcgtcgattcgccggtgggtccaccaccgcctcggcttcctcaaccaccgccgcgtccccgtgcgagtgggcttgagcggcgtccgggagtggagaggccccgatagggataggagagaggcccgcggtggcggagtttgtcgccgaggtggggggagtggggagaggccgccagcggcagagttcgtcgccgaggtgaggagaggacggaggcagcggcatcgctggtaaactcgccaaggttggtgggtggagaaaatggagaggattgtgcagtggtggtgggtgcctgggtggggttgagatttgtattatttcctccactgtaaggtgttcattgtaaaatttgtacttctttctaaattgagaaaaatatgagggctaaaatcaaaagtggtaggagctaaaacgaaaaatcgaagtcacccatgaggccatttgcactgtggggaaccaaaatttggacacagtatctttagtctatgtggcagttttaggttcttcaaatgggtagtttgcattactactgcccttggtgctacgagtcgagcaagtcccaatcgagtgaagatgcaactctggccggagtgaggcggcggaccagctgcaagatagcttcatggaactttgcagcgatgatgatgagtgctcgcgctacggcctggatgtcgtcttcagctgtggcagtgtagctggcgtcggattgcagagacttggatgaaccctgagaggatttcagatctaaagccacctctcgccgttttgccgaagtaaatggcaactgtggagaggatatcaagggctcggtggtggagtgctagagatgaagcttccgtttcacgcctttggatgccatggccggatccacaagatggcttaatatagctatgagttcaagtccccctctccaccaattttggcaatggcgcctccttggatgccggatgggacgtgaatctccggccctattcggcacgagaactcaccagagcagcagacgcgcgctggagaggctgatgcactgtcggtggaatcgacgccgcgccgatgcttgctgcgactgtgcctctcgttttttctccacctccaatgcgctaatattcgatctaagtgcttctcccctactccctccgtctaaaaaaatttaacctagaaggggattgttcattattctaggaggggtcacattctgttataggttgagttttttttttttttttgatggagtgtatgtgcctggcaaccctcctgcccaatgagccatcgacgtcgagcgcatggtctaccgcttgcacgccgctcaggacaagcaggagccgatgcagatctcgattcgcctccgtgaccaacggttgctttagtgttcggaggagaaagatgagggactccgcaagaacaggtggagaaagcaatgcacgaacgagcgaccgaaagctatccacgccgtcaccctcacggttggcttgaacagtaactcaacaggccagtccatctcgcggtaccgagattattgcaccatcttaatttcagcccatccgaatcccagctttccaacgggcccaaaaaaatggtccaaaccaccgcattccagaatgtaattcaccaggtgtataccattgccaatgcgcaagctgagcagatcatgatcaaatgcatagcaatgatctaaccagtagtattatactatcatatagtactaatcattcaactgcattcaaaatgagctggccatgaaatcagtctcacaattttccatggttttaatcagagaaaccaactcggcagacaaaaaagggtatcggaactgacattaagttttgatcatccataatttagtaacagcccaaatctcctaaaaggtaaagcaactagcaacaccatctctactcagctgctgcaacctcccctgccaccgcctcgtcagtctcagcaggcctgtccagcttcataccgacatcttccttgtagtcaccgtgtacctgtaaaaccaataaagaccacattttctcagaatctatactccttttaaacaagggcaatggtgccaccaagtacagtattatttttatttcccacctactccatcatgttttgtaccaactatccaaactatccatgattttatcatatttcatctgtaacaacatctacaggaatgaaattgtcccaaaaacctcactattaattagatttaatccacagaaaagcacaggtgtttggctagtaaagttacgtacacacaggaactaggagtggaaaaaaaacatctggcactactgaggacatcaagaggcagcatactgaggccaatttgtgttggctgccttcaacgttatttgaggctgttaacaaacatgttttgtacttggacgccatatcatgtttaaatttacttgctacattctgtgacagtaaaaaaaagaactccggccaggtcatttagcccccctaatacttgagtaagtcttgcttccaaatcaacactacagtacagcactatttacagaaggcaagccctaatataagatttgagctaatattggctgcctaagagcacaaaattgcctaggaattttttatcaggaaaaattatctaaatgcataatgtcataaaccctaaaatatattgttaaaactcggtattgcaacatcttacactaaaagttagtattcaagtcaaagcaaaatcctgaactaagtattttagggcagccaggttatagcaggggagttagtaaacatagttgattccaacacatagcaaatatactagatagattttctaataagattccaaagccaataaccatgctaatacatttctcagaagaataaccaggagcactaaaggcatctagctaggcatgagaataaggttcctcacctccatcaacttcccaagatcaaacttcggtgccttcaagatcttcaccttgcggatgaacacattttggagagggaatatacttgaagttgacttctcgatctcctttccaatgacttcagggatgaattttgaaaccagttctttcaagtcacatgttgatgcctggttggccatgatctcaaccatcttccggcggatcttcaaacagtggacaaaaataaagtaaacaacaagaacatacctcatctcaaaaaacaagaacttacctagtacagaacatgcaaaaaagtatgacaaaacttttacctgccggatctggctagcctgagcgtaacaggtacgcttcacctgatttgggcggcgcttggtgaaaccaatgcaaaacaggcggagcatgtagttatctgtggtcttaacatccacatgggcttcaatcaatgtttgccatttcttgaccaaggacctaagtttgtccgtggtaaaactcatgccctagagaaaatatgtattggtttagactacataggacaaaagggatcacagatacaacacaaaaggattaatgaacaatcaatgctcattcttacccagaaattcgtgaggacattcctcccctgaacatcctcagcacgaagtctaaccttcctgtaagcctgatcctcgtcattctgaagatccgccaaggagacttcaaagacacgatgcttgagaccctcagatgcaatctagaaaataatttcatgaataataatcagcaacagacatagtgctgtaaaaaattcagataaccttaggaagattacacaaagaaatatcttgggtatttaaacatcagactaaaatatctaattagtgagaacacatgatagtgttactgaaatcaagcatttgatgtatgacgcattaaaggcagcaaacattaaaggcagcaaaaaggttactccaagtacatctcagcaagaatcaatcacctcaagaacttatatatatgattagtgttcatcaaatgaaatgaaacattccatgtatcagccataaaaatctaggagagtagaacaagtacagcacagaagaaatcttgccagaactcccacatttgcattaacgaaacaaacttctagccaaaacataaaaatgcatcaagacatcacaatcacaataactacatcaacgccaacattaatcccttagcctactcagatatagaatgacgcagccacgcagatccaaacagatagattccgcacatgtactcacagacagtgatacaaaatgaaagcatggatcagatcgcggattgaggttgacgggcgcgaatggggaacgaacgaacgaaccttggtcccctgggtcctggagacgagggtcttgccgatgttgcggacggagaacacggtcggcgccttgatgtcgtaccaatccttcttggaaaagggatcgacgctgcacccacacggagagagaaaaagagaagaagtcccaaatcagaatcccccaaaaaccccaagcaagaacaagcagctcagagaggacgagaggtgtggcgcccacaccgcccgcgcgcaagcagcttacgtcttcttcttgctgcccttcctgcccttggagatcctcttgttcttgcccacggccatggctgctcctccctctcctccggggttagggtttgggagtgagtggcggcggcgcaggtgggagaagaggtagaagaggcgaaacctagtggcctgggtggggttttgtaagggaggggtggctcgatcggacggctgggatgtgccaagccgcaacacgaacttagcccagcttggtcgagctcggctcggtgaagctcgcaagcgttacaagtaggaagaagagggatttcattcggctcgatttccagtcgagagcccagcagaaaacgagtttgcaacaagccgagctcaagtagctgagccttgaggcccatttggagttccttttaacgtgtgatggtttaagcccaagtatgggaatcagacttatatttagggtttaatatggatttgttaatgtgtagtctgattatagttgtataaataatttgattttttttattgatcttcctttagccctttgcttggactagagtgaaatcgaattcttaaattataattgaactatatttgttgtatttgaattatctccccttttataattcgtcaatatattgcttgtgtttgtgtataacgtatgaccttgtgattagcgaattaaattggtatttgattcccggacttttattacatcataattggattatatagaaaaaaattggtgtttgatttcggctgc

SEQ ID NO: 2228 - DNA, 10167 bp, Oryza sativa
tgctttatttgatatttgtaaattagttcatttacattcctcggtaggttttggtatttaattatggatagggccgttttaaggtgaagttccacataactcaggcaacaagatcctaaaatgatgcaaaagttggaaattttactgatctttaactgaatatttagggtgttacactttctctttcgtaaaatctatttggagaggcctcttgattttgccttaactagtgacgtctaaatacggagaaacgtggagaagtccagctactacatggtactacatgcatgcattttttttaatatacatgtacgtccctttcctcttcaaataaagttttctctcaaattacttatccgatctacaatccgattacaccattgtgttcgttacaattaaatcttcacaacaaaatcttacgtgattatattacgatgaaaaaatatttatatttataaattacttttattatatatgtaagttactcttatctcatatatatatatatatatatatatatatatatatatatatatatatacatatatatataaaagttacttttagagttgactaaattacttcttagacatataaaagtaaatttaatagagtctaaaagtaatttacatatatttgtcagagttacggataaggtataccctctacccttggatgtacgctatacgacaatatggtacatctgcgcgtgtacggacgttctctgtatacactaaggaaatccatcacgaagtccaccaatggaaaggttcctacccgtataggactgggtcgtcactatatcgtgcagggtacgatgtctccgagtcctacttggagaccacatgacctgcgatataatagggacccccgggaagacctaaggcatcgaatctcatagccaacacaacgaccacagcctacgaagccggagcctacaggagccaagtcgtcgggtgatctagtcgaatcaactcgactacgatctcgtcggtatcatcgagttccattattccctttataatttgtggttctctccatataatcccatatcaactggattagggctattacctattaaggggcctgaaccagtataatcgttgtctcttgtttccttgatgtcgtactacgtagatgctcgtaccagcgtaccccaataccctctatatccggtctacgggtacccgccgtcgacagtggcgcgccaggtaggggaacttggtgctcaaggttgtactactatgacatcaagcttcgtcgacaacggcgtcaacaccggccccatccaaggagtccctacttcaacaatgctggtgtggactcaagtcggcaaaattgtcttcccggtttacaccacggtaccaatctcggctggtccatcaatgaccggaaacgagaacgccgtggctataaccccggacgatcccgtgtcgaaggatcctcccgccgtagcggagaacagaacatcgacgtcatacgagcccgagaaggttcctagtgcggccaaaccttgtccttccgacaagaactgtgagccgacaaggacaactcccgaggtaacaaagccctggtgtcctatccacaaatccaggaagcacaacttgcaagcttgctgggtttttctcaacgtacaagctgaaattcatgcttgcaaggagcgtggaatccagcgtacttctccaactcgtgatgtctattgtcctattcacaagacgaagaatcatgacttctcaagctgcaaggtctttctccgcgccatgaaaacatcgcttcctaaggtccagcagtcaggaatctctcttaaggatgcagacaaggaacaaggagcgacgttgacctcggatcgattcgttggagtaatcgacatcgatccccacgagccatcagtcctacacttgctcgaagactatggctcgtcatcttccagtaaacgacgcgacgtgtttaccatcggtgggactagcacgtctgcgcacgctaacgcagatgcggagaaccaagcggtcacgccggcccaacacctcggcaccgtcaacgcaatactgagagaagctccctatgaccccgtacttaacgatgatctcccatgatggacagaacgactacgggaatcagtagccaatctcagtaacgcgttcgaggaggtcgctaccagagcacaaccagaacatctgacggttggcggtgccgacggcgaaccaccggagcaacggacgtcgcctagacgagctacccctccacctcgcggcaccggcgatctccgcgaccatctgaatggccgccgagaagcacaacgcgcgcgagataacgagaatcgttcccaacattgtgtctcttcacgtcgtcataagaacgaagagcgaggaggccgctcgaacgaagaccaacaccaccataatcgtcacatccaccacgaccgcgacgatcgcgaacagtggacaccggacgatgctggtcgaggacgtcaacatgacggtgattataatggggatcggtgccaggacaacaatggtggacgacgatagaattctcgagaacctgaacgtcgccctcggaatcgcacaccggagccgagtgaaccatcgtcatcatcgtcatcatcttcatcctcgtcatccgatagacatccacggaggacacacgatcgccgacaacccaccgcccctagcgccgggtgtagagctttcaaccgttctctatgtgatgtccggtggcccgagaaattctgacccgaggcaatagagaagtacgatgggagtactgacccaaaagaattcctccaggtctactccacggtactatacgctgctggagcagacgacaacgcgttagcaaactatttgccaatggcgttgaaaggttttgcgcgttcgtggctgatgcacctcccgccctactcgatttcttcatgggcaaatttgtggcagcaattcgtcgctaacttccaaggaacttacaagcgccatgcgatcgaagacgatttacacgcgttaacacagaatccggggaaatctttgagggactacgttcggctctttaatgagtgcagaaatacgatccctgatattaccgacgcctttgtgattcgcgctttcaaaaccggtgtcagagatcgctacactacccaggagttggcaacaaggcgaatcacaactactcgaaggttgttcgaggtcgtcgattgatgcgctcatgtggacgacgcactgagacgcaagaacgacaagccaaaggcggggggagagaagaagccagccaaggacgcacctgagccaagcaagaagaaaagcggcaagagtaggaaaaggaaagctcaagcggaagtcctcgcgtctgaatacgagcaccctcccaaacacccagacccacaaggcagtgatacgaagagaatatgatgccccatacacaagtcagacagacattctccggaggagtgcctcatcttcaaaaagtcgctagaaaagcaactagctttggagaagggcaaacgagcacgtgtagtcgagaaggccgcagaggcaaccactcaggactcggactcggcgtacccagatttcgatcttcatgtctcgcacatcttcggaggttccacagcgtactcttcaaagcgagaatacaaaaaagtggagcgcgaggtttgttcgacatggcaaggggttacacccaagatgaagtggtctgaacagaagatcgagttctcagatgaggaccaccccaaggctgctgttatcccaggacgatatccgatcgtggtcgaacccactattcggaatatcaaggtagcgcgagtcctcatcgatggcggcagttccatcaactttctcttcgccagcaccttggacgcaatggggattcctcgaagcgagttgacaccaaccgatcaaccttttcatggaatcactccccagtcttcgtccaaaccattgggcaagatcacgcttcctgtgactttcagccaagcgagcaacttccgaacagagcagataacatttgatgttgctgagtttgacacagcatacaatgccatcatcggaagaaccgcactcgcgaagttcatggccgcatctcactacgcgtatcaggtactcaagatgcccgggccgaagggaacaatcactattcaagggaacacaaagctggcggtccaatgcgacaagcggaacctcgacatggtcgagcacacgcccagcccaccggccacagccgagccacccaagaaagtgagcaaaacaactaagacgccgaaaccagatggcgcaatcaaaattgttccactctccagtgccaaccccgacaagacagtcaagatcggggcatcactgaacgagaaataggaactcgcgctcatcaccttcctccgcgacaatgcggacgtattttcttggcaaccgtccgacatgccgggggtccccagggaggtgattgagcacaaaatcatggtgcgacccaacgccaagccagtaaaacaaaaactgcggagatttgcaccagatcggaaacaggccatacgagaagagctcgacaagcttctcaatgctggtttcatcagagagatactccatccagagtggctagccaacctagtcatggtgcggaaggccaacgggaagtggaggatgtgcgtcgacttcaccgacctcaacaaggcgtgccccaaggatcacttcctccctcgaatagaccaactagtggactcaacagctggttgtgagctattaagcttccttgacgcttactctagctaccaccaaatcagcatggtaaaagaggatgaggagaagacagcatttatcatgccgctcggtgtattctgctacgttaaaatgccgtttggactgataaccgcaggaaataccttccagcgtacgatcctaggcacgttcggttagcctaggatcttgatccatggttgctctcatatccgatccccagggtgtggtcagggtaacttctctacgtctacagtcaattactcctctatgctttgctaaccaatccattctcaaaatgacatcaagagtttgtggtatcaaaaccataaggttggagggaaacaccacatccctaaggcgaataggtacgtcaatgcaagctgtgtccacggctatttcacccccaggtgaatgtactaacattggttgccttagtttaactctggttaaattgtgttgttgacttgctttcagagatataaatgaatgcgatgctcctgaatcgaagagaactttaactggagtgaagttgagtgaaaacatacccatcagtacgccttggtcctcctgggcctcttcagctcgaacgtggttcacttgtccgcgtccaaatccggtagcggtcctgttagtctatggagtcctgaatagacctcgtccagcagcaggggtagtagttccgtgaatagtcgttgcattagctccggtgcaaataggtgtcttgtttggatgggggcatttgttggcgaaatgcccgtactctccacagttgaaacagcttcctggccttactgatccagtggcggcctgattcggtgcaggagcgcggttctgaatggtaaccggcctgtggtaaattcctcccagcttggttctccagcatcttcttctcaggctcctttgtatgtgtcccaccagtctccggctggtccttccaattggtttgccacaaagatcactttatcggcctcacgtactcgaacaagagttagcttcttctcaatgatccttaaccaatcttcagcatccataggttcttcagctgtggcaaatgtgggtggcttggtcctcacaaactctccaaagcttgatccaccgcggttgccttggttatttgcaatggcttgcagaagttgggtttgggtgaccataactccggccagggtggttaggtcaggtgtctcagtttcttcattgctggttgacgcccgacgtcggcttgccatctgtgtaggttgatggaataagtatcctaattttctaactagctcttatggttctatcccattaagggggttattttggtgtgaactttgttttgcaagcatggtggaataaactcatttataacacaacaacaatagatatcataaataacatcacagagtttcacaaatggtacataaatcatgatgcaatcgactgcatacatacgcagtccaaataaggttcatgcaaaagatacatcaaactaatcatcaatctactcgtcaatctaggtaagaggggggtgtgtctcgcatgctatccaaaaaccatctgatacgagatcgaagctgcaaggagtctgtcaatctagtcctccagccatccgcaggatcctggggcaggtagagggtggtcgctggcacgcgcaaacctgagtccccacggctcagaagtagtggcctctggatctggcttgggcctcttgcccggaggtcgtgtgctcttgcgagcagtgctgagggtgcgaggacctccaaggaaggtgatgcggggaacaggggtctcatcctctaaaggatcagtgatgtctggctcgatctctggctcggtgtcggtcccctctgtctcggagtcgacctggatcggagtctccaaactggaacccaactgcggagaaggtgtagggatcagtggagtgcgcacaatctccggggcaggtggctgtgtcactgtcgggtccactaggtaaggtgctgactcggtagctagcatactagcctcacccagaagagcgtggaacgttggtgggtacggcggggtgaggaagaagtagcggtcacgccctactgctgtggaagtagaagcccctgtggtgctgatcgtggctgctcgaagctgctcctccagctggctgacgtgctcctgactctctcttagctactcctcaagagtatccatcatcccgcggcgatcgttgtactggtcagataactgctggaactggtcgccgtggacctggagctgtgccttcagtgagtctatctcactgccccaggcctggtgctcctcctccaactgaagctgctgcgctgtgaggtcggtcacctcagtctctaactcccctacacgtctctactgatcgtcgatctccaatagggcctcctcgtagaagtcgtccgcagcctcagcccatcgtgacagtcgggtcactatcgggttgtagcagcaaggtgtgtcctgaactgtgcagacggagttgccctcctctcgaaatgggtggtgagcaaactcagtactcgccaactcagctcggtggatagagctaagtcggaggaaggcctcccgggctgcatcctgcatcgcggtctccggcaagtcgcgacggtggcgtgtcggaaagctgtagtctaactctgacgaaactcgtgtgtgaacctcgacccgagcctcctaaacagatccacactgtctcactcggtaaatcggaaatctggggtatcgcagacgcctcatcagccggtgtagctcaatgacgtatccctctgagcggggtacgcccatctcccaggtggcgggtgaatcctgatctgccttctaatctttaagaaaaacccaaagtcagctaagagtaaaacttgttttgtgaagaaaatagttaagagtaagatgaaaatcgttccgagttttgtaaacatagcgtttttatttttgaaagtattactaaatgggaatttctcccttggccaacttagaaaaggggtggagcgccttttggtcttttcctacagtcgtatggctctgataccagctctgtggacccccgtttttataacaggaatcattcgtgtaaacagtaccatttccctggatcaagtagtctggtacacacgagttcatagctgaaataccaaaagtacatacacgagagtctagtgctaattattacatcagaagcccgcaggcattgtcttaaatcatcggaccgagcggtccggaatacatccaaaagcagaaatagataaggcagcggaattcagcagcggcatgccattgccacaggcaacgaccgtactaacacctactgagcgccatcgtcttcatctccctcctggtagtaggcatagggatcctccgaagcttcatctcccgcttctgattaattttatatttgcaagggtgagtaccaaccgtactcagcaagccaccacagcaacaatgcatatgaaaggggtattccaaaggatggctatggctcttttgcgctaagccagttttgtaattcttttcacaaacctaagacctagcatagactgatcaagttttaataccagtgttcacattaaacaacgacggttctgtccaccatccattgtgatttcaaggatagcttcccgccattgagtcgtcatggttttctgaggatgtccaccttccctcctctcaggaagtggctccagcagcataaaaatcatcatgcaatatcccatcccacacaggttaagaatttagagtctagccaagtgcaatacatgtcccggtgctcaataactgcgagcacggctattcgaatagatttggtttactcacactgcagtggatgtacactttacccgcactccacgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccgatgtagggcacgcctctcggccctacctcaatggctgtcccaccgtagcgcacctgcctcactcaggggtgaaccatctatgcagggatactgcttccgctcggctatctactccgctaggtctatacccatacgagaagtgcggttgtacgagggtcgtttcatgcttaacttcatggctcggtccttaattgaccggggacggtactagccttttccagataccacccaaatcctccgtccgccccagtcgaaaacagttgtgtaattttatttctcctttcacaaatcatgtcatcaacatcatggcaatgtggcgctcatgtctccacatgccgcatctccattaccttcccaaaggtaattgcccaaacatatagcatttgataaatatgagtatgcatgattctagaatagcatttctaagcaattgtcatagttgactagggactcatacgtaaacatggttacaaagatctaagggtaatcaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcgggtcttggccttcgcttggatccgcaactccctcaggctctatagttacgtgcgaaaattgatttgaattcggttagaattcaaataagaatccaaataaatccaaatgacagtcgaatgcgaaagtcgattcctttttattaactttactatccgcgaactacggcaaacccaatttcgatttaaactattttgcgggtataaatattttgttgtcataagtttttaatttaatttacccgagcattatatccatataataggttaggaatttctatcgcgagctaaatatcggacgaaaccctagaaatattatacgatttaatttagtctaagactgaatgattaaatgtaacacacggctaaaatctctagtaattaaatccgaatttctaccgtgaatcgattacttatagggattacccaaaaataatctataataatctataagaattcatctatttgtttagtaattaactacatctaaattattaccgcgaattgatttcttatagaaattgccaagaataatccataatttatattaaattttgcaattctacgactataattaatccataattaaattctaattattttaaattttctaaacttccctaatcttcctctaatttctatttattttttttcttttctttttctctcctcttttctctcttttcttttctttttctctctttttctctcttttctctcctcccggctcctttctttcttttccttctctt

SEQ ID NO: 2229 - DNA, 4566 bp, Oryza sativa
  unsure (1)..(4566): unsure at all n locations
gggctcggggcggcgcgcggggctcggcgcgtggtcatgggacggcgacggcgacagcggtggctcgcggcgtgaggcgggacgcgacggcgacggcgacagcacggcagcggcggcacggggcgcaagacgacgcgacgggcggcagcggcgacgtgacagcgggcggcgcggcgcggggcgcaatgacgcgacaacaacggcgacggcgacgcggcagcgacggcgatggcgcgcggcggtacgaggcgcgaggcgcgacggcgacggccgagcggcgcggggcgcggcaggcgacagcggcacggcggcaggcggtgatggcgatggctcggggcgcgaggtgcgcatggcagggaaggggaaggggctagggaacctcgtcgaacacctagagtgcaatgaacagtgtctttttcctatttatcccgattttagtttatttcccatataaatttgattctataatttctaaatcttgcataaatgaagtttactcaatgtttctgttatctcaactaatgaattcaccctagattaatattactcatattttattggtataatttatttgaatttttaattagggttaattcttgttccattgcatttaaatctaattaatacaaatatggccgcgatgatattttatttattcctatccttacataatctttattttaaattataatttatttatttctttaaccaaatctaatttcagggttaattcctaattaattttcccctatttctgatcgatgaattctgaaatcaaaatccaataaaatcgtcgaataaaattggcatgatgcaatttatttaaaaagtttttgaaggcccatatttttagagtttagattttttttttgtcggtcgaattttcagggtgttacaaacctaccccccttaaataaatctcgtcccgagatttcttaccagttttcgaatagatgcgggtactccgtcctcaagaattcttcgctttcccaggtggcttcatcctcagtgtgattactccattgtaccttgtacatacgccacactttgctcctagtcctcttttctgctttacccaatatccggatcgggtgttctggatacgtgagatcattgctaatgtgaatctcttccagcggagcttgttcttctggcactcgtaagcatttctttaattgggacacatggaagactgggtgcacatcagcgatattctctggtagctgtaactgatatgcgacttctcctcttctagccgtgatttgaaagggtcccacatatcttggtgctagttttcccttaatcttaaacctttttgttcccctcatcggagaaacctttaaataaacgtaatctccttccttaaattctaggtttcttcttcgggtgtcggcataactcttttgtcgtgattgtgctacctttaaacggtcacggatcaagcgaaccttttcttcggcctcattgataatgtcaggtccaaataccgcccgttcacctgtcttagaccacatcagcggcgtccggcatcgtcgaccaaacaatgcttcattgggggacatcttcaggcttgcttgaaagctgttgttgtaggagaactcggcgtagggcaaacactctcccagtctttgctaaaatccaacccacaagctctcagcatgtcctgcaggacctggttggttctctccgtctggccatctgtctgtggatgataagctgtgctaaaagcaagataacttcctagggcttcatgtacttttcccaaaaatgcgaggtaaactgtgtgcctcgatcggatataatcctcttaggtataccatgaagacacactatcctggtcatgtacaactcggcgagtttagcactgctatagtttgtcttgacggggatgaatcttgccgtcnnnnnnnnnnnnnnnnnnnnnnnnnaaatggaatcatatcctgttgcggtcttgggcaatccaacaataaaatccatacttatctcatcccatttccactcgggaatcctaaggggttgcagcaagcctgccggtcgctgatgctcagccttcaccttttggcacacgtcacaaagtgctacgtattccgccacatctctcttcatgttgggccaccagtatccttccttcagatcttggtacatcttcgtacttccgggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttacccttgctgctggggagtgggtatatatacccccaaccaccaaaactagccgttggaaccgaaatccccaactttgtgctctgccagtcagactgccgttgtgaggctggtcagaccggactactttgtaacggctacggctagaaaactagccgttacagggcaatcattgagcccactcaacctggccggtctgaccgcagtgtagtggccggtcagaccgtccacggctcggtctgaccggttgcggctctggcggctctgtatcgccaccaaaaaccagaccagtgcaacagactagtggggccggtcagaccggccttaccacgccggtcagaccggctaacagacccggtcagaccggcctaaggcccacggtcagaccgcaggtcacttttcagctcaaccgaccgttagtaaaacgacgatatctcttgactcgggtctcggaatttggcgttcttggactctatggaaagcttattcaaagggccatccaacccatgaaaaatccatccaagaaacacaacttaagtcaaggataatgggctcacactccaaaggatatccaccggacatacccacaagatgtcactcactcctattggacatgtccacttctctcttggtttaggacttgagaaaactaatcacacttggttagacaagcccaaaaaatgcacctacatgcatatgaactaatatggcacaagatcatccacaagctcgcttcatagaaccctcttgatagtacggcgcctatctagcaaatccgatctacaccaaacaccaagaccgggaaaagactaagaaaacattcttagctacattatacctttgccttgcgccatccatcttagggtcaagcttgagccgagatcaacacttgtgaccatccggttgaaccatgtttatgccgaggtcttgtccatcctttgtcaagactttattctcatcacaagcttgacttcattcttgccaacataacaatgtacttggcttggtgaccactaacccatggtgtcattcattagcctcatcgtagtgggacctattccttttcacacctcaaaggagaacattagtctcaacaaatcggttgtcatccttcacttgatgaccaaccggttgcatatgaaagatatggatatgtttgttgagtattcattaacatcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatacaagtgtatgcataattagagaatgaccaatgggggtttatcttatacatatagagaaggcatatgtagtaatgatgtagaccaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcgttttatctccatgcatttcatccttgtcatgattaaggtccatcacaaaagaatgcatatcttccacatctcattatcaggaaataacttagtagaccacttatccaaaagaaaggttaatcccataaacatcggtttatcatatatcaccaaagtaacaattacacgaattgtttaatcccagatctgtcaatcttttctctctttggtgatggataataacccgatataaacaatatagagagatgagatgaaaaatgatttcaaatcaagatagaaatcttataatatacaaaatatagaataagctccccctcaagatgtgcatacatatggatatgaaggaacgcatatgcacataatcaataaagatcaaataggaagctcatcctatattttggatccacaagagagaccaagttagaatatgtgaagtttaatacatacctctcatcatttttactttcatatccaaatgagactagtcaaagaaaggctcataaaaatgattagtctcatatagttagatttgtcattaatcaccaaaaccaaattaaggcacttgaacttacatcatgacaccgcactccccggtgagctggtgcagaccagtgtaggtaacctgcagcgagccacggatctccga

SEQ ID NO: 2230 - DNA, 1457 bp, Oryza sativa
ggcagcagcagcggcaatggccgcgtcggacgcctcctgggcaacgccctccttcaacgaagccgccgcctggtggtccgcgagcggcccaatgatgtcagtcagggagagtgcctgcacaacatgaagtcatgatgcgatctaagagttaaaaggtaaagggtcattgattacactcacgttgattgcggcttcgcgctcagccgcctctttctcgcaaagaggggtgggggcgttgctcgctgtcgtgggaccactgatcatcacctgggaaacacggtgctccacaattgcgctgttcaaacctgtagatcaagaaccaaatttcgataagtcaggaggaatgcgcatgaaaggagagaaacccagaatacaagaaaaatacctcgaggagaaacccgggtcgcgtcctctggcccagagtagtcaaaggctggatgggctcgagcctggagcggctggatccgtctaccaatgaagtccgcagcgacttcataccccgacaatcctcgtactcgtactcgtactcggagatccaaatactagagagatggggtcaaggcgggtttggcggtccaagacggaatcttgtctggttgctcctcaggaacaatgaagactggatccgaatcttctatctgaagatagaaccacctctgtggagattatggataccccatacctacacggcatgtatagtccgactgggtatggggtgtcatgtatagatagaatatttttaaaaggactcgggttaaattctaaacttgtatgtcaagaaaatacccgagatcctagtcggttacgattgtattttatctataactgcctattccgttaggaatatgggctgtgctttgtaatacggatcccttcccctatataaggagaggtccggatgcctttagggacacaattttcacccagatcatacgatcaataatacactcggtggatcaatccccggataggagtagggtattacttcttgattaagaaggcctgaacctgtataaaattccttgtctctaaacccatccacttttctagcttgatagccacccccttttagtattgccgaaatcttgtttcgacaacctcgcccgccatttgctacgagaagaggggcactggaaagggatgtatcgcgacttcaggccatcccgaagtcaaaaaccaacacacccggatacctttttagattccatccagcgcaactcgtagtaaaaacggaagaggtcaagaaacggctctaccccaatgtaggcctcacaaagatgataaaaaatgctaaggaaggctatggagttggggttcagatggagcagaaaaagaccgtagaagttcaagatgagaaggaaaactcagaaggcggaggaagaaaaccacagagaatataatcctcaaccgcaaccatgcggcccaggacgggttcaggttcagtacctcccggttcc

SEQ ID NO: 2231 - DNA, 6593 bp, Oryza sativa
  unsure (1)..(6593): unsure at all n locations
cgccgaggtgaggttgaaaattttcctaagtgctggccggaagttcctggcacttttaccccgaacctcctggtaggtttccagttcaaacttgtgagtaatggctagatgacgtcacctagccgttatatatatggatttcgtcccccaggtcaccctttggccattccactttagttcttgtgttccctagcttgttctatcctctcccaatgtgattttgcttcctccacctaaatcttgtgtatttcttgagtgagagagtgattttgagggtggtggtgaggattggagaaggttttgaaggctaggttgacttgagcacttggggtatctcgttgggctgtcatttggagcttgttactcttggagggtgacctcctagacggttaggtgtcgcccgcgagtttctaacaaggttgtggattgacccgggcaagtttgtgagggcgttattccacctccaaaaggaaacggaatactcggtgagtgtaatcctaggtgaggtttaggaggtcgtcttggtagagcaagccttacttgtggtgttcttttggtgttcaagttggggatcttagtggtcacttgaaaccaaagagaagtacctaggggtgttggcttgaagaccggagacctcttcctaggccttttcttggtgaggcaagggattaatcaagacccagctctttagagctcctcaacggagacgtaggattctcggtggagaatccgaacttcgggaaacaaatcgtttgtctcctctcactctctttatctttgtgattgtgatgcttatctccttatttgcctagttgtgctatcatgtctcccattgtatgatcacttgtgctatcttgtgtattttcatgtgtattactcttgtttgagacatgttgtacctctctatggtttaggcttccttgtgatttaatttacttgttgtgaggtgcttgaaatagcaattaacaactgcccggaagttcctaggaagaaccccggaagttccgggcagctttctctgcttgtgagaaaaagctgccaggaagttccggaccttttgccaggaagttccgggccctgattttaaccgttgtgttttgaagtaaattttaggaacgcctattcacaccccccccctctaggcgacatcaaggccctttcattgtcgaccactccttgtctctacggtcctcacaccaagatcgaccagtcgagaacgacagcaactccgacatcagaagtcgcgatcggttacatgagttcatttaagctgaagtcgggggctactgtcagggttacggataaggtataccctctacccttggatgtacgctatacggcaatatggtacatctgcgcgtgtacggacattctctctatacgctaaggaaatctatcacgaagtccaccaatggaaaggttcctacccatataggactgggtcgtcactatatcgtgcagggtccgatgtctccgagtcctacttggagaccacctgacctgcgatataaaagggaccccccaggaagacctaaggcatcgaatctcatagccaacacaacgaccacagcctacgaagccggagcctacaggagccaagtcgatgggtgatctagtcgaatcaactcgactacgatctcgtcggtatcatctagttccattattccctttgtaatttgtggttctctccatataatcccatatcaactggattagggctattacctattaaggggcctgaaccagtataatcgttgtctcttgtttccttgatgtcgtactacgtagatcctcgtaccagcgtaccccaataccctctatatccggtctacgggtacctaccgtcgacaatattataaaagtaacttaaaacaaaacagaagtaattttgtcacgacattataagtaaatcatttgtaggaataaaaatatgattttatctagaaattaaatttaatcagcagagatcaacacacataagtttaacaatttttaaaagtaacttcaatgttaattggaagtaacttttgcatggttcaaaagtaactgtctataaatctatttaatcatcgatagtttctttccttacatttttgtttttcatgtagaatgagaaaagaagatactattgtttttttcaagttgaaaggagatacaaaatagagtacaaactagttaccactagctatgtagtcacttccaattaaaaaagacattcattaaagttacttagtttttgttataagttacttctataatatatgtaaattagttttaggcttcattgaatttacttttacatatctaagaagtaatttagatatattataaaagtaatttataatttttcatcagaatatagtcatgtgagatcttgttataaagatataattgttacaaacacaacggtgcaatcggttcgtagatcggatgagtagtttaagagaaaattatatttgaagtataggtagataatgtctcttatagatggagtggaactagctaccactagctgtgtagtcacgtcctttctctttctatgtggcatattaccatattttatgggtccatattaagctaatatggtattttttggataatgccaaacgtcatggactaaattacgatccctttagtgtacagtagagcttatatgactgatgacaacaagaacatgtagactctcaaagcatgacttggcagagagaatgaagggatgagggactgggagcgggcaactatataatcgcccgactacacacgcactccaagaatgacacacccacgctaccaggcgcgagagtgataggtcatctgcagtacaacagagttcctgtggaatagtgatctaagtctgctacagtaactatcgcatggtactgtagcaagagtcctttagcaacagtggtcgaattttactctcgagtctcccagaggaacggcatattcgatgccacgtccatcacagacgaagccccatgagtaggggtgaaaacggtacgtaaactttccagattccagatctattttcaaaaacggaatctgtcggtcggaattttttcggaaacagaaacgaattcgaaaatattttctccgaaacggaatcgaaaattataagggcagtttctgtcggaactcggaatcggtcggaaactttccggaaattttctcggaatttccggaaattttgtgactgagatagcctggattcctttttttaaaccacttaatagtgaataccatggtgtcaggccgaaaatatcattgttgtgaaaatatcattgttgtgaacagtggtttccgtccgtttcnggaccgttttcacccctacaccacggtcagcaacgtctcctgcatttgccccgacgtccgtcagtccgacgccctcgtccatccaagcctccgaggctctgacagcgtccgccaggtcgccacctcgaccacccaggcctccaccctgggctgcatccccctatgaccaccatcatcggctcgtcgcccgttggatccgttgtggctgccgccgccgtcacccgctgcatctgccatggccaccgccaccgtccgtgttccccgcggctagcgctcctgccatcgttcgcgtcgctgcactcaccctcgccccgtcccgtgtggcagccactcttgcctgttgccggtagccgtaaggtcgcgccctctccccctccatccgctgcggccgccgccctcgccctcgctctcttcccgtgtggccactgctcttgcccgtcgcccgtagccgcaaggctgtgaccctctccccctttatccgtcgcggctgccgccgccctccatgcgtcccccgcgaccgtcgccctcaccctcgcaatcgccatggccaccgctgacaccacccccactctccccgctctggcgtgctcctaggtcccgtcttcactggccgcttgagagttgccttcatcgtcagagtaaaggaaaggaaaggaggaagaaaaagaagagatggaagaagagggtgtggctaatgggcgatcgatccccatgccccctgtacacacctctcctctcctccccttcttctcttcctactatactataaattttaaaaaaataaaaaaataaagttagaaaaaattatgtatagaaatactatatataaaaaatatttgaatttaaatttaaatttgaaacgggtatgtaaacttttgacttataaactttgggtttataaactaatatttgaattcaaattcaaatttgaatcgtgtatataaacttttgacttataaactttgggtctataaactttagatgtataaattttatatgtataaattttatatgtatagaaatactatatgtaaaaaatatttaaattcaaattcaaatttgaatcggatataattcaaattgaaatttgaatcgggtatgtaaacttttgacttataaactttgggtctataaatttaggtgtataaactttagatgtatagaaatactatatataaaaaatatttaaattcaaattcaaatttgaatcggatataattcaaattcaaatttgaatcggatatataaacttttgacttataaactttgggtgtataaactttagatgtatagaaatactatatataaaaaatatttgaattcaaattcaaatttgaatcggatatataaacttttgatttataaactttggatttgtaaactgtatatgtgtaaacttgaggtgtataaactttaggttcataaatttactaaaatagaaaagtaatgtggtgccaaaaaagaaaaccacgtggaggagaggggggaaaccgatcgctcctggcgatcaatcgccaactaggagtttcgggaagaagatgatgggccctacaaaaaataatagaatattggtattagagtaaacaagatatttctattgtatgcatgggctctattatttactataggtgacatggctacctattgcagccagtactgagttgtgttattgaacttgcttttagagcaagtttaatagtatagctatctactagctacaaatcatctatagccaatgtaatagccaaatcatataatagttgcttactatactattaatacctagtcccacctgtcaaacacacattacatcttggagtccgtgctgcaactagctacagatctgtagtccgttgctcttatctctcttcttttatctctttaaaatacgtttatagctggtttatagcttgttacgtacactagtaaccgtgcacgtgcaatgcacattccccacattatgtaacattaaacatataaacacacttaaactttgacgtgttttccccaatacatgacacaaaaaatgtagtttgagaattatatctattgtagtgtaatatagcacaacttaataactcccttttaaacacacggtaaaaaaatttggaaagcagccagtgaggataaaatcatccagcagccgtcaactggaagtatttaagccattaaaaaccctttggcagttatcagaaaatggggaacaattatccctaatcaagtaacctgtggcacctattagaaatgtttcagttatcaacccgataattcattttgttgaggcattaaactaaaggttgataaacggtgcatagctatatatcagtatattattcttcctctgtcctccctctgagtgttaagtctagccattcatcggtggagtacatatcaaacatgcagaaaatatacagaaggtaaaaagtatccaataattgattacatatttgtgctgctctatgataaaaagaagagatttaccttcccctaattctgattactaataattaccaagccattacatcgtacagtacacattcacttgacacttaaaactcacaaaatagtagactacctatcagttaactgaatggataaaacacttttaacagtacataacctacctcaaatggcattgtagatagttacaaatctctcttcctcttctgttgttccaaatctttcaattgcaattaaaagttgtagaggaatgggcaaggtacaggaggtgtttgtcagtgagccgaggccaagcagagagaggagaacaacaaaatttgcatcaataggacatgagctaactgacaacatatatgagtgaatgttaccaatctgcaaaacaaaacttttagaacaatatgtgaacttatattgaacattatttaagttttattgtgagcaaatgaaagcataatgtataacgttaggattatacctcaccattaagattcattctttctgatatggggaggaagactacagctgctgcactgaatcttgaatcatgtacaaaggtaaatcagattgaaaattgcatttataattcttttaaattcttcatttagagtgcaaatgaaataataccgtgagatattgaggatagttctcaaaaagatactggggatatatttgttgccaaaccgtcaggacatacaacattaaaaacatatgatttctacatcggcaaaaatatgcaacacaagcaatcaaatttgggaagcaaagagttgcccgggtggatgtgcagatcatagtaagacaatacattcactggaagctgc

SEQ ID NO: 2232 - DNA, 3813 bp, Oryza sativa
tcctgcagcccatatgatagcatgaatgcaaagcaattcaatgacctgaagcatctcatcttcatgctgatgtatgtgtgttctggacttctggtagaaagctggagcatccgaaacataaaactcaattaaatctctaatgtgcggcgtggttgcggcagagggctcagcgtgctcacagcgtcaacgacggcagatgtgggctcgacatggttgtggaggagagcacagcgtggccgtgggtgcgggtgtggggtgaatgagcgattcttgcggctgcggcggatggggaagaccacggttccggtggtggctggggacgactcggctccggcggcgactcgggacgacgtcaactccggccacggctggccgcggcggatgggaagaccacgtctccggcggtggctggggaagacctcggatccggcgagggcagcggtggagtgcgccgcggcggcggcggaaggggacgacctcggctccggcggcggctggagaagaagtcagctccggcgggggtagcggtggattgaggcggcggcggcagtacatgacgggaggagtgagccgcgcgtggagagggtgaggcatagacgcgtagtcttcgcgacgtcttcgcgcgaggtgaggctaaaatcgtgcggtcgagatgggtggacggtacagattagagatctgcggatggacggaccagattacaccggatttgcggatggacggtagagatcgatccgaatgattacaccaataggattggagggaggcgacttatctttttatattaatatagatatagatatagatatagatactcttacagtcttacgtaccatagtaatatttttcgaaccctttccataaagaaaaaaaatggaaaccggaaaagaaaacaaggaaccagtacactagcttacatgcttccattgattccccttctatgcattccgtccctcccgattctccaaacccactcacacacccaagaagatggaaggtcagggaacgcaccctgccatgcccgccgccgccgtctcggtggtgctcgacgacgacgacctcctccgcgagatcatcctgcgcctcgccttccccaccgacctcgtccgcgccgccgccgtctgcaggcgctggctccgcgtcgcctccgccccggccttcctccgccgctaccgcgccctccacccgccccgcgtcctcggcctcttcgccaagcacgccggggctcgctgttcgagcctctcccccatccccgcgggctcgccgccgccgcgcgccgcgccgcgaagggcgccatgctcggctccatcggcggcggcgagccgctgcccgtgtacgactgccgcaacggccgcgtcctgatggacctctccgacccgttcgaccgcggcgacggcacgctcgcggtggtcagcccgctgctgcacgcgtcgcggtcgctcgccgtcctcccgccggtcccgctcgccgcgcgcccgccgcccgtatccgccatgggcgacgacgacacgctgctcggccgggccaccgacgtctgcatcctcctccccgaggacggctgcgacggccagtcctacaccgtggtgacgctggtgcgcagcaagcgcgtggactggcgcgtgtggtgggagttcttcgccaaggtgtccgtcctgcgcgcgggcgcctgggacgacgacgtccgcgccacggcgccggtcgagctcccggcgcggtgccgcggcgacacgacctggaaccgtgccctgcttgtccaaggcaagctatacgtcctgggcatgcagtcccacgccattcttgtgctcgacctggcatccatggccacctccttcatcaacctccccgacggagtgcgccacgaggaggacggagacctcgacctgttccggtcaaacgacgccggcgtcaacctcatccatgtcaatgggtttcaagctcgtctctggcgtcgcggtggcgacgacgatgacggcgacggcatgacagcgggcaattgggtgttggtggacgacattggtgttcgtcgagggttcgatcacctcgcgaaggttggcggggagatggacattggtggtccggttggggttatcaaggtcggcgacgactgcgagttcatgttcttgtgcgttgatggcgatgtgctgtacatggatatcaggacgaggatggtgaagaagattttcaaggcgtcaccgaagagaggaggtgttctgccagtgatccatccactgaccatggtttggcctccaatcttcccagtgctggagtagatcaaggatggaggccatttcagtgatccttgaagaggaggtttggtttttggtgctttgtgtcttaagttcttgtctactgctggcttgctgctggattgatttatcatgtgtgtttgtttcttccattttgtggtaatggacttaaaaatggtatggtcgatgaattaatggattatgaatatatgggtatcctttactaaaatcaatatctgcttgtatatttgatttaactctgaaacaaacaagtaaattattatagcagattattataatctataagctagattattataatctaataagctgctctaggtgagcttttttcaaattattgagtggctaaagacccactactcctacataattgagaaaaattacccacctatgccatcaaccgaacagatagctgagggcattatagactttagcttttcaaacccaataatccatacctccaataatccaaacaaataaacaactcacagcttattctatgtcagcttattataatccagtttatagtaatctggcttaataatctagattataataatcataagctgaaacaaacaggaccttagttacttctatcgtaagcagagcctagttggcatgataactctggtgatgcattgatcttggagatttgttactgtaaccatgaactgcaagaaaggaagatatattttctttgaagcaaacaacccgttgatggaaattttaaccatgttgatggcttatgctccatatatccttccgatcgagcagaacgataaatatcttacgattagtgtacgatacaatgtttctatggcccaatcaagtatcatgcatgactggatcgtatcaaaatcgtaacaagtttgtcgtacgtacagcaatttcccgagcggaactacctcagcagccaggaactagagagccccaggcatcagtcgtttagtaattttgatgttcctattctcatgagttgccttgccgaatcaaaatgaaaaccgaaggattataggttctggatgttccatgctcaaaacaaaacaattgttgccatgttagaatctgaagcattatcaattcagcagtttcttttcgtagctgtgacttaccactttcaattatatgcatgagctgcttcaactatgacctgaaacccaaattcaactcaattttaagttggaacaaaactagataaaacatgctgggtaggcccacctggtgctagtgtctatcgagccatagctagacttatgcttggtgggtacaagtccaaattttccaacaacatcacaattgtttatatgatctgccatatccctgtttttcatttggatatgttgctaagccgagcaaatattccttttttttaaaaaagaaagtgttagaactcaagctatgacagagttgctctgaaatccgaaaattcctagttcagaacaagcagcacatggtacaacacacaaggatatgatttcttctttgttcctgtttcgtatgcacaaaatcagatattgagattcaatataaatgctacataatgttg

SEQ ID NO: 2233 - DNA, 2565 bp, Oryza sativa
cctgcagcccgaaaaaggtgaaatttaaacctgaaatattgcttgaattcaatttgttaagcagaagaatattttggaagtagatcaggttaactcatacttaaatcttattttaaagcataacaaaggaacatcacataagatgcctgactctcctaaaagaccagtaacaattagattgttacagcaagataactacatgctgaattgagaatcggttagacatcgcataaagcactagagaaaaatcctctgggatcattcatactgaattactgatcatcgtcatcgtcatagttcaaagccgggaaagtgggaggccatatcatcatgaagggaaagatttcaaaaccaatatcttcctttggagccatctcgaaaaccttgttcgctgtcctgctcgcaatatgtatgtggaagatcacgcggtctatcgtcaagaacagctcggcattatcctcgactctacgaagtgaaacaagagcatccccaagtgaaggatcccccgactcccaatcgggcctcgcaacttgaccaaacgattgatgcagagacatggtatcaaccatctcccaatcaccaccattcccaccgccgtctgtcgcacgatgccaaacatgaatctgaaaccccttcagatgagcaagatataatccggaatcgccgtcccgcaacaactcaaggttccccatatgctccagctgctccacaccatccgggagcttgatcaagaacaagctcatcgacgccagattcaacccaagaacatgctccctgcccagcatgtagaggctcccatggaagagcaatccacggttcatcttcttgtttggccagtagtgattcggtagctcgattgaatcggaggtgcggatctggtcgtctgattcacctctcaccaacactgctctcgcgaacaatccacggcctcttcgtatcagaaccaccagcgtgtaggagagatcgtcgccgccgtcgtcctcctcctcctccgggagcagcatccagcccgggcgcagcacacgggcatcgttgggtacctgatggagctgcgagtgcaggttcgggggcagatcgggcggcttccgcgcggggggcagcagcggggagacgacgccgaagcgtagctcgtcgggcgggggcgggaactccgccctgaggaggcggccgttgcggcagtcgaagaccacggcggagacgtcggcgccgccgagcgcgaacccgccgaggcggcggagcacgggggcgagctccgggggctggggaagcggcacgaacgccggctgctcgtcccggcgcgcggtgtggtagaagccgaggaggcggggcgggttgcgggcgcggaagcggcggaggaaggacgagtcggaggcgaggccgagccagcgggaggagacgagggcggcgcggacgagcgtggtggggaaggcgaggcggaggaggatctcgcggaggaggtcgtcgtcggcgagcaccgacgaggccgcagaagccgccggtggcggagaggagggacgcgtcgcctcgtcttccatttgcatgcgatcgaggaggtattggagtaaggagctcaggttgagctaagctaagctggtttaacaatatttttctacttaatgtcatttctacaacttcattactctatccatatcaaatataacaatttttaaccttcaaaatttatatattaatttttccacgaacatttttttccaaccaataatactccaacattcaagctcatcacttctaccatttaattctacatatattttttaataactatgtccaactctaaatatataaatctatttatccttaataaaggagtaactaaaaaaaccacatatattaatcagagaaaaggaaacatatcttatatacaaatactactttaattcaggttttttttttcaatagttgggctgaattttggttaggaggcgcccacgctctcctgctgtaaaccacacacgccgtaggattatttggacaacacgccatgcattattcttttgtctcttttaatatcgagttaaacctttgctataaaaaggtttcaaacatctagctttaacatcggaacaaaaaaatctagatgtacatatactactcgtcctggagaaaaaaagaggcaagtgtcaagttgtcgaaacaaaatgtcatcttgttctgaacagggtatctaacattaagtcattaagtcattaggaacaccggtctaagggcctgtttagatccatgctaaaatttttcaccatgtcacatcgaatatttagacacatatatggagtattaaatataaaaaaaataactaattacacagattgcgtgtaaattgcgagacgaatcttttaagcctaattgctccatgatttgacaatgtggtgctatattaaacatttgctaataacagattaattaggcttaattaataaattcgtcttgcagtttacagacggaatatgtaatttgttttgttattagtctacgtttaatacttcaaatatgtgtccgtatatccgatgtggcacgccaaaactttacactcatggatctaagggg

SEQ ID NO: 2234 - DNA, 2545 bp, Oryza sativa
ggggctatcctcatttaaatgttgaaatagtcatatcacccatcttatgttgtttggagaatgagatgggttttgcacctactgttgtgtactctctctgttttatattattacaaatcacatgacatttttcctaattaacgaagtctctctttggtccatatattagatgaatacccttgatacaaccgaattttcgctgggttgtttgtaagtaagctaggtaaactatattaaatatttgattgagtttataaaaaaacatttagcaacatctactacaacaaattattttattaaattcaatatttatatattttaataattgcataggtaactaatcaatgtttagtcattgcagtgcttgtcacggtctcacagaccaaagtacatgcgcatttgatatgctagcttcgagggtgtgtttagtttcacgttaaaattgaaagtttgactaaaattgaaagtttaaagaaaaaagttgaaagtttatttgtagaaaagtcttgatgcgatgaaaaaattaaaaatttgaagaaaaagttacgccgcaagagtctatcgatgggctgtcacttgacccactcgaattctcatcaccaaactgcacaagagctcacagtgagccagcccccacattcattcaaatcgctcggcaccgacaccgacaccttacagtgaaaacgtaacaaacaccgctagaagcctagaacgatgcgatgtatgtaaccgcaaaattcgccgcggtgaaaccgaaattccaaattctgaatgcaaatcaaatcgctccatcccatttcgaatctactacaacaaatcaatataatcccaagtacgtacgtgcgtgcacatgccaacgcaacaggtatatatatatatgcgcatgcagcatatggttgagctagctacagcgagaggccggagaggaaggagacgccggtggccggcagccacgacgcgccggagatgaagcgcgccaccgtgaaccgctccgcctcggcgctgtcgttgatgacgcggtggcccggccacgccacgcgcccggcgaccccggccccggggccgtagttcatgtactccccgtagtagagcgtgtcgagcgcgaacgtcgcgttccacgccagccacccctccggcggcacgtgcccgccgatgtacgacatcatcaccaccaccctcgagtacagcttccacggcctccccaggtacgtcggcgccaatggcgccgccacggccggcgccgtcgacggcggcggcggcgaggggacgacgcggcaggcgtggatgacgaggccggtggattggccgggatcgcggcggttctgggcggtgacggtgttcttctggccggggagaggggagcgggaccagaggttgcagcgctggaggacggcggcggcgttgccgaagacgaagtcgacggtgccgtagacgtcgcagtcgcggtagaagtggcggttggagtgggcgtagagggtgtcctggtagccgatgatgctgcaccggtagacggcggcgcggtcggcgctcacgcgcagcgccaccgcctggtgcctctccggccccgcccagttctccaccgtcatgtccctcatcatgaacccgctccccgacgccgctgccacaaatttcacacaaattaattaagctgctttcttatactagtacgagattactaatttgcaacaaattcttgtcaaatttcagcagtgctcgcgacgtgccatgtcgcgccataccgctgcctgcctgcaggctatccgatttctggttcagttaagtgattaagtcccccacccactacactacgccatgttaccgcaatgacgcaaacacagcaagaatgcaggtcgagtagtccatttctaccgtttcttttcaggaaatttaccagcttttatacccagtcatctacagcagctattagtacgtgcctaatactacgagctaatcctactcgaagtggtcttcattgcggaacagtagaagcgttaggagattgcagaagtaacagcaggaataacgatcgatcaattgcccagcaaaaaaatatataaaagaaagaatccaccaatttaatagaactaatgaccgcaaaataaattggatggttccatcatcagacattcacaacaggctggagtagatcattattgtgattagtgaagtttcttctgttgttggcatagtgttgtagtatttaacttcggtagcaatgaattaattgtgttttcctgtaagctcattgcaacccgtcactgctcatatcactaaaataattgcaatttaataacttgcctctagctagtttttactactaccttcttgcgttgagcgcaaaagtaaaattagtttatttagacaaactaggaaatcgtccctatttgtaacacttaatttcttgtgcaaaatcagcataggtctatctatggtgaagacaggggatgcaatgtcagttgaaaagtaaaaagtgaaaaaaatatacttttataaaatataattgtttttaattattactccctccattctaaaatataaggcacaa

SEQ ID NO: 2235 - DNA, 4738 bp, Oryza sativa
  unsure (1)..(4738): unsure at all n locations
cggtgtggaacgtggtgaagttgtcggcgacgctgcggccggcggacacgacagtgacgcccttgccgtcgccgacgaacaccaggttcgtcttcttcctccccaccttcacgttctcgtcgtaccgcccggccttcacgtgtatcaccgtccgccgcccgctgcgctccggcgccgccttcaccgcgtccgagatcgtccggtgcgtccccgtcccgtccttcgccaccaccatgtccgcgctctccaccaatggcgccgcggggaccagcagcagcctccggtccctcgccgacagccacctcgggaagaggcttcttcttcttcttctccctctcttcctctgcttcttgctcttcccgccgccgttccggacggggacgccggcgaggccgtccttgttgctggttgccatggccgccgacgcggcctccgcgtacattgtgaggcagtcgcggaccatggcgcgggcggcggcaaggtggggcgcggcgtccgcgccgtgggggatgccggcctcattgaggctgtcggcgcaggtgtcgtggttggtgagcgcggcggagagccacgtgaccgcgtcgtcgtgggcggcactgggctcaccggcgccggcaaggaggtcgagggagtcctcgagcagctccgcgcagtcgtcgcgcgcggcggcggcgaggggcgaggaggaggaggagcccgccgagaacggcgttgtcatcacagcggaggccggcgcgacggcggcgcccgacagggcctcgagcgccttccccacgtgcaccgccgtcgcgttgagcgcaatgcggagccggtggtggcgcgccgccacagcctccgcctccagcgccgaggccgggaaggcgtgcgcgccggagagcggcagcaagaagcaggggaggaagacgaggaggaggatgaggcggcgagcgacggcgtggcccatggcgagccgagctagctagctatggaagctggaagaagtcgacgaggtgctggactaccagcgatggcggcgcggccatttatagggcgattgggggtggcgagaatgatgggacgcgcgcgggcggcgagctgggaagcttttgcgtctcgcggaaagcgcggcatgtaccgatggtttgcctgccatcgccggagaacgatgggctcgctcagctccggcggcggccgcgtccgcttggtttgttcgccgatccatgggcgcggcacgagacgagagccgcgtgggctgggctaccacagcagcacacatgcagatgcactgctcgtttggcccccaccccacctggctggcgcgcccaccgcgcggcattgcgcttgcgcgtgtgcgcgcgctagctagcgcgcagtgcgtcagtgagacgctgcgtggtctcgcgacgggtacaaatcctgctctgtgtgcacgtacaaaccacggctcacagatcactgatatgtgtcacttgctcttgggcgcatattttcggtctatattactactcatggagtagtagtagagtagtgcacctctcaactaccgtctcacacgaagcttacgaaatgagataaaactaaaaagatgatgtggctagtgaactaacgttattaggtgcatgagtaacatggaaatcaagagattatatcataagtaatgttatttgaccaacaacatctataaaactaagatgtttaaataaaaatagttgcatattattgtagtttgtttaatgataaatatagtaacatcaattttatatgattgaccttttaatattttttttctattaatagtcatagttaaaaaaatgacttgacaatattttaaaaatgcttacattctgtgacggagtgagtactatggatatataaactacttactatattacggtagtttttattcaccgtgtattatctatggtagttttatttaccatgtattatcttagaaacaacactgaattttagtttggatctaattttcttatgaaagttaaggctcctttcgaataaaagaattttggaggattacatttctatcgaaataaattcctatatgatgctttagaatgaaggtattgaattccttctaaattccttataattgtctcaaatcataggtttttttttgcaaaattggttatatatcatcaaaagttcactttttttttctttttatagcatcgaaagatactaaatagcacctaaagctcaccacgttcccatttttaacactttcgttaattttcaatcgtttttcgtccgccttgattactattgactcagccacacacacaatatgatgtttctacccctgattgtcatgcattctacttgtgagaggtagttaggaattcatattcctctcttcttaagaaaaaaaaagtgcgctcacaactcgtatacattcatccatataatatatacacgaacatcttacctttatatgaacaccttgcaaagatcggacatattctttttatctttacacgccttattaacgtacactaaaaatgtgaataagtgaaccctgcatagccatacatgtttataaaagaaaacaaaatagaaaggcacgaggagaacagtgggacagccaaacgtgacggtgatttcacttgaaaaagaaaaataaaatactgtgtgccgatttagacaatgcaaatgcattattccaggctatatatatagctagttagctctgtcgtcgatgcttcttctttttttgtcatttacaattttgctgcacatttggatgtgattttcgtattgtattgtacacgtatatatgggctcacgaagagatagctaaagggaatcgtgtgacattggcacaatggcacatgtgacgagcgcagatggagctctcgcctcgtggaaagaaacaaaaaaagtcgcggcaccgatgggcgatcgatcggtggctgggcgagtcgtctcgtgcgatcgtgtgcggttggtttggttttgctggctgcctcgccacaccggcacaccgcccgtccatcataccacgctctggctgacgcgctgcttgtttgccgtgccgtgtgccggctgcatatcctctcgatcgccctagtacatgccgcacactccattttcagctacctttttttttatgataatggatcttattaggactaactgcaaaacacgtgaccatggaataataacgtgggttcaataaatggaaagctagcaagcttgaaaaacaaaggaaatatatatattttgtagtactaagaaatttgatctacagtaatattgttttatttcatactccctccatcctataatataagagattttaggtggatgtgatccacctaaaatctcttatattttgggacgagtatctcctatcattcaattcatcttgtgacaacttttttctctttacctttctctatattgttgccgccacattaaattgcttctcttgatctcaagcgtattttccgatcataaaagaccgagagatgatcttgatgttattactttgaagttgcacaaaccccaagccccgaattctcgattgggattcacagatccgatttgttttttagaatcgcttggttttcttgaaaccaatggcggaggcatcgtctgggcaggcgaaaactccattaaaattttatattagtgagtaaattggtgatgaaatttctataacaaatactagttatatttatccggttttaaaaaattttctagctccgccattgcttgaaaccaccctgacccaatttgtgaattccaattgattttagttagttttcatacatagttaacaaaaaaaaaggtcaccggttctatggtttgtatcggctttcgcgctgttttggtaaaacctaccatgatcggttttcagttttcacctcgatctcctccgggcaaaccgcgacatttgaaagaactttctcctttacgaaatgcccaaaataaatacaacaagttaataaaaatggaattcgaaccgttagcgtacgctacacccggccccacgcgtcagtgaaacccaacagtctcctgaaatcaacccgccacaaaggcccaaagcccacgccgagaaccccgccgctcgcattcgcattcgcatctcccccgcttcctctcctccgccgccccaaaaccctagcggcgagcgagcgagcgagccatccatcacccatggcccgcaagcgccgcgcgccgacgcccccgcccccgccgccgccgcctcccgaggccgagtcctccgcggattcaagcggcgaggaggaggaggagnaggaggaggaggaggaggagagggagtctcccgtcgccccaccgccccagaagcccagcggccgcggcgccgcctcgtcggatgaggaggaggaggaggaggaggactccgacactgacacctacgcccaaggtttccagcttcggaaggttggcggcggcgacgaggaaggggaggaggtggaaggcgactcgtcggagtcggagccggagccggagcccgtcaagaaggagtcggcgaagaaggccaaagccgaggccaagaagaagagggccgcgcctgagcccgcgccgtcgggcaaggccaagaaggccaagccggagaagtcgtcgtcggcggcggcgcctgagcccgctccctcctcgggcaagtccaagaaggcagccaaggctgaggctgcgaaagcggctccgctgagccggctccttctaccggcaaggtgagcaagtacaattgagcgccggagccctcgccgggctgcag

SEQ ID NO: 2236 - DNA, 5762 bp, Oryza sativa
aaagataaggtgagtggagattcaaaggaagccgccaagggagataaggtggatgaagccgccattgctgtgaatgaaaagggtggtactctggcagagaataagaaggggaaaaccaacaagcagaaaacaggtatggaaacaaaggttggatcatctaaggaggctgctcttgctgctagtccaaccaagggtaagaagaagggaagccacaaagacaaattggatgaagaagcaaagagtggcacggcaaaggtgacctccacaattgccactgatgatgatgatggaactttgggtgggagtaagagggagaaggctggcaaagaggaattggatggggacacacatatcgtcatgccaaaggaggccaccacaactgccgctagcgatgatggtactttggttgggagtaagaaggggaaggctgacaatgggaaattggatggcgacacacacagtgttatgccaaaggaggccaccgctggcacccaaaatggtggcatcctaacaggaggggaaaatcacaaagaaaaagtagataaagatgctaatgtaccaagcatacggagggagtatgctgaattgcagagtttgtatcccaaccttgcttcctttgtgaacggaattgaggcccagcatccatgtggatcaaccttcaagagagcttttgagttcattagtgatgataaggcttgcaccctggaatccaagatcaagaagcagaagatagcggaagtgagaatgcagctccgtctagcagacacgaagaaggaagtagccaatgctttgttaggattgctggactaaaacattgcggtgctgacatcctttttgtgcggtatacattcttcttacttgcgttattatgttcccatttgtatattaaagttctgttatagctaaatgcatttaaagtgtttttgttgcttctaaaatttgagtgtgacttctgaactaattattgaaacaaccctgttcttatgtggtcagtttagtgtgaaacatgtgcaattaaggaaagtgtagccaatgaaagatttagccatatttgacacgtacaaaccatctaaatatttgattggtttgtatatcaagctaacttacactttgtaggtgttgagagggtgagtttgtcatacgtagcaacataagggagtgatttgaatatatcatctgttggattctactattcttgattggttgtaaattaaactgtacctacactttgtaaggattgagaggtaggagtagtgaacaagggaacactatgaataaagcatctcttgcattctactcctgaaatagttagctttaccttattcaaacgcacagttgttgctttgctaggttgtcattgtaatgttttgtacctactatactctactcaccgtgaatagtcattttttggggatggttttcctttgcagaactgagttataatgctttttttttaccacaactgatatatgcaatgtttactggtagtttgtccatatgaatcttgtgctgcaaaaggcagcatagtttattttcaagttctttgtagttttgtttgttaattgtagcttaggttgatataaatagcttaatgtttgaagttatgctttatatttttcaaagtaaattattgtgtgatgtccattgctctagtgaatttagggtttctcttgaagaattttgttggctgctccaactgctcccaataatgccactaaaagaacagttgcatttttacaagccacctgctagtactgacatggtattggatgtgacatttcctagtacaacaaatctgtcaggagcttatccagatttgttgtattagggaatgtctcgtccaatactaggttggttttttgtgggacggagggaactaccttgtcttgtatagatgacctgattttgttgactgacctcatcaactccactaaagaacaacagttgcattctgttcaagctacctgctagtactgacatgggaatttgagtagctaccttgtttgtctagatgaccatcctaattatgtactacctcattttcaaaatgtgtgacgccgttgacttttcatacaacgtttgaccattcgtcttattcaaaaatttaacataaatatgtaaaagtataagttaagattacattttatttgatgataaaacaagttacaataaaataaatgatatttatataacttttttgaataagatgaatggtcaaacgttatgcaaaaagtcaacggtgtcatacattttgaaatggagggagtatatgccaccacacttgtcagtttggtcaagcacagaggattctatgctaagcctgcatttatttcagctgaatttggagccttgatacgtgaatattgatttgtttatgtgagcctgtgaggctcgctcagggatacatgattttttctgagtctctttaaccaagtcacagtagcaactcaggaagttgttcatctagagttaacatacaaatgaaatcaatggtcaatccaaaatccatatatgaatatcatatttaatctttaatttggattttgttgagccttgtggggctgttggcatgaagattataagttggcaccattttagttagttcactgcttaaaggctgagccaatacaaggtagcttagtgtaacagccgtacataacttttctcaatatctcaaatctgctttatttgttttcaaactacaatgatgagcatatgagtgcattgctaagactttgatttgtctgtgcctggacaaaacatttcttttcgttgcttcaattttcttcttgcatccttagtagtactaatttatattgcttcattatccatacacttattctgttcactgttcacaagcagatggttgtattgaagattcaagttgcagaagatttttggcttgtggagctaagggatatgacgtgacgagttgagctactgggttttctgtctctggttctcgagagctattctgtgaacggttgtttatgtgattagatggtagtatccctttaatctatgagttagcaatggagctgatgacagtttaattaactcctgtatctatgatggcatttggctttaattaggaggtgtgcctaattaagggggttctataactttgggatatgcgtgatgctgatattgacccgaaatcccgtaatcctgcttattttgttgcccggtttattcgacctgcaaccgtttcgttttgttgtaatgctccaacatgatctcagtctcgtacaattctgtgcaactaagtcatgcttattcatgaagtgaaaaatatttcatttcattacagagagtgaagaatttcagtttccggatgcatgatttgcacgctacgactacgatcatcttgatcaacctgtacggttctccaaatttgattcggcaatcgacttgcaatgcagatagctctgaaccatcatccctcatttatctctttagggttaagtcttatttacccccttcaactatcatgaaagtaaaaaataccctcatcaactctaatactagataaatagctttggccgatgtccaaagtgtgagcttggtgttgtcttgcttgtttaggcggtgcctccaacgatgtcgcgatcgccatggagtcggagttgctaggtcgctgggcggcaagctcggcaacgatgacacgtgccttgtaatatcaaacttgtatgccacttcttcagcatctcaacatcgacgttcgctcttggattccgccgttgtttctttggtagtttggctagtgttgtttggtgcttcgtgtgttgtgtggttgtaccagttgcggtggaggaacttggcgagtctctacttgtcgagaggttgttttatttttctgtaacccgtctgggtttttactccagcgagaggttgttttatttttccgtaacccgtctgggtttttactcatgtttaattgaaatataattgatagttgtcctgccggtttagtttcaaggacgtgactagacagacagtggtagctgatttgtctaaatcaactaccactctatctaagaaggacacaatccacttatactttaaatacaattttctcttaaactactcatccgatctatgatccgattgcactgttgtattcgtaacaattaaatctttataacaagatcttacatgattatattttcatgaaaaattataaattacttttatcatatatctaaattacttttagatttcactaaattacttcttagacatataaaagtaaattcaataaagtctagaagtaatttacatatattatagaagtaacttataaaaaaaagtaactttaatgaatgccttttttcatcgtacgagaagtcatatttttatccctacaacgaatttagttactttcattttgttttaagttacttttataatataatatatgtaaattacttttagactttattgagtttacttttatatgtttaagaagtaatttagttaaatctaaaagtaacttctatatatgataaatgtaacttacgtatataataaaagtaatttacaaatataaatattttttcatcataatataatcatgtaagatcttgttgtgaagatttaattgtaacaaacataatggtgtaatcggattgtagatcggataagtaatttgagagaaaattttgtttgaagaggaaaaatgacatgcatgtctattaaaaaaatgcatgcatgtagtacgatgtagtaaactccacgtcttctccatattcaggtatcaccggttaacgcaaaaatgagaggcctctccgaatagattttacgtttcaaaaactattcgatccggatagagaaaccccccttcctcccatttaccggcggttttgggctaattatagagattaatctcctaatgaggactgaggagacgggccccgcctgtcacgtgaggagcacacgatggagttagctactgcatgtagaggccatgtcactctgtaattggcccaaaatggttcaagagattagtttaatagtatagccaactatcagctctaaatcatttatagtcaacctaatagtcattcatataagagcacccgcaatggtaaagtaatgtgctctctataaaacatgtacatctcagcaatatactcgattaatagtaaaccaccttaatagtatgtctacattggtatttatagctctctcatgcattgcctcgtttttctctatagactatctctaagttagtagatagctttgctctctctcttcatttaatacctttcaagtaggaaaatatgctgacatggatttcttgtagagagtatatagataaccattgtgggtgccctaatagttaattacaaatatatactatatcattaataactggtcccatatatcatatacacatagtgttctagagttcgtgctgcagctggctacaaatctatagcccctgtcggctattttttttttcatcctctgcgaaccgtctcaccggaaggaagctcagcgccatgctcaccggaaagaagcagtcgtgccgtccggtgcctcctgcaccctagtgttagggatttgggctctagaggatggggaatttgagggaaagagagacgagaggagggaattatttaattttttgctatgtcatccgtcggagtgtcatgtgagataactctggaacaaaactggctataaatgggaatgagggggttgtgtgtccggactgaatagttatggtgaaaatgctcgatcggtcgactgggggaggg

SEQ ID NO: 2237 - DNA, 1873 bp, Oryza sativa
gcccgatttaaacgattgaaacattttcgatctacttagtgaaataattccgatatacctggtggaacatcgtgcaacatttaaaaaatatcaataataagctaaacttttttcgtcggaatatatccatgggtggttttgttttgaagatttaattgcaacaaacttaatggtgcaatcggatcatgatttggataaataattttaaagaaaaattagtttaaagtggttttgcacatatgggtggcgctgatgtcagcgcccgctttttggagatttgtatcgggcgaccgatccctagtcatcccctagttacggggtgtgacttgtttggaattagagttgaggaggctaaatcatattttcgttatagttggaggggggggggggtcaatcggacttgagccttatttctttatgcttagctctctgttaatattcaaatttcgatggatttaagtttgagtgtattcttcaaccgtttttgttatagacgtcgaattatttttttagcctgattagtcgaatttatggctggttgatctacatcaagatttttcttttgcagggaaaatagactttattaaatcacacgggacctattacaatcgtttttgataaattatgagttctcaatatttcaaaagcccatctcagcacaaatcttgacaaacaaagctagaagggactattactcagatttgagtgggtttgagtacaattctgctttgcggttatcgaaagggacaattacttatttgactctattttagagtctaaatatcaatttggccctacttcttttaatttgcttatttgactccgcatttgtaaaacgaagttaccgtttggtcctatttccatttcgctgttaggatttcatttagaaaaaaaagaaacaaaaattcaaatcatattcaaactgaccaaaaatacgcttgaggactctaccctatccattcaatccctaaattttattactacttcagaaacaggcacatgatttatgcaatttgctacactgattgtttttgaaagatctaacctaacagaaattattaggacaagctatatgcgagatatattgatggaatgatgggtcataaaccggagaacttaattactgaactttggaagccatagtcaacgtgggcccatatttgaagtgactttaaaaaggagacaacagtgcattaccccagttaatttattttggaaaaaatacaaattaccccccgaactatcgcgcctgtccgaattacccccatgaaccacaaaaccggacattcttcacccccaactatgcaaaccggacgaattaccctcctcgaaccaattcagagcggttttgtccaacgtggcgcacatgtggcaatccggtcagcctttttttaataaaaaattgtaggacccacctgtcatactcttctttcccctctctctttattctctcactctctctcgctcttttctctctcgccgctcacgcagcgcgcacgtgaggacggtcggcgaggacggcgcggggacgggcggtcggcatgggcggtcggcgacggaggaggcatcgagcgcggcggtgacaaggcgaggcagcggtggaggcagcgagcgcggggaggcaagcggcggggtagggcagtggaggaggcgagcggcggcgggagctcgcgctgctcaaggcgaggcgaggcggcggtggaggcagcgagcgcggggaggctagcggcggggcagagtgatggggcaaggcagtggaggaggcaaaaggcggcgggagctcgcgttgctcgaggcgaggtggcggtggaggaggaggcgagtggcggcggggtgtggcgaaggaggcagcggcagcggtggaggtagcgag

SEQ ID NO: 2238 - DNA, 591 bp, Oryza sativa
ccgaatgaaatccctcttcttcctacttgtaacgcttcgagcttcaccaggccccccccggggaaaaggggggcccttttttccccgggggaaaccccccccaaaaaaaggggcctttggggggggggccctttaaaaaaggttcgtgttgcggcttggcacatcccagccgtccgatcgagccacccctcccttacaaaaccccacccaggccactaggtttcgcctcttctacctcttctcccacctgcgccgccgccactcactcccaaaccctaaccccggaggagagggaggagcagccatggccgtgggcaagaacaagaggatctccaagggcaggaagggcagcaagaagaagacgtaagctgcttgcgcgcgggcggtgtgggcgccacacctctcgtcctctctgagctgcttgttcttgcttggggtttttgggggattctgatttgggacttcttctctttttctctctccgtgtgggtgcagcgtcgatcccttttccaagaaggattggtacgacatcaaggcgccgaccgtgttctccgtccgcaacatcggcaagaccctcgtctccaggaccca

SEQ ID NO: 2239 - DNA, 428 bp, Oryza sativa
atttaaaaagtaataatttaatggagaagatgtcatagttaattgtatgcttgcatatatgccttatattatcgaacatataagaaaagtggttgtgccttatggaatggagggagcaacagcgttcttttctaaacttatgtgatatgaaaacagtacaaaagaaaaatgcactaatggtagcaatgaaaagtttagtttcagagaacgtgatagatcaaaattgtttcttcttgacaccataacattatcttttttaaaaaaaaaatgttcgatgaaatgacaatggagtgagtaaatcgtggcgacaaatgacataccgaaggtggcggtgtggaacgtggtgaagttgtcggcgacgctgcggccggcggacacgacagtgacgcccttgccgtcgccgacgaacaccaggttcgtcttcttcc

SEQ ID NO: 2240 - DNA, 516 bp, Oryza sativa
ataagaaccaaccaaaaccttaagacatttaacagaatttagttctgtgcatgcatgtgcataaaaattaaaaacgtagattaagtgcagcatctctacatagtacatacataataattcaagaatcacaaaattttccaggaaatgtcatgtaacactgtaatcacaacaggagcacgtaccaattaacaggattcagatatgtcggacctgagataccaaagatatctctgtccacagccatctggctatgcagagtcactcttcactttattggactttatagtgatgaaaaacataacactgaaacattaagaaaaaattagcacataaaaactgatactggtgtcaacaaatgaaagtattgaaatcctcaagaaaaagctacaaaggtggtcacattcaaatgccatctactttggaccgagagtgtggtagttaaacaataaataaactaaagagcaggcaaataagtccttagggtagttcgaagtatctatgttggtctgttcagca

SEQ ID NO: 2241 - DNA, 566 bp, Oryza sativa
ccataaccaaggagtctttgttgccttgccaggggcagtatgcataatttttaaaagtccaattaaatgtcgggaccatgctcctttactgtccgcttattgcccctcccctctttattatcatagtagtctagtcaaccactatgaacctatacctttatgacctacccaccacacttactctttatcgacattgggattcttaaaattaaaatgaaaccttattattctcatggtctcaattttatagcttttaaaagtcataccaactgtcaccctctttaatcatttgccacgcttttacttacttgctcgacccgtcataatttctatgacatcatcctagatgcctttaaaaatcggatcttatactgtttacattgtggtgtctcgacggatgccatcttaataaggactaaaagagccgtgaaatgccgccaccctcctgtcggacctatccagtgtcgtctctactctgtatcggcatctggatgataaaaatcgaactagactattggagcgctctttttcactttctagaattcctatcaatcgatgcgacccta

SEQ ID NO: 2242 - DNA, 620 bp, Oryza sativa
agtctctttgggcagaggagtatgatttttttcttaaaaaaaatcatagctgccaaacaccaccttattacagagtcacttattaggtatacacgcatgcaccgctcagttattagtaatgaaacaaagcatatccagagaccaccttattacagagtcccaattcccttatggggagtcatccttaccaaaaaaaaaaaaagaaatatcgtggctgcatggaaaatagaaccttcatttcaggatttgcagcatcggcaggtttggcaatgttttttttctttttgaggtttggcaatgatttttagagtgaccatataagctgctactgacatcgtaacagttaaagcgaaatgtgccagcttcgaagccttgatagatttggctcggatggctgcagctatcctgcagaaacaaaaatacatgacaaaataaattagtcttggaaacgaaaacggtaaattcgaaaataaaaacagtataataatatcggaaaccaaaaacagaacaatatgaacgaaaatgcattggtatcgacaaaaatcaataacaaatatctaaaatcacacattttatttcgcataaccatataatataagaaaattaattcaaggatacac

SEQ ID NO: 2243 - DNA, 663 bp, Oryza sativa
gttccgtttttgcaaacggatctccaatccgatacacgaaattttttcaccaagctgtctatactgtgaggagaggggatggagggagtcggactcaccaatgccgagaggaaacggtggctggagatctctgtcacgggtggagaattgattcccgatctatggaaaggctccatgtgaaaacagagacaaatccctcccttcctttttcttttctacgttggccaccaaacacaaaccaatccaatctaatctagacagatctctcctccttccttcttcctcgcatacacatgcacggcaaatggaacacacggcagcaacacggcctcgggacagcgcagaatcacaccacaaaaaactagatgcaactcagcaacaacaaaaccgaccaatagaaacttctgaaaactagaaaaatgaaaccttggcggaaagacgattccgttttcgtaggtcccgacgacaacaaagcacacgacgacaacgatgacagtggtacaaaacgtgaccaaactcgaaactctaaacaaactaaacgctatgaccagcaacatgacgtgacgatgcaacacaaatttcaacaaagcaaaaactgaaaagaacaatgcaatggcacaaatgtggctaggtaatgtatgaatttttttttcgggctatttt

SEQ ID NO: 2244 - DNA, 8757 bp, Oryza sativa
ggagatgggccgagccggcccaagagggagagggagggaaaggggcctttttagagcgtttctttttatagaatcattttaattttgtttatttcttaataattattatgtgtgctctgaaaattccactgaaatttatttacgcattttaggcttttaggaaatatacaaaaatcctccaagccttatttgacttttaactttgcacattttaattgttggagtctttcacatggattttaattattctaggcatcatttaaaggatatattttagagtcgttttgggacgtgacaccaagattgtggtattttgttatgcctacaaagatgtttccaatcattagaagcatgtttagctaaaacactagaggcacacataaccttttgtttctcagacaagacatgcttttgaaattcactatcaaccgctagctcccaattaatgtaagcatgaggatcatagtttccctcaaaataaggcagtgcagatttgatcttacctagaacatcgtcacttacctcataaaggtcatgttgatcactcctcatgtctcgacgaagatgtcgatgttgagtacagctatccccaattatcttgcgtatccctgccattgttcgtagaaaacaagaaacatacacaaaaatatgcgctttcctattaactactaggtaatggcagctcaaaaatcacacacactcaagcttttaaccaagctcttacaagatcttactaatgcaagcggaatggtgacatacaccgattcaaccaagcaccccaatggaggttggatgtatcgatgtcttggctaacacttgctgtacggctgcaatcaaatctgtaaagctctgggtaggcttaaatatgtagtaaaggaatagcaaatgctcaaatcagagaatgcaaagttgaataattgttcaaagtcaagcaccgtgctggtcctaggctagaacgtactagagacgcgagcctagacacaaacggtaccacaagatagcactaggaacaacttatgcacaactctgatatatgaaagcaaattcaaagatacaactgatttttctcttttcctttttttttcttctttctttccttttcttttctttttttttggtgcggctttttcttttcttttcttttttgtatgcacctttctgcctttttttctttttttttggattttttttaacaaaaacaacctcaaggactataaatcaagtttacagggactcaaatataaatataaaaaaatacagggactcaactgtaaatgtccaaactcaaaattaaaactatacaaaaatggaatgctgttggtcccgtaggttccgtttttgcaaacggatctccaatccgatacacgaaattttttcaccaacctgtctatactgtgagaaaagggaatgaagggagtcggactcaccaatgcgaagaggaaacggtggctggagatctctgtcacgggtggagattgattcccgatctatggaaaggctccatgtgaaaacagagacaaatccctcccttcctttttcttttctacgttggccaccaaacagaaaccaatccaatctaatctagacagatctctcctccttccttcttcctcgcatacacatgcacggcaaatggaacacacggcagcaacacggcctcgggacagcgcagaatcacaccacaaaaaactagatgcaactcagcaacaacaaaaccgaccaatagaaacttctgaaaactagaaaaatgaaaccttggcggaaagacgattccgttttcgtaggtcccgacgacaacaaagcacacgacgacaacgatgacagtggtacaaaacgtgaccagaactcgaaactctaaacaaactaaacgctatgaccagcaacatgacgtgacgatgcaacacaaatttcaacaaagcaaaaactgaaaagaacaatgcaatggcacaaatgtggctaggtaatgtatgaatttttttttcgggctattttctagttataggtaaatgaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcggcttagcgatcgatacacctctccgtgggttgttgatcttgccggtgcagatcaaccctattcctgaaagcaaatcgaagaaacaagcaagaacaagataaaagcaatctgatattgcaaataggaatttaatacaaaagataagttggggttccgaagaacaagcagacggacggtctagccgacacgcgcgctgcaagcaagtagcaatggctaaactttaatctatcaaaaccgaagaaaccctgaaggggtacctaggggtgcctagggtcgtgctccacctggttggggggcaccccacatgggccccacctgggccggggtcccaaatgaagttacaagcctataggcccattataggtgacgtagcaccttgtgcctgtgattccggccacacaagatggaattcggagatgaggctggatctgttggaaagagggctccgagagctttccatcaagtactcacgggccgaaaacggaggtcgtatgtagattcggcggccgtttgaagtcagcagtgtagcatgtagccgaatcggattccagctcttggacgatgtgatcttgatatcttcttgttcatccatgatgtgagcaatggttgcatccgtggtagccatagtcacatcaaccttccagagttttctttacatcatcagataaaggggctaaagctttgcttgtggtgtcttcttctccttcatcaagataatctttgatgtcgaaagagaaaagatcggctaagacctgcagtaatgatgtagaagcagttagaggttaaatgggcatagctaatctgagtgattgttgtcaagagaaaaacttactgggatagcaggaacaattggttgaatttcttcttctatatggtgactccctacagctgatgaagtctgatcgcttgatgattgatgtacagaaggggaaggaggaggtggctaaaaggaaacaagtgttagacagaatcggctgaaagttaactaatgaaaattaaaactatcttactggtggagctggtttagatgttgttgcaaccgatttctttttcaccgcagtcttctttttttgcaattataaatttgggagtgatcggctataagacaaaataattgtgaaaagggttaaagaaagatgcttactcttgaaaagaggactggagtagagggagttggaggcgtttgcttgggcgaagctgatggtgttttttcagtatcgcttacttcggctgcagcctgatcaacttcatcttcaattatctcttcatccagagcttgttcaatggatgggtctagggtaggcaggtcatcggctggcttggttttccttgtctttttcttcttagttgggactgcgatgtttacagccgatgatctggttttcctctttttgccggcatcggctggttctttgatgagcccttgaagaagagctgaggtcttgggggcatcatagccaataaccggaggggatggcccacctccattaggaattaagcctggggcataatggatatccttgccactgttgctctgacgaggaggagaagattctgttgtctacaaatcaaaagggggattagttaagattaatcggctaagcattatttaaatgaaatcaagtgaagttaggacttacttgagggacaacatctggaaagaggtctgtcatatacattgaagctggttggtggaatagatgcagcttccattcaccccaccatctatcaaagtttcttcttctgaacattgccagttctatgttttcaatactgcccagagggggtcctagaaggttgagcagtcgatccatcatcaaggttgatgaaatttctcctcggcattggatcttgtcagcaaaaaataagccgattaggagttgacccattccaagttgtctagctgagctcattggatgatagaattcataagaaacttggatgtttcttccttgatgaataccgacgggaaggatgcatgggctgattgcagctgagaaaatttccctagacgattggtatatctcatggttaatgtcttcgaatctaaagtccgatgggagctcaaggtcagccgaatcttcataaagaaaccatactcgagcatctttctgaaagccttcatagaagttgcagaactaatccttgagcagctcagctgatagttttgctccggcatcggttggtgtggatgcatattctccgtatgacatacatctgcgatgagtgcgctcttctccatcatcttctacaatcggctcttgtcacgcccggaatttctatccaaaattccaaacgcttacatgtgtgtaaaccctcgtccaggaatcagcggcatacaataacaaattgataatagagtacaattattaccctaattaataagcgaatataaagtcattacagagatagatagttcctctcaaacaataaaattctaagcagcggaaaataaaataaacggcacagacgactccatcccacaagcagcttgaccagggctacgcctaatcatccacaccttcagcatcactatagaactcctcctctgatgaatgattgcaaggtgagtatatgacatactcaacaagccacgcagcaaatatgcaaatacaggggataacaaaggatggcataatatggtcttatttgcataaacaacatttaataagcatttgagagaatagtaaaacagttgcgtaattaagcaatattaagtaaacactatacaacactcccgtattgcataggcccaaccattctgaacaaccaatcccggctgcacagttctatctccaaaccaggaatataccattccaaaccaggagctaaacaaattattatcatcatcatttattatggtgagagatatgaaactaatcacgaaagacattgttagacccgcccataaccgcgggcacggctattcgaatagttttactctggccagagatgtacaactgtacccacaagacacaacctcaacatcatgtcaaccatgcgtcgcgatacttaacaagtacccgaatagagattgtgacaataccccctgcataacacaattcaaagtagtgcaccgttcccggatcataatcacccccttgtaaataaaggcatggactccccagcgacccccgtgggtttatctccgccacttcacagtctggtgctctacaatgaaccatactatatagaaagtaaagtcgttgcccacgctggcttgtggttggcacgattaatgtttcacaaccgaaaatcgtgaaccggtgcttaattgtcatgagcacgaccatcaaaaccatgtgctcacaacccaccattattaggttttagttggcacattaattaattaaccaatcatgattaaccatcgtgaactataattaagccatcattaaataatagtgaatcataagttattccatttatgtgagctagtgtctctaagcatggctaagcatcctaatgacttttgctaaaaccatataatgttctagctaatccaattattaaccaaacgacaaagaatagataatcaatatcaaaagggctataacaaggcaataggttattcccacccaatgacattcagaaataaatgcaatagttgaatagaaaccatagctttaaacgggatcaacatgctcaaagggttatttgggatctgtgtgacttgccttgctggccttggaactcttcaaagtcttctcctgcaaaatcggactctccgggaacatcggaatctaagcataaaagagcaaaatcaccaaaacagcacataaaaaatcatgaatagtacatgtggatatttttaacatgtagatctcaattttagaaaaaattagagacttaaaccaactaaatccgagctaagatgaattagttatgaatttttaaagattgaaccggattaaaacacttatttagattttaattgaatcatgacgcaataaagaattatttttgaaaagaaaaaatgatttattgcgtcagcggctcgggttcatggtggaccgggtgcacgggaacggtctacgaaacgaatggccgagatggatctaatgcaaaacggatggccgagatcgaatcggtctaccgcgggtctatggggacatcgacggtgacgtcggcgatgtcgtcatcaccggcagcgacttggcctcgcatgctcgccggcgaacgacggcgcggcggcgtaaacggagggcatctatgcgtagagggagacgcggcgaactcaccgagggcttggacgacgacggacggcaacggacggcgacggcggcgaggtcgaagcggcggtgacgtttgggtcaacgacgacggcggtgctccggcgctcttcggtggaaacggaggacgggacgaggacggcgacgacttggcgatcccgacggcggtcttctcaagcgacgacgacgaccgagacgacggcggcgcacggctggacacgcggcgacgacggcggcgcaagagctaacgcggaggcggcgctacaagcgacgacgagctaaagcgagggtggctacggagagaggaggtcccgggggtccttataaaggggctagggggcggcgatggaggcccacggcggccggcggcgagaaggaaagttaagattcggggggaaaaaaaacgaatccgattcgaactcaaatccggcgatttccaaacgaaattagatgaagattccaaaagagaaaagatagaggatatcccgaggatcatttcccctctattgattcgaccagagatggaaagactcgggcgaattttggaagggcggcggcggctacgcgcggcgcggctagggcacggctggcgcgaggtggatgaagatcctgacaggtgggccccacctgtcagcgagagagagagagggagagagcggcggctcggctggcgggctggctggaccggcgcgaactgggccggggagagagagaggaaggttttgggccgactttcggcccaaagccaaaagaggtattttaaaacctttttccatttaaattattcatgaaatgcaattccatttattaaaaatacttccttggctcaaataaatcccaaaaaaatctaggaactatagaatcaatcgaagtattttataaaattttatctagcccacttttatattggaatttcttatttaaaattagatctttgcttcaaggcttttaaaattatttctaataattccatttaaacaacaatttatacatttgggatttttaaggtgtgacagtcttggtaactcggattctgacacggttggccgattgacaactttcatgactatcaaatttagccaagtttggagcaaccatggtcagcctgctccaactactgcgccgacagctatcttagccgatgcattgttcagcatctggtataaatagccgaggaggattttacccaagagaaattgtctctttgtttctagagcttcagctataaactgccagttggttgtagggccacagcttgatccacaaaagaggaatttctctagccacattaacaagaaagccacatgttctcggggggtgaccgaaccttggcccatatatactgctacataacttgaccagccgcctatgctcttggtcttgaagtcatattggttctttatgttcaagctcatagggttagccgatgaggtgatatccagacccgtgatcatgacgatatctaggagagttggggtcatcggcccttggttgaataagaaggcattgatagtgttggaccagaaataagaggcagctgccatgagaggttcatccttggctgagtttgctatggttaggtcaagttcttggctgattccaatttcgtcccagtgaactcttttgctagccgacatacgcatgaaccatgtagtccaacttttctcgagggaagttttttctagagacggccaagatttaaaggtgtttttccagtgacctggatctggattggttaatcttaacggaatcctattggtttcacagataatgaactcggttggatcaggattgccgattgggccgagaaagtagtggttttcatgcgataagctaggaatcgcaactaggttggagaggtgctacaaatccaaagcgaccgagaagaagagaacaataggagacaagagaaaatcaatctactcttgggaaaagggatttagccgatgagaacttacctcagcgtactcggctgatggcgcatcagatgggccggcggaagacgacatcgctgcgggcggaaatctcgtcggggaggaagtcgcctggaaatcgcctttgcgccggaggaatcgccggagaagagagaggaagaagttttgcttgagcggtgaaaacggaagtcacggcgtgagatttctcgaggggaacggttagtatttaaagcgctggaataacggtcaataatggcggagtgcgaaacttactcggagacggtacatgacaaattcggaacattaccaaatatcccggacttggggggcatgtgttaacaaccaaatttggtagtgtcagcatcggacaggaagatgggatcgaagcggaatcgaagatgaggattgggctgcaggaa

SEQ ID NO: 2245 - DNA, 6886 bp, Oryza sativa
tataaccattttttttcaatctattaggcaaaagtcagaaacaaacaacattgatcgatctctctgttacagcagctccgtcaattcctgaaggcaaggcatgtcggctgagatttcgccatagccagcggtatctacgtacgcctccgccgcaggctgcttcacctcccttcgagacgttatgacttatgagcatcgtggtgtttagcagaattagtgtaacagataaagagcttagtgaaaagaatgagggatttttctcagggtacaaatagttattaccgctgattgccctagtagatgtcgaccgatcctctaatatggagatgaagcaacagagtattggtacgtccctagtgaccacttgtagccccacatggggagatcgaacaactccatacctcgttgcctggtctttgatgggctgagaagaataagaatttccaatggacctaatcaaatgaatggaccataaaaagaagcatattggagataatcgaatggttgagaataacttcctcaaatgatccgacggttaatttttcgtggatgacttggcttcacagaatttgagctttatagcacaaaaatgacctttattgcgcaccaattatatatgaagaaatgatatgcgtatgattaggatgagtagtagttgcttgcgaatgacctcatcctttttttttcatttgatcgccttccccttttcatgagtgctcgctgtgcgcttagaattcccaaggaaattcattttcaaagcttgcttactcacacttttaattcaacatcttttaaactcttacttgaataacaatacatatttatcttcaaaaatctgagtttcatatgaaatttttaaaaactatgttgaaaatattgacattttcaatttccaaaattttataacttataatttcaatacattctacatgtaactttaacctatcaactcaaatttttgtatagtttctagtactcaaaacatcaaatatttaagtaaaaacattacaattaagatttcaaaatcaagtactttcaacaaaattataagaacttttctactcatatcttcaacatgcaaaccaaatttctactcagatcttcaacatgcaaatcaaaaatctggagaccttgccaataacgttaggagaacaaagatcagaagtccaagccctccctaaaatataagaatttctataggtttttaggataattaaataagcagttttaattgaatcgtgaaaatttgtgattggttcagaagataaactatgtgaagaaattaaatagtagatgtttatggctgattgagatttggaggtagggggagaaccagttactacattttaggataaattgacgatactcgagaaatatatattttttctacggatggagtgcatccttgatacaattaattatctagttgtttcttcggatcacgttcgatggcttctgttgcagagaaatatcttatcacaacgtagcgtacttagtatgtataatataatatgatttagttgattctttggatcacgttagattgttgcaggagcaataatatcttatcacaatgaagcgtagtatttgtcgtctatataaatctgcacgttttgccccagtggatgattggtggtcacgtacggtcctcggatatagcaagcacgatattgtatccacttggatcgaaatgttggaaaataatgaagcaacaacaataatcaatgccgactggacaaaagtcacgaggtgtccatccctaggacacgagcgtgcattggatggtaaaaaaaaatgacattaataagattatataagtgccagtttatagaaaaaaaatctgttactaatgtgataggtcacggtccgtgttaaaaaccaacactatgtcgccctattttttcaaatgcaccgacacaaagcctagcctagccgaacctagcaagggaaaaatatatgaaagttctctctctaaatctcttcatcttttctcctctttctctctctctcgatctatttctttgcctctcactctccccctacttaagtagaggtatggaaaacagcaggtggctctacagagacaacctacagcggctccaacgcttggcttgaagaatatgttcataacataagtcacgttgggttctgcaatgcgcagctatcctaaaggacaacacgacggtaacaacggcaatagtgacaacaatggcttaggtggcgtttggatccaggaacttaactttagtctctatgtttagacactaatttagagtattaaatatacactacttacaaaactaactacataaatgaaaactaatttgtgagacaatttttttaagcctaattaatctataattagagaatgtttactgtagcatcacataggctaatcatggattaattaggctcaatagattcgtctcgctaattagtccaagattatggatgggttttattaatagtctatgtttaatatttataattaatgtccaaacatccgatgtgatagggaattaaaagttttagtcccatctaaacagggtcttagccgttcatgtcctccagctcactagacagccaggctaggcttctctggggaacaaatccaatttgtggctcctactaaccgcccgaggtcagcatcccaccttttatcctcctcgtacgtatcctcatctctctcttgctattcttgttgtcgacggggatacccgtagaccggatatagacggtattggggtacgctggtacgaggatctacgtaatacgacatcaagcaaataaaagacaacgattatactggttcaggccccttgataggtaatagccctaatacagttggtacgggattatatgatggaaaccacagattacaaagggaatagtagaactcgatgataccgacaagaccgtagtcgagttggttcgactagatcacccggcgacttggctcctgtaggctccgacttcataggctgtggcggttgtgttggcggtgagattcgatcactttggtcttcccggggggtcccttttataccacgggtcagtcgatctccaagtagaactcggagatatcggacccacacaatatagtaacgacccaattctgtccgagtaggactccttccatccgtggactccgtttcttttacgtgatggatttccttaacatgtacaggaaacatcagtatatgcgcaggtataccgtatcggtatacaacatgcatccaagggtagagtgtataccttatccgtaaccctaacagtaacccccgaattctgcttaaatgaactcatgtgaccgatcgcgacttcggatgtcggaatcgttatcgctctcaactggtcgatctcggtatgagaaccgtagagacatagagttatcgataacattgtacgaagttcaacggtcatgagtgaatttaaattgtagtccgaaaactgctgcgcgtaacggacccagaaatttccggcggccatctctctcctttccttggaattcgcactgtcggtagtgcgcttatttaaaggggttttggggatccattttgaagtccgtttgccgcaaaactttctagccttcaagctcccctcgtcttctccgctcccgcaaaaaaaaccctagtttgctcatctcggtcttattctccggcgatcttcggcggtgatggatttcgacaagtccacctccaccaacgcgtccctgaagaagctgcaggacgacggtgccctccctggtcgcgggatcatggagagcgaactaggaggtactgaacccgaacctgtcctgggccgcatggttgcggttgaggattacattctttgtggttttcttcctccgccctccgagtttattcttcctgtcttgaatttctacggcctttccttgcttcatctgaaccccaattctatcgcattccttagcattttctcctacctttgtgaggcctacattggggtagagtcatttcttgatctctttcgcttttactacgagttgcgctggatggaaccaaaaaaggtatctggatgtctcggtttccgacttcgggatggcctgaagtcgcgatacatccccttccagtgcccctcttctcgtagcaaatggcgggcaaggtggttctatcttcagatagagaactcggatccagcctctgttgttcctgaggagcaaccagacaagattctagagtggaccgccaaacccgccctaactccctcccttcagtctttaatcgacattattgatgacctccgagtacgagggttgtcggggtatgaagttgctgccgacttcatcggtaggtggatccaaccgctccaggcccgagcctacccggcctttgcatgttcctcctgacttatcgagttctgtttgtcgatcttacaggtttgaatagcgaaaccgtggagcgccgcgtcggtcaagtgatgatcagcggccccacgacagcgagcgacatccccgtccccctttgagagaaggggacggtcgaacgcgaggctgggatcaacgtgagtgtactcgttgactcctttacttctgtcttattgggagcgcatagtgacttcatgtacgcaggctctccctctaacggatgtcatcggaccgcttgcggatcaccaggcggcggcgtcgttgaaggagggcgtcgccaaggaggtgtccgacattgctgctgctgcaacgacgagtggcagcaatgttccgaagaaggggaggacgttctcctccgtactcgggaaccgtcggaaagcacctactccgtcggtaagcctctcttgtctttcgttcatgtagtcagaatattttgacctcatatcgtgctatcttgtttaggccatggatgcatctcccccaccccagcgaaggcaaaggctggtgacgctcggcgaaaagtaagtagatgctttagaagtcgtcctatttgcaaagtcttgattgcctgacttcatgaaatcgtgggaattttgcgcagggcggcgcgggcgaaaggctgcgcaagacgggtccagtgcagcctccattgcatcccctgcagcggcctcgacggatgtcgtggtcgtggccagggagcgggaggtgacgccaagcggcctcgccggtggccttttacccgctcggggcgcgcctgctgatgtcctcacctggggggagctccaatccgagatggagcgtattctccaggcaagtgctcgcggcgtaggacatgaaatcgaggaggccagggtagcggcgtcgtcggcgaacgagcgtgccaacaaactagcacgtgacctggcggaggttcgagaggacctcctaaagatgagggagctggtggccggcaacaaaaggcagcgacaaggactcgagcaccgaatgtcggagctcgagaacaacttgtcggagatccgcggctcgctgcggatgacttacactggcctacaccagctcgccggggagtgcggcgtcacgagcaccattacggtgaaccctgacgagttctcgctgacgtcctcactcacggaactagccacggcgatggaggagatcccctgcaagcatgcggccaggatcggcgaggagatgtttaacgggatctacaccggggcgagccacgtcctcgcgtgcatgaggttggcgcaccctaatatcgacctccagaggatcttggatcagggggccgccaatgacacgcgcaagggcgtgatggacgaattcggtgacttggggtagtctgttctccccgtttttgaagagtaggattttatttcccctgtactccttaatcgattatgcttgtaaaactttcgtaggttcaaactgcttttgtgtatgcagttgtttccttcgttttctttagcatgttgattccgagtactttgttgtaaatgtagagatgttgatatcgaggatgtccagcaacgcgggcagcttgagttgccggtagtcgttccggcacttgtgcttaagccgtacgtgccgcgggacgatgtcgatcaaagcctgtccgtggaggcggacatggtgatgacttccttaggttggtactttggtcttcatctcctttactcttttgttcggatcgacttaatttgccgtgttctcgaaagaggagaacaactcgacttagtcatttccgtgtttgagcagacctcgagagtgtgttggccgaccgagatcatcgaatccaatattggaggatgaagttcaaggtggccgaactcgagaggactatggtggaagtgaagaaagagcaggccgtggaagccctccgaggtcgcgaggtgtggttcaactcgtacctcaggagctgctgcatggcgatggctggagtctgtagggagctccgagtacctcgcgggaatcccgaggagtcggcggctggatacatctcatggttaaatggggcctgcgctcagcttgaagtcatcggcaagcatatcgacgaggccctgaaacaggagtgtcgtcggttgagccgatatgccggagggcacgtgctggcctgtgtccgagatcaccgcccgcagctgcacctcgagttcctccaagaagggttttcacgttctcggaggactcccgcagagatagacaatctggcgaagtcaatggcgccgcttgccgagaaagtctttcaatccatggattggcgttagccatcctggtagtctttgtatcctgtaaaaattatcttcaaggagacatgtaatatattttggagtagttataaattgtaagaagtactcgtgaaatagaaaaggaatctatctgactagggtttagggtttagggttttgagtcatacactctccctagcccccagccttgtctttggagaagcgttcttggaggataaggctcttggacccttgacttgccttggttgaaaaa

SEQ ID NO: 2246 - DNA, 2230 bp, Oryza sativa
  unsure (1)..(2230): unsure at all n locations
ggccttatccgctctgggcgtcccaagccgaagttcacttaggttcctcagaggccttgtcaagacggcgtaaagggacatgaggataggtttcaacgctatgtgtcgtcgtggtaagggatcgtcgggaaggaacacattgattgtagtctttacctaaaatcaactttttttgaagtcgtaagatgtcttacaagtatggatactattgatttacacataaaatttacgtaattgatcaatgttccatgaatttgctaactcgcgaccatcgccgtctgcaatcttgaatgcacctggccgcaagacttgcgtgatcatgtatggtccttcccacttgggtgagagcttgttacgccctgcatggctttgaacccgtcagtggacgtaatcgccgatcgaaagcgtgcgtgctctgatgtgcttctcgtggtatcggcgaagggcctgttggtagctggctgctctgacggcaactctttctcgatgctcttcgagtagattaacatcgtcgcttcactgcccctcttgatccttgtcggagtacttctgtactcgtgtgctctgatgtcgtagctccgtgggaagcatggcttctgagccatacacgaggaagaagggtgtctcgttgttggacgttatcggtgtggtacgcacgacccataagacagaggggagttcttcgacccacttcttgtcgtgtgacatgagtctgtcgtagacacgggtcttgatcccttgtagtactatgccgtttgccctctcgacctgtccgttgctctgagggtgagaaaccgaggcaaagcagatattgacgcctaatccaatgcagtaatcctggaagtcgacactgatgaactgggagccgttgtctgttatgatgcagaatatccctttaatgcagaataggaacctatatccgccctgtcctcgtgggaatggtccgagtatgtcgagcccccagcacgagaacggccaagtaagagggatagtctggagcgcctgtgctggtagccttgtgtgtttactgtggaattggcaggcttcacaccgctgaaccatgtcgcaagcatctttgacggcggtcggccaaaaaaacccttgttgaaaagcttttctgaccaatgtgcgaccggcggcgtgtgacccacagatcccttcgtgtatgtcgaggagaagatgtttgccgtcgtgggatgaaatgcatttgagaaataccccgtttggcgccttcttgtatagatcgtcgccaatcatacagtagatttttggcttgacgggttattttttcggcttctgcatcgtcctccggcaactcgtcactactcaggaacttgatgagtagggtccgccaatcgtctgtggtctcaatgtcggcaacggcgcgttctgcttttgtagcccccgagctgatgtcggggacgactgtgctatcttcgtcatttaccaaatatggaagctcatagctttgaggtgagtagacattttaattttccaagtggagtagtttgtgccattaaacatgggagccttccctacatggttcacctcgttcgacatcttctctctaggcggaaagcccaatcaagagagaccaagctctgagaacacttgtaggatcgagatgtcgactagtggggggtgaataggcgatttaaaattaaatgacacctaatcaaaactaacctaagttgctaggcttggtgagggtcaactctaactaagcaactaagttatattttgcaaacctagggtgatagtggctcaattatatctctaggaaagtaaatcacactcctatgtcaatgtttagcaatcctagggtgatatgatctcaagaatgtctctagaaatgtaaattgcacaaatgtaaatgcgacaatcaaatgagacgatgagacaagatatttttcaccgaggttcgaaaactcgccggtttcctactccccgttgaggtgagcccaactccaccgctcaaccacgaagccaccgcacgcccccttcgtcaaggggtgggcaaggcggcagccggcccacggagaggactaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2247 - DNA, 3767 bp, Oryza sativa
ttcctgcagccctgtctctagaaatgtaaattgcacaaatgtaaatgcgacaatcaaatgagacaatgagacaagatatttttcaccgaggttcgaaaactcgccggtttcctactctccgttgaggtgagcccaactccaccgctcaaccacgaagccaccgcacgcccccttcgtcaaggggtgggcacggcggcagccggcccacggagaggactacccaagcctcgatcactagggtagttcttccttcactccgaaggtggtgaactccaaaccaatcacaaaccggcgccgtgcctcctccacaatcttctcggagaggtcaccgggcaactcctccacaagccgtctaggaggcggcaacctccaagagtaacaagcaatgacccggcgtggagatgatcaagtgccacactagctctacaatggaagcaaatgcacttgactcttggctaaatcaacctcaaccactacaatggatgaacactaagctcaatggtgtgtgagagaggtgcaaggggtgtatgcaattgaattgggtgccaaaagagcccccttgctgctggtgggggagtatttatactcccacccaccaaaactagccgttgggcgaaatcccccaactctgtgctctgccggtctgaccggaggtatgtgaccggtcagaccgtgctactcagcaacggctagaaaactagccgttgtagtgctgtcagagggccccatcggcctggccggtcagaccgacaaggggtggcctgttagaccggcctcggctcggtcagaccgccatcagctcggtctgacagaatacggttccctcggctctgtatcggccatcctgagcagcaccatcccggccaccagggggccggtctgaccgcgcatgtcctgccggtcagactggccttatgcgccggtcagaccgccattgtggcgccggtcagaccgccactatgtggctgctctgaccgcccctggtcaggccaaacccagtgaagtgtgtgtgtgtgtgaaaagtgagcacaagtctaaatgtataatgacctaatgtggcaattaacatcatctctttgctaggtcattacccctcttaatagtacggcgaaactaaaaataaactagcaaatttgatcgccctacacctcgatcaattctaaataaaagtgctagttttaccgtcttctttccctttgctttgcgccgtcaattttaatccatcaataatcatccatgcgcacatatgacgtggacctaacttaaaatgtatagctcaaagacaacggttagtccacaattagcgcttgtcattaattaccaaaattaacaccgggggcctagatgcttcaacgccgtgctaggtcgtcgagttcgatgttgtccttgcgatatacgtgtcgaacttcgatcccgtcaaaccttttctcctgcaaggtacttggataactcggggctagagcacttgtagtctttgtgcacctggtttacgactagttcggaatctcctttcacgattagtcgcttgactcctagtgcggctgctgctcttatcccagcgagtagtccttcgtactcggctgtgttgttggtcgccttcaagttgaggtgaattgcatgcttgaactggtctcccgaaggtgatgtcaagatgaacccttcccctgctccttggctgtagagtgcaccgtcgaacgccattgtccatgtttcgctgtcggtttgactgtccagcctgttttcaggcatagtccagtcagctacgaaattggcgaggacctgggacttgatggttgttcgtggtacaaagtggacatcaaactagcttagctcgactacccatttcgcgatgcggccgacaatgtctttatttctcacgacttcactaagagggatggagaaaacaactatgaccctgtgggcttggaagtagtggcgtagctttcttgatgtcatgattactgcgtaaagcagcttttggatctgtgtgtatcttgtctttgcattgtggagagcttcgctgacttaataaactggcctttgcaccttctctctcgacaacaatgatggtactcacagaatatggcgtggcagcgatatagaggaataattcttcattaggttggggagcaacaagtatagggggatttgacaggtagcgcttgagtgcgatgaacgcctcttcggcttcctgtgtccatacaaatttatcttgtttcttcagcagagcgaagaaaggttgtccacgctctcccatcctagcgacgaactgtcacgcccggaatttctatccaaaattccaaacgcttacatgtgtgtaaaccctcgtccaggaatcagccgaggcacacaataacaaattgataatagagtacaattattactctaattaataagcgaataaaatgtcattacagaggtagatagttcctctcaaacaataaagatctaagcagtggaaaaataagataaacggtgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggtttcatttgcaaaagcagcatttaacaaacatttgagaatttaataaaacagttaagtattaaacaatattaatccaacgctatacaacataccctgttgtataggcccaaccattctggacaaccatcccggctgcacagttctatctccaaaccaggaatgtaccattccaaaccaggagctaatcaaattattaccaattatagcatcatttactatggtgagaagtgtgggactaatcacgaaagacattgttagacccgcccataaccgcgggcacggctattcgaatagttttactctgatcagaggtgtaccactgtacccacaagacacaaccccacatcatgtcaccatgtgcctcaataccaccacgggtatctcagaaaggagctgtgacagtacccctcgcacaacacaatccaccacagcgcaccgttcctggatcataatcacccccttacaaacaaggcatggactccccagcgacccccgtgggcttatctccaccacttctcagtctggtgctccgcaatgaaccatgctatacagaaggtaaagccgttgcccatgctggcttgtggttggcacgtttaatgtttcacaatcgaaactcgtgaactggtccttaattgtcatgagcacgaccatcaaaaccatgtgcccacaacccaccattatcaagttttagttggcaaattaattaattaaccaatcacgattaaccatcgtgagctatcatcaaatacccatcattaagtaatagtgaaacattagttatcctaattgcgtgctaatgtttctaagcgtggctaagcaattatgtctaatacatctagttgaaccattatataagtacaactagtccaattaaaaccaaaggtatcgaagaatagggtaatcaatacaaagtggccataccaaaggaataggttcacaccacccggtgacattcgaaaataaatgcacagttgaaataaatagagaatttaaatataggatcaacatgctcaaaggaattgtgtttgggatctgtgtgacttgccttgcaataatcggttttcaattaatcttcttgaatacttccgacgcacttgcggggctgcaggaa

SEQ ID NO: 2248 - DNA, 728 bp, Oryza sativa
aatcggagctaagatgaattagttatgaatttttgaagattaaatcggattaaaacacttaaattgattttaattgaattatgacgcaataatgaattatttttgaaaaggaaaagaggatttattgcgtcagcgggctagggtttcggtggaccgggcgcacggcggcggttcacgcgaacggacggccgagatcgatccatccaaaacagacggccgagatcgatcggtccacgaccggctcacgggagagggcgacgatgacatcagcggtgacgtcaccaccggcggcggcggctcggcggctcgggcgcgcatgctcgccggcgtacggcggcgcttcggcacgaacggagggcaccaacgggtagagcgcgacgcggcgaactcaccggtgaccaaaggagcggcggaagaccaacggacggcgacggcaacgaggttaaaacggcggcggtcttcggcttgacgacggcgacggtgctccggcggtctacagcgacggcgaaggggcggacgaggacggcgacaacttggcgaccacgacgacggtcttcccgagcgacggcgacgtctggaacggcggcggcgcacggctgaagcgacggcgacgacggcggcgctagggcacacggcgctagggcgtttccgacgacgagagacgacggcaagggtggcgacgggtagaggagacaccggggaaccttttaaaggggctcggaggcgac

SEQ ID NO: 2249 - DNA, 845 bp, Oryza sativa
tgatgaagccagctttgagaagcttgtcgagctcttctcgtatgggttgtttccggtctggtgcaaatctccgcatttttgttttattggcttggcatcgggtcgcaccatgagtttgtgctcaatcacctccctggggaccccgggcatgtcgaacggctgccaagcgaacacgtctgcattgtcgtagaggaaggtgatgagcgcgagttcctatttctcgtccagtgacgcctcgatcttgacggtcttgtcggggatggcactggagagtggaacgatcttgattgcgtcgtctggctttggcgtcttgtttgttttactcactttcttgggtggctcagctgtggcgggtgggttgggcgtgtgctcgaccatgtcgaggctccgcctgtcgcactgccccgcgagctttgcgttaccctgaatagtgattgttcccttcggcccgggcatcttgagcacttggtacgtgtagtgagaaccggccatgaacttcgcgagtgcagttctcctgatgatggcattgtatgctgtatcaaatccagtgatctgttctgttcggaagttgtttgcttggccgaaagttacaggcaacgtaatcttgcccaatggcttagacgatgactgaggagtaattccatggaagggttgatcagtgggcgtcaacaacagtcttggggtggtctgcttcagagaattcgatcttctgctcagaccacttcatcttgggggtagccccctgccatgtcgaacaaacttcgcgctccacttttttgtactcttgcttcgaggagtatgccgtggaacctccgaagatatgcgaaacatgaatatggggggcg

SEQ ID NO: 2250 - DNA, 2317 bp, Oryza sativa
gaaggagaaattatttgctaagtctgatttgccatatccaaccaatgttatatttcacatttttggcgaatataatgatcttggaatatattttgtgcatagagtttacatctgctcggatttagaacttactgtacatgtggataaaacatacaagctagagagaaatgttattgctaaccaaattgtctcgagtttgccttgttttaattggaagaaacaggttgttgtaaatggactatgcaaagagcaccatatggaaaaaccgaggacggttttctgtgaagaagggggggatgatgtgaccatggctaccacggatgcaaccattgctcacatcatggatgaacatcatggagcacgaccctaggcacccctaggtcgtcctcccacccctatatatagctaggtaccccttcagggtttcttcggttttgatagattaaagtttagccattgctacttgcttgcagcgcgcgtgtcggctacaccctccgtctgcttatctttggaaccccaatttatgttttgaataaatttctggttgcaatatccagattgcttttatcttggtcttgcttgttttttcgatttgcttgcaggaatagggttgatctgcaccggcaagatccacaacccatggagaggtgtatcgatcgctaagccgcaacataatgtctcgtacggttgtagtcggatcgtcaacgtttctcacaaattatagttctcacaactcacagaaagatcgggccaacaacagcattgagtgtagagaggacttcagggttcatcaaaggtatcgctgatcggctagaggcatcatcactagatagtttggtggttgattgtggctcaattaggactcggctacacaaaattcaggctctgatcccagaggagttagccgatatccttactctagctgtttaccttgagcaacatcaattcaaactagagaaagctaagttaagactggccgaatggcgagagccaaggacaatgaagccactatccaagctaatcggcaactggtgcatgaagagaaatccaagcttgatcaacaatctgaaggcccaatcaaatctaacattgatcggctcgaggctcgcaagattgaactcttagcacaacttgaagaatgcaacgctgagctggatatagaacacaaaaaactagccgatctcccaaagtctatcaaagagcagaaagcaagactcaaatcggctatcaagcatgtcgctgatctgaccaagtctctgaagatcatccctagaaccgatgcttaagacgctcaagccattgaagaagtagagcagattaggcaaaaagctgtatcggctatccagcgctatctttctaataactttcatgtattaggctttaggaaattttgtaaccggcaaagatacttctaagtatatcttgataatcttttgtgccgatacatgtataaaacatcctaatttgcttaaatttatcaaaatttgcaacttatggatatatgtgcccccctaattttacgatgccacaagtagtgataaaattaaattgtgaactaagggcgatacaacaatatcggccattgtacatcggcaaaccacaaccgattacattataaaaaacaactaaaggcgatataacaatatcggccatctcaaggcgatgtaaacacatcggctgtcatacatcgacaatactagccgatgtcgcgtctcaaaacgactttaaaatacatcctcgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaatgttaaaaaggttttataaaaagaaaagctctaaaaagtcctttttcccccctcaccctcttgggccggctcggcccatctctctccctctctctcctcttccccgcggcccattcggcctcctccccgcgcgcgcgccgctgacgggcgggcccgcccgccaccctcgctgacgggtggggcccacccgtcattcccttcctcccgccgctcccgccgcccgcgccctagcgccgccgccgccgccgcgaatcccgccgcccccgtccgccccggtgcaatcaagaggttggaaatattccccgggatcccctccccctttcccctcatttttccctctctctctccctcggattcgtttggaaactttccccctaacctcgccggcgccattaatggc

SEQ ID NO: 2251 - DNA, 1412 bp, Oryza sativa
ctctagactttgggaatattctcatcacctggacactatggaatggttggattattgtggaattggattcacacctccccctctattcaaaatcctcaaaatggatttaggctgggctcggggcgcttggttttgatagtagcgcctcggccatataaggaccggtcttcgggcctctgttgcaaagcactaccgtacttccacatgtctagtgggtaaggcttagtttgtggctcagtctggttataaacaaaagtacacggatggagatggatgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggctacacgtgaggaagatgtgtcttgtgggtaaagatgtacacctctgatcagagtataacctattcgaatagccgcgccctcggttatggacaagccgagcaatgtacccaagttagtgttttaattcttaaaacctgcttaacaactaaaatgtggaatggttggcctgggttggcttgggacgagctgggacccagggtcgagttgacggttcggtccgaatcatcgtaggccttgggttaaggcaggttcgtgtgggttcacggccttgataaataatattgtatagttctagaatcgtgtttacaaaatagctttgagcaactaagtgtcttttaatgctgtttactgcaaccctaaccctttatattataactcccttgtactcccttgcatttattatgcacttgtgggtgtgtcttgttgagtacggtggttgtaatctgtcttgctcaatttttcccaaacccagaagaggagcccctagaagatgaaggctttggtgtctagctcgtgcctgccgtcaagcgcctgtggtcgtcgccctagtcttccgctgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacaagtggtgtaacatcccggcctagggcttaataggattaatagaatactcatatcaacaagttgcaacttcttttccggaagtcactctccaaagaactccagggttaagcctgcttggcctggagcaatttgggatgggtgaccgaccggggggctgcagga

SEQ ID NO: 2252 - DNA, 269 bp, Oryza sativa
aaattcaaattcaaattattgaaacaaaaccatatagcaaaatgacaaaaacaaaagttgtagatattgataagttgtacgactttgtgttgacaatttttttttcatttgaaatcatttactacccgaaaaactatttgaattgagaggagggagacaaaatggacttcttggtgagggaggagcaaaagggctggaccgatggcctgaagagggaggaggagggagagagaggctgcgggctgagggagggagagagtaatacttgg

SEQ ID NO: 2253 - DNA, 240 bp, Oryza sativa
aaaaaccgggactaaaaacatctttaatcccggtttaaaagatcaagggtactttttcatctttagtaccggttggtgttaccaaccgatactaaagatctatttgtagtcccggttggtgttaccaaccgggaaaaaagatcaacataagctttactcccggttggagttaccaactgggactaaagatgtatttttagtcccggttggtaacaccaaccgggagtaaagatccccatg

SEQ ID NO: 2254 - DNA, 1989 bp, Oryza sativa
atatatgggccaagtttcggtcaccccccgagaaccttttcaactgttgatcctatttaaagctattgttttgggcagactttcggcccaaagccaaaaaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttcaagacttttaaaattatttctaaaaattccatttaaacaacaatttatatattttgaattttcagggtgtgacatagatgtacagtaccgataacactggaataaattttaaatgagaactattaaaagatattatgaagtgcatgtgccattagtttggtttaattaaaagagaaagggaggagaacagttctacttttccaatatttttagagggcttctatgagtaaccatttggcataacctagggtcaaggaggctctgataccaacttgtcacgcccataaccacgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattacagggttttagttggcacattaattaattaaccaatcacgattgaccatcgtgaactatcattaagctatcattaaataatagtgagtcataagttatcccaatagtgtgctaatgtttctaagcagggctaagcaattatatctaatatctagttgaaccaatatacatagcccaactagtcaagttataataacccaaggtatcaaggaataaagtaatcaagaacaaatgggctataacaatgaataggttaattccacccaatgacattcgaaaataaatgcaatagttgaaaagaaacaatagctttaaacgggatcaacatgctcaaagggttgtttgggatctgtgtgacttgccttgctggccttggaactcttcaaactcttctcctgcggaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttgaagattaaatcggattaaaacacttaaattgattttaattgacttatgacgcaataatgaattatttttgaaaaggaaaagaggatttattgcgtcagcggctagggtttcggtggaccgggcgcacggcggcggttcacgcgaacggacggccgagatcgacttgatccaaaacggacggctgagatcgatcggtccacgaccggctcacggcgaacggccccgatgacgtcagcgatgacgtcaccaccggcggcggcggctcggcggctcgggcttgcatgctcgctggcgaacgacggcacggcggcgcaaacggaaggcaccaacgggtagagcgcgacgcgacgaactcaccggtgaccaaaagagcggcggaagatcaacggacggcgacggcgacgacgaagaaacggtggcggtct

SEQ ID NO: 2255 - DNA, 1043 bp, Oryza sativa
aaataaatctcttcaaaaccatgcacatgaagaggaaggcagcccaaagccttccagtcgactactgcataaaaaaaagtcagaagatatagggatctagaattagttagtaagcaaagaaagaaataaggacccagtattagcaacaaagaaagaaaatctaagcgcagcaatcgctactcgccttgcatttgctgagccgcatccaagcaatcaacgtggccgagctgcgttgccgccgtcacagggactccggaggcaaccacctccaccaccttaacaatagcgaggcgtagtccttgatatgtcggcgttgggatctgccggcggaggatcagccgatgcaaggcgatgcggaggggggctgtggccgcgtggatcgggggattgaggggatgccgaggtcggggaacggggggagaggccgccactgccggtggtggatgacgcgacgatggcagatgagccgatggaggaggaggagtcgcggcaggactcacggaagaggcaagacaccgtggcggtggaggtagtcgccgtcggtagtggtgggcagggagctcggcggtagagtggatggtggcggcgaggaagcagacgatgacagctgggtttcagtggatttgggaattggaatcggctagggtttgaggaaccagggtatgaagcaatcacaacgcggctttaccgaaatgaccctagtgcgttgacaatagttattgaattatttggacaaaacagtcaattcaaatttaaaatggcttgaccgcaaagtggcccgaccgcgaagattttgcttttgaaaaattttggctcccaccccacaaaaaaattggcgtctacagctacagtatcattcttttttggaaaaaaaatacaaactatatgcaaaaataatttcaagagcaaataaacagtatattccaacataaatatattttaataaaatgaagacatttggtgaaaataagtgagaatgctaccaattttctgaaatggtgtatccaaaacaaattacaagagcaaaagaacattatattcct

SEQ ID NO: 2256 - DNA, 2466 bp, Oryza sativa
  unsure (1)..(2466): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcggcagccttaccctgagtggtttgaaagagttcctcttcccaatcggttcaaagttctggacttctccaaattttcaggacaagatgatgtgtcgacttatgagcacattagccgattcctagctcaatgtggtgaagcatcggcggtagacgctctgaaagttaggttattccggttatctctgtctagatcggcttttacttggttttcctccttgccatatggttcgatcaacagttgggccgatttggagaagcaattccacaactatttctacagtggggttcatgagctgaacttatctgacttgacgacgattaagcagcggcatgatgaacctgtgcacgagtatattcagagattcagggagatgaggaacaaatgcttcagcttgagtttaactgatgcccagttagccgatttggcctttcacggtatgattgctccaattagggagaagttctcatctgaagactttgatagcttgtcacatctgatacagaaagtaaccctgcatgagcataggtctgcggaagttaggaagagctctaagagagttaatcatgtttgtccgtacatgtatggatgatgaggatgatcctgaaatagctgcagccgaatgggtaaggagtaaaaaggtcgtaccatgccaatgggtgaaatgttctggaaaagaggagaagtataattttgatattactaaagctgacaagatcttcgatctgctactccgagaaaagcaaattcaacttcctgctggtcatacaatcccatcggctgaggagttaggcaaaaagaggtattgcaaatggcataattctaggtctcattctactaatgattgcaaggtttttagacaacagattcaggtggccattgaggggggcaagattaggtttgatgattccaaaaagccgatgaaggtcgatggtaatccttttcctgttaatatggtgcatacagctagccaaacaaccgatagggcccgcgcaaggggttttcaggtgaattcggctaagattatcaacaaatattagaggaagtatgacaagcagcaggagaagcattatgaagaatacgatgatggttttgatcctcattggggttgtgagttctttagattctgctggaatgaaggtatgaggttgccatctattgaaaactgccctgggtgcagtgatattgtcgagagctcaagccgatcatataataggggtaatcggctgaggcagacaagagtttctattcatcaaagattgggtcctgtgaatcaagatcatggctaagaagacagtgtggtcaggaagaatcaatggtgtccttctggtactttcacaaagaatcagaagagaagggttcaaagattgaggaacagagaacgccttcaggaggttgaacaagaaattaatcatcggctgaggaaagcaaagccaaggcaggagtggcgtgttaagaatcaggttcatgtagccgatgatgttgcagccgatgaggcaaagaggttggcaaaagggaagagtgttgtgacggcactgattaacatggtctttaccttgccagccgatttcgggattgatcaagccgatgtcgacgaggtggaagaggaatcggctaagttggttctatcaccagaacaggcagtgtttgagaaacccgaggggacagagaatcggcatcttaaaccgttgtatataaatggctacgtcaatgggaggccgatgtctaaaatgatggttgatggtggggctacggtaaatttgatgccttatgctacgttcaggaagttgggtagaaatgccgaggatctcatcaagacaaatatggcactcaaagactttggtggtaatccatcggaaaccaaaggtgttctaaatgtggagctgacagtcggcagtaagactattcctactacgttttttgtcatcgatgggaagggttcttacagtttgttgctcggaagggattggattcacaccaattgttgcattccttcgactatgcaccaatgcttaattcagtggcaaggcgacaaaatagagatcgtaccagtcgacatgtcagttaatgttgccagtgccgatttaggtctttgggagatggatggccttgattgtttatctggaaaggtttgggatggagattttctaaagagtaaagtccatcaccggtccctaaacttgtaccgctgtgtcatcctggtccctaaactcgcaaatcgactattcatgtcctcaaacttgttcgactgtgtcatcccgatccctaaacttatagatcactcgtttaggtcctccaacttgttcagttgtgccacctcggcccctaaatttggatttgaatatcatctgggtcaaataggacggtctaa

SEQ ID NO: 2257 - DNA, 1294 bp, Oryza sativa
ttgttgagattgaaagctgatcagtaatttacttgggaggcagagcagcaaaaggctttggatgatattaaggagtatcttagctctcctcctgttttgattcctccacagaaaggaataccgtttaggttatatttatcggccggtgagaagtcaatcggctcagttttgattcaggagttggaaggaaaggaacgagtcgtattttatcttagtcgtcggctcttggatgctgaaactcggtactcccctatggagaagttatgcttgtgtctgtatttttcgtgtacaaggttgaggcattatctactatctaacgagtgtactgttatatgtaaagccgacgtagtcaaatacatgctatcggctccaatattgaaaggaatggttgaaaagtggatattttccttaaccgagtttgatcttcggtatgagtcaccgaaggcgattaagggacaatctatagccgattttattgtggaacatcgtgatgattcaatcggctcggttgaaatagtaccgtggactttattctttgatggatcggtgtgtactcatggctgtggtatcggcttagtcataatctcccctaggggggcatgtttcgagtttgcttatactattaaaccatatgcgactaataatcaagctgagtatgaggcagtgctcaaagggttgcaactactcaaggaagttgaagccgataccattgaaatcatgggggattctctgttagtaatcagtcaattggcaggagaatatgaatgcaagaatgatacattgatggtttataatgagaagtgccaagaactaatgaaagagtttcggctggttactttaaagcatgtttctcgagagcaaaatattgaagctaatgatttagctcaaggggcatcgggatataagccgatgatcaaagatgttaaagttgaaattgcagcaatgatagctgatgattggaggtatgatgtacatcgatatttgagtaatccgtctcaatcagcttctaggaaattaagatataaggcattaaagtatactctgttggatgatgaactttattaccgaacgattgatggagtattacttaagtgcttgagtgctgattaggctaaggttgcaatcggcgaagttcatgaaggaatttgtggtactcatcaatcggctcataagatgaagtggttgcttcggcgcgcagggtacttttggccgacaatgctggaagattgtttcagatattataaggggtgtcaagattgtcagaagtttggagcaattcagcaagcaccggcgt

SEQ ID NO: 2258 - DNA, 51174 bp, Oryza sativa
  unsure (1)..(51174): unsure at all n locations
atagtatggcttgtcatggatcgatccaagtccctccttacaaaattgtttatggacatgaggctgttttgccatgggaggttagaatcagctctcgaagaacagaattacaaaacgatttaacggccgatgagtattacaaccttatggccgatgagagggaggatctggttcagtcacgattgcgtgcccttgcaaaggttaccaaggataaggaacgtgttgctcggcactgtaataagaaagtggtacctaaagatttttcggaaggagaacttgtatggaagttgattttgccgattggtactcgtgatggtaaatttgacaagtggtcgccgaattgggaaggaccgtttcaaattataaggttgtatctaaaggagcgtatatgttgcaagggcttgatggtgaagtctatgagcgagcgctcaatggcaagtatttgaagaaatattacccaagtgtttgggttaacgcataatcggctagtattgccgatgcatgacagccgatgtgtttccatcgccttgagatggccgatatggttatatcacccttagttgtttttttttcctggtgtaatcggttgtggtttgccgatgtacaatggccgatatggttatatcgcccttagttgttttttcatggtataatcgattgtggtttctataattttatcaatgcttttgacattgtaaaattagggggcacatatgtatcaaaatgaaatttttttgagcaaatttcgaagtcatattaatcggcacaaaggattgtcaagacagtaaagtactagagcatcttagccgattacaaagatttctaagtcctattacataaaagttattgagacaagtattgctggatagccgaaatagctttttgcctaatttgttcaacttcctcaatagcttgggcaccttgagcatcagttccaggaatgatcttcaaagacttagtcagatcagcaacattcttgatagccgatttaagtcttgctttttgttcttcgacagaccgcgggagatcggctagtttcttgtgctccagatctaattcggcattgcattcctgaagttgtgccaggagctcaatcttgcgagcctcgagccgatcaatgttggatttgatcggaccttctgaaagctgatcaagtttggattttttcctcatgcacaagttgccgattagcttggattgtagcttcaatgtctttacgttctcgccgttcggtcagtcttaacttggctttctccaatttgaattgatgttgctcaagataaacggctggagtaaggatatcgactaactcatctgggatcagagcttgaatttcatgtagctgagtcctaattgaggcgcaatcaactaccaagctatctagtgatgatgcctctagccgatgagaaatattttccagagttttcttcacgtcatcggataaaggggctaaggctttgcttatggtgtcttcttctccttcatcaagataatctttgatgtcaaaagaaaaaagatcggctaagacctgcagcgacgatttaaagagagttaggggtcaaataggcatagccgatctgaatgttttttgtcaaaagaaaacctactgggatagtaggaacagttggttgaatttcttcttctatatggtgacttcctacagctgatggagtctggtcacttgttgattgctgtacagaaggagaaggaggaggaggaggcttaaaaagaaacaagtgttaggcaaaatcggctgagagttaattaatggaaaattgaggttatcttactggtggagctggtttagatgttgtcgcagccaatttctttttcacagcagtcttctttttctgcaattattaaatctttaagtaatcggtcataagatacaatgattataaaagggattaaagggagctatttactcttgaaaagtggactggagcagaaggagttggaggggtttgtttgggtgaagccgatggtgttcgttctgtatcgcttacttcggctgcggcctcgtcaatgtcatcttcaataatttcttcatccagagcttgttcaatggatggatctagagcagatagatcatcagctggtgtggtcttctttgtcttagtcttcttctttggagctggggctgaaatatttatagccgatgatctggtctttcttttcttgcgggcatcagctggttctctgataagcccttggagaagagctgaagacttgggggcattatagccgatgacggggggagatggcccacctccgttggggatcagtcctggggcatactcgatatccctgccgctgttgctttggtgatggggagaagattctgttgtctgtaaatcaggaggaaagttagctaagggctaatcaaccaagtagttattcaaataaaatcaagtgagttaggacttacttgagggacaatatctggaaagagatctatcatatacttggaagccgattgatggaataagtgtagcttccattcaccccaccatctgtcaaataatttgctcctaaaggttgccagctttatggtgtcaatgctgcctagaggaggtccttggagattgagcagccgatccatcattaaagatgatgagatttctcctcggcattggatcttatcggcaaagaataagccaattgggagttggcccattccaaattgtctggcagaactcattggatgataaaactcgtaggaaacttggatggttctcccttgatgaatgccgactggaaggatgcatggggtgattgcagataagaagatttctctgggcttctgatatctgtcattgttgatgtcttcgaatttgaagtcccatggattttctagaagtgttgagtctccatagagaaaccaaactcgagcatccttttggaacccctcataaaagctacaaaaccaatctttgagcagctcggccgatagctttgctcctgcatcagttggggtagaggcgtactctccatatgatgtgcatctccgatgagtgagttcctctccgtcatcgttaacagtcggctctaatcttgggaattcagtttctgttacagatggccgatcgacgaacctcatgactaccaagtttagccaggattgcagcagccaccatggtccacccgctccgactactgagccgacaattagcttagccgatgcattatttagcatttggtacaagtagccgaggaggattttgcctaaaggaaattgtctttttgtctccaaggcttcggctacgaactgccaattggttgtaggaccgcagctagacccacaaaagagaaacttttctaaccacattaataggaaagccacatgttctcgaggggtaactggaccctggcctatatatgctgctacatagcctgaccagccgcctatgctcttggtcttgaagtcatattggttctttgtattcaaactcatagggttggccgatgaggtgacatccagacccgtgatcatgctgatatctatgagagttgggatcatcggcccttgattaaacgaaaaggcattgatggtgtttgaccagaagtaagaagcagctgccatcaggggttcatctttggccgagtttgctatagtgaggtcaagtgcttggccgattccaatttcgtcccagtgaacccttttgcttgctgacacacgtttgaaccatgtggtccaacttttctcgggtggaactttctctagagatggccaagatttaaaggtgttattccaatgacctagatctgggttggttagtctgaagggaatcctattggtttcaccaatgataaactcagtgggatcaggattgccgactgggccgagaaagtagtagttttcgtgtgataagcttggaatcgcgattcagttagagagatgctacaaatccaagacaaccgagagaaagagagcgatataagataggagaaaatcgatctgctgctaagaaaggggatctagccagtggagacttacctcagcatactcggccgatggcacatcagatggattggtggaagacgacatcgctgcaggcggaggtctcgctggagatgaagtcacccgggagtcgcttttgcgtcggaggaatcgccggagagagagagaggataaagtttcgcttgagcggtgaaaacagaagtcacggtgtgagatttctcgagggtgacggttagtatttcaagcacggcaataacggtcggaaaacagcaaagtgcgaaacttgctcgaagtcagtacacggcaaatccggaacattaccaaatatcccggacttggggggcatgtgttaacaaccgaatttggtaatatcagcgtcggaggtgaagatgggatcgaagcggagttggagataaggattgttgcgggaacagagtaagaatcggctggagtccagatcagctacgactagaatcggctaaatctgaatcagactgggttacgtgatacaaccaattccggcaatacgacttggtgtacaacatcgggttgagtcgatatgcttcaagatgattgccgcacatggatagagttctgagaaggcaattgtatctattaattaggatgttttacgtaatttccttagagatatgcttagggcaaaagtctgccgcaaagaacgtatatgctataaacgtatatagtttcattattaatatatatttcgatctaagtgatttatactgtctcggcatggcgaccgatctatcccaatcacttgatttaagtatatatcgatataaagattatatattggtaatatatgcagccgatcgagtatatttagtcccttcttatttattaatggttgccgattgatgtatatatgacatcggctcaaagataaatgatatgtcatcggcacctagccgatcggctatcatttatagatttaaccgcgatttctttgcttctacttcttgttggttacaggatcaaatcaactggcacgctagcacacccgaaggcgagctttggacctgcactggagttaagcagatctcccaggcctcgtgttttctgtcaacagacaccctccgaatgcctgcatgtcgtcgtgcgcgccgcattctgtgctgtccacccacgcccaccgcccgtcctcgccatgcacgcagcatgtgcgagagagaggaagaggggaagtggagtatgatgactggattgccacgcgtgcgccacgttggacaaaaccaatcttaatttggtctagggggttaatttgtccggtatggaaagttcaggatagggtttagggggctatcaaattttagttatttctaaattatatttctatacaaactctatactccacttccaatgttctttattttttaattatgaattttcattatttataagttttactcctatatttcttattttaaattcaaaacttcagttatttctaaattatactcctatatgaactctagacacttcttttaatattgcttattttttttaatttgtgaattttcattatttctaattgtatttctatatgcactctaaactcatcattcgatattatttatttttaatttatgaattacagttacttctaaattgtatttttatggactctagactattgttccaataattttcataatttctaattttagttatttgtaaattgtatttctatatttactctaaactcaacttttaattttattgtttttattttgaattttaattaattctagattcctatatggactatatactcttattctaatattcattattttaattcctaatttctattaagtctaaataggctataaacttacctttcaatatttctttttttatactccttccatccacaaaagttacacctattacttttgtcgccaagaccaaggaaaaattgaatcatcttgaatgttacaaaatcaatgagtgaatgcaagcatgcaactaatgagtatttagatgactccttggattgtactccctctggttctatattaattgacgttttggacaaggttgaggttaaacttttataactttgaccatctataactttaaaaatattaagtttaaagaaactagaaaaacatatatagatttgtctttcaaaacactataataaaagtaaacatgcatttatttattttatatattataatagagaaataaggtcaaagatatatcttgtagagcgtatcattatccaaagcgtcaatcaaaataaaaccagagggagtaatcaaacatttaatttatctcctcaatcatcttgaatgttacaaaattaaggagtgaatgcaagcatgcaaccaatgagtatgtagatgactccttggattgtaatcaaacatttaatttatctcctcatttaagtctttttttttataattacacagtacaacgcatacactcacaacgcacgcgcacacagccttatgaaggcacgcacgcaaaccctacccctatgagcatcttcgaagactaagccggcaaatccttgagattgatgaagtcaaacgcacgctcattcacacctatgaacgcacgcacgcaaaccctacccctatgagcatcctcgaagactaggccggcaaatccttaagattgacgaaatcatcacaggcgcctcgctaccacttaaagcacaacactgttaaatcgtagaaaattcgcttccatggagagtcgaacccaggacctcagatgctactgagactcttgtaactactataggctacaggcattttcgctcctcattaagtattgaatgcaaaaagactacaaaacttatttggaaaaactcaaatgtaaaatatgtctaacttttatggatggggggagtaattccgaatttcaattatttttaaattgtatttctatatggactctatattcttcttccaatatttattattttttaatttcaaattttcattatttctaaattgtatttttatatggactctaacctctacttttaatttttcttatttttttaattccaaatttccattagttatattgtatacccgtataaacttcagtcttccttttctatattcattatttttaatttcaaatttcatatatttttgaattgcatttatatatagacttttttttattaatatgagaattttcagaccatagagcgaacgtggaggcttttttctattccttaaataagttaataaattctatagttttatagtcctccaattaccaaagtgggtggtaggatttgtgggaccaatgaatatacaaagcttattgtgcatcaaccactcgatgagatgagagagagaataatatgtttgtaaacatcagcgcccgatattttggcaagagcattattttggatattcctaaaatatctgtaggatttatggaagccagttcatgtgttctgaatggccatatagaaatttgttcttagtattttctacaaaaagtatcgtcgtccgattatattcccttcaagacccttaaagaaaaaaaaaagcatgagaccacacctcgcgaacgtctgttttaaaatcttccagggttccaacgtaaaccaatgcacatgacacattgacaccatattcttgcattttcccaatcccattttggataatccaaatctaatgcacatgacaccatatttcttacattttcctaatctcattttggataatcctgtgtttcagaggattagcatccacaaatttttggttaatcgttgggccatttcgccattggaaaccaaatagctcccaatcttacagcccaatagaccgttacgatcacgtcaggacacaataggcaagaacagtttcaaggacaaaactccacagaatcaagggcaatagaaccctgagaaattgtgacaaaaccgatgtatcgaaacatgtgccaaaatttcaatgctcctcaatagcattgcaatgttctcaacggcaatacagcacctcgatctagagcttactataggtccatataaatgaattacaataaggattgcaaaaagatcttcaacttgaaacttctatttcttcttgtcagtagtaccagcagacctgcacaacaagagaagggatttagtttgcaaattctctttgtcaaaggtaagaattggccagaaaatgaaaaatgaaacaaaacttacatacaactgaggtaccaaaacaacggagaaaatcatttgtactgctttgaattataaagctataataaataacagaacagaagtatagggacacaagttgggcggacaagcgggattattttatttttcccggttatcccacttatagttcactttttcttccaaaatttgtgctaccatgtgggaaatgaactagcaagaaggtatttatgcaaatagtggtattgtccacttgcacccctacatagctacagaaaaaggaccaagttaatttagagacaagtccaatatttgcagaatgcctcttatatacttgggagtacttacacaaataaatctcacaacaatgttaccgataaagtgctactccctccggttccataattcttgacgttttggacagagtgtagtcaaacttttataactttaactatcaactttaaaagtatttagtttaaaagaattagaatagcatatatggattcatctttcaaagttctataataaaagtaaacatgcatttatttattttgtatattataatagaaaaacaaggtcaaagatatattttgaataccgtgtcattgttcaaaaagtcaaaaattatgaaaccagagggagtagaacccattctacaatacgcacggaaaaaaaatagcaactaaaaaacagagaacatcaacaatgaaattgcagaatgcagtagtaaagacacacacctcatcttcctgatgacacccgccatctcctctctcttcttctttgctctcttgggggtaccgagctttctcttagcgaccttcagtgcacgcttgtcctttccaaccttcagaagctcagtgattcgtttctcatatggagcaaatcccacaacctccctaatcaagcccctgacaaaattcactctcttggtacttttctgcaataagacaagaaaacatattaatgaaagaatataaataggaagcagctatggtgtatggccgtattcatcaggaagacagcaaaagaaatctctggtcatagactcgagaagcagctatggtggagattgtagttctcctcagtaaagtgaatttttttttcacgtcataggctcaagagatcacaagatcaactaatggtaattcagaattttctatttgacatgaggtgacaaagcatcacttcatcgttcatttgtcatttcaaaatattgaagctgtggaagttaaaaaatagattttaacagaacatcatttttatttgcttttatagctttgctcagaaaggtaaaccaaagatccacacaactgcacaagcaaaaaacattcaatttttgtttacattgcacagaaaccgaatctacattactggataataaaaaacaaaaaacattaaaatatttagaacaagacaaaacagaggtaaatttagtgagatattttagaaacaaaatcatgaggtgattaagcttccacgttagactcaccaaataaatatatgcctccaggactagcaattttggagttgtgttttctccaaattgccaaaggtgagacgaggcacaaagacatcagtgtgcatacacatctaagccattcaaatgcaattttgatgtacagaaaacgataacccattgctgatacttgccattaacacgccaccatttcaggcaaataaattaataaattaaacacaccattcttagtccattataatcaaattgccaggaaggtgattaagcaagcacaagccaccacgcacttactcatgtccaatggtaatttagacaaccatataattttatgccgacataatatataatttaacaaaaaaacagcagtcgctgctccgatgtctagtacgacgaaacgaaattagctagcaaatacagtaactgtaccatatagatctaatcaaacagatgacatgcccatgttgctacgatacgagatgagcaaggatagagaagggaggaaacaaattacccccttgcggtcggacgggcgaggtggcagctcgcgcttggtgacgacgtggcccttgttgatgccgacgaagagccccgacttgggctgcggcggcgccatggcggatctcctcctcgctcctcggacctgcggcgaaggcgacggaacaaaccaaaatcgatcaacaaacagagaatcgaagcggagaggggcgcgagagatctcgagtaaggaagcgctcgtgtgtgtgagagagaggcggcgctcggaggctgcgtaccttggatcggcgacagctacaaaaccctaagccgccggctgcgtccgaggagaaaccctaagcgatggagaggatgttgttatatacacgtcgggtactagggtcacagcccagatcgattcgtaggaggaattaatgggccggcctagtttgccttcctgggcaatgactatgggcttgcttcacttatccatttcgctttttagctcgcgtttcgttgttatctcgagaggctgtaagccttgaaatgtaaaattcttgtacatgaaatctttcgtctgctcgcttttcacttaatgccatcatgtagcagcaaagaagattagtactccccttgttttttgtcgaaatattctttttcctataaccttcaccaatcgctataggcttttgtaccaaattttgatagcgttggtttagtttgatgtttttccaaaatttagtagcatttttatgagggaatcttcggaactaccaaatgttggtaggatggtgttgttaaggtagtgtttagtttttttcccaattaaaatttggtaacactaaaatttggttatgttgaaagtacggtaaagtggcacatgccctgtatgtcaaagaagagcgtttttttctttttagagatgcaagcccttatacataggtacattcaccctttagcctttgtaaaggcgaatccgaacaccttatcctctatggatacgtttaaaaattggtgtatattttgaggcgaacgaaagtcaccataaacgtcgtcatctatctatctatctatctatctattatctatctatctattatatactaaaagtccataaaacttcctacagacgttctcaagccaccacgtggcgctctaataaaatagagaaaatcctagaaattctaagaaaaaagcaaaacatctatcccttgattttaaattaaattggcggggtccaatattacacaccgttagataaaattgatcttaaaacaaactaaatactatgggtcccacctatcctcctcccgcacattggcaggtggattatatacgtgcgtactgtacatacgattcctccccttttttttcctttttttcttcttttttcaatttatatatataatggatatattttttaaataataataattttacaaacaaagaatctaccatcatataatttaaaccggtgtactctttactttgtactattattttcaaataatgcactattttaaaataaattttacacaattatatcgtgtacctatcaaataaacaatatctatattaacaaatttatacgtgcacttaaactgatggccctattatataaattatcggatctactttttacattggtctattattctcaggtaatgcactgtttcaaaataaggtctactattattaactaattaactaatttaaattctatattaactaatttacacttacactagaactggtggacatattattataatcattggatctattgtttgctaataaataaagcgtccgaaattctctttttgcatgctgcacagcgcacgtctgcaccttggcctttcgcacgtgtgacaaagcgtagtgtctgagacatctaaggtgatcacaaccgctctagcactaccgctttgccacatatcaaatcataaatcatatatgaagatgattaattttgttaataacatgaaaagaaaattaaaggtgatgcaacgagagaataattaagcaccatgggttgtgtttttctcaacactaattagctctgtttaagttgaaaccgagagttgattacataataattataatgtatttgtgttatgtcgtatttggattttgtactatttatctgtacaggtgaaatgaatcattatgttataaatgcgagtacaatattgacgaatatcaatagaactcttagtacgacaagggtgataataggagcttaaggccctctctttttttcccgattccatattttggatttttttttgcacgctttccaagtttctaaatggtgtcttctttaaacaacattctaactttttagaagtcaattcattcgtttataccctcaaatagctatcacataaattatataattcatcaatttcagctatcctaaaccttaagtactacatatttttttcatgcgagtcatggtgatcagtaaattggtgatcaacgaatcatcgaagttgtaagatgaatatgtaagagttactctgaacaattgtaaataggtgttaaaattaattgctattaatcagacatttaatggcttgctagccacaaaattaatttctctctacatatatataaacatagacgaagttggaataaatattaccatacgtcccatacatatatattgcgcagttaatattctaattagtcatttaaaattccttaaaatgctctcaagctgccacgttgtgctctaataaattagggcaaatattagaaattctaagaaaaaaataaagtatccgttacttgattttcacttaaatcggtaggtccaatattataaaccgttagattaaattgatcttagaacaaactaaatactacgaggtcccacctcagcataggtatgcacctacgtgcatgggtacgtacgcctcccctcccttttttatttttctctttcttctttttttcccatgcatatgcttccctccttttattaccatatcatgcgtctttatgagacgatttaatcaaaagaattttgagtatcatgcactcatatttttcatttgtggccatactacacgtatgtatatatagatggactgtatgataattaactagcaatatttttttatttactcgagaaaaaaaacatgattcaaaagttataagtacttaatccatctcctattcaaaagtttatgaatggttttctaaaataccttaagaaaaatagaacccttaatttattataaaataacatcatccaaactttagtttgccctaaatttatgaggcaaaatttctgaacaaacaataatcttacctttcaaaaatatgcccgcgcatacgcgcgggccaccatcctagttcactaaaaaagtaattagctgtaaacataaacacccgtcccaaattagagactaaccagccgagtaaatcgctttccatcaaccggtttcggattgacagcgtcgtataggttacacaatgctgaaaggattcctttcaatggcgcacacgattcaatgccacttaaatcaccgcgtgtggtaagaagaggggaaaaaacgcaaattgatcggttaaccttcgcaagctgttttcgtctcctcgttgggatgacgcgttgctcttccatccatgtacgctcgaatcaacaaaaactgataaagaacttgtctatttttttatcggcaaatgttttactcggcaaagacaaacgtagcagagatcaatgtgaagaatcatgaaagattcgacaatgacccgggttctctggaaaatgagaagaatcgaaatgcaacgcgaaaccgatcaaactcgagcatctctagccatggttccccatgagaatatgagatcataagctacaacgagctgctgcttgctctcctctccatctcgaggaattgcccgagcgacggcgcggcgcggccgttctccaggtggctccggaggcagagcgacagcagcagcgccctgaccttgccgctcttgctcgtcgccctcgcgctccggcgccgccggctacggctctccatggcgtccaccaggccgatcaggctcgccagcgtcatcccgccgccggcgccgccgcctccacggcgggacaatgaccatgccgactgcgacaaaaaacatacttatatataaacgtacgttacgatcagatccagatgtaatctgcctgcactactgttccattgccgcattgcgaatttgcgatacagattatgttcgaactgacctctgtgtcgaaatcacaagaagtgaaggaagacgaagcgcagtgagacgaagtgaaggccgtgctgaaggaggccgagccagaaagatccacgcttctcgtcactccagctcttgcattcatggcgcccagtccaagaggccacccatcctgcaccatctccccaaacaaaccacaagcttgccatgatcaattggtgcgctaaaacagactgagaaaaagcatgtgagattagagctacaattaggcgaaattaagattggcgcacctcatgggccatgatctctcagagccgagcttgccgatcccacgggggacaagagcactaccagagtctagaaagcaggggtaactgactgatgaggagtggacaggcgtgaaggcttatatggtggagtcgaaagcgggcaacacgtgaaaaagccaagcatttgtcagtaaaattatctgacaaacctgcttgttttgcctcgagggttggaaagttgcaggcggataaacaaagtgcctaattgccaacactactacatggattagattcagccttggttagcatcaccatcacgagctcatgagatgtcgtcagtgctgctgctgctgcgtgagctcttgtgcgcgcattttacaagcccattgtggccaaagcacagatcgggaggaggctgcttacagtaagataatggaggaaaagccttgaaagacggtgcgaatcgttggcggtgtatgcggacaaatgtgcgcccgagaccgcggaaagctcgctagctccgccgctgcacgcctgcagcgcatcccgcgcatcctccgttctccctcggtccctcgagtttttcagttaccgggggacttcagtagagttaattgggatcactttccgggctgactgcattgttggttgggcttccggcgaaattctctactccgtcacgggcctaatgtctggcccagatcgttttcgacggggaaaaagtacaccgaaggtccctcaacttgtcatcgggatacaaaatcgtcccccaactgtaaaaccagatatccgacatcccttaactatacaaaaccagtcacaatatgtctctcggcggtttttatcccggttttatcctacgtgactgctgtctcagcgtgggacccacgtgggccccacatgtcagcctcttaatatttctctctcttgccctttccactctcctttccacgggcgaccggcgtgcgcgcttgcgcgggacggagaggctgggcacggcgcggccggcggcggcggcaggggaggagctgggcgcgagggcggtcgctggggagccgcgctatcctcgcctcctgcgcgcacacgccgcacacacgcgctccgcggcgtgcgcctcgccgcgcccccgccgcctaccgcgcgtttggcgcgctcgcggctgccactggcgagcaaggcgaagtggccaggctcggctactgactacagatttccaaggagagagtacactctcatgctagctttgcttaaattaggccttgccatggtggtgatgtggttaattagctggctgagcaagctaacctcttcgagcatggggtaaatgtaaatcttgcccttgagccgctgcagctcgcccccgtccatggactggatctgcgtcggcgcggtccacgacgacgagcctccgccaccgacggcgtcttcttgcgcctgcttgggtgccttgcttgccgacgatgggctggtggtgctcttcatggggaggctgcagaactcctgcaagagctgctgcgtcgggaggaggaacctttagccgcggagatgccacgcgccttgctgcagctgccatgtcgacgccgcgcccgccgccggcgacggctggtggtggtggttgtgctgctacatcagcagcgacatcgccgcctccggcctgtgaagcgagagggacagcggcgcttggctctgcggtgttggtggtggtaagctcgccgagcccgccgaagtggaccgtcggcagtcgcgcctccatcatcgacgccgccgccgccgagcgcgcccacacccttactttgctcgtgcgcgtgcgccaccgtcgctggcatgagccccctcacccatctttggccgccgcagagcttcaccgggctaccgccgtgcttccccactgcggccgctgccgtcggccgccatcgcggcgccgccctcctcctctcccgcctcgccccggcggcctcctccccaatccccagccgccggccggcttgcgatttgcgaagagaaaggaagagaagagaagagaagaggaggaggaagggagagagatgacgtggcatcctggtggggcccacgtgggtcccacgctgagtcagcagccacataggacaaaatcgggatcaaaatcaccgaggcactattgtgaccggttttgtatagttaagagatcatcggtatctggttttgcggttggggacgattttatatcccgatgacaagttaagggaccttcggtgtactttttccttttcgacggtgagcatatggcccgtgaaaattctggcaggctaccatgagggagttgccgcgtgccgatggacatatcggtacggtcgtaattcgtaaagacgttaagtaaacgacattgataaggtcgttaccgttttcaccccggtgtcagtgtcatgctcacgctgtcgatggtgaggctctctcgacctgactgtcgtgcatcctgttggggcggctgctccatcacttgtcgacgctgagcacgcagtttgcaagtagcgatacgtgactcgtcacgacgaaagtgaaggctgcgattaagaggatgaggaaaaaaaatagagaagatactgtcgacgagtgatactcatgtatcggaagaatagagtattgggttacgtcggaatagggatctacgtagtacgacattaaaacagacaaaagacaaggattgtactgtttcaggccctttatcaggtaatagccctagtccagtttatatgggattgctgatgatgagaacagattacaaagcgcaaaatctaaatcgagagcgctcttgatttagtcataacgagcgacgctagccattgtccagatacgattagccattgtccagatatgtgtcttgaagaatcttactttactatagtactaattgatcaagcaagtagaaaaaatattcctaccatttatgcttcaaatataattttctcttaaactattcatccgatctacgatccgattacactgttgtgttcataacaattaaatctttacaacaagatctcacatgattatattttgataaaaaatcataaattacttttataatatatctaaattacttttagatttcactaagttaaatatataaaagtaaattcaataaagttttaaagtaattaacatatattatagaagttactttctttttttataagttacttctatagtatatgtaaattacttttaggctttattgaattacttttatatgtctaagaagtaacttagtgaaatctaaaagtaatttagatatattataaaagtaatttatattttttttcatcaaaatataatcgtgtgagttcttgttataaagatttaattgttacgaacacaacggtgtaatcggattgtagatcggatgagcagttttagagaaaattgtatttgaaatataggtggatagtgtctatcatatatgagacaaaccagctaccattagctgtgtagttacgtccattacagagagagtaaccgaacaggtgataccgacaagatcgtagtcgagggatttgacgagatctcccggcgagttggctccgtgtactccggcttcgtaaactttggtgggtgtgttggcgatgagatgcgatgcccttagcctctccctaggggtcccttttatatcgtgggataccttgactctcaagtaagacttggagattatgtaaaccgacatgatatactagagattttacccttttcgagtagtacttcggtaatcccttaactcgtagagatatctcccataatttgaggtgaatttctaacggcgtatacggaaaccaaccgtatacgtatacgtgagagtataccttattgatatattccataagtcataggacagaggttatccttatccgtaaccctgacagatacacgcgatgaactgaaccattaacccgtaatcaattgggtaatattttttaaaacttgtaacgaatttaaagtaacttttctataaaattattttcaaaaatacattgtttaacaactcagaaaaagcatatatgacgagaatttattctctctctggtccgaacgaacgtagcttacgactggacaaggtggcacgtagaaaagcccgtggaccgtgacacattttaacacagacatcgtctcaatgaaaaagttaaaaaatgtagatgaaatcctttcttttctggttctcctacttcttccacgctttcaccggtgacgcccgtcgactcaccttgggacgctaggaacaatcttgcactgtactccctccgttccaaaaaaaaaagataaatcctgggttagtgtccaatatttaactgtccgtcttatttaaaaaaaatatgaaaaaaattaaaaagacaagtcatgtataaagtattaatcatgttttaatcatctagcaacaataaaaatactaattataaaaaaatttcgtaaaagacggatagttaaacgttgcacacaaatttagggttagtctttttttttttaagtaagtctaacaaaagcgggtcaaatcccttccaacctccacctgccaaacgtcgtaggagtatggctccagaacacttccgtagaaaaaccgagaaaagaaatcaaagtcatcgttctcgaaagcgactactactgccactaccactaccactaccactaccaccaccacaccgcttgtccctgacgtcgctgggcgatcgatcgtgcgatatggagtgtactcctatacgcttcggggcacaggcgcacagcgcgaatgtgcgtcgcacagagaattccagcacggccaccacctgccccccatctgggccgtcctcgccacggcgcgcacgccacgcgtacgtaggccggaccacgtgacctcagccgcgacgcaccacggcggccacccctctagctagtactagcgcctgcgctgccctggctgcgccacgggatgcgggtttcaaaattcaaaactcgcccacccgtctaatagtaccaaacaccagttgacaatcttgtcgcctcgctgcactaggccactagcacagcgtagcgtcgtcccgtccacttttgaacgcttcaaaggggtgatgacaaagagatcgaccggggcgcgcacttctttcccctccaaataagctcgtccagtccaagcacacaagccattccaccgctcgccgtcgctgtctcccatcccatcccatgcatcactagcggatttgtggagtggttgcgccccctgcgagcgagctctgttcgtaccgcgcgctccggtgcggagtggttgctggccggcgaggcgggcggacggacgcgtcgatgcgcgtggcagtagctgcgtgcgggtgacgaagcaggggcacttgctatatccgtcgcctcttggcggatgtgcgggattctgcgcgcagtacgcggcggccatggacgcgtcctcgcccttcagcttccacgagctcaggcggcaggcctcgtcctacctcaccgacaagatccgctccgcgcggctcgcgctcaccgatgttaccccgacgcagctgtgagtggctccttcctcgatcgatccttcccccgtcttgttgttcggatagatgtcaccgatccgttgttccatcgtgttcttgatgctgaggtttttgttggtatggtccaggatgacggaggaggcgacgagcggggacgcatcgccgccgaacgtgaagacgatgagcctcatcgcgcggcaggcgttcgagatcgacgagtacgtcaggatctccgacatcctccacaagaggtgagcgatggacgtgcctagcttgcctctcttaacgaagccacccacacgcacgctgcgtttgtgatctgctcgtttgttggctgatcgattgattcgggggcgggaaatcttacaggttcgcgaggttcgacaggcggcagtggcgtgaggcgtacaaggccctcctcctcctcgagcacctcctgacgcacggcccccgtagcgtcgcgttggagttccagagggatcgggaggtcatcgagcagatggtctccttccagcacatcgacgagaaagggtccgtttcaattcttcgtcccgactcgatcatatcttctcctgatgttctctcgcccttctttctcatcaccgatggtttcttcttgaatccgagttgcagtttcaactgggggatgacggtgaagagcaagtcggagcgcgtgctgaggctgctggagcggggccccttcctggaggatgagcgtgagcgtgcgcgcaagatagcgcacgagatcaagggattcggcagcttcaacctcagcagcgcgcatgcgtcggggtcggcggcggcagccctccgcgcgggggcgatggagcaccagtgctacggccggagcaactcgcggtacgagggcaggtggaggagggaggcctgcgtggacgacggcgacaaggagaacctgctggtggtgtcgatggccgaggcgaaggccgaggcggcggcggaggagccgcaccactaccaccacccgttctacggcttcgggcagcagcggccggaggcgatgctgctcctgagccagtagtgatcgtttgggtggatggttcttcgtcgatcgcatcgttcgttggtttgtgatgcgtgagaaaaaatcctgtaaagtcagtggcttgctggcatcctctttgtgatgacccttttgtaatcgtcgtccttaatttcagttctgatttctgaaactctaaaaatgcctgattccctgagctcataaacacacgaagaaaggaaattttgagaagttggaagcttcaagctggcaattgcaggcaaatacacctgacatgaatccggacaggtacaaggatcgtgaaaagacatgcgaatggatgaaccgatgcagtgaaattctctctgctatactccagagtccagaatgtgatatgctgaactgatcagaatcagacctaggcctggtttaggtcgtgtttgggaaaagtttgggaagaagttgatagtttggaaaaaaaaagttaggagttatatgtgcgtaggaaagttttggatgtgatgtgatgtaatggaaagttgggatttggagggaagtttggtgtccttaggctgtgtttagatcctaactttggattcaaacttccaactttttatatcacatcaacctgtcatacacacacaaattttcagtcacatcgtaccaatttcaacccaaacttctaactttggaaggaactaaacacagcctaagttcccaactttttcttcaaacttctaactttttcatcacatcaaaacttttctactcacacaaacttccaacttttccgtcacatcgtttcatttttaaccaaactttcaatttgtaaaatcaatgtgtgttttgattcttattctgtgataaacaattggcatatgtgattattggttttgatatttggagattatcgtcgaagtggttttggagataatcaattttcaggtgatgatcggattcactgttatttcatgtgaccggtccgaccgggcggtgtatgccggtcagaccggtggtgatcgagcggttagaccggccggcccgcggtctgaccggccgacgctgtgtcggtttcggtttcgagttgtttctttggatatccgtgattgtttcatagttatggcttctagatggatattatacgtatgtaatactgttgtttgctactaatgagtcaagttggggatagcttggtctcgaaatatggtttctttgtttgtttcatgtgtaggtgactcgatgcctcgagagagtatttgcggtgatggaccgggagtcggcttggtggtaagacgatgtccgtggtggtcagatatcatgcgggatactaaggctagagttgatgcacatgattggtgaagattccatatggcatacaatggaggtattatgtgcgtatgggatgcggagtcgaatttggaaggagtccaaatttggtacgattggttatgtaaagtttctttcttatactagagggtttcctaaggtgtttaggactcttagtatgagtttggttcgtggctttaggctgcctacctcatgtataaatagagggggagcgtgaggcttcccggtatcgcttttgagagcaattgagttgctagtttagttagggtttcgagtttagtcgaaatttttttaaggagtgctgttggtatactttgtaaacacagagagaagcaataaagttgtgcttcgatttgtgtttcaccgggttttggcagtctaaccggcgactcaccggcggcaaggcggcggtcagaccggctagggcgaggcggtcagaccggcggcgacttcacacgcggcaggcaatcttcaggcggttgaaccgagtgatcaacatcggtcagaccgacagcgcgagcgcggtcagaccggcggatcaacttcggttagaccgatctacatcgaatttaagggtaacttttatttccgctaaaagtttgggtttttgggtataccaaccattcaccccctctggttggcttagttactttgtttcgatcctacacaattttagcgtgagttaaactcacccctaagcttgctgattaatctgtgacatacgagtatcagaaaactctggttcgtgccggacagttcggcgttcgtgttccattgcattttctttggcccaagtcccactcttaattttattctaacctagtaacatcatgcaaatacttaaactcttcactaaacacatatctacagcttaccttttctctgtcacttttacatgtaaactgttcgtcattaccacttgactagttgactttaccataccatcaaatattccaacaattatcagtgtattcaacgctacatactagcactctatctggaaaaaaaaacactacagagcactctagttattacttcctatgtcccataaaaaaacgaatctagtattacatgtgacatattctagtacgatgaatctggacagatgtatatccagattcatagtactaaaatatatcacatctgatactaggttggttttttatgagacggagggagtactccagctacttgcaaatagaaaggagggcacaaaagctcgcggcagaaggcagctgcggtctataggtaacgcgtagcaagatgacatgaatagattcctccagtgcgtgcatcattcccaactactgtacatccctttttgactctgctatcatgcactgtttaatctgttatcatatcttatcctaccccacaggggcccttcgaccggcaggataggaaaaatataataatagtaaaaacgtaggaattgaagtaatatgattcttcaatcccgttggaataaaaaacacaggaaaagatgaaatgtgccctttgatagtgctataggaaaaaacacatgatttctcttccaaagaggtcagacctttttcttttttttcctgtgaaaatgaactaaaggtatgtaatccttgaatgtttcctttcatttcctatgaatcagaggcatccataggaaataatccataggattgtgaatcctacaaaaatcaaaatcctatactgatcctttgattaccgatcctttgaatcaaagagccctaattactggaaaatggcgtagagagtgtatgcctgaattatgcgatgttctgtacaagatcctaccatgggagtactagatttccctcacaagtacagaattcaaacctaaggttcaataacagacttttcatgtcatggtcaccaaaactctacagcgccacaatagcacgcgatggaacgtactggagcttagcattttacctccgacatcacaatagtgctgtgaaaaccggctatgtaaaacaccgaccctattggttaatatcgtcaatcctcacaagtgttcaatatccacacaattgtttaaaagaaatgaaatgaacgtgccacaaggattcattggtaactcacctattgaaggaaccaggcaaacttctacttccttccgaaacagctactccagtaaatggattttcctcggctggtcccatttatatcattaacaagggctaagaaagaaataggaaaaaataaatcaagcagaaatatcagttctttgaaccctcccacaaaaaataacccctaatataaagatcaccggaagcaggtcacctcatgtacagatcttgctgcagcatggcaaggccattctacttgtacattttcactttgtaaccatcatacaaaaatagacagtacaataatatgcctgcaaccatgtgaccacgaactaaattccactgttgtatcaatgaagagcctctgacatcaaacatgtcctaccaatttggatcatctgaagttgctccatgcttttgctttacctaagaattttaacatgtggcatgtctaagacatctactttcacatcttttcaagtcaatcaaattcacagtacaacaaatctcacaaaaactgtaactgctaatccaacaagaaaacagaagcaactttcagttttctctatgaacatagagttctagactactgaatcagcacattcttgacctaagaagattggaattaatggctagatagcatgttacactacagtcacctgatcttcatttcgacatttagggcatgtaaaaagagagggggaggaggctactatatccactaagaacacttatgtcagctacccttgtattattgatcaaaatttgcagattgaaagaacctcataataactatgcatatcttcttcctttttttttctttttgttgataaaagtacaggtaatcaggaattttagatgcacaatcctttgatggagtatgtataagaagttcagaactccattaagctcatttgcaggaataggttacaagaacttacagaaaagaacattgcatattcctactctaggatttaagttacagagataggttaaatgatcttacagaaaagatgaagcttcagacaaggagcatgagaacaaaaatcaaaaggtaaaaaatattaaaatagatgggcaccttccatttattcattattgctgaaattcagtctcaagactgtacccatccccccccccccaaaaaaaaaaaaactgtagcacaataggtgacaagtgcatgctgcagcgcacaacaaagaacaagatattggtgttacactgttttctacagcatatgccggtatttttctgacaagacttcagaatgtgaaattgaaaacatagatacaaatgcctcttgatttcactgtaggctatagatggacaagtccgcaacaataaactaaaccagtaatttgccactaatccaacatacctatatgcattattgctaaatcttatcttgcccaagaacctaggtgttccaaacgactcattactttgatctttcataaatatcacctcatttgttttcatgacatgaagacactcgagacatatgataaatattgaactttttttagtataaatattctccgcaatctgaacagtatatttcagataggcagggttttctattctgcattcatttcttcactcttcagtggtacagaggatacacttttactgaagtagttacaagtttaatgaatagttacaagtctatgacaaacacatcgcatccagtattaatgctgaatttccaagacgctagtttacaaagaaagcagaaaatgtgcacgtcattatttagaaagtttgacatttcaaccatggctcatctcatggatattattcagaaaagaacttgatgggtcccatggctcatgtaaagtacgcatgagctggcacatgaccaaacgggtccagaaactaatcgaataaagatgggcaacctcaataggtccactttcatggactctagtgaaactacatacaaaagtttcatgcacagtggtccctccccaaaaacccaccagccattatgaacatgaaacaccacagaatgttaggaatagccgcacatataaacggtagctaccagaggcatatacaagttacaacaactcatgtttttggtcgacatgtttggataactgacagactatttggatatgtttagacgttagactagcaatgcatgacaatagcacctagaatttcaaactctttattgggatggtttaaattccctcaaatctctaccaaacacaacaatatacaactacctaacttgcatgaaatgagcaatacctgataggtagtcacaagaatcagaacacctacctatcagtaaattcgcaacctggtatacaatgctgctaaacttcttctcttcagatcttagggctgctaaagttcatataggaagcttttggagctggggcataagctatttaatttaactgcaaaccaacttatcagatttcagttcacacgctacgaaactagccaaatgatcagcaaggagtacgtggtaggccaccctatatggttagataaaaaaagggataattgagcatatgccaccctaaatggttggtttatgtcctcaacagaaatttaacggtggaaaatcctgaccaatcagctaaagggtggacatgtgttcaatttgtcttcagggaatagtaacagcaagcgcaactagagtccgcgtcattagcaggaaagaggagtgagaatcaaaaacaggggtagacaaccaggccacctccaagctggccagctcattcctcacgcttaccacctatctatcaatctccagaaccctgactccaagacttcaggtccttgataaacaaaataccaggcaaatgcatgtcttcaaattcttctgcaccttaccttaatacaaaagacacacaaatcgattccccagtaatcctcagttcctcacaccaattccccagtaatgctagccccaattggacttcagttcaaacacaaactgacctgattagaacaactatgaacatgctgctgttcgttttggaacaagtaggtttcataggtctctctacacatgatattatttcgttaaaactaataaagaaactagacaaattgctactgcttttgcccctataaaattctctacccatcacattcccgtagtacacattctaaaatggggaaaatagtaacagaagaacaaaaattgagcaaaatgaagcgagcaatgggtaacatccggatctcataccagaggtagtagtaagagatgcagatttaggagcaccaaccgtatacaccaccaattgacagcccttgccgttgacaatgctgatgacgactcactatcagcgccaccccgcagtgctggaggtgacgacagtctcgtcggcggcgtccgcacgttctcggcagcatctggcgccatcgcgtccggcggcggcgccatgacgtcgctatcagcaccgccccgaccgaacatttccttgggcagtagaaccttcgagacggcaaacaccgcaacgggattttggtcgaacaccgtgcgggtgatcgaagcctgcacgatgccggtgtcgatggcgacggagccattgacgcgtgtgatgtttagcgtgaactggccggcctcgaagcgctcggtggcgagcgtgggctgcacggggttcacgatggactcgagggagccgagcggatagtacgagtgcagcacgtggaagcgaagcacggtggccttgcgatctgcggggagggactggaggcggtcggtggcggggaggtcggcgaaggcgtcgtcggtgggcacgaagacggtgatgccggcgccgcgctcgtctgccgtgaacttgtccgcgacgcccgatgcctccagcatggaggcagcaacgttgaacccccgcgcgtccgcgaggacgtgggtgatgttgacgccaccggccgggcggctgtcggaggccgcgacgtcgagcccggaggggacgatgaggccacccaccgcgagcacgctgaggttgtaaggcacagcggtgacggcgccgaggacagtggcgctcgaccccgggaaaggcgccggcgaccggaccacgacggtggagtttcccccgacggtgaggttgacggcgccgagatcggagggcgcgcgcccggtggtctggaacagcgtcgtcacgagcttcccgaaggcggggaggcgcgcgaggtcagaaggggagaggtactcaagcaggacgtggtaccgcagcacatcggcgatgtcggcgccggaggccgccgcgaacgccgagggcgagcgcggcaggttgttgttcggcacggccagcagcgtcagcgacgaccgcgccgccagctccccggccaccgggctcgactccagaagccgcgcgaagtcggcgaagctggggaaagccgcgagcgcggccgtcacgttcaccccggccgcccgggacggcagcacggcgagaactagaagcagcaccaccccgagcgcgaggccgcctggcaccggaagggctcccgctccgccccgcatctcgccagcggggggagcaactggggtggtgggtgggggactgaggagtaagcgaggagaagaggtgcccgaggaggaaggagacggggaagaaaaatattttgcgcgtgattttggttttagattacggggatttttttgctgtcgaaatgcgatagtttacgcctttctttaaacggtggacttgttttgggtgtggaattaaatggtggcgtcgcagcgttgatgggacgatgtggactcctgctagtctactacgccagccagctctttcccactctccgctaccaggcgcttttgccaactttgtaccatgatgcacgtcgcatcacgtgtgccttggtcctattcgacagaatggtgcggattgaggcgtcattctaccaaccaaacaattaaatacggactttgctcttaaaatacttcgaatcaaaggattaactatatgaactagtccattactgtaaatttcaaaaaaaaaaaactagtccattactgtaccctcaattcaggatcaaaaatatttcgaaactaatggtcttaagattcgacattgttttggtcctgggcggtgtttactctgttgtgtgaaaatggggcacgtgaagggcgtagtgaannnnnnnnnnnnnnnnnnnnnnnnnnnnnnnnntagtgtgtgtattacactcaacctgaccagaacagcaagatatggccgaactttcctcaggtgaggtatcgtcttccggaccactacgatagcacggtatgttgtgacgcctgtttgagaagccttgattcattcagtaccaaaaggcacctggccaaaaatgggtaactgaaacaatgaacgggcaaaaaggcgaatctaaatccgtcagagagatttcacgagatgctcgactcaccagcttcctttcacaagttattgtcgtttaacggggatgatgcgagcggcgtacataagctacaaatggggcatgtgacccgcctcgagcccccattgacgacctgcaactgacgccggtgaatgcttgtactcgataagctgaaagcaagacggccgtggaaaacgtaccggttttcctttaccatcacattcttcatcggactgataatctctcatactggacactttggttttgaaagattgccaactgcaatttcagaaatatcctgcttctcagatggcaacatgaagaaccagaactgggaatagaatttccaacttttagctgtttgcctgtttctgactcaaactgaaattggcaaattgtacaaatgaaagaagaaggaaaacctccctcccttgatacaataatcaaaagaatagttagacaaagagctagctttcagatgaaaggatcaataaattatatcagaataagcattgttcctcttctcaaaatttgtatgacaaatttcttcctagctgagaaatgtacaagggaactactattacatcaagcggactggcactacattgtcagggtattagacctagaaacggttagacacatctattgagactcagatcggtgtattgttagccccaggattagcttagctaatatgaatctaatatatccgcaaaatccacctggggagtgtaatagatgagcaatgctgcagtagggtgcttggagaccggacagacatcacaccaccagacggcaagcaaagaatgagcacatgctatggtaccaaaaagaatcaaggtcagtcaatcaagtcaagactagtagatgctatctagcctggatggatttagagtgttctgatttgtttgagcggcacatgcagtcggggcatggaaaggtgtatatagattcatttgctcttttcatttcaatacccttggcatcgctgtgtgttctcatattcaccaactgacgtttcagtgacttccatctgcacaaatgcaactaaaattttaacaaaacgaaaatttgctagttttaacaacgaataatgcaagaacgtccaagatttccagagccagaaggtaatttaatactgagttcatgagccacagtaatagcatacccgatacgtggactatcgaagagtatggctaatcttcttttatcaggcttaattgtcttcgaatgaccaccataaatgtatctcctatgaccaagaaggaaatgaggaaaatttccaccttgggtagtcacgaaaacttcactatgaacacatactgtgtaatcgatagctgccatccttgaagagaaattctggcagatattgcattatgtcagatcatacttgaaaagcaaagaaacttttgcagacaccatttgtatataccttgaatggagcaagttcttcatctgatgccaatgtttcttttgtctgcaagagaggaaacatttcaaggagaggtgccatgttcttctctgatttatatatcctcccagaagccaaatagatcgcggtgttattgctgaaacccatcccgcgaagcattaacccaacctaagcacagaacataaatatgtaaacctatggtgcaacaatcttaagcaatggctattaattaaatcagtgtaaacttgatggaaatatttagacactagaatacacctccaaaggtgtaagtggacatttcccattcatccttattgctccaggccttattacacgtcctggcctagtaaactttcctctccaacccctctccctggctgcatccagttccttcttctccttttcacccccgtcgaagacacaacaagagaatgcaaccatatcctgcaaaagaaaaatcaattggttgacaattctcttgtctgagaaacaggggattcggaccccattattattttggacagaatcagcacccaaaggtatcatgaatagtccagaacgatttgttaacagaagaaagactaacctcttcaaaacggagatgcaccgctacatatttcccattgttttcggcacttttttctctcattcgagatactaaaatgtcagataaagttgtgatcggcttagaaaactttaaggcttcaaaattagccagacatctcaaccgttgaacagctgatggagcatcaaaggacagtcggtttgcaaaaggtgatatccttataagcctataatgtacagataaaagcaataaaatatcatatatcacagtcggtttgtgaaatttactctatcatatatcacaagtcaacattcttacattcttcagaactacaataacaaaattggctttaacctacctttcttcgatcaacttaggaagaacagcttctttgtagtatcggatagaagaccaagcctttatcttgaaattaaacacattactcaaattgtgaccaaacctctccataataaactcaggcaccttgtcaactactcggacatcatttttcaatcgttggacgaagtgttcctcatcataaatatcactaaatttgctgtatcaagaaaaagaaatgttaataacttgatttttttatgttgtaataaatcctcaaagaagcctctctcatccaaacacaaacatagaaccttgtcagtatggcagttaacatagtacagtgttgcagcatgcaaaaaaaggaacattttcatacttcactactaccatttggtatcttttttatgtgacacctttgaacaaaatcatttctcattaactcatacacatatttcataaaaaatggcataagtagagttaatgcaaacaaacttctggttgtttcaaaagaaattcaacttcgtcagagagagagggggagagagagagagagagacctaggatccctccaaatgctgtgatagtggaagtttgggatcacaagagttgcatttagaaaaccagcaaccgcaacagcattgcatatctgcaaaaaaaaaagggggggggggcgggaacaaaaaaaattgtagaaactcatgatgtgtttgtggacagaaatgataaaaatacaaaaacaaaaagggttcattgaaggtaggtaacaaccgatgccctttgctgattcaaaccaccattcgcctccacgtatatgtagccatttaattcaggcaaatctaacataaatatttaactttattagataattccatcaagacataggcgcatcatgcaaaatggtattgctgttttactaagtaactgaaaaaggagtatgcatatagcataaacaagtatggcaaatgcacataagtaaacgacttccagtaaaaaaaacaaagtgccctaggcctaggatgtacagtcaaactattattttactttgaccaataatagcttcatggtagttatattggcacaaaggtgccttatgccatgtcccacaaatatatcggtagatttatcttaaaacatacttccaataatattacaaatttcccggcctttacaaatacatcacaacaaaagtgcaatgtagaaagtgcaccacatatcactcatatgcaaatgacaagtggaatcatttgcatgtaaatgtgatttatctttcctttagatttttgtgcaaaaaggatgtaccaggaagcagcaagccaatggaaggaattaaatgtctgtttgttcagagatacacaattaaccatcagagatgtcatatttggaaactgtgaagaaataataagcattgttcataaaaatcctttatgggcatgtccacatgtgcctgattctaccaataaatgtaaccctgaccaacatgcatatgtagtggtatagtttcacctaaatcacttgtaaagttttgatattttctttcacaaaatggaacttcaaatattacacgtggacaaaggaagaaactaggctgcattggaattcatccaagtcatatcatattaataggaacagttctggcctttgaaatgaatatataaacaaatataagaactgtttgaaactcattagtaaaaaaggaaaggtaggaatggcataccatatgtaatattgtttatgcaaggtcgccaaatgccacccttgtaagcatgtctccatacagttgctagctacaaaaatgtagtaatatgagattataaacatacatcgaaaacatgcataagtgaacttagaaggacaagataaagggtgatagcatgagggaaataataaaccctcaaaccacagaacaatatggatctgtaacatataacatgaaatggtactaggcaacactaaaaattatgtcatataactacattaaagctaatggacacaatagaaggaaaatggtattgataaatcaatcctccattatgttatgagcacacaaagatctatatatgaaaatagcacatattccatctttgataaattcagtgcaaaagaatgccccacagtgctatagcaagcaggtggcaacagttgtacagtacatcttattgtttgctaccaagcaaggtcattttcactgatcaaaaggacaatgcgagctatcacaccaggaaacaggcccataaaacttgaaaggccatcggatacacagaagtttcattaatttgaattaaaaaaaattacctgtaatcatctaaaatgaaattcttttttgcagtcatcatccatatcgagtgcaataattcattaaggaagaaccaactaaggcatttacttaatgtgccacaattcataatcattgtggacaaaaagatacaaatgaggtgtatttcttaaactcccagcaggcagtcacaataaacacaaacatgatagctttttgacccaatgtacaaacccaacaggcttattggcttattgcttgcagcagttgaactgataaattctcacattccaacactctagttctgaccaagcaaccccattgtctgctaatgcccaactggctaatattataggacacccacaaatccacaaatatgaagtaggtttcaaccggtgaaacaccactagtctgccctctaatccaccccgcacatgcagcaagtacaccaaaaacattaactgatacatcacacgcatttctataattttattgcaattccccaacaactgtaagaatacctaacccaaatccaacccagtcagaataaactaaataatctaatcgtttattggccgctagccacagacacagttcactgttgctacagatgcgctaaacttagtacacaatcacccagtaatccaagtaccaccgccagacctaagacatctcaagcaccaagtaaactcgctcagcggtcatcacaaaaaacgaccaaatattttcatcgcaaatataaatttctagtgcaacagacccaggctgcggatgagcaggtgggagacactcaccgcgtcagtggcgttgtcggcgtccatgtcggcgcgcaggcgggcgtagagctgcgggctgcggtacagcgaaccaggcgccgggcgcgagatgatgcggggcacgctgtcgagagagatggagcccatgtagagcagcatcgccgcgacgtacagcagcggagcgaagaggaagaccgcctgccgccgcagcagcgcggcgagcaccaccctcgccgccctccgcacggcgcctccgccccgcacagctccggccgcgcctgcccccgcccccgccctcgccgacccgcccttcccagacgacctcctccccgccccccgccgcggcgaagacggcggcgacggcacggcgccgctcccgccgccgccgccgccgcccaagctccccagccggttgtacgcgtggttctgcatcgagcccctcccaatattaaagccgttagttaatacccccccccccctccactgtagagctagggtttctcccgcgcgatcgatcgcgcgccgcgccgccacgcggcgggagagcgagacaacaccgaggcggcggcggcggcggcggcggagaggaggaggtggcgagccggagcggagggggaaggggcgccgcacggcatgtgtccggcgcgtgaccccgcgcgcgcgcgtgcgtggccgcgtgggtgccggtccgagcgcggcgctagtggccgcgcgctggtggtggactggtgacctcccctaatcggtcgcgctcggattcccagaagttttttcgtgcgcgtttcaggcgcggcgcggcgcggattatggtttggctttggctttggccgtcgctgaccggggattcggatttttctggtctctctgatgtggtgcggccggtgggcgcgcggcacgccaatccagcacgggagtcgggatagattgattgatgtgggaatgaacggaatggaaggtctaatgttcaagattgggagtatggaactagtcggattatctttctatcctcgcgtgggtggtggtggacatttgggtttggggagagattcgtaatgcgatccgatctttgcctcatgatcgtgatggggaagtgaggttgacagcatcaggaggccaggaatgggctcggtaatgaccctttttattcgttagggcatgccaaatgtatctggctcaagtgggcattagcataggcccatgtaacaggaggtagcagtgacatagagagttcactatgtatattttgtctgccagaggtagtaaggtggggccactgaaaaaactatacattttctatataacataattgcttaccccatgaaaatgttgcacatctattatttttttattttcttgctaccggtagtagtactaaaaccggatagcagttgttaccccttgccacaatgtttattacccgataatagagatgtatttatgtcttattacctacttttcaaccatattgtggttgtagtgagtagtgacggctattgatcagagtcatcaggctgtgcttcctgtagtaccgcatggtgactgtgacttttaacacgaggataggatgcaagttgggagtgtacagacagacagaaatgctaccagtattattactaccggtttattaccacgtcatcggtttaggccatgtgagtatgtgacacgcggagcatgtagagagacaaaccgaagacacgcttccttctattccggatctttcaaagaaaactgcaagctgtactcagcattgatctctttcctcgtttcctaagcttccacagctagtactagtagtactacgcaagttttgtgcatgacaaccgaatttcttccagaagatactgcatatgccagtgtgaagccaagtagtagcacaaaattgtttttctgctcttctccgatctgtcaaactctggtagccgtgcatagttggcgatggatattattttcgtctcaagctccccctttttcacacggacagaacttatattgggccataacaccatctttcaagtggttttggtttggtgtggtatttatgccacttaaatactatgccaaataatgcggtacatttcccacgggttattataaatggaattgctatatgttattcgaatgaaatttagagatgaaatcttatagattttagactattggatctatgccaagattcgtacatcggcttctctcctctaactccggcgggctccccttcttctccggcgctggcgacaccccccaacttcggtagggagcatacgggttaggatttggagttggggtcagagtaggaggggggttagggagggggaagagagggttttcctcggggcttagagagatggccgtaggaggcagagaaatggcagtgggtggtgggcggtggacttcagcgggcggcaaggcagcggcggcgccgccgaagccacagtgatggaggagggtggtgggccggcatcggcggcgggggcaaagcaagcgtgtggttaggagacagcggtgatggttgcagattcggcgatggggagccatcggagacggggaagacggcagggcgggggcagggggctcgctgagggagcctcactagcaccgttgactatttccaactagccaacgaggcgggcggcggcacagtgggacggtgatggcaggggatcgcacgagggacggaaggaggagtggtggcagcgcgatctgaacggggggaggaggagaggagttgttgagaatataggcatataatgatttaatatattccataaataaatcatgacattacagatgtatacgggcgagctgtcgcggacgaacaaggagcagtcgcgcgaaacgcttcccaaaaaccttattgccgccttctccggtgcaggacgtcgaaggcgataagtcgcgcgtaacttatccggactccactacgcgaagcgcttcccaaaaaccttattgtcgccttctcccggtgcaggacgtcgaaggcataagtcgcgcgtaacttatccgactccattgcatctgcgaagggtgaggagccaattttgtgaatcattcgacgcgtacgtctgccagaccaggccagcgagcgcgcgcgtgtgttccccctcttctctccaccacacatgcttcaagtggctaggagggcatcctcccctttaaggatgtccccctctcctagaataagcaaggtggtactaaactccacatgcatgccatcccatgaggtgggcttttgtgattttccaaagaattaatcttcgaataggccttagcccatctattaattccaacagaagttagggttaagagctccgcacaaatcttgaagcatatccaatggtccaaaattcgaataatatgatgtgggattttctgtcacaaaggacctgttcagattgtagccaaaataaaccttacaataccaaaaatttggcaatttaataatattaccaagttttggcaggattttttatttatttactagagtttgataagtaactaaatggatgcacgtatttcacaactttgcaaaaaaaaaggtttgaaatggcatcaatctaaacaagcccaaaatatgtagacatccccatttataaacatttttcagatgtcctgtatttattttctggaagctccatcacctgattttaaacataatgtatttgttatagcatgactgtatatgctacagtttgcaccaaagtaattgcatctttgatcaatcctatcaaaaggctataaagaattaagattgtgtgatctatgacatgttgattacggattgatcatccaaagcttaattaaagtaggttgatatggtttcagaaaagaagaaaaagaataactagtagtaagaattatttaaggccagatacagttaagatggtgcagctatatcattacctaccattaatggtggggagcattacgatccgactgataaatttagttttttttttgccttaaatagttccgatcatacaaaaacaaagaccaaagtgcattgatttttttctagaaaaaaagagtgttgttattttggcatgcggtcatgacaaaagaaataacagttccaagggatgaagaaaatcacaaaagcaacagaggactaggaggaagaaagaggaggaagccaagcgctacatcagccagccacattgccatctacaaccagcgatctatataacaatggagagaccagagtggaggaagcaacgaccataagagactcgaagttgagaaggagaccctcgacgtggtcaccattcgtcgaagtggacgaggatacgcagccatcagagacaattaggaggaatgtggctttatctcagcagtatgggcgttgggtggacagtatacgcgcgagatgtggcgtgtgagtggctaggtgtgggactatggtctatgggaatggcgagtgggtgactgcttggataagaggcacctagcttactcaagaaccataacaattactatattgacagaaaaaaaaactagaagatatgcataatttgaccacgttgaatataggctttaacgatgtaggtgtactgatatagttgtgtttatgaaaatggaagaaagggttgaatctcaaatacaatttgttttaaaagaatctaactttgcatcaagttatgctggaaaatacattagcttgtgtcgaagaaagtaaaagaaactaaatcattcccatctttttttctgaatggataggtttattatgttaaatttggaagttttgagaactgtaccaacaaagcccgtctagctcagtcggtagagcgcaaggctcttaaccttgtggtcgtgggttcgagccccacggtgggcgcatttcatttttttcctgttaaagtcctttcctgtgatccagcacatgacacccagctaatgctttctggcactctagatacaggatttttttttttgccgaagatggagaagctgatgaatgcggtagcaaatcgccgatcatctcatcaatattcatcaggtgacaactgacaactcaagaatcccacttagacaagccattctagttccctgtgtggttggttccttatatcattggatatttaattcatggatgagactcccgactttctgtggtttgtagttttgccattgacatgtgggccatatcaaaaataggacccacatgtcagtggcacaaccttaattcagttacctcttttagcacagcctgcacctgcaatgtcgtcgaaaacacagcgcactagcgagcagttcatgctgatacttaacgaccgattgagtgaggatacaacctccgttattaagaaaagaaaccttctagatatggcttctttgccaattttttttattatacgaatgcgtatttgaagtattgaacgtaaactaataacaaaataaattacagattccgtctataaactgcgagacgaatttattaagcctaattaatccgtcattagcaaatgtttgttgtagcatcacattgtcaaatcatggcacaattaggctcaaaaagtttcatctcgcaatttacatgcaaactgtgaaattgtttttttcgtccacatttaatgctacatgcgtgtgtccaaatatttaatgtgacatttttggccaaaaatttttgggatctaaacgcaccctatgtcgaaatatataactagaatttaggactgttttggtttgctgcaaaaatttcctctaacaaatagttggcacttaaaatagtaccttgtagatgtttggattgatgccaaaatttaccaaaggcaatataactcctataattcaactctactaaaaatattggcaatgccaaatcttgcccataatttgacactaccaatgatttggtagggcaccaaaccaaatgagccctcattatctttttaaaaaagagggagtaggcaaaactattggtagttcatatgtaacggggtaagtgtagcgtcttgcttgaaaaaaaaaaacaggtggaagtgacctaaatatatgcagacccgaaatgactagtactaccacaataaacaagatgcgacatatttcgtattttattttttatgggacgaatatagagaactccctctgtccttaaaaaaaaaggcaaacttaaatttccatgccaacgtttgactgtccgtcttatataaatttttttttataattagtattttcattgttgttggatgataaaatatgattaatactttaagtgacttatctttttaatttttttcataagttttttaaataagatggacggtcaaatgttggacacggaaaacagagtttgtctttttttttttgggacggaaggagtacatgctaaggcgcgctatatagtctctagtgttaacaatgattgatttaaggtatggtggtaggtgacaacattcaaccacatatcctgattcctgacattaaacaggagctatttttccaactagactgaatgagctgccggttgaacacgtctagtttcttcatagctccatttcaccaagtacatgaaacggtagagatggtcggttggtcacgttgatctgaaaaaattagcacgagtgggattattcaaggtcctagagatggtcagttgagcgccggctgcgcgcggccaccgcccggaggtcattccatgccggcacttggacgtatatattacacgagtaccccgtatttacaccatcatcgtgtatacacgagggggagggggaactccgatgtggggaacaacagccgcagcagcgcgccgtctctgcgcggccggcgacgtccgctcggtgctcgcgatgctcgcctgcagggcgaaggcgggggacacggcgctggacatgaccgcgtgcgccgcgcttgtccggaccacgggttctgcaagggcggcgatgtggcggaagcccggagggtgttcgatctaatgccgctcttgggggtggcgcctaatgaggtcacctacaccgctttgatgcacggctacttcatccatggccagagggagaatggtttgtccttgttcgaggagatgagaattgaggagggctggagtcgagccaagcctctacacctaaaactgcttgatcgcagagtggtgcacaagggaattcgagcgcgctcgtaactagttcgacgaaatgcctgcaagggtcatagtacgcaatattattagctctcattgccgcctacgcaggcatggcaagctgtggggtaccgccaagctattggaaatgatgcggagggacagtactcgtctgagataaacatcattacctatagcctccttgttgatggctacggcaaagctgggaagatgtccaatgctttgcatttcttcagcctgatgaaggcggccagtttccaaccagtgcaatgacatacaatatgcttattgccggtttctgtcgtgctaggggcaaatagggctttatctgacatgaaggaacgaggcttggaaccgaccaaagtgacatacacaatactaattgattatttgattcatttgccagagaaaatgacatgaataaggctttttagatgcttgcatgggagaaggcaggtctagaggtggatgtgcgcacttatggtgttctggttcatgcactcttcatggaagggcatatgaaggatgccaggaagctgtttcagtcaatggaccagaaaggtgttgaaccgggcaatgtgatctatgacatgatgatttatggctatggaagagaagggagttgatacaaggctctgaagttgatcatggaaatgaggcagaagggtttggttccaaattccgtaaggtatgccttgatgatgacgatttgttttctttgcaatgatgataaatgtcaggaagctgaggctctgctcgatgacatggtccgtgctggtctgcaaacaagtgaaccaatctgccagtttactgaatgccaaggcaagattgagaggttctactgatggctcttttgtgtaagtaggaattcatttcttttcatgttatagtgaattatcctgattcatgagaaattagaaagatattgcacaaggaaatctacgtattgaattacaatataagaaactgtaagttcatttgctgggcatcacagagaactccattgcaagcgacaaagataggcagcaaaatgccgaagataaatgcacccagcacttgctgcaaaataaaggtcagtgcttattgggatcctgtgctttcatgctcgtcctgcacgccggaggctttgccaggtgaaacttggtttgagcaaaacccttttcagatgttatttcatgattcctagtacaagataacctaccttcatactcaggtattagataagaaaactagagatatatagcttcaactattttgtgtccgtaccatatactccgcccatagcgcctgttcatatcagtcaagtagaattaggttttattgtttcttgtttgtcagggggtcaaccatgagtccttgacaatgctgtatgagttcctgctatatgatagatcagcagtcgtcattttcctcaggcaatataaaacctagctttatattcttgctcttatttgcttcataaacgcttgactttaagttataacccatgtttatcatgcacacgcaagttcccagcactctcctacattattaaattggggtgtgtttagttccatgccagaattggaagtttgaagaaattagaacgatgtgacagaaaaattggaagtttgaatgtgtaggaaagttcgatgtgacggaaaagttaaaaatttaaagaaaaaagttgactcttcagggatggagaccccttccatacaaagaaataagaatgtcggcgttctctataggctactgacaaagctatgctacatgagttcccttgcacccccttttcataatataagagattttaggtagatgtgacacatcctaatacaacgaatctggacagaccgtttgtctagattcattatactagaatgtgttatatctacccaaaatctcttatattatgggacgtagggagtaattaatagctctatatggtttaaggaaatgagtaccctatccaaatttctacacctgggcctcctcgtccttttctgattgctatgtgataccggttcccacttgctaagttgccttaacaccgcactttgcaatttttctgataggagaatcaagagtgaccgatccttttcagattcttttgcaggtacttttcagttcatcttgtgtttatgacgaaatgctctttaattcttttgagctcatgaataagtgtcttaaaagaagagctcatgaacaagaataatttaattgttactaatactagtaacaaattactgcatatttactctctcttttgtttttacttgttagtttggacatcaacatagtctacttaattatatttatatatacaaaagaatgctgaaaacatacttcctccgtcccacaataattcaactcctggattcccaatgcaaacttagtacaaccatgaaaataccgaaatgccctcaacaacaacattacacaggattgtactgggttctctgcactgtcctcactgaaaaaaaaggtttaactgggttctttgcacccatcgattacactggtatccagcaaaaaaatgaagttttaaaccgaatatgctaacaaaaattaagaacctctagtctgaaaaaagaaatcataaaaaaaatactactccacaatctgcaagatggtttgcatccataatctgtcaaaaaaatacttctccacaatctgcaaggagtatgaattaatctgcaagaactagaaagaacaaagaaaggtgtttgcatccaccaaggtggcctgtagtcatgtgtgtatttatctagattgaccatgcaaaaagtcatcatcaaaatccaagaacttagtatagttaacaaggtgaaatggcagaaataaacaccagagaagaaagagtgatgaaaaataagtagtagaaaagagtacctgggttcattctaatggcaaagcttctcgaaccacctcagcgctaggagacacaaaatcgttggctccttcatcagatccgccattgcaaaagcttgtgcatcaggctccctgcaacagatccactggcgctggagaccataggcttgcgccttcgccgccgtagtcgagcagcacctacacgttgcgttcgccttctcctgcatcacaatcgcaagcccctacctctgccgccgtgctgctagtgcctcatccgagccatctcaatccgccggggccggcgctgcccccgccgacctgtcgcatccatgacatcacgggaggtcgcagggagggagagatggatggagcgtggagggaggggaagcgactcatcgccgtcgagggatgggcgaaggtcgtgaggagagggaggagatgagaccggcggtggtggttttttttagcgcggctgtgtggtgggcgagaggagagagacgggcagggataaggatcattgaatatttctcgggtgttgcgcaggagttgattttttctgggacaaatcctcacccccagaaatcgcttctttctgagacggagggagtaaataattgaagtacttctgacgacaagtctcttgatgctattttcatgtactccttccgtcccataatataaggtattttgagtttttacttatactctttgaccactcgtcttattcaaaaaatttatgcaaatataaaaaacaaaaagttgtgcttaaagtactttaaataataagggcaaaaaaagtaaataataattccaatttttttttaataaaacgagtggtcaaacagtactaataaaaactcaaaatcccttatattataggacggagggagtaacaaacatttatcttttacgaatgggtaaattggaatcatgccattataattttgtaaagtttgagatctatcggtatctcaatgacacgtaggacccacatgagtcaatgacatgtgggtcaggatgacatatctcaaattttgtaaaattataatgacatggttccaattttccgttacgaattgatgtcaatgttcttggaatgttcactacagcaagtactagcgctgaagcagtacagcataacgacgactataggactatttacctgttcattactcgtcgtaatgtcgtggactcgtggtacgccgcgtacgcttctgcacgctgaccgctcgccatgggccatggcaaatgtgaagccgtgaagcatcggcccagcagaatcacccgtacacaggatcgattaccaacggcgcagatgacctggaggagaccggacgcggccggatgcggaagtgtattccccttcgcaccgcacggtcgcacgcacgcaccgcgagccgttaggggttcaaacttccggcccacaacggtaactgtcgacgtttgcgaccgcggccccttctggcatctagaacccgaaccggggcactcgcaacccgacggcgccgtcaactaaccatggcacgaccgtcgcgtccgctacacgtttcctttcgtctccaactcgtattgctcctctttttttttgtattccacccctctatttccgtaaatcatactatcccatgtgttactgtactactatacggtaggggaaatctcgtttttttcatgcattttgcattgtactaacagcacaattgtgagagttcgtgctgaacatgtccagggttcatattcctaatggaaatcacgattttcatgaaaatagaccgattttcatggaaatagaatatttggggttggttccataacaaaaaccattcgatttcatggttaagcttttcaaacaatcaaactaaaatttaattattttgataacatttttctcatttttgtcttttttgttagtttaccggtagttttcgtgaaaactggatatactgctcgtgctagagaaagttttcagtccgataaagggattgtgaagcctgccctaaacacatgaaaaatgtaaaattcaactttgatttttttgcaagaatccttttccttttttttgggtgcttttcttttgtatagcactgtaccgtatacaacactgaatacaacaatgtaggccgagtttagttccaaacttttttttcaacttccaattttttcatcacatcaaaactttcttacacacataaactttcaactttttcatcacataattacaatttcaaccaaattttcaattttagcttgaactaaacacacccgcaatattagaaatttttttctcgcctccttatctaataaggacaaatctgagggacctattcggaaaaaagagatgggttaataatttattcctctcgctcgtcttccccttccccatcgcttcaacgggcgaggttttttgaaagcatcatcctctctctctcctcccccatcgactacccccgacacccaacggaagccgtagaaggagagagaggggaaaagcttgctattttataccctcatctagggttccgagcccaccggctctctccccccttgctggcttcgcgccatctctcccgccaccgcctccccccctccccccctccgcctccgatagattcgcgctcgccctcctgacccacggattcggttcccacgaaaccgctcgatctgggggatctgctagattcgtaaggcggcgtttcgatcgatctgttcgggggtttctgccgtggggaattttgatctataaagttagttttttgattttgtttcttttttgctttttggtggcggtttcgctgtgttaggtttgtggtggtggtggtggtggtgaggatgtgcttgtgccgttagatgggggccatggcgatggtggagcaggaggggtgcgtcgagaaccggcagcccctggcggcgtcgagctcgtcagtttccgacggaagcagctatggcggcggcggcggcgggctcgcgcagatgtcgccgccggtgtctagctcggcgaattccatctccggtcttaggtaaggaagttctttgcccgattcccctcagttgggatcctattatgggagggatctaggaaggtccgttggttagtacctaagttcgtgtggtagttgagaaaaatggggccttcgtggatggctccccgatggttgtgtggttttatcgctggcaatttgccctgtctgtgattccacgagcggttgtttgtgcgtttgagaaaaaatcttgccacgaggagtgctaccttggcggatatgtggcaccgagagtgttgtggtggctgtttgagtgataaatttggtgtttttttggtatccatttgatgagatacttttttatattcagacatgactttgagtgtgttatgatggatatactgatatgaaggcgttttccttttgggatggctgttgatgttttcatttctgtaattaatttgcttgccttactttaaagtgtgtatattgatgtaatttggataaaaatatgttcacttggaacactaaattggtccggttacatgcagcagtagttgtttaaactggaaatgtgttttttatgccatgacccaaggttttattagatttaatatgcttgggctacagcattggagataccatttacttgtaaccttgatgtgtatattttttgttctgactgctgcgctaaaatatggtactggtgcactatagaaatagttgttttaatgaataaacagtatttttttgttaggccctgtttggaacgtttaccctttgtgtaagattcctgagttcaaaacagggcctgaatagttgcagttacaactaaccgccatttttgtttcccacttttaatttcttgatgatgaattgaatggtgttagtagggttaagcagtatttttttcatggaaatctttcttgttcatgaaaggctccacacatgggaaatttacattgtcgaactatagccttaatgttcttccctatgtaggtctctcaaccaacaattgctgtttttttgggtcatcttatgctagtgtatttagatataccttgtgccttctcggacctaatatgctattgtgccctgaacagaaaatctttcactttatttttgctgataatctttatcttatgttaggcggacaagcgggccaataaggagagcaaagggtggctggacaccagaggaggtcaacacctcactctctattgtacttcataaatactccataagtcctattaaatgcaatacatacctacatttgttacacatatatgctagtttggtttgtatatgtattttggcatattcagtggtaatatcatgcactggaaaagttcttagttaatctttttccattcctgtttttctaaggttcttattttatccgattttatttcatatatgtttttattgttattcatggtctgaccattgattttttgtttgaatcaaatcttctattttcctgcttgaacgacatttccatgttgattcagttacacaatcactgttactaattggtcttaacttatcgcaacaggacgagacattgaggaaggcagttgaggcttataagggtagaaactggaagaaaataggtccggctctcaattccactgcaccagtgtataacttgggcagtcagttatccttgagatgatgctatcattttgttgaaaacaacctgtcaggaggattgcaaatgcctaatggtttgattccattaatatcggcccatttgcatataaatatgcgtatacaaatatgatctcagcaaactaatacatttttgcgtagattatatttgtataaatatatataagtatgcaacctatagtaatattggtgatcttgtagttgaaatagctgtttttttacctttttaatgttgtagtacttcattatatcagttgctccacgtgtactggcatacagcatgccatattatttttccatatctgtatgccaagtacattgagctcatagaatgtatctgtatgcagccgaatgttttccatacagaacagaggtacaatgcttgcatcgatggcaaaaggttcttaatcctgaacttatcaaaggtccttggactcaagaggtttgtcatgtagctgactttgctttgatggtaagcgttgacattatatcttctaattgttatattaatgccatgttttctgcaggaagatgatcaaattattgatcttgtaaagaagtatggaccaacaaaatggtctgtcatagctaaggcattacctggccgtatagggaagcaatgtcgagagaggtaatatttttatatcatggctgtattgttaccaggattcagctcactgttattaataaaacttttaaatttccagttatttttttcacatatgcatttatttccctttacatgagacattaggaaacttttgtaattgcaagaaagaactttaaattttaggatgctcatagttgctacaaaagctcaggatcccgtctattatgaaatatgaattaattaaggccttgttcggttaatccctgtgatggagggattggaggggatttattccacacctattgtggtgtggaattattccccctcaatccccttcaatcctcttcaactctaaaccgaacaaggcctaagaaatgcactacttactgaaagaactgtgaaaataattggctaataattatgctacagtatctcatagctgaattcaaactgttgtccgcatataatttactttctttatggcttcaatagtatttgttatgaaaaaagtgcttaagtttggcatgatacaatacattatacggagctaagtatgaagtcatacaatcttaggtggcacaatcatctaaatccagaaataaggaaagatgcttggactactgaggaggaacaggcactcataaatgctcatcggatttatgggaataaatgggcagagatagcaaaagttcttcctggaaggtacgtttataaagcttacttccctcggaattttttgctttcattag

SEQ ID NO: 2259 - DNA, 13033 bp, Oryza sativa
  unsure (1)..(13033): unsure at all n locations
cttcccgtgaggcatctgtagttatggttccgctgtcactttagtggcgcaagctctggaaagtgattctgtccgtggtaagggcttggaaattgattctgttcatgagaaaggtcttgaggttaactcggcacctgatcataccgggaactcttggaccattcaactagaagctgcaccatccaaaggtgaagcagaattatctttgaagaatgaggcacgctctcttggtccactttgttaccagatccctaacatggaagatgtagtccctgtgagttcctcactcttttctgaccatcttactgggaaccatacatctgaacattgtggggatgatatattgtcacctgctggctgcactactccccctccaacaaagggaaaattaacaagccagcttagtgttgattcaattttgaagagtgctgctaacagttttccaggtactccttcaatattaaaaagaagaaaacgggataaatcaacacctgtttcagctagtgagatgaagatcagtggatcaaatactgatagattttacactcccatggggatggaacctgctacagctacaccagagtcattcaaaactacatcttttttgtcattgggttctcttgatggttctgtaaagagctttgatgtttcaccacaataccgggcaaggtcaaaaagaatggctctcacgaaaacagttgagaaacagctggatttttcatcagatggattagatacttgtggttctgagattctgaactcttcctgcaataattcccaaagcacactttctattaccgaagccccaaaactgaaagaaaaggaacatgctgttcaattggaaaatttaaccaagaactttgcgcatacaaccaatttggatgtaacctaatcnnnnnnnnnnnnnnnnnnnnnttacaaaaatcttgaaaacccctgctttacaattgagatgcattatacttttcatagccagtctacaaattctacctggtttatctgatccatgttggtagttgggtccttttattaattgatttgaacatggaagaagtgtgcataattgttttaccattgccttgtaggaactgacatcaatctgatgaagtaggacagatgagctgaagtgtctttctgagctgatgagctttttctcaaagtatcacgattaaaccacaacaagatcaaacaaaaccggtggagaagaattccagaattgaagctttgtactgagtacagaaggtccaccaatcattctcccatctcttctaaccaaggtgtacaaaagatgagcgacactctgtagaagaatacattgctcgctgcactttgtgaatttacagttagaaaattcagattgtagaagccacaggtgtgtacaaaacaacaacgaaaaaaaattatagtgttagaacgtcattatagctgaataagagtattcctcattggattgtcagatttattttgtcttgtgctttccctttgtcgcgaaacagccagggtctgctctgtgtaacaataataaaacccgtttttgcaaaatcattgccagagatagtcaagaaaccattttgacagcagctcaggtttcgtttgttggttgttgacaattccttaaattctttagcatcttctgtactcgctgaagctctgttagaacaacgttgcagaggctaatcatatgcttgtgttcgttcttacttgatgctagttgtatgatatgattcagctgtattactggccctgtttgggtgagcttaatttagagaaactggaatatgtttctagattctaattctatatctatagtaactatacatatcagaatatgtatgaaaaattagactatgtaagaagggtgtgttcacactaaaattggaagtttggttaaaattggaacgatgtgatggaaaaattggaagtttgtgtgtgtaagagttttgatgtgatgaaaaagttgaaagtttgaagaaaaattttggaactaaactcggccgaagttttttgtttagagcatcaccaatgtatatggcaaagtgatctatatagatgggacccacataaatagtttatccctatgataatgtccacaatgtatagatacaaggtatcattaggagaaggagaagagagaggagtagagatagataatataatttatttcatatgggtagtccatatgtatatgggtattttttgctattttttttatatggactagttgcacaatgataataggtggctgaatggaatattctattgtttatagactacttttatattgtggatgcccttaggaaaagctaaacccctatcggcgcctttctatgcctctctatcaccttttggtcattcggttcatcgcggatcgacgagaaaccaggttggcccgaatcaatcggcgccggcggcctccgcggtttccgccttcgggtaggcgcctgcggcatcaacaaagcacacagccgaaaccgaagccttttctttcttccgccccaagaagctgtgccacgtgtttcctccttcccctcctcgatttaaccgccccatctcgagtccccccatcacagcttccactccacgaaaaccctctgcctccttcgctcgctgcaccctcgtctcggcgatccatccatggctgccaggaagttcttcgtcggcggcaactggaaatgcgtaagtattccccccagcactagtcgtctcacaatccagattccggatgagccggagacgctgctgatgagtgatgaggcttgggttttatcgatgcgctgcgctgttgctgcgtgcagaatgggacaggggaggacgtgaagaagatcgtcaccgtcctcaacgaggccgaggtgccctccgaggacgtcgtcggtgagccgtcgtcccctcccgagggcgttgtttggagttggatcgattcatgaatcgatctggtgctgatctgtgggtttgtttatttattttaattttttttgggtgcagaggtggtggtgagcccgccgttcgtgttcctgccgcaggtgaagggtttgctccggccggacttctccgtcgccgcgcagaattgctgggtgcgcaagggcggcgccttcactggcgagatcaggtgagcgtcctcccccactcccctgctctgtttcccttccccttttgttttgagagagatgattagtgatttatttggcattgggtgaacaactcggccttacagcgcaatctgagtgtttatcacgagagcgtcgattttagtacggattgttcgaaccgcgagtattgttagtcgattataagcagctctagttccacgaaatctgacttgattataggcatgaatggatttgtgggacagctgaataatgaggcatgagtatgctgctgctgctctattgtggttatcggtgatgttctgcagactgcagtgctattatattaaggggtgaatgacagcagaatgtggaatgctttaagagcaatcctttgccaattcactgacgtatgcttcatatttgcagtgccgagatgttggtgaacctgcaggtgccttgggtgattctgggacactctgagcggagagcgctgatgggcgaatcaagtgatgtgagttctttctacattgtctagaaacataggattttttttcatgtcagctttatagcaactagaatgcgggcagctactggtttagcaaggccaggaacttgccaagaatatctagacaatggtcctattttaaggtcaatctgcaccgtccctaagctagcataaaagactgttgagttactctgttgagttttagccaagttagacctataaattgggttatttcatcaagctgctggaaattctgtttgaagctcatgggattttgatttactatgttgttactaacagttcttttcaccattcatgacagtttgttgctgacaaaattgcgtacgcactttcccaaggtatcaaggtaattgcttgcattggtgagacccttgaacagagagaagcaggaacaacgatggaagttgttgcagcgcaaactaaagctattgcaggtaatttcacttgctattcttcaagttaatttcttataaagttggaacttcacccctaatgttggaacaactgaataagtgcttccttccttccttatgaagtaccttgtgctgttgataaatccagttcttccaccttgaaagctgttaaacaggaatgctagtttatatttgcagaatagaatactgtgattgcttttaccctgctaaatatccaaaaggtatctgtagcttgtgtacaggtttatgatgataacggtgtggtcaaattattaaatgatctatcatttgaactaggaattatgtcatacaagaaacacatactttactactatgagccttttagttattgaagaaaacacatcctgttttgattagtcacatccattttcgtttcatttgttctttatggcttttgtggtccattgtactgtgctgacatagaagtcttctcatttctccacccctaactttttgtcttttttactcgtcatatttttcagagaagatatccgattggaccaatgttgttttggcatatgaaccagtttgggccattggaaccggcaaggttgcaacccctgctcaggctcaggaggtattccttctaacatagagcaattacatcacgattagcatgttcccttcacatttatctgcctcataaaccaatatgggttttttcctatatctaatgtctttcttgaccgatgcctggtacctgattctgcaattctgttcattcgaattatttgaaatatgcatgacattaggttcatgatggtctgagaaagtggcttgtgactaatgttagtcctgcagttgctgaatcaaccaggattatttacagaggtatacctttataactataggactatgaattgaaatgtaaccaagattttgtttagtagtgatgccaattgctaatgtacaaaactctccccacttccctacgattaacctgatcccttgtcttcgcatatttgtcttctacaggctccgtaaatggagcaaactgcaaagaacttgctgctaaacctgatgttgatggattccttgttggaggagcttcattgaaggtcatattcctattcctttattatcctctccatgatattgatagtagcatgtagaacataagcctagttaaacaaaacaccatttgaccagtacaatccttgtgcggttgtgcctagtagcatgccaaatatttgaatttaactctatacattctcacataacatttcaggctttaccgttgtgtatattactgatgattactttttttttctgcagcctgaatttgtggacatcatcaagtctgctaccgtcaagtcttctgcttagtgttctgggttgcaaccagatgatcgtaggagttaatgctgccaattttaagttatgacatgtttgaccagcttgctttgttatatctcgaagtcagtgaactccatatcgttccatagagcatgcagccacctgtggttgctttttttctttttgactttttctcccgagaggatcagatgaactgaaagtgccgttaatgtctgtattatcagaagtttgttgatggcttgatgctataatagttgaacctgatacttcctgagtgaagtactgtcctttgcatgtttgattgatgattacttgttttcgtagtcaaacgggctatcatgaaggatatactacatgtttgttaagtttgttacttcgtgatttaagcaattgttgattaatgcagaataataaccgggtcattcgcttgttactctattacattgtcatgtaaactagttagtgactgaatccatctgtgacgtactgtcctccctcttcctttcttgaatgtacactcccttaaaagcgttttctgggaagtagttatctagtgcacattatcatccagaagaccaattttaaacatataattacatattgcaacagttgcagttataacagattttttttctctatataattgtcaacaaccatagccagacgaagtgtacattacagattttgtactcaccagataaaataaacggtatactagtacttataaaatatcatttcaaagttacaataaaatgtaatatgcgaacatccatactgattcctgcagatcagaggatgtgtattctgaatagatcctttactgccagtgcccccttgcattgttccaattctttaagagaaaatcgagcatgatccggcataagttgaacacctttgtgctacggcgtttgtcaatcacagaagccgtacaagctgcggcaatggcccccggccggccactcgacgacgagtttaacttcactggtgagtggtcccctgaggacgcctaagcggcgaacccagaaaaatttatgttgggcgtaatatgaagggctaatgaattaatttggcaacggactagctgacattgtaatatccaaaaacaccgccgctgcttagcgcctcaaacatcaaataatggggtgtttcgtttgtgcagggcacggactgcagtctgcagctagcttaatgctgataaatatgactacactgatgagtcgctgatcccaggaaatttcacatttcttggggtatgccggtgccctcccggcaccacccctgggtccggccttggaggacgggcgagttgccggcggcagccggcaggccggcagcggcgtagggtgtaacgccggctcgttcctacttcctccgtttcacaatgtaagtcattctagcatttctcacatatatattgatgttaatatatatatagattcattaacatcataatgttagaatgacttatattgtgaaacggagggagtagaaggcaacatgtcaagaaggcaggaaggcaatcgagggcggcgcggaggacatcgctgaggcagaggcgcagaagagcacgccgtccggggatgctcgtcggtgaggtcaggggctcagggcggccatcattggcagcgatccaagcagggtcctttttacaaaatgtcagggcctattcgaaaatgtgttgggcacggatgcgtcaaacgtgggtggtccctggccgttggatccctgtcaacgccggctcacccttcgtcctcgccgttgcaggggacgaccgacgacggtgatcgcatggatgtcggtgccgggagctcatcagcaacgaggtcgtgcgcgagataatcctcgctaggatttcccgtcgctgagcgtgagaagcatcgtggactaatccgcaggtgcagggcgagcaaaaccaataagaattttctttctagttgtcctcgattaagccaaattaggaaccaatcttctcgtcacgctacagagttcaactaattcaccttgaaaagttgatggtcacaaactcactagatcttctgctcacaaactcactaggtattgctgtccaattaattcagttgctctatgttttcggcaattagaatttcggaatctatgctagatttgtcgagctcagttcctcaggatcttgacatgtgaattctctgtctgctttcatttttctctgtctgaggatttcaacttttggattactgcgacactgatccatgctttgttctttaattagttatgtgttgcgcgagctatcgacttcaaaataatatgctttttttttgtgatcgactgatcgccatatacctgtacgtaatgtgagacgaaaccactattcaattttgcagctgacgttgtgatgttgatgcctgatggtgctctactgctctgtttcctgcgttcccgaaaaatactgctctgttaatctgtttccagcgtaaattaaaacaaacggccaatgataatcgtttttaattttttggccgagtcatcacagactcacagtatgtcaacaactgatgtcagtacacccgttctttgttattatgacacatcactgtcatgaaaaccacctgataggttaacaatcagaaccaagcagtttctgattctgagacccattcttcagaaatctggaaattctaccgatatctatctgcctgactatctctatctcgatctcgtccaggattgttcttgcgaactaatggttgtacgcaaattcgtctccctactgcagtctcagtccaagtttcctctttgatgattcttcgaacttatcgcgtagattgggactcgcgcatttagccgaggaaacacgcttagcagcaagactcgatcagctccgatcctcacgttgaagcgatgaaaaaaaatcacctcgaattcgatccaggcggcgagacgtgaccaaatcacgtacaagtcgtcgtcgaacagacctggttgtttaaactactaattctaaactgcagagggtcagagagaaagatcgtacgaaacttgtactgctaatcatgcaataagcatgtgttaatgccaggacgattcactggggaaggaatcacaccgtgggcatgctgttgactagcggaataataccactgatttaagtagggtcatatattgatatatagcataactgctaactgccagttgctagtgcctcttcggctcttccagctgggagtcgaaacaaacaaaagagccgtcgttaagcacgtccaagtaattaaattagtacgtagtagtaatccctaagctaaaaatatggccagttgtagctgacagctaggagtaagagatgggcaagtagagagtatagagaggaaggagagaggaagcaatatgggagaacagtagtgaagcctcgaaccggctcggttcagtccaactcaaccacgtagaaacgtgcgggtttacacggtggcgaccgcttcaaatgtgcgggagctttgactggtccccagccagctcgcctataaacgcgcgcacgctcgagccagctaccacggcatctgcttgagttggagcaacacaccaagaaggccagagagattcagagaactacaccgagaaggcgagattgtttgcgtggttggtaatttggccggccttgatcgatcgagcggagaagagaagagaaagatggcggggagcggtgtcctggaggtgcatctcgtcgacgccaagggcctcaccggcaacgacttcctaggtgagataggtgcgtcctacctcgatccgcggccgagcgccgttagaagaagacgaggccgatcgagctcgatctcatccgcgttcttgtcctgtgcaggcaagatagacccgtacgtggtggtgcagtaccggagccaggagcgcaagagcagcgtcgccagaggtcagctaatactgctccgtgcagattactgcaaacttcttggtttttcgtttcagaattcggattattgttagacgaggcattgacgaacgttctgggctctgacctgaaaatgcagatcaagggaagaacccgagctggaacgaggtgttcaagttccagatcaactccacggcggcgaccgggcagcacaagctctttctgcggctcatggaccacgacaccttctcacgggacgacttcctcggcgaagcaacgtgagtgccattatatgctctcaccaaaacaaaaagccaacaaccatggcagctagcttagtcatagcaaacgctaaacactaaagtaattttccagttcttaaaggagatattaaggaggtaccaaatttacactaaaatttttggaatttctcgaggactataaaatttctctgaacactactataatctcaacgtgctgaccacatagttaggcaaatgaaaacaagcagaaaactttatataccttttgaacatcctgcacaaatctgaatcttgatttttgttgtaatgcaggatcaacgtgactgacctgatcagcttaggcatggagcacggcacatgggagatgagcgaatccaagcaccgggtcgtcctcgcggacaaaacataccacggcgagatcagagtcagcctcacgttcacggcttctgcaaaggtaaacaaatcaccagacgcacgactgaattattgattattcatgttacgccccgttgacctccattggtctctcctgattggctgggatctgaatgtgattcgatgttgatgtccaatgacaggctcaagaccacgcagaacaggttggaggatgggcgcacagctttcgtcagtagaaagattgtgaacttcaagtctataatcagttggggcctgtgggaggtttagataagtatactatagtactagcaaggtaggattttgtgagtaacaacggcatctaatgcccaagattgatgtggttcgaagtgtatgtatgctgccttttttttttctatactagatgtatattcagaacattgtagagtcatgaacctgttaatggatgtgaattatgatactacttcaacctctttttcgcctttgtgtagcgatacatacggtcagactttaccatctctaacctccaatatattaattagaatgtatgtataattcaagtgtgatgataacgagttgatttttcatcaaaaccacttatgtatcgttatattctttacaattttttattaccacattattaggacgtctgtgtgtataagaaatcatctatttagaaacctagggagcaggcttacaccgggaagtatctactgagaagtaccaattaggtcaaaccgtgaaaaccatcacatatcagagtatcgagaggaatgtctgcatttatccactccataattcatgagaacaaatgcaatcaagtttcttgtgtccttggaaaatccattcttagtgatgtcctccgaaaagaagactagttcagaaataaatcaaaggaaccactattctttcatcgtgtcatcatatacaacgaccaaatataaacataagcaaaaaatctattatattattaaaggaatagaaaaaaggagtctccacgttcgctctcatggcctaaaaattctcacattaatcggagaaaaagaaaaatcagagtccatatagaaatacaatttagaaatagctgaaattcggaattaaaaaataagaaatattagaagaggagactagagtccatatagaaatacaatttagaaatagttaaaattcgaaattaaaaaataaggaatattagaagaggagattagagtccatatagaaatacaattaggaaataactgaaatttggaattaaaaataaggaatattagaagtagagtatagagtccatatagaaatacaattaggaaataatagaaattcggaattaaaaataaggaatattagaagtagagtatagagtccatatagaattataattaaggaaataatagaaattcggaattaaaaataaggaatattagaagtagagtatagagtccatataggaatttaaaactaactaaaattcggaataaacataataaaattaaaggtagagttttgagtctgtataaaaatacaatttacaaataactaaaattcgaaattaagaaaaacacgtgaagaagagtttaaagtcaacatagaaatacaatttagaagtaactgaaattcgaaattaaaaattaaagaatattgaaagatgagtttagagtccacataaaaatacaatttgaaataataaaaattcagaaataaaaataaataatattggaagaagagcctagagtctatatagaaatacaatttacagaaaattcggaatataatttacaaataactaaaatttgatattaaaaataattaataactaacacatatataaaatacaatatgaatatttcacatttgtagtttcgtaaagttattgcaaaatttaaaattatgatgttattttaatatatttgaataatataatgagaaaacatatatgctattatatgagagaaaatataatgatgctagccgtataatctgcgcgggccaccatgctagttaacataacagtagaaaatgcatccaactatacagttatccccaaaagtccgcgtttgaacctgaacatagcaaaggtcctacttaactcaaatgaccagatctgttccttcacctgattgtctcggactcaaaatggatgtacaagttagactactggtacctgttaaaagattcaaaatgtgaccatacccctgaactgtactcgtttggtccaagcaatatggacttcgtagttgtaaactgaagaagatggtctcgaagtggagatcgttgcctcaggtgcataggtaacaagtcacctcttgcatttacatcagaatcaatttcttcataccttcactatagaggaaacgacaggtgcaattctgctccttggcaagaccaaatagcaaagctatgtttcctaggtgcacaaagttgctgcagtagtactgtagtattgtccaaggttctaagttcagatcgtgaggcagtttgcataaacaagggattgcatttttactcatcttaaacttctgtaatctctgtgactgataagatgtcatcacgtggatgggctgcttccacaacgacactaacttcatctcccactttcccagttgaaaccacggctgtagcttggatcccaacctgcgaagtatcaccagaattggaatgtaataccccaatgacgatattgagaaagtgatcctacttcaaggaacccaaatatgccattggagaatnnnnnaccgcagctagtgtagtggcaaagtagtctagtacagcagacatattaattagctgtgactgccagaatcctatatatctgcaccactagcagcgattagtgctattttctcctgtgtaatgaaaccacatcatctatgttttacacagccggaggtctccatctagtaatacaataagattagctctagtcgtttctagcatgatcactgatcacattgttccatgtccagataaaatttttaccagtctggacaaatctagctgctataaaagttgggagttggggctggtgggccatctaaccctttttcacctcactaaaaaaaaagccgcaaaaagaaaacgttgcttttggtcccacaactcccttttttaaaaatttg

SEQ ID NO: 2260 - DNA, 3771 bp, Oryza sativa
  unsure (1)..(3771): unsure at all n locations
ttatcctaagtcatctgggattggtcatactcgggaataaacaattaaaatgaagtgaatacacaataagatggtttttatactgactaggatttgataaactttcccaagccaggttacactggttttccaagccctgggcaagaccactaatatctacagaggtgctcttgctccaaatacaatcccataaaagcaacaagaatactctcatcttatatatatcaaataaaaatgtactggatgaagcatgtttgtgtacctctataacaagcaaagttgccaaacgatccttaataaacttaagaatcagggctttatacttctttccctttggttgtcttctcaagtattccaacaaccagtaacgtaagttgttgctatggagtctcctggcaactttaacatgcatgcttgcaataaaggtcattccttctaggtcaccagctgaatagggtggagattcacctctaagaaaagcctttatctgcaatttaatacatcttccatcagcactcaaatttaagtagaccataagtacgacgctcggatcaagatacaatgaaactagactgcactcataacataaaacacaaggtgggaaattgataataggaaagctctttgtaaattgtaaccatcatgttcctggaaactgttaaagttctccctattagcaggaataacagaggcatatttacctgataatgagctagcagatcaacatatcttcgaataggggaggtgaactgtacataaccaggaataccgaggacaccatgtggtacaggtttttggaaatccatttctgcagcacggagcacactgatgttggcaaaactcctggcaggcccttcagggagatgagtaaatgctgacacagctgtgttagactggggatgccctctgtatggcaaagcaatattgttgtcagaaccaaaagcagccacggcctccccacagagtatcatcatctcagatacaagctgcattgctgggttggattggtcttcaacatatagattaatgtttggttcaggatcatcaggatttgccaccttgatacgtggttctatcatagcagtatcaatcgaaccctgtgaacttcagagtgtcaattttgtcaaataacaaatgcatcgtagtactgatgtaatacttcagaaagtctttgaaaatacaggcttgagctaattggtaagtggcaccagtagtccagtactaatggtgaaatgaacagccgtggcattcattttgtagaccttggtctaggaaaggaatctggaagggagttcccttgtccatagaaaaccatgtgtatctcgctttataagaaaattacagttgcatttcattctgctttcatttgctaatcacagatgactcataaaaagacaatgtattgataacttttgaatgtttatcactcccagctaggcaagggaatactaggctctttgaatggttcacatggctcctataaataaagtccaatgatatttgaactacacttgagaacatgctggatggtgacattgacaaggaggcaacttccgcttatgacttgctaagtcctgctgatggaggagcacaagtcatttggctctcctggtgcataatagattttctagtcaacacaggctagagtgtttaacattctcttctctacaaatgacccattctgaatcaaatgtgctcacagactgaaaataacaaaggcatgtttagtacttacctgactacgacgccactgtgcacgaagggaagcagcttcttgaagaattctcagttcttcctcttcttccaggttcatatacagtagttcagttgcactctcatatgttaacatgtaggtaggttttatgattgaattctctatactatattctgcaatactatgaacaacacaaatatagttctcaacaattttgctataacaagcaagagaaaagcaatattaagatagtaggataccttccatctggctgcaaaatcacagatacagtaacagatttacaacccctgccttgttgcaggctcatagcattcatagcaagcctctctgggaacattggaaaggtagcagttggtaaaaagatcgaggttcctctgtgcattgcttccctgtaggaaaaaaagtaatgttctcttatacataccaatactgatagaaacactagaagaaggagaagaacaagaacctgtcaatgatgctccggggttgaaccaagcttgttgggtcagcaacatgtatccagacctttatcctaccatcaggtaatctagcagcacttagtgcatcatcaagctgagtcaccaaaaaaaagtgtttaatggatctgtcagtaggcacagctgctaaattataaccagtctcttgggatagatgcaatggcagaaggaacagaaacatgcctcatcagcttcatccacatcaatagcatacactttcaaagttgagagatccttcctgatatcctggaaagatgaattgaatgagattttgaattagtatacatcttttaagggaagacagtgagggagaggcttgctgtcagtacaaatcaacttaggctgtgcactatacttgtaaaaaaacaaaaaacaatacaaagggcatcagtatttggtagtagactaatagctgacatattaatttatagttgtacagctaaacttacataaagggaaaaacacaatatgaagaacatcaatatttggtagtaattaaaactaccttgtctgagtcaggacagtctaccagaagttcctctgcagctgacaaaacttcctcagtgtacctgatgcgaacatcatacctgtaaagatcaagattgacatgcacagggaagtatccaatatttataaggatctttagagcagctgatgaagtctttgaaaagcccatagccttgagaatctgcaattacattaataatcacacaggtaaacatcagctacaagggaaaacttaattatttccttcaatgaagaattatgttacactacaaaaacatttggttcaaactttttaaaggacatgatactttatgatggtaaacaaggattatggttattcagtaaaccaacactagtgtaaacaaatatttacttatttattatgcatgacaaaataatagtagtggtatagaatatgttacgtttcctgccgttctcctttgttcatcatcacatgcatcaactgcatatgcctgaagtgactcaatttttcgcttaactttctcctccatcaaccatgaatcttttgaaggtttagcatctagaggcaatgctttggcagacttgattaactggacaaattcttccatctccttctcagctgcctctttagcaagtttccgtcgtaagagttcctccacctactaccagatgagaaatttaagtccaccagccaatacaacaacacaagttcatacagaaaattaagagataagtgcaacctgaggtaattgggcatgtgattaatacagtttttaaccaagaaaccatatgacagtagcaatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2261 - DNA, 1489 bp, Oryza sativa
cgtgcaaaatggtggtggcgacggcgggcaaactgagaagagtcggattggaaaaatggttatggctattgacaatcgatcgagacgatcgatggatggtgtagcgggaggactcatcatatccttgcctccacggaaggggtgccatggatgtcctgccgcctgatggcgtttccatgggatcctttgacgacggcatggtacaagacgatgccacacgcctgatggattgcatcgtcgcctccaactcgccttagagccaaatcagctttgttccctccggataaaccgtagatagcgcaggcttatcgatctgggctagcgagaagtatttagaattaaatttaaaaatatattgttcttttaattttttctcatgaatattcgggatgtaaaattttttgtgtaaatataccttcgatctcgcacaaccgttgcgcgaaaccgagattggtgtgacgtcatgggcggtaccgcgcgttgaaagtgcgagaacgcgcggtctagcgcgacgaaggcacgagagcgcgcggtttcgcgcaatgaaagagcgagaccgttcggtctcgcggaatcaaattgcgtaaatgtccacaggctccatttaattagtgcttaattacttaattagcaattaactaataataattagcaactaattatcctaattagcgattaattaataattaattaattgtaattaattaatcgctaatcaagataattagtcgctaattgaatcagcatggcaccggtctcgctcagtgcttgcgcgagaccgttctgtctcgctgcgccattccgcgagacccgttgttccgcgagaccgcgcggtctcgcgccttcgccgtgcgataccgtccacgacgtcattcccacgtcattctcgcgcaacggttgtgcgagattgacggtatatttacgcaaaaaattttacatcccgaatatttataagaaaaaattaaataaacagtatatttttaaatttaattcgaagtatttatacgcgagatcattagtattcctgttttcccattacaatgcgaaactttttctcgttcaaagcggatccgcctagtggatccggtaacaagcttcatcgaggcttgcagcgatggacggtagatggaaccgggagtacgtactcttgagggtacagaatcattttcatatcttaatcttaactaattaaaagattcatatttttccgttcgtcactttcccgtttcatccgtttttcgttcgtcacttcagccgcgatcacccgtcgctcctcctaaactctttttcatcctcagaatcggattaagaaaaccaagtcataacaacagaatcctcgtatgaatccaatcttagacaggcacttttcaaaatcagtgtttcacagcttccatacaaccaaatcagatgcataacgaaaagcaagatcagaagataaacagcaaaatccaaaaatttgttctacctccagccaccgcttgagagacac

SEQ ID NO: 2262 - DNA, 3066 bp, Oryza sativa
aatctattttggcaattaattagagaagaaaatgttttttgtagacattttattttgtatagattttggagcggatgttcttttttttacagactttgagtcggacgtttttttattttttgtttacggacgagaagtcctgttttccagggagtcagacgtttctttcctttttttttacgacagaatttttttctttccttttttgttacgatagaattttattctcgccatttttttagttttatactgacaacggaaacatctattattttattttttttatttattatttattttagataatcttttttaattattttaattttaattttatttttttattaggtttatctactttaaaatattgattttctgttcatcacacaaatttctatctttatctcctgcacaaaggcaatcacactgttcgcccattcgttcctcccatatgctacatccatcacgcgtcgtgtcacgagcatcatccacatcccgtaaaatataaagtagattaattgtccaagaacaaacatgactttttgtcattatacacatcgtcaatgccgatgatcatgctcgggtgcttcgataaataattgagatcaaacttcagccacatctggtgcaacgcacgagcattttgctagtatatgtatatatatgtatatctatatgggtaaattaactggtgctacatggagtatgggctccaagattcaaattgagtatatatccaatttgaatgagtatgaatttttttaaaatgtttaggtatgaacattaacttcttgactaccaagttcaaacaaatttgaactgagtttgaactttttttttgttagattttggttctaggtatataacatccaaacatataattcgctaggtatgtaataatgaattgtgaaataaagttgagtctaatttattttgttgttaggtattggtatgaatcaaattcatatacctgggtttatactcacaatttaaatttttaaaaaaaatttgagagattttgtgtgttttatactttggagcccgggcaccatggagtcccatatgggtatcccatatgtatgtatgtatgtatgtatatgaaggttaaaatataatttatttgaatatcctgatcgaacagagttgtatacgagggtaagtgctaaaaggtcaaatttcagggaaatataactatttgatgtgaaatgtttctagatgaggttccaaatccttgggctgagcttaatacaagtggtgtgtaagacattttcatgtgccaattaccaaatgcgataaattcataagaataattgtcgcagaaaaatgttcactaaaattttaatgctagaaataatttctaggacgacttgataaagtcaaccaagtcctgtagggctaaatcagaagaaccacctttcgtagtgcattttgacacgacatcacccatctctctcatcctatctctaactactccaccctctatcccatccatcaacctctcaatcgctgcctgtattccccctctggtcagcttatcctcgacctcaaccctaacacccaccttccacatgtcacatacatacctcgccgtccctaactggtcaccgccacatggcttgcatatcatcggcacggtcctggatatgctctccagcgtcgagttccacccacagtgtgtcaaaaacgcgcctatagcggggtggctcaggacctcctcttgtggtgcccacctgatgatcctccctctgccacgtgtctcctcgagcagctcgctggggagctcgacggagtcgcgcccacggaccagccttggccggaccacccacaggaacggccggttgctggcagcgaggccccaagccacctccaagagctcgtcggcgtcaatggagacgagggtgccgaagctgacgaacagcacggagcctgggagctgcgtgttcagccattccaggcagctgcggtcctcgaggagcaggctgcttttctgcgtcgccaccgtcgctggtggcgagagcatgtggagggggccaacggggaacactgggatggcggtgtcgcgccggatctgctcgacgtcggtgcgctcgatggcgttgaaggtgttgaggattagaccagaggattggcggacaccggcgacgatgtgggcgagcaggctggcgtaggcgacgtgccgagacgtgtccatcatgatgtggaggtctcgcaccaacaacggcggatgcttgtccactggcatgtccagatttgactctgaacaacatatacgattgcattatgtagtcagtattgaatgaaaagtggtttcattcatcaagaggatatcctctcatttcttgtacctcacttagataattataaaaaataaaaaaaattgacaaaataaaataatatcagatagatcactatgtaaacatgcaggtacacaaataacaaatataaatataaatatatgataactagctatagtttaatttgttcttttacatagtgaaatttctatggaaatgtgtgaaatttctatagaatgcctcacttcatgcaagttttaaaagaaactaggaagaaagcctgcgcatgtgcacgggcaatttatttactgtttataaaaataatattaaaagaagccctatctcaccatattcactacaacaccaacttttgggtttgaatgtgggaacccacttgtgggtttgaatatggaagaagtgagttttttcgaatggagagagtagacaatagatgctaacagttgatacactaaacgatattgtcagaaaatttggatgtctttttaatagatattattacatctgtacctataaaaaaccaaatgcgtcattaataccaaaaaacttcagctctacttcatacccatgtctcatagatatccaaatctatatataaatatttaaaaattctgcttctaccaattaataggataaaatcgtatatgaatgcccctctaatagctgggtgaagccaattgtagccactaaggctttttccttggatgccttgacttatgggtcccgtattgatatagtcgtgctcatcacgaaa

SEQ ID NO: 2263 - DNA, 1234 bp, Oryza sativa
atggcaagagggtgagcaacgggtggcgtgaggcggcgccatggcgtggcttcttttaccacctcgcttggagtggtcgctacgcgtatgctcaatttgggaaaaaccttatagctggtaagaaaaagaaaactaccaaatgggacatatcatatccacactccttttttttctttttatatacgttgcatacgcatgtacataggagttgtgtatgtatgtaagggaagattagacagcctttaggatagaggaactactgtcatagatctaatctaatttgttgaaaataatggatcaccgattttgagtgtaaatcgatggatagatgttttgccttttatattttatttcttatattctctcttattagagggtcatgtgacatcttataagcgtttatatgagtgtaggaacactattactcatagccgcaatctatttatagtcaactattatttgcggtggattggttgcgtcctctatttaactactccctctatcccataatataaggtgtggtcaaagttggcacagtctccaaaactaatttttaacttataatttctcatatactataagatttgtagcaacaaaattataaccatatgaatgtaaatttaaatctcaatctaatgatataatttttaactaataaaatttattttatattatactaagtgttggtcaaatgttttaaagtttgaatcttgaaatgcgtccatgtcttatattatgggatggagggagtatcatttgttgaccgttatgcacttagtattgccctttatatttgtgcttgataacacacgtgcttattagatagatacctcataagtaatatgaaatatgacttggcgattagtggatagtggcttatatataaaacttacaaacatagggatcagtcaggacatacaattgatattttaggctaggattgaccaagtatattctaaactacataatatgtgttttattatcgaagtaataaatttaagagcgcgttctaacgtgtatataggattagatactcccttatttgtagcgagcacatttctcgagcggctaaatgctgcattacaaggtgcatgttattcaaatcctttatatatataaaagttgttttttaaaaaataaattcatttttagttttgtaatatttaatactcaattaatcgtatggtaataatctgtatcacttcgtgtgcctggataagctcacttaatgacg

SEQ ID NO: 2264 - DNA, 2027 bp, Oryza sativa
  unsure (1)..(2027): unsure at all n locations
aatataaatattggtggttttttaagctatatctaacggttgaaaataatggatccatcagattaaatcaaaaccaatggttaaatattttacttttttttataatatctctaatttaatagagtgccacgtgncggcgtattagcgttgtacagtgccacgtggtggtttgggagtatttttaggaagtttatttaacttttagtatataatagatagatagatagatagatagatagatagatagatagatagatagatagatagaagatttaacatgggctagaaccttatggaaatttttctttgagtatttatctttacttaaattcttgtatttttttctgcggttcaattaaacgatattttgtatttttcctatattttgcaatcatttattttatatttatattcatatcagaatcttatgttttgcttattcgtctattttttttatttctacgattcaataggccctgattattctaattagtctgctgaaactagttctctgacgaacacattttcgccgggccatttcaaaataatggaaaaataattctaattagaagctctgaataaccaatttatattgaggaaaaccatagccgcaggcatcagttttcatgtcttctttgtaaatcagttgtttcctaattgtaaattaattagtgggttgttttagtcatgtattccatcatattatggaccacacgtgggaaaaaagagaaagaagaaaccaagtttgtattcttcactgctaacttacattatcatgtattgaccaatgaccatctgcactctatcaaccctgaatttttatattcaccgtaggtgtggaattaatggacgcttgtgattgacgaacggtaaactttggcactgtttattataggggtggaaagttttggtgtgtcacatcgcatatacatgaatacacaattaaagtattaaacgtagtctaataacaaaataaattgcagattttatctgtaaactgcgagacgaatttattatgtctaattaatctgtcattagcaaatgattactgtaacaccacattgtcaaatcatgacgcaattaaacttaaaatatttgtctcgcaatttacacacaatttgtgtaattagtttttttctatatttaatacttcatgcatgtgttaaatatttgatgtgatagggtaaaaagtttctgcgttgatactaaacagggcctttgttgttatgcccaaaggcaggggatgtgaaccccagacaaaagagcactacatttagaatagttcgttcataactttatattgatagtgcggcatgatgcaaaatagcgtattactcctatctatcagtgcatctttacataatatattgtcagtgcatgaaaataaaaaaaagtaatgcttttaaaatgtaaacaacaagagacataattattactccttccatttcatattgtaaacaacttatttaagtttaatcaaatttatagaataatatagtgttaattaccttggacaggtaaatatcccttttcacacagccgagggtacgccaggtacaccctgaacctcgccgcgctgctggtcatcagcgccagcgccggcacgccgagctccctcgccgcggcgagcggcgcgaaccagtcgacgtcggcgaccacgcacgcgacgccgccgccgtcctcctctcctcctcctgccggagcgcgccggcgaggaggtcacggaacggcgccgcgcagttcctgttcagcgcgaacacgaacgacgggatgtcgccggacgcggccagctccggcgggaggccgtccggcacggtcaccagctcgcacccggcggggaggctccggcggtcgggcgcgcgcgtctccgtgtggacgacggtgacggcgaggccgcggtcgtgcagcgcggcggcgaggcggagcatggggttgatgtggccgtggtatggcagcgggagcagcagcacgcggcggcggccttcgtggccattccggtcgcttgcaggcgccatggcatcgagatg

SEQ ID NO: 2265 - DNA, 4543 bp, Oryza sativa
  unsure (1)..(4543): unsure at all n locations
aaagattcttttttcttacaattttcgagattttatttgaacgagacgacataagacagcggccatgtcatacgcatgagggtgactattggaacgattttggaatatagtgcaaatttttaatgctaagatccacacaatcttgataagaatgtgagatttaggggctgtttggttgctaccctgagagaaattgcctgacctaaagccagcctgagactaacacaggtcttgtttggttggtgcccttagattccaaacccttcgcctgccctgacgcagcccttcccgtcattagcgtgagctaggcgaccgaaatcgatcgcctgagctccaggcagcaacagcgatacatacttaccatcctaatctttatccaaagcggccacgcgacgtagattccaggagcgaagctgcgctgcttccgcgaagccgccgccgaccgccatcttgccggatccttgcgaagccgccgccgcccgccgtcttttgtaatccctgcgaagctgtgctactctcgctggcgtgcgaagccaccgccgttttgccggatccctgcgaagctgtgttgctcccgccggcgggtgaagctgtcgccgtcttgccggatcccagcatagcagcaccgcccatgctagatgctgcccaggctgcctttcgtgcaaaatagtaagcagatcgatttgcaggttgccagatgcatttgcacatctgggcagaatcatctgaaggttgtgctcctgatgcacggatttgggatctatttgactcttcgattgcgttctcctctctctttttttccctgcttttttttctagatttttatcctcgttatgtatgcaagatttgtgcttgtacatgggaagttgggttcataaatggatcttggcaggaggtttagatgcaatttgtggcaagatttgtgacggccattaataattgatttagctgtataataattaaaggcgtaattgcatatttgtttctcaggcagcaacaaacaaccaaacaagcatatactcaggctacctgaccaggctagatgcattgtcttctcgcatgccactcaggcgcacagaaatttcaggcatgttgctcagggcagcaaccaaacaaccccttagagcactaacagggcaaactacactaagtttcctcataaaaagagaactacacgcaggagaaatcactaacaagacacaccttccatagtgtaggtaccccgccatctcctcccctcccaccgccgtcgtcaggtggtgcggtggagggagagggagcgagagagagagatagctgagagaaagagagagacggacaggggaagggagggcgccgccgccaccttaagccgtaggtccgccaccatcttatcccctcccaccgccgtcgccgggtggtgcggtggagggagagggagcgagagagagaacttagagatggggagagagagacagcagagagcaagtcgagagagagtgagcgagagagagacagagagagagaggcgagaaagagacgtgcggtggagggagagtaatccgtggtagataaggacaagaaggatgtaggagagtgatatttagccttggttggtgtcaccaatcaggattaaagatatgatctttagtcctggttggtgataccaaccggaactaatgttcgttggggacctcacatggcctgacagctattgaaaagggactaaaactgattccaacccaaactaaagatcaaaaagtaccgctgggtatttgaactcggttcctattcgatctgggactgatgtaattttcgtcatccgtgtaaagattagttctccagtagtgacacctccaataccatctagaattggtccggatattgtccactagccaagcatggcatgggaagaagaaagtgagagatggagggttcaaatgatccaacgtgcaacaaaagatattatacctagcccaaactgaaaattttcttgtgatggtccaaggtgaaaccttcgtagcataggtagatcaatgtactatttactcttatatttatagtaggcactgaaatatgtctttgtaatccaggtatatcatttcctatgacaagcgtagctagccttaatgaatatatacatgactcatttttataagtttttaatagctatagctctcaaaatctttagcttccgtaaatagtctagatttttaactagattctaccggttagtagttagaaaatccatcaaataaaataaaagtcaaaagctagaaaacttagtactccctctagttttttttgtttgacgttgccgaccggttcgattaaattaaggaagctgtgaattgacttgtttgccttcacccttatccctttgcactgatacgtttcatccatgcaggggggaagaggggaaatttgcgtacgggaggagggcttctgaactgcgagcgtcaaacaaataaacccttttgagtatgaactggaacgtcaaacgaaaaaaatgggagggagtattttcatattcggaccagctaactactcgttagctatctctcaaaatatcaagctacctaaacagagctatagcatgctattcgcttataagattgattttgaaaaggcttatgacaaagttaaatggccttttgtacaacaaacattaagaatgaaaggcttctctcctaaatagtgtgagtagatagcgtcttttattcaaggtggccatgttggtataaaagttaatgatcaaattggtaataattttcaaacttacaaaggtcttaagcaggggatcctttatctcctattctttttattattggagctgatatgcttgctttattaattaagatggctaaagaggcggaacttttgaatggggtaattcctcaccttgttgatgatgatttgtctatcttgcaatatgctgatgataccattatctttttggagcatgatttgcaacaggtaaagaatctgaaattgattctatctgtatttgaaaagttatctggcttaaaaataaattttcacaagagtgaattattttgttttggctaggcgaaggaatgttatgatcaatattctaatatctttggttgtaaattaggttcttttcctgtcaaatatctaggaattccaatgcattttaggaagctttctaataaagatcggaaaggtattgaagaaagaattgagaaaaagcttagtagttggaaaggcaagcatctgtctgttggtggtagattggttttgattaattctgtacttttgagtttacccatgttaatgatattttttttgagataccaaaagaggttcttcgaaaattgattattatagatcgaggttcttttggcaagaggatgatcacaagaaaaagtacaggctcacgagatgggatattgccaacccaaggaccaaggggttcttgggattcataatttggaaattcataataaatgtcttttaagtaaatggttttttaagctaattaatgaggaaggggtttggcaagacttattgaagagaaaatatctttataataagtctataactcaggttgaaaagaaacagggtgactcccatttttggtttggacttatgaatgttaaaagtactttcttaaatatgggttcctggattgtcaatgatgggaaacaaattaggttttgggaggataaatggttaggcaacttggccttcaaggataaatatccatctttatacgctattgtctgaaggaagtcgtcttctattgccaccatcatgggttctgtttcgcttaatgtttcttttagaagagctttagtttgccagaatcttgcttattggcatgagttttgtgcttcaattgtacatatccagttgaatttttcttcggatagctttagatggaattttcattagaatggtatgttctcggtaaggtcaatataccttgcttttaagtaataatggctatgttgaaaggaataagtgcatttggaagcttaagatgccacttaagattaagtttttcatgtggtacttgcttaaaggagttgtgttgactaaggataatttggcgaagcggaattggaatggtagcttgagatgttctttttgtatgaacaatgagtctattcaacatctttttatggattgccatttcgcgaagttcatatggagagcagttcagttctcttttggttttaaccttccttctagcatatctcatatttttgatgggtggcttttgggtgttgacaagaaaaagagtaaactgatacttgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaa

SEQ ID NO: 2266 - DNA, 661 bp, Oryza sativa
aacaggccctttggcgatgccacgagaagcacatcagagcacgcacgctttcgatcggcgattacgtccactgacgggttcaaagccaagcagggcgtaacaagctctcacccaagtgggaaggaccatacacgatcacgcaagtcttgtggccaggtgcattcaagattgcagacggcgatggtcgcgagttagcaaattcatggaacattgatcaattacgtaaattttatgtgtaaatcaatagtatccatacttgtaagacatcttacgacttcaaataaagttgattttaggtaaagactacaatcaaagtgttccttcccgacgatcccttaccacgacgacacatagcgttgaaacctatcctcatgtccctttacgccgtcttgacaaggcctctgaggaacctaagtgaacttcggctggggacgcccaaagcgggtaaggccttgtcggatcatgtagggacaaacgactatgtaagatctgttcatgtaagagctcttgccgtgcgtattaaccaagccgtgtaatcggaaactgagttttccaacttcacggctaggggctagtgtcggtgacatgggaccgggggtatcgtgactagaggcttgggcagccgcggtcacccacgtggcctgaccccctcggggggcgt

SEQ ID NO: 2267 - DNA, 482 bp, Oryza sativa
gcctaatttaagcaaagctagcatgagagtgtactctctccttggaaatctgtagtcagtagccgagcctggccacttcgccttgctcgccagtggcagccgcgagcgcgccaaacgcgcggtaggcggcgggggcgcggcgaggcgcacgccgcggagcgcgtgtgtgcggcgtgtgcgcgcaggaggcgaggatagcgcggctccccagcgaccgccctcgcgcccagctcctcccctgccgccgccgccggccgcgccgtgcccagcctctccgtcccgcgcaagcgcgcacgccggtcgcccgtggaaaggagagtggaaagggcaagagagagaaatattaagaggctgacatgtggggcccacgtgggtcccacgctgagacagcagtcacgtaggataaaaccgggataaaaaccgccgagagacatattgtgactggctttgtatagttaagggatgtcggatatctggtttta

SEQ ID NO: 2268 - DNA, 701 bp, Oryza sativa
ttcttaaatgcaattccatttattaaaaatacttccttagctcaaataaatcccagaaaaatctaggaattatagaattaagcaaagtatttaatgaaattttatctggccccattttatattggaatttattaattaaaaattagatcttctcttcaagacttttaaaattatttctaaaaattccatttaaacaacaatttatatattttgaattttcagggtgtgacacgaacgtgcttagtgccgccatgcatccagttagcttctggacttccttgagttttgtgggcgacttcatgttctcgattgccttgatcttctcgggattttcttctatccctcttccagagacgaggaacccgagcagcttgcccgatggtactccgaacgtgcatttctctggattaagcatgaggcgatatcgtcggaagttgtcgaacgtttcccggagatcgtcaatcaatgagtcgcttgtgttggtcttgacaacaatgtcatcgacgtaggtctcgacattgttcccaagctgatcgttaagtgctccctggaccgtgcattggaaagtatttcctacggttatcagtccaaacggcatcttaaagtaacagaatacaccaaacggcgtgatgaatgttgtcttctcctcgtcctctttcgccatgctgatctattcgaggaagatggagtgatcctttggg

SEQ ID NO: 2269 - DNA, 4163 bp, Oryza sativa
  unsure (1)..(4163): unsure at all n locations
ctatgatctgttgccacagatctgcccatgaaaaaatctaatatggtgggaggtggactagccataaacgtgcagatcctttcaacgccgcttgcaaataattcaccaacacgttgtcgtctgctccggcagcgtaaaatactatggaatagacctgaaggaactcctcagggtcagtgctcccatcgtacttctatattgctctcggtcgaaatctctcaggctatcgaacatcacatagagcacgactgaaagctctacacccgccgccgggggcggtgggttgtcggtgatcgtatgtcctccgtggatgtctgtctgatcacgaggatgatgaggatgacgatgagtcacttggttccggggtacgaatacgaggatgacgtctaggttctcgagaatcctgtcgtcgcccaccgttgttgtcccgacggcgatctccgtcgtcgtcatcattttggtggcgtccttgatcagtctcgcccggcatccgctgttcgcgatcatcgcgttcgtggcggttatcacggtcttggttcttgctcgggtgtcctcctcgctcttcgttctcccgacgtcgtgaagagacgagatgtcgggaacggttttcgttgtctcgtgcgcgtcgtgcttctcggcggccattcaaatggtcacggagatcgctggtgccgcgaggtggaggggtggcttgacgaggtgatgcccgctgcccaggtagttcgccattggcaccgccaattggcgggtgttctgtcggtactccggcggcggccccctcgaacgcgttactgaggttagccactgattcccgtagtcgttctgtccactgtgcgagatcatcgttcagaacgggatcataaggggtttccctcagtattgcgttgatggccctgatgtgctgggccggtgtaaccacttgatcctccgcttatgcgttagcgcgcgcagacatgctggtcctatcgatacggaacacatcacatggtgtactcgtcgatgatgaggcctggtcttcgagcaagtgtagaaccgacagctcgtggggatcgacgtcgattaccccaacgaatcgatctgagataactgtcgctccttgttccttgtccgcatctctaagagagatttgtgactgctggaccttaggaggtgacgtcctcatggcactgagaagaaccttgcagcttgagaggtcgtgattctttgtcttgtgaatatgacaatagacatcacgggttggagaagtacattgaattccacgctctttgcaggcacagatctcagcttgtacgtcgagaaaaacccagcaagcctgcaaggtgtgtttcctggttttgtggataggacaccaggaccttgttgcctcagaaattgtccttgtcggctcgtgattctcgtcggaaggacaagatttggccgcattaggatccttctcgggcttggatgtcgtcgatgtgtaacatacctgaattctaggattaaggaatttccatcaaaactagttgaaagggaagttcttcaattttgtaaaccaaaaatttccattttaaacctaggtgaagttgatctaactcttgcatgataaaattttagaacaaattaaaaacctttgcatctctaacctaggacaaaaatataaatttatgtgtaagcatgcatactctcatagacatgtttgacttgagtccttcatatgcaattggatttggattgcattcggattttcgatttgcatatcataataggtctcatgaatattaactaagatctagataaacaactggaccattagggcctagtgctagctagaggaagttaaaataggaaccatacaccttaaaatatatcaacaaggccaatgccaagccccacaaaactattttggtcatccatctgaagactagtcatgaacatggaagtgaccaaataaattatatcatataggatatattctatcttaatcatctctataagcattctcttaatttaatactaaagtaaacttgtgcataataggtaaggagcttatgacctgtgtaaggtaaactgaaattctaacatatcattatcacctcaggttaatgagagtccaaatataacttttataaacatttacatgcttttaggaaaggaaacacatataagacataactcttgagaattatctaaaataattcgtgcaagataaaatcatgggaaaattcatgtaggctctactcaacacatacaactcactgtaattttggtatgatttaataactaaatttgtacctcaaataaatcagtcaaactaataaaaactagattaactgtagttcttaatcggctaaaaccatactttatctaaaagtgcatttaactgcatagaagtgtataagtaaaataatttattcaaatactaggtcatttatcattaataaaaataattttttcagaatttatcttctctgtttagggctcctaaaaattcgaactagtttccaaagaacccatattcctctaatttctgtgagtaatctatccataatttttgagtgcaaccaaagaaaatggaaactaggtacatacacctacctccagtaaaatcaacactagttaatctgatcaacacattaagtattgaagctacaaaattagaggagaaaataattccggaaattcgtccaaaaaccaagctcacccatgtttctgcctacacatctctcttccacctagtttacttcgacctgngccccccttgtcagtccctccggcttgcccttcctctgtgcaacttccctagccgaccgagaaacactgagagggagagatcgagcgccgaccggctctggacgccgcacgacgcgtggccacgacgtgtcgacgccctaaaaacgccgagctccatttctgcctctcccagacgcgtcgccactcttcacccaccattccagtgccgatccatcgagggagagcatcctcgctgctcttctccactggttctccatcgccggctgcgaagaagacgatggccgcaatcgttgatgagccgcggtcgtttcctcttctcttgcgttccatactctcctcaccatgccgaatatttctccttttgatttcatcctctctggtgcagccaatcggcgggaacgctgccatgcacaccggagctctggagcgcgctctgcgcaccgccgcagcaacatcgtcgccgttgccatcaatctagatcaagccggagcgagccaccacgccaccagcttcacctcaacctcctctccatttcccctcaagaatcttgaagaatggtgctacgagtgtggagatcgtccaccgtcttctccacctccggtcgccgtcgccattgtcgattccgcctcctccggtgagccattgtccgattcttcgcgtatacaccatccctgggacctcactaaccccatgaaacacatgcatgtcaattcgatgagtggatcgagccgttgccgtcttcccggagctctacaccgtcgccggaccatcttcttctccgctgccgctgtccagactttccggcgcctcgttcaaggttcggtgagcacccttgagcccataggattgcattcatgcatttcattcacttagaattgagcaccaactcaacatgcagtagcagcctaagcacagccgccgctcggactcgccgccggcgttactccgatgtccactgaccaagaaaagaagaggaatggaatcgcaatagcatgatcttcattttgtcttttggtcgcaccctcaaacgagccaccgtttgccgctggcaagcttgagatcgagctcagccatggcttgatctgcttcagctcgaaccagggacctcgtcacaagaatttaggttaatgtagggctctttatgcaaaagctcaagacacacagaacagtcataggactgcgggttgatttcctgaaactataggagcctttttgcatattggcctgagactgacagtgcaccccttggaaacaaaatctgaaattataaaagaacagtaactaaaacttgtaaaaatccatataaaattaaatatagctcattttaagatgattcaaatttctgtgaactcaccaaattgggaactttgatgttatggaataaaaacttgcactcacagtacaaatttagcctctaaaatttatccaagtta

SEQ ID NO: 2270 - DNA, 4106 bp, Oryza sativa
acacctataacacgttataacttgtaaaatacaaaaagaattcatattaactctaaaaattatgaaaccaaatgtgttagtgttagaaaacacatattttccacccccagcaaacataaacttataagaattaccttacaacagcatttcacaacagtaactaagtaaatcctacactataccgacgaaacttctaaaattcataactcccaaataaaatgagataaaatagaaattctttcacctaaattaattttagaccagtacctattcactgtgcacaaatcatccattttagagtattttggatttttcgcatatttcggtgtttaattgcataacgtgtactttgtatagatgattgcttaaacggtgaagaagtgatttaggtgctgacattttcctgattcaaggcaagtcccacctccatctctttgatcactttgaacctatgttttggaggttattgaaaatgtttgcaaatcttgcatgtcgattgtacactaataaattaaaattttgttaaacttgttagacaaactcctattgtttgcattcaccttgaccccacatatatccatatccctcattcctaaccttaggaacaatatgactataccactttatatatgaattttggagtcactaggttactataatgcttagccatgcttagaatggtcttccttgtcattatgggctcattacaaatatgaaaaattgattttgaaataatctggacagaactttaatacttgtgattttgataaataaaatgatggaaaacatggattttaggtttgagcctcaagtggtgcacatatggtgattagttgtgtaccgatagggggagagtgtgcccaaaccgacctaaggacttcactcaatgtcagttcatttcgtatacagtgcaaccacatgtgctagtatgggatagcccaagcttagtaaattatttatggtttagccttacattctggtaggccggtgtgtatgagttcgtataattcagaggagcttcctatttaccccgaagtggtagtttaggtgactaagcgtgtccaatacaacggtattgtgccacgtggtgggttcccgttgtgtccgccaccacggcgttaagtttaaggcgtgggcccgccacttaacggttctaggtcatataacatgtatggcttaggatggagtaacacgtatcgtgctggtgtagggctaaatcatgaattttggaaaagctttgttgcaggtaataaatcgggtacttatgtatcgcgtgacatgctcttgcatgattattatttcgtatcatgtgggtaaagtgtacaaactctgcagagttaaaactaatcgattagccgtgctcgcggtcatgagcggcgtgtggatatgtattgagtatagacttgtgtttattcttctaaatgctgaaatttaccttcaaattgtgatgagatttgagaatgatctccttgctgccatggaaggcaatgaggtgcatatttatacatgattaatgcctaccttgatgcccaatatgtcaaatactagcttgctgaaattttatttgaaagtaaacctgatttagaaatgttttatgcaaataaaacttgctttatgctaaaaagaaccatattatgccttccttgattatatgccttgcaagtagggtcttaggcttgtcttggtgcttgccagtacattatttctaataatgtactgactcttgctattgaattaaccttttgcttgcaggttttagatttagtctttgagtgatgcgggtaatcgactacttcttctaggacttgaacttaatggggtaaacccctagtcgatgtgcttgtggattgagtagacaagcttccgctgttctatatatttatttggtcagttggccaatgtaactaaagtagatgtagtttataatcgctttcatgttatttgtgtttgctatgtataatcatgcttgagatgaaagtgtgaatctagtgcacatcctgggaactagattcacatgagtatgagttaagaatatttgagatgttgtagatctttagccattgttgtcaagtctcctgaatgtgtaacacatctggtcaccgccttcgagtggtttgacgggcacatctcaggctgaagttgactggcaggctaaaggctcggcaatgtctccaatattcctctctcgaggcgtcggatatttcattatacttgtttgatgacttgaattatacatttcatctctcaattataatggaaggtccggagagcctacgacacgatgttccgttctccacttctgagggaggattcttcgacatggagccgtccagggttgtaaccacggtgttctcgcttccggtcattgatggaccagtcgagatcgacaccgtggtgtaaaccaggaagacgagtttgccgacctaagtccataccagcattgttgaagtagaaactccttggttgatgctggggttgacgctgttgtcgacgaagcttgatgacacttgagtaccaaagccccctacctggcgcgccactatcgacgggggatacccgtagaccggatatagagggtattggggtacattggtacgagaatctacgtaatacgacatcaagcaaataaaagacaaggattatactggttcgggccccttgataggtaatagccctaatccagttggtatgggattatatgatggaaaccacaaagacaaggattatattggttcaggccccttgataggtaatagccctaatccagttggtatgggattatatgatggaaaccacagattacaaagggaatagtagaactcaatgataccgacaagaccgtagtcgagttggttcgactagatcacccggcgacttagctcctgtaggctccgacttcgtaggctgtggtggttgtgttggcggtgagattcgatccctttggtcctcccggggggtcccttttataccgcgggtcagtcgatctccaactagaactcggagatatcggactccacacgatatagtaacgactcagttctatctgagtaggactccttccatccgtggactccgtttctgttacatgatggatttccttaacatgtacaggaaacatccgtatatgtgcaggtataccgtatcggtatacaacatacatccaagggtagagggtataccttatccgtaaccctaacactcgtcgctagtgattgtctgcacatcactgcttcctgagccctagtcttcacatgaccctgttggcatgtgccaccttagcattaattgacccctagccaccaacactccttgacaaccagcaccgatccctgagtcacccaacgatgccatcccccatggcataaggtctagccacagtttgccactatgttccatcttatgaaaatttgtcttgcctgtatttttcattttacatatttggatgtggatttgtttttgttgtgacacacgaagcctcgaaagatatatttagctctagtataggtcctatcaattaggttcatgttatgctagttagtttgattttgtaactaacaaaatgaaaataaatatattagaccataaggccgatcggccaatatataaagcattttcctaacactgtgttttattttttcaagcagacaaaatattttcacttttaccgtttgaaaataccaagaggcctcatatctttggctccacctatgaaaaattgacttttacaggcgaggtttgaagaggtttgcctatgaaaatacctcatattttcgcaggtggaaactctttagaccgtgcctataaaaattaatttttgctggcggggtctaaagtcgtctgtctagaaagtggggttatagtgtgggggcgttactaaaatcaggacccgatcgatccagcggagctcgcagcgactaagtcttggtagtctcctccttcaccatgcctccaccaccggttcccctccccttccctctcctccactactggcagcagggcagcatggtggtgatgggggctcctcccctccaaatctagctggaggtaggtctgcagcacctgacgatagagaggagaggcggtggcggatgctccactgccgtccc

SEQ ID NO: 2271 - DNA, 2690 bp, Oryza sativa
tggtgtcttgcatcgttcaacggtagggagaaggaggggcgatagcagaggctccagtcccctcccatcggtctcctagatttggttagagtggaggagatcaacgtttgtggcgacaggcgtcgtaaaaggagggtggcggtggcagcggcacgtggtagaatgaggaggggatgacgtggcggctccactctcccctcttccctttctctcccctccctttcccagatcctccgaggggaggaggccagtagaggcgacaaaggggagggtgaatgtggctcggctacggcaaccatccttctcggcatggcggcggtgactgctagtttcaccaacgacggccattggtgacagcgacaaggaatgtcgtgttgctatggatttgttttgttatgcgaatttgtgatgtttctgtgaattggatttgatttgattatactggatgggaaatgggaggtggattggattggatgggaactgggaagattttttttaataaccgttcgtcctattaaaaaaatttaagtaattactaattatttttctatcatttgattcatggttaaatatacttttatatatatatatatatatatatatagttttatatatttcacaaagttcttgaataagataaatgatcaaatatgtttaaaaaaggtcaacagtataatatttagggacggagggagtattacgtggcgagagtaaactgttcatgtaaaaatcggtaaaaagaaaaagatatataaacttaatttgcatgctcaataactagacatttaggcagagctcacatttttcattggagagatagaatggagttcatcacgaagttcaagagcaaggaaaaaaaatcaatgttctgtatagcgtaacatgagttgattattaaaattgcatgcatgtcgcgtataacttcctcgcctattgtcatgaggaactcataattaatttagtttcaaacttttcacagtttttacagaggtggatccgatgcaacaaattttggtagaaatttcaattcgataaagttgagtagttggcaattttaagttgaaacatcatggctcagtgagtagatgaggagtatcgataacgtcaacattcacgtgtttcggtctggagacgatagcttggaccacgcctgcaacaaacgtgacaccccatgttttatcgtggaattagtggatgggtatatgtgaaaattgtacaaatgatgaatgttgaaatgttatgaaaataatgtggggagaagatgtgtcttgcttgtgtgaaatttaagatgttaattgctagtggatgatgagatgacatactagtgggtatcaactatacaaagtatagatacatacaatcagggtttacgattctgacaaaatctagtccgatttcgtgaaatttcgacgtttcgatgaggctcgaaagtataaaccgtttgagatttcgaggagtttcatccaaattcaatttgaattgataaaaaaagaaaaaaatcaaaaaaatcttataaatactatgatattcatataaccaattgggatataaatttttgaaaaaaatgatgtattgtgtgtatttattgaaacttacatcaagaaagaaaagaataaataattaaaaaaagagacaaattaccgatcgaaatttcgatgatttcgatcagaatttcgctaaaaccgaccggttttcaagaacttgtcgacaaactcagggatttgtattcaaattttggtttatgaaatttgttcggaatttaccggttttttaccggatttcacgaaattccgaatttcgccggtgcccgaaacagaagagcctgtcgtaatcgtaaacccaacatacaatgatattttttattgttttggcggtggaaactagctctccacacagtttctccagccagttgcaaaatacaatctgttattttcattctttgctaattaaatataagttgtttcagatatccgcataatttttaaaatttccttactagttggtttttaactactaaatactacctttgtttatacaaacggtttttccctagtaaaacaatttagaggaagttgcaaaaaaaacatttttatttatttgtttatcatttcgcacaaggctgaaacgacttattatatatatatatatatatatatatatgttaaatggaggaagtagcttttttctaaaaaaaaatggatcaatatgatttttttagcaactttcgtatagaaactttttgcaaaaaaaagcaccgtttagtagtttgaaaagcgtacgcgcgaaaaacgatggtggggagttgggaactcctaacaaagaacgcagccttaatactataaccatccataacttttaaagtacttagtttcaaatcgtatgtccatacactggtggagaaggggtttttcaaccgggactacgaatccgggactaaagatcgctatctttagtcccgggtgaaaaaaccgggagtaaaaatccggttggtgttaccaactgggactaaagatacaaccgggactaaaaagactagatccggttgctctttattatttttttttcttcattgtttttaatatatattgatttcaccccatcccgtccccaaaatcccaaatcaatcatcctcaaattgcctccaaatccacaatcgatcatctcaaatactcaaatacatcacaaaatct

SEQ ID NO: 2272 - DNA, 1277 bp, Oryza sativa
actcaaaaaccgtaggagtgatcgatctcggaggtggttcagttcaaatggcctatgccatttcttcagatgctgcagaaaacgctcctccagtccctgtcggcaaagatccttatgttacaaaggagtatctcaagggaaaagattataacctttatgttcacaggtagaatcgacaacaacttcttaccaaattatatcttacttcttcagctccatgcaatttttgttaacttaattttggtctgtattgacaacaaaaggctgtggacctgtggttaattaaaagaaagcttaaaacagactaactcgggcttgattaatttctgaacatcattcagagttagttgtgtaacacaaggaaataagtagtaattatatactttaggcaatggtgatgatcagacataatcttgaatgaacagttacttgcattatgggctccaagcttctcgcgtcgagattcttaagacgaagaatgggcaattcagctcctgcatgcttcgcggattcaatggtatgtcccagaaaaaatactttaatttctagatttaaatgtgtcacattaataccgaatacgtctatatgtataggctggtggaatgattttcatggattttcgacataaataattgaggaattttagaaccccgcatgaaactatttagccagaaaatttcaaaacaaaatcattttttttctaatttagtcaacgtttattcaaataggggcaaattaaatttcctcttttttgcacggtcgcccgttaagaaatgttcaaaacgaaactgcaaacgaaaataatttgacgatttattcttggtcgatgacctcgacgaaggtacatacaagtacaacggcgaggagtacgacgcggcggcgtcgccggaaggggcggaccacggcaagtgcggcgaggaggcggcggcggcgctgggcctggacgcgccgtgcgagtcccggaactgcagcttcaacggcgtgtggaacggcggcggcggcgccggcatggccgacctctacgtggcgtcctacttctacgacagggcggtgcacggcgggttcgtcgtcgacgacgcgccgagcgccgtgaccaccccggcggcgttcgcggaggcggcgtcgaaggcctgctcgctgagctccggcgaggccgcggccgcgtacccggaggcgttcgacgtgcagttcatatgcatggacctgacgtaccagtacacattgcttacaaagggcttccgtaagtaattgcaaaaatatttcgtccattccaaaat

SEQ ID NO: 2273 - DNA, 1125 bp, Oryza sativa
agccaactagggagatgacgcttgtgaaacaggtcaagtatggggattgctacgtggggtcggcgtggccgctgggtactgccatagaagccttgtcctcccagaagagtcatcagtctgcatgatccatttagctatatcacgcaaggatgcctacatatatgtatgtgttctgattcacgtacgtttgagcggtggagaagatgtttggcagatttgagtagcaaattcataacactgcgcaattaataacttaataaaatggtattgtttgacggcaaatttatactgagccttgcatggtagttacatacactgaaaaatcttaatcctaatgggcctccaatcgaaggccttaggcaatagcccgggtggccagaggccacgttatgtttcacccatggttacggggtttaaaataaacttcttacactaatgctcaccggttgtcaagtctcctgactgatatgtttatttattttcagtcgttaaatttacgggcatttcactttattgccaatttcaatttggtaaattttgaggttaccgaattttggtagggtttttatgattagaaagtttgggaaccatcaaattttgctaagatgatattggtaaggtactaaggtagtgtttagttttttactctatcaaaatttacttgggttgaaagtgatggtaaagtgaacatgcccaacattctcatataaggattttcttttaactacttagatatcacttatgcttatggtgttgtgcataaagccatgccattccaaatctctgtggtatatatgttacaaatcaccacggtgcatagcatctcacaccatcacacgaaatcctttttatcgacggtcatttctatttcagtcttagcctatcccattcccatttagcaggtcgagggtaatgatatttctctcatgtgcattcttttaaatgggcttatatgtttttgggaaaaaaaaacccatgcacatggcccgaaaggaactgtagcccattcatatacatgggccatatgcaattcgttgtcatttacaagcatgaagttataggtacaaaatttatgtgtataaaatgtataaaactcatatgcacatattatatatatatatatat

SEQ ID NO: 2274 - DNA, 447 bp, Oryza sativa
ctcagtcccccacccaccaccgcagttgctccccccgctggcgagatgcggggcggagcgggagcccttccggtgccaggcggcctcgcgctcggggtggtgctgcttctagttctcgccgtgctgccgtcccgggcggccggggtgaacgtgacggccgcgctcgcggctttccccagcttcgccgacttcgcgcggcttctggagtcgagcccggtggccggggagctggcggcgcggtcgtcgctgacgctgctggccgtgccgaacaacaacctgccgcgctcgccctcggtgttcgcggcggactccggcgccgacatagccaatgtgctgcggtaccacgtcctgcttgagtacctctccccttctgacctcgcgcgcctccccgcctccgggaagctcgtgacgacgctgttccagaccaccgggcgcgcgccctccgat

SEQ ID NO: 2275 - DNA, 698 bp, Oryza sativa
ctggtgtaggccagtgtaagtcatccgcagcgagccgcggatctccgacaagttgttctcgagctccgacattcggtgctcgagtccttgtcgctgccttttgttgccggtcaccagctccctcatctttaggaggtcctctcgaacctccgccaggtcacgtgctagtttgttggcacgctcgttcgccgacgacgccgctaccctggcctcctcgatttcatgtcctacgccgcgagcacttgcctggagaatacgctccatctcggattggagctcccccaggtgaggacatcagcaggcgcgccccgagcgggtaaaaggccaccggcgaggccgcttggcgtcacctcccgctccctggccacgaccacgacatccgtcgaggccgctgcaggggatgcaatggaggctgcactggacccgtcttgcgcagcctttcgcccgcgccgccctgcgcaaaattcccacgatttcatgaagtcaggcaatcaagactttgcaaataggacgacttctaaagcatctacttacttttcgccgagcgtcaccagcctttgccttcgctggggtgggggagatgcatccatggcctaaacaagatagcacgatatgaggtcaaaatattctgactacatgaacgaaagacaagagaggcttaccgacggagtaggtgctttccgacggttcccgagtac

SEQ ID NO: 2276 - DNA, 1497 bp, Oryza sativa
cctgtttagggatcggggtgacacaactgaacaacttggaggacctaaacgagtgatctgcaagtttagggaccgggatgacacagtcgaacaagtttgaggacctgaacggtcgatttgcgagtttaaggaccgggatgacacatcggtacaagtttagggaccggtgatggactttactcttttctaaaggtatccgattttgatatatagccactcgaagatggagaacccaagctattactttgagggcgtcgtggagggttcaagcgtctatcccaaggatacggtagttgatctcgatgacaagcaaggtcagggtcacgagacaagcctattacatgaaagttattgagaaagatagcgagcgccggcgtcggctatgaatcctgttattaagccctggccattcagaggatgggaaattgatatgatcggcatgattaacccaccgtcaagtgaaggacataagtttatattggtggtaaccgattattttaccaagcgattccttcgaagaaagttgattctggggatgccattcaattcgttcaagaacatataatataccgatttggtctttctcaaactattactaccgatcagggttcaatcttcgtgtccgatgagtttgttcagtttgccgatagcatgggtatcaaattattgaattcttcaccttatcatgcacaggctaatgggcaagccgaggcgtctaataaaagtttgatcaagttgattaagcggaaaatttctgattatcctcggcaatggcatactcggttggccgaagcgttatggtcttataggatggcttgtcatggatcgatccaagtccctccttacaaacttgtttatgggcatgaggctgttttgccgtgggaggttagaatcggctctcgacgaacggagttgcaaaacgatttaacagccgatgagtattacaaccttatggccgatgagagggaggatctggttcaatcacggttgcgagcccttgcaaaggttaccaaggataaggaacgtgttgctcgccattataataagaaagtggtacctaaagatttttcagaagaagaacttgtatggaaattgattttgccgattggtactcgtgatagtaaattcggcaagtggtcgccaaattgagaaggaccgttccaaatttataagattgtctctaagggggcatatatgttgcaaggacttgatggcgaagtctatgggcgagcgctcaatggcaaatatttgaagaaatattacccaagtatttgggttaatgcatgatcggtgtcacgaccggaaataacccaacgggcgttccttacgtgcgtgcattaatccttgtcccaggaggcaaggtacaccaaaagttgatacagttcagagttcaaccagcggaagcgtaaatagttaatttattacatgggcagcgaaagccatcacacacaaaaacaaacgggaaacagcggaagactagggcgacgaccacaggcg

SEQ ID NO: 2277 - DNA, 4607 bp, Oryza sativa
agtttttgtgatggtatcacaaatagcaatgtagttgctagtggtgatacctcctaagctgaggtgttgatacttgtaggcacttatgttgatacctgcctaaataaaaaaaatgataccaactctgattcataggtaccattgtactgggttttatctgatatcatataggtactaggtattattagagtttttgtgatggtatcacaaataacaatgcagttgctagtggttatacctcctaagctgaggtgttgtcacgaccggaaataacccaacgggcgttccttacgtgcgtgcattattccttgtcccaggaggcaaggtacaccaaaagttgatacaattcagagtttaacaagcggaagcgtaattaattaatttattacatgggcggcgaaggcccagcacacacaaagacaaacgggaaacagcggaagactagggcgacgaccacaggcgcttgatggcaggcacgagctagacaccaaagccttcaacatccaggggctcctcttctgggtttgggaaaaattgagcaagactgagtacaaccaccgtactcaacaagacacacccatattatggggggttagggtttgcagtaaacagcattaaaagacacttagttgctcaaagctattttgtaaatacgatcctagagctatacaagattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacaactttacccacaagacacatcttcctcacgtgtaaccacatgccacataccatcacggtatacggacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaatccaattccacaataatccaacaattccatagtgtccaggtgatgagaatatcccaaagtctagagttgtaaaaccacctaatgttacctaattaaatagcgaagcatctacctaaaatcatactagtggtaccatgagtagagtgtccactagttggggttttgtttattctagggtgaacaaggaaataataacaataacaataataaggtcataacaaagctaaataggcatggctagataaaacagtgataacgcgggaatttaaataaagcgataatgcaataatttaaagcaacataattttataaactgggattcaatatgttcaaggatgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggctatttgaagtttatatgctctttaagtgaatatttacgaatttcttcatttaaattttaatttaaaaaaaaagtttattgcgtcagccgagggggagggggcgcgcggaccgggtccacgggagtggggcccacgcggcagcctcacggtccacggtggaccgggcgcacctgggctcgcaccggccggcgccgtgagcgccacgcgtcagccgctcggtgcgcccgaaggcggccacggcggcgcggccggcgggtggcggcgcgcccgcgccccgatggtcaccggcggcggccataggcacggcggagcggcggccgagagaggggaaggaatgggggaaaagaggcggcggtccacggctcaccctaggtcgacggcgacgacgaaaaaggcggccggagcggaggaaggcgccggcgcggctcgggtcgacagggtcggcgttccggcggttggcggactcggcgagggggtggacggggtcgccggcggtgcggcgaagccggaggaggagacgccggggcgggagacggtccggggcggcgacggcggcggaccggagctcggcggcaacggtggagagagagggcgacgtcgcgagctcgaatccggcgaggaggaagggcggcgagaggcggaaacggacggaggaggcacggggagggtttatatagggttggaagggggagagggcggccggaggggaaggaataggcgcgggaggtccggccgccatcaatggcgccggcgagatttgcgggggcaaatccgtccgtttgaatgcgagagagagagggaaaaatggggggaaaggaagacgggatcacggggaatatttccccccactttattgcacgcggggacgacgggaggcggcgggattcgcggcagcggcggcgctagggcacgggcgaggcggcgggagcggcgggaggtcagggatgacgggtgggccccacccgtcagcgagggtggcgggcgggcccgcccgtcagcggcgcgcccgcggggagggaggccgaatggtccgcggggagaggagagagagggagatgggccgaattcggcccatcagagagaaggagggattttagggtttttctttttataaaatcattttaactttgtttatttcttcttaattattatttgtgctctgaaaattccactaaaatttatttacacattttaggcttttaggaaatattcaaaaatcctccaagccttatttgacttttaactttgcacattttatttttggaggctttcatacggattttaattattctaggcatcatttagaggatgtattttagagtcgttttgggacgtgacaggtgttgatacttgtaggcacttatgatgatacctgcctaaataaaaaatatgataccaactctgattcataggtaccattgtaccgggttttatctgatatcatataggtaccaggtatcattagaatttttgtgatggtatcacaaatgacaatgcaggttctagtggtgatacctcctaagctgaggtgttgatacttgtaggcacttatgatgatacctgcctaaataaaaaataagataccaactctgattcataggtaccatcgtaccgggttttatttgatatcatataggtaccaggtatcattagagttttttgatggtaccacaaatagcaatgcagttgctaatggtgatacctcctaagttgaggtgttgatacttttaggcacttataatgataccggcctaaataaaaaatatgatagatgtaactatcgatggtgatacttctaaagtataaatatactctagttatatgtacttgtacttttgatgatgcatgcactggttcaccggttaccagctgcacacgcggatcccaggaaaagcctagttcttctatgctgtcatacaaaaggacttgactggttgtggggcctgccattgtgcatgcatgcacatattcactaagtgcatggaccccactatgcatgaccctactgcggcatatgtaccagacgcatatacttcgagagagcggaaacggaggcgggcctaaaggccatagagctgtttgtgtcacgacacgatttgagacttgatcccgtgtgacgggatcccgttatatagtttttctcatttggttttacggttcgaggatgttttttttatcccaatgataaattgagggaccttcgatgtactttttcctatattcttcgaggtctcaagatacagcacaaagcccattaacctaggtctaaaagagtacaggttagtggcttgggctggatcccatctgaccggagtggcggggacgacgccggtccctaacagtgtggctcctacggagcttctcacaagtcctgcatacaagcagcaagcttgctaggaactagctaatagtgtcatgtcctgaagcatagtccatctgatgttgaaagtcctggatttttcacattttggtccttttgaaaaacttatttcgcaagtagacccttagaaaaacttatcccaaaaatggtcctttttggggcgccagagtggctggcgccgtcgttcaacaggacggcgtcagcctctttggcgccgtccccctgctgacgtggcggggcgatgctgatgtggctaggggg

SEQ ID NO: 2278 - DNA, 2523 bp, Oryza sativa
ccagccactctggcgctccaaaaaggaccatttctgtgataagttttttttagggatctatttacgaaataagttttttaaaaggaccaaaatgtgaaaaatccaggttgaaagtccctcttctcctctccatttgtggagcgcagtggcggcagtgcttggtcggctcgtcgacggcctggctttagtggcacactctaggagtgccgacgagttctgtggtggtgccatgggctagtgcggtggcgggttggttgctgtcgcgcgctggctcgcaagggaagaatggtgagctgcttgacggtgtcatgtggtggaggtgcaatacgaggcatcggcggacgagctgtacgtgcggggtagagatcctcctttcctgctttcgcaaccagttatggcaatggcactcagcgcaacagcaggtaggcgtgctagtggcaagaccgagagttttgtaacagctggtggcaacagtgggttgtatggctgagtgtgggctagatcctccctagggctggacgaaaagctcgtggctcgttagctcgctcggctcgtgacgagctcggctcgaatcgactcggcgcgttacggttttgaaacgagccgagctgtagtttcagctcattaggcataacgagctagttcgagctggctcgcgagcagctcgcgagccttaacgagcttacacatagatataaatccccatgacaggccaagtacattagtcccccgtgcatgcgtctaccgaacagaaaagtatcgcttccccttcctctcatctatctccaaactccaatccagatcgagtcgccgtcggccgctctgagccttcgcgcctccgcgctgctactccctgcgtccatccctcgccacgccctgccgcaccggcgccgcttcctgcaccagatcgagtagccgtcggctgctccgcgcctccacgcctccgcgcctccacgcctccgcgctgctactcccctgcgtccatccctcgccacgccctaccgcaccggcgccgctccatgccgcaccagcgctgctccctgtctccatcctgtgttgccatcggccatgcatccttgtcagtcatgaccatggatgatgaagcatgaagaaacgaaaggatgctttctgctctctacttctctgtcacagtaggaggcttttctgattttgcttttcgcggtgaaagatttcggtgttgttgtgttagagtttcttgatgggagattgtagactttttcttatatcttttgataatttctcagataattttggagccatttcatcttgctgctgcgttctctacttctctgttgcatactagctctagcttgcgagcctaacgagctagctcgagctttcaaacgagctgagccgagctgggcttctagctcgttaggataacgagccaagctgagccagctcgttatcctaacgagctaaagcgagcggagccgagccgagccggctcccctaatcctccctctccatgttcatagctggacagggggcgacaagaagcataggttaagaaatgttgtgccggtggcagggcggactagatccgcaccgctaggcaagattagtgtatatgttgactgtcaaaaaaaagctttggcacaaatttgttttacactatttcacgctcgaaccataaaaaataaacaatatatttatcaaaaatatttaaacttcttcacctacattttattctcaacaaattacaaccttcctccatttagttgcatgtattttttaatatagatagtaaatattattggattagtagttggtcaaaattcaaaattgaacatcctaaataaatatttagacttatattttggaatataggaagtatatttttaatgtcatgcatataatcactgtaattgtatttgcaaaaatattttcgtatgatattagtttcttaattagttgttaatatataaagaaaaagtttaataatcaacatataatattgaagaccatgtgaaaaaactaatgcacgagggaatgaagccactaacgtgcaactcaaatttctgcatttccacaccaacaatatatgcgcactgtagccagtaggacactcccatgctattttgcactttaaaaaacagagtgataaaccatgcattgcatgcatgtggatgaccagaacgctgtttctggtcctgccgtacgtgtgcaccgttctcagcagcatgcatgactgaatcgcgttgtaatgtggatctcggtgcagttatctactggatctgacgcacaggcaatctagaccaaaggagcagtggatcctaatgctaactagatgacaccccaacacgttattgcgggatacttagtgtatacactgtagctgctagatttcaatattggattagtagttgtaacagaaaaactactttacagtattccgtggagacgaaataggaggataacgattgacttatccattccccttcgtcttcgaatttttttgagaattaatattatttttatggaaaatcgcaaaagtagtgg

SEQ ID NO: 2279 - DNA, 8302 bp, Oryza sativa
aaaatattttgaataattaagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaatagataagtcaaggacgatcagtgccctttgcacgcttgttaggtcctcccttcttcctatgcctaatctgctcagtgggatatgtcaaattatcaggggggtgcctatctctagctgcctgctgtggtgtcacttctggcccctgaccggcctccgtctcctgcgtcggctgtgtgacctgaggtgctgcgtgccagtaatccatccctacttccccatggggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgtgggttgaacataaggcggagtttggaatacctgcggacgtggtggtgccgtgctcgacgtgggtacccctgatccagctgaccccctggtgtactccggtgctggggtgagctgaaaggaaggacgatcgtgagatgtgtgggctgcttcgtacccgcgacgtgaagaggatggaccactccgatccacgctggaacgtcggggtagtggtggtgatggccgtcggcccgacgtctgcaccacatctgccgcgctccgataggagacacgacgtagtagtgcggcagcacgtgcacggaagttgcgaaggactctcgccacgtcgtcaggcctgacgactggaggtctcgcctctagtctttgcagcagggtgtcggactccacgtgaacgtgctcaacaaattcggcctgttccacaaataatcaaggcaattaaaattatttaaccatttgcatatttattaagagtatttaacaagatgcacatttgttagaaataatgaaccagttgcacatcatttataaatactgaactagttccacatttatgtaagaaaaggaactagttgaaccaattgcacatttattagacatactgaactacttgctaacttttttaaaaaattgaactagttgctcaaattccacaaataaacacgtaccattgagttgtaagctgatctaggctgaggggcaaacgtgtcagtaatcgctgcctggtgggggacggtgctatctctttgtggaggaaaacacctccatcgtgtaacactgcggtaccaacgaaggtaagctccataataactcccatcgtctggaggtgtctgaagtgccaagttatcagctgcgtgctcccactcttgtaccatcggctgaaccgtggtcacaataactagctcgtaggaaagcccgagcccctttctggagtacctgcttcacctctaatagtgggggaagattgtgataagaatcctcataagttccaaaccacatctccaatgctttctgttttgccctccaagccttgtcgtacgatatctcagatccgtactctttctcaacgtcatgcattatggtgaaaggggacaaagatgtttttctaaccacctttgaatataccatttgtgccacaaatgccgctgtcaggtttctgtgcaccagatgggtattctccaacaaacacgtatgttgctcaaccctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtaggcatctaaaccatcgtttaccttcatacgactcattgatatggtcgtccaatcatcgggtatgttagtttcgttgtcccacagtgttgtatcttctccttccactacaagcgcaatgtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcagcttgtccaccttccaatggagtttcttccaccacggcatgacttgactcccccgatcgatcaacacatgttgtcttctgcaccagtattgccaggctatagcctttctcccttactttactaacaaactttctccaactcccagttgacgcaacctccactactctccagtgccatccatgttgacccctcactggtcagacggcatttatgacaaatttatcgtgcactggatctaccccaaacatattatacaaccaccctaacacgtcgttcaaacgcatatgctccggtgcattcagactagtatcatggaaggcatatacagtcaaatccaccccgctatcacatatttgtataggagcatcgccataatacagacgaatgggcatatcacctgacatcctgataaaacataacaaatagtttcacgtttaatcatttaatcattcgataattaccctattacaacttatactacattgccgtgtactaatttacaactattagtaacaaacaactagtttaataatccaaataaaatataacacctttgtacctattttaacacacaacatatcaataatatgtactaactaagaactaaattaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgcaggagggtgtcgccaaccctttcctcccggccggcgcctcctcggcctcctctccggcctgctatcccctcccctcgctccctccggcgctcacggcgacgatgtggcgactctcggcggcggctggcgatgtggtcctcaaacaaatcgaacaagcatcgcggcctgggtggacggggctttaaaccggcctgtcgaatgcccattgttcgacagggtcggtggagggtcttgtcgaacgcccccggttcgacaggcctcgcggcgccgggtggtgggccctgttgaactccctccgttcgacaggtgagcttgtcgaacgccagccgttcgaaagggctttgtcgactgcccgtcgttcgataggtgccctatcgaactacacccgttcgacatggacctactttcgcgattttccccggttggccactacttttgcgattttccataaaaataatattaattctcaaaaaaattcttcgtattcctcctctgccttttatttcgcccctcctttcccccttgccctcctcctttttgctgtagagagctcctccatacaagcatggcggcagtaaagaaggcgaaacccctccccctcctgttggttaacaaccatatttggtagtgtcagcatcggagaggaagatgggatcgaagtggaatcgaagatgaggattgtcgtggaaacagaatgagtatcggctggagtctagatcggctacggttaggatcggctaagtctgagtcagattgggttaagtgattcagccgattccgacaatacgacttgtatacgacattgggttcaaattaatgtacttcaatatgattgccacgcacggatagagtcctggaaaggcaattgtatctattaattaggatattttatgtaaattccttatagataaatgtgggcaaaagtcttccgcaaagacttatgatatcttagagtttgttagagataacagtcgtgtccggtatgggcatatcttgtaattcttgggtataaatagaccccgagacctatgtaatttttaacacacacgttcaatacaattttggcgcatcgccaccttttgctttaattttatttcgacgagttcttgctttcgggttgagctgcatcggtttgatcttcaacaagaggtaaaacttgttatgataacttgcgttctcgggatttgtacttccatctttacgatactgtaatcttgtttatgtgattcgtcgagttatcatatatcttacgtaatctctggcaatatcgtcatctaacctacaatcggctaacatctatcaaggaaggcaaccgattaggttagatttcaatgttgattcagattatataagatatctaccaccctatgaaacatccagcggtttgattgtctagatattgtccttttcatacttaatgctgcatcagttgagtttgatctattaagtcgtgcttagaattacaatctctagcctgccttctggttgccgattagggtagtatcggagtttcagccgatctgatctgatttgacaatatttgctttatatgcttcattgacatgttaaatctgccctttatattaagatcttgtcacatctaagtatattaagcatctgcttgagtattttatctgcttcaatatcttaatataaagcagtatcggagtattagccgatacatgctagatctatttgatcagccatgctacaaacatatatataatctcgttattaatatatattttgatttaagtgatttatactgtctcggtatggtgaccgatctactccaatcacttgatttaagtgtatattgatataaagattatatattattgatatctacagccgatctagtagatttggtgttttgttacttattgatgatcgccgatcgattcacatacgacatcggctcagagataaatgatatgtcattggcaaacagccgatcggctatcatttatagatttaactacggtttgtttgtctttgtttcttgttgattgtaggatcaaatcaactggcacgcttatacattcgaaggcgagctttggacctgcactggagttaagcagatctcccaggtctcgtgttttctgtcaacacgcttttggcacgcccggtaggacactcaagaagtcagacaacctctccctcatggccgagaaacaacctccaccaccatctagcccaggttctgctaaaaacaaggcgtcaaagtcgggattggatgacatcattgaaaagaacgtcatgccaatcgatccagaaaagttcacacccgaacagaagaaagagtttgaagcaacgttgcagcaaacacgggatcagtttttgaactcatttatgcagacccgcaaggggacacttgttcaaaagtacaagataggagtggttgctgatgatcctgggaccggttcttctaaagatggagaaggaaaacaagctccagacggctcagctcagccgagtatcaaaggtgctaccgatggctctttaggaaatcaaggtgacatgtctcaaggagttcatggagttcagagtgacggtgctcaggggccacaaggagggaatcttaatcagaatagtgaagtggcacaagacttttttaacaatttccaagaccgggttgactatgctgttcacaatgctttgatcgatcagtccggggtgttggttaacactttgtcaaatatgatgaagtcaatagccgatggttcaatagctgagcatcaggctgcaggcccagtgtatttacaaggaggtgtcttcccaaattatcggcctttgatcactgatgctcagccgtctattcaggcagctcctcccattccgtcgccaccgcagccgacgacaccagcatcggctcccacgtttgctgcgcaacttttagctctgggccaattgatcaatcctcaattgttggtaagagagcaaccacaccatgctggaccaaatgtgacccagctaacgcaggatcaggttgcatctatatatttacctacttggaatacggttgatccaactcagcagcagctgattcaacaaacaccacccaggcaacaagttgtgcaacctgttcaacaaatgcccccaatccagcaggtcacgcaaccaatccaacaaacaccaccaaatcggccagttgtacagccgattcagcagacgccgttgagacagcaggtcgttcagccgactcggcagcagggctgaatggatgcatcggctgggtttgcagcacatgctggtcagcatgtgcagtatgctgcaaataagtcatcccagagcacttggttcatcacgtacaaccagatggcatagtgataccccaagttattcctaaacatttggtgcgtggtattcaaccgaaccttcacaattaccagggggcgatttgaattatcagtatcaacctacatcaccgcaagttcaataccagcaggcagaatcggctcagcttcagtttgttcctcaatacaataaatttgggcctataccacaacaacctcagggaacgcctcagcaacgaacatgggccgatgtgatagctgatgtgatgagggagaaatttgggcttaaaccaaaagaaactggaaatttgtaccgacaaccttatcctgagtggtttgaaagagttcctctacctaatcggtttaaagtgccaaatttctcaaaattttcaggacaagatactacatcaacctatgagcacataagccgatttttagctcagtgtggtgaggcatcggctgtggatgctttgatggttaggttattccggttgtcattggatggatcggcttttacttggttttcctctttgccgcatgggtcaattaacagttgggccgatttagaaaagcagtttcatagttatttctatagtggggttcatgagatgaagttgtccgatcttacgtcgaacaagcataagcatgatgagccggtgcacgagtatattcagaggttcagggaaatgaggaataagtgttacagcttgagcttgaccgatgcccagttagccgacttggcttttcagggaatgattgctccgatcagggagaagttctcatcggaagactttgaaagcttgtcgcaccttacacagaaggtatctttgcatgaacaaaagtttgcggaagctaggaagaactctaggaagattaatcatgtttatccttatatgtatggattggatgatgaggatgatgattccgaaatagctgcagccgagtgggttaggagcaaaaaggtcatactatgtcagtgggtgaaaagttctggaaaggaggagaagtatgatttcgatgttactaaagctgataagatctttgatctgctactccgagagaagcaaattcaactttctgctggtcatacgatcccatcggccgaggaattaggcaaaaagaggtattgcaaatggcacaattctgggtctcattctactaatgattgtaaggtttttagacagcagattcaggtggctattgaggggggcaagattaagttcgatgactccaaaaagccgatgaaggtcgatggtaatccttttcctgttaatatggtgtatacagctagccaaacagccgataggatccatgcaaggggttttcaggtgaattcggctaaggttatcaacaaatatcaaaggaagtatgacaagcagcaggagaagcattatgaggaatgcgatgatggttttgatcctcattggggttgtgagttcttcagattctgttggaatgaagggatgaggttgccatctatcgaaaattgccctgggtgcagtgatatcgtcgagagttcaagccgatcatataataggggtaatcggctgaagcaggcaagagtttctgttcatcaaagattgggtcctgcgaatcatgatcgtggccaagaggatgaggtaataaggaagaatcaatggtgtccttctagtattttcacgaagaatcagaaaagaagggttcaaagattgaggagcagggagcgcgtccaggaggttgaacaggaaattaaccatcggctgaggaaagcaaag

SEQ ID NO: 2280 - DNA, 721 bp, Oryza sativa
taccatcacaaaaactctaatgatacctggtacctatatggtatcagataagactcgatacaatggtacctgacggagcgtggggctcctcaccgggagaccgcgcaggcccccctttgccggttcggccggggaccctgggtgaggttctaagctcttggtttgaggaaggttcgcgagagtggaagaagcacacaagacacgggcgatgtatacaggttcgggccgctgagaagcgtaataccctacaaagtgttttggtggatctgtgtatgaagaagctacaaagtgcgaaccagccccgatcgctctgggatcgttcggtccttttttttttttctctcgtccgatccccctctctaagtgggcaaggtcctccttttatatcccaaggggataccacatgcaccatctctctcttttgtgtggggacttatcctatcttttcataaatggacggagatttgtatggttgccgtctgaatgaccttctgatgggacggcccatacctacctccacttccgccggaaacaggcgcgacgtgggaacatggctgtctgctgacgacatgaccagtgtcagaccggtctcaaatcggtcattcttgtccaccacgcgtcagtttatcaatctgcatgttcgcccttcttcatacaatatcttgcttgtaatggttaggatgaagcctggcatatatctgaccgggacccacgtgccatc

SEQ ID NO: 2281 - DNA, 1550 bp, Oryza sativa
ggtaccagttcctagtaccgttagctttgccacctatttgtatcatcaccaacctcttcgaaactcgtacctacctgctttttctcccttcatacacaactactaggcagctagctagcaatggtgtggagcagcacaactttctacatggcagagtagagaaaggaatccgatgggttcacatggcagagcaagagggatgaattggatggtgttgtgctacgtgggcatcagcaccaaggtgcacgtagccccgcgtgggtggatgagtggcagccgtgtgccccacgatttatcccgtacatgatcgatgcaacgggataccgtggactagcagtcctcttatatatataatgggttccttaactaatcaaaaccagtcacgcgaggtcctttgacggttttcaacccggttttgtccaacgtggctgctgagttagcgtgagacccacgtggaccccacatatcagctgaccacgtcatcaccctctcgcctcctctccggctctccctttctcctctctctctctccctctcactcttctcgtttgggtaggcagctgggtgcctgggaggtagtgctgcggtttgccgtcgatggaggtagtgctgcggcttgccggcgatggtggtggcgccgtcgccggcgggctcggcatccatgatggtctcgaaggccccgaggagcgctttcaccctgctgcactgccgcttctccagcagcttgctccgcgcctcctcgatcacgtcgttgctccaccacgccatctcccaccggcgaggctgctcctcctccaacctcttctccatcgccgtcttcaccctgctccccttgaccttctccgggatgacctccagcagatcttgccttgcaccgccgctgccgccatggacgtcgtcgtcggtggtagtgatcccatccaaggaacgcatgctcaccgactcggagaccttgccgttaaccgaggccgactggccgagttgtcgccgccgacgtcgtccttgctattcctccggcgagatgacttgctgctgccgctgcggcggaacgcgcgctgcatgagcttcctcggcgacagcatcgacgagtagtacgacagcgagggcgacggctgcatggctgcttggctgccgccttgtccttgtgggtggtggccggcggcggcgactcgtcgtcagtcctgaccgtcatgcagctgatgcctcaaaccggcatgaaccaatacagagaatatatacggctggttaaggatgttgagctaatttcctaatacaaagggatactgacgctaacatgtggggcccgcatgagtcccatactgattcagccgacacataaactaaaaccggcgtcaaaaccaccaaaagacgttgggtgatctgttttgtatagttaagggaccctgtatatctggttttacggttcgaggatgttttttatgccgataacaaactgagggaccttcggtgtacttttcccaagaatatatggtcttttggtaccgatggatttcatcataggctatcattaactgatctaatacaacctg

SEQ ID NO: 2282 - DNA, 849 bp, Oryza sativa
ttgtgttgtgcgaggggtactgtcacagctcctttctgagatacccgtggtggtatcgaggcgcatggtgacatgttgtggagctgtgtcttgtgggtacagtggtacacctctggccagagtaaaactattcgaatagccgtgcccgcggttatgggcgggtctaacaatgtctttcgtgattagtctcacacttcttaccataataaatgatgctataattggtaatactttgattagctcctggtttggaatggtacattcctggtttggagatagatccgtacagccgggtatgattgttcaggatggttggacctgtgcagcatgggtgtgttgttcagtgttgattaatattgatgattaattattctactgttttacaattctcaaatgtttgttaaatgccgttttcgcaaatgaaccctatattatgccattctttggtatccttgtgcacttgtatatttgttgtgtggcttgctgagtatgtcatatgctcaccttgcaataatcaatcaaacctcagtggaagaaaaaggatccagaataagaagacgtttggcttatacctcatttgagctgcctgtgggagtggagccggagcttcgctagaccgtaattctgctgctgtttttcttttcttttgtaagtatgtaacgttattattatgatgaatctgtatattatattgtcagtttgtgtacctcggctgattcctagacgaggatgtaatgcacaaataagttcggaaattactagtgaatttttgggcgtgacaaatatttcccctactacttaattaatggattagtactacagtaaagtaagattcttcaagctaacaca

SEQ ID NO: 2283 - DNA, 238 bp, Oryza sativa
cggtggaccaggcgcacccgggctcgcaccggccggcgccgtgggtcccacgcgtcagccgcacctaagggcgcgggcagctgacagccgggccccacacggcagccgcggggcacgcccgaaggcggccacgccggcacagccgacgggaggcggcgcgcccgcgcccctatgctcgccggcggcggccataggtacggcggagcggcggccgagagaggggagggaagggggaaac

SEQ ID NO: 2284 - DNA, 855 bp, Oryza sativa
  unsure (1)..(855): unsure at all n locations
tgaactaggtggcatccaagatcagcagcttcgactttctgacaacaagtgtgcaagtccacgagatattattttgacgaaaatctgatccacgatttattttttttcttttcttgggagaatcttggatccacaattccacatcaccacgtggacatcgagaaaacacgtgggccgtgggccgtgggccaccgacactttcgttacgtggggccaatataattgggcatcggcccatcactgctagtagcagaaactccggtaaaattatgtttttttgtatccattttaacttcacataatgccctctaaaaaattcttgacacaaacgtcgtatacagcttacaactctctgtactcatacactctcccaaatacggcaacagtttctacacctacgtgtacggtatttatacttcagcttttttccggtgatcgttgccaggatcgggcattgccggcggcgatcaagaaccgactctggccgccggcgtggcgtcgccgagcatcctgtggggcgccttggcgaggcaggacgccggcacgacggcgccggccgccttcccggacgccctgtggcagaacgccgacgccgcgccgccgcccacnnnnnnnnnnnnnnnnnnnnnnnnnnnnnnnncccggcacggcacggcgtcgctgcacgccagcttgatcgcctgctccgtcgccgacgtgccccggatgcccgcgaactcgatcttgcgcacctccaccgcctgcgtctgcatccacagagacgaaaaattcccaagtttcagagatgatgaactagtgctctgaacaatggcaaaagttcagagtttcagagatgatacgccgctttgcaggtga

SEQ ID NO: 2285 - DNA, 495 bp, Oryza sativa
tgagtgcatggttttgctggtcgcacccatggcagttaaggaccggttcgcgggatgccctggaagaacttatcgtacttaccacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgcattgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtttcaccctagtgtaatcttttgaatt

SEQ ID NO: 2286 - DNA, 1618 bp, Oryza sativa
ttcaatgaaaaatgtgagcaatcaaagaaaacaatgcactacatcaccttcacagtgtttccattctttccagttgaggcatgaagtctccacttgcagccatcactcctttgtgcgcatttcaccctatatctccctgtatcactcttctcaatgtcatagttgaactcatgtttgatagcatggctagctaaagcaatcttaaaagcatccatatcagaataaacagttcctactgtcataggagggtcattcttatcataaaaagcatcaggcatattttctggctccttgtctttaatttcatcatctatgtctttgtagacccccgatttttggaaatcggaaatcttctgtgtttattcgtaccaatccctggatcagtagttggtacacacatacatagttggatcacaacatatcacgaatgaatctaggctaaaagagttaaatacttacattagggccaggtaggccaacaactatcagagaacaacagcggaagacaaaataatataagggcccggttaacatgccacaggcagtcgactggggaacgagacctagaaccagaccgcactccgatcatcttgtgggatacgcaagcgtaccgacaagggcttctcttcaacactctcctaaaagatatataaatagcaagggtgagtaccaaccgtactcagcaagccaccacaacaacaatgcgtatgatagaaggtatttcaaggaaaggcttcaggttcttttgcataaagctaattttgcaattcttttcataagcctaagacctagcatagactgatcaaattttagtaccagtgttcactttaaacaacgacggttctgtccaccatccattgtgatcccaaggatagcttcccgccgttgaatcgtcatggttttctaaggatgtccaccttccctcctctcgggatgtggctccatcagcataaaattcatcatgcaatatcccattccccacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcctctcggccctacctcaacggttatcccattgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacag

SEQ ID NO: 2287 - DNA, 2145 bp, Oryza sativa
ggcatggcatattcacaagtaggatgttcatcattgcatgcaattttatttgtaaacaaaacaatttcgcaattcgatcaacatgttcaaggaatagtgatgacttgccttgctcaggataatccttattattgatataatcttgatcaaccttcacctcctggaagttgcagacgttgcctcacgactaaccgatacacaaggtctataatacgcgagaaaaaccaatattcaaacaacaatcaaatatgcacaaacaaaatatatttgctgaggtcgaacctagggttgctcatattattcgcgcttgctaatggactctaatcaagctaagagctaaggtttcttagtctttctgttgtcatggtggttcagtctagctaatggctaaggaaggattatggttacacatgcatctatctaaatagaacggttatacactagaggttctgttgccggatggattttggatcggtcaaataattactgtgaatcatttgtattattattttattaatggaggctttattttaattatgtacatatttcacttgtcaaaataaattataaaaggttaacaattacccatgctttgtatgttggaattgtttaggttaatcatattatggttacggattatcccatcacctaattttacaatgaataatccaagtttacagttgatctgtaattatacgaggacaggatgtataactagtatttatctaatattcatgtttgtcatatactccctctaaattaatatatgcaacaagcaaattaatacgataccatatatctataacgggatgtacaatatatgcgtgcataatatcttaatatattgaatcatttatttgaatagtttctatttactgcttggttaactaagggttgctcaccttgcctactatatgctattttatgggatatgtcgttgattaatttcatataggtgatttaatcacactagctctgttattatttgccataaacaagcttatgaccgatctatgtgtatctatattttacttacctaacaattataaggctaactctatttaaataactaataagtcgtgggttttaattatatttggacatagattagtaaatggcactaatattttcctgtacacccattaatttgaaggattgattataactaatttatttagttgctacagtgacaagacatgttaaagataattatgccactgtacaatatccattttcgatttatacatcctaaactattttgcgggtataaatattttgttagcataagtttttaatttaatctacccgagcattatatccatataatagggtagaaattttctatcgcgagctaagtatcggacgaaatcctggaaatattgtacgaattaatttagtctatgactaaatgattaaatataatacaagggaaaaatccgaatttctaccgtgaattgattatttatagggattacccaaaaataatctataataatctataataattcatcttatttgtttagtaattaactacatctaaattattaccgcgaattgatttcttatagaaattgccaagaataatccataatttatattaaattttgcaattctacgactataattaatccataattaaattctaattattttaaatcttctaaacttccctaatcttcctctaatttctatttatttttttttccttctttttctctcctcttttctttcttttcttttctttttctctctttttctctcttttctctcctttctttttcctttctttctctcctctctctctttttccctttcttctctttctttcctccctcccggcttcttcctcccttcctctctctctctcggctcaggctacccggggcggcgacagcggcggaacgagggaaggggcggcggcttaccgacgacggcggcggcgacggcggcgcaaggcgaggcgacgctcggcacggcacacagcgcggtgtggcggcaccgagggcggcagcgcggcggcacgagggcggcagcgcagtggcacgagagcggcggtgcggtggagagggaagaggggaggaggagggaaatggagtgggggaaagtggagagggggtggggtatttatagggaagagggggagaa

SEQ ID NO: 2288 - DNA, 15946 bp, Oryza sativa
aggagaggggaaagggcggcggcttaatggcgaccgacaccggcgcacgggctcgggacgacggcgacgcgcgggcggcgacgcgatggccgcgcgggacggcgcgcggcagcacggggctcggggcttcgaaggcgcggcagcgcgaggggcgacggctcgcggcgcacggcgatggcgacgcgacggcgacggcgtgcggcgcggcacgatggcgacggcgatggcggctcggggctcaaggtgatggaatggcgatggcgcgacgagacggcgacagcgcggcagcggcggcacggggcgcaaggtgacgcgacgggcggcagtggcgacgcgacagcgggcggcgcggcgcggggtgcgatgacgcgacaacaacggtgatggcgacgcggcagcgacggcgatggcgcggcgtggcacggggctcggcgcgcggcgatggcgacagggcgacgcagggctcgagatgacggcgacatgacggacgcaacgcgcggcgtggggcgcatggcagcggcggcgcgcggcgcgaggcagagacggcgacggcaggcggcagagagagggggaaagaggagggctgggttaggggaccacgtcgagcacctagagtgcaatgaacagtgccattttctatttaacccgattttagtttatttcccatataaatttaattctataatttctaaatcttgcataaatgaagtttactcaatatttgtgttattctaaccaatggattcaccctagattaatattactcatattttatttttatataatttatttgagttttaattagggttaattcttattccatcgtacttaaatttaattgatccaaatatggtcgcgataatattttatttatttctatccacacctaatctttattttaatttgtatttactcctaagcatttgggtgaccatattaagtgttcaaatgtgaatttgcccaaaatttaatattgtccaatatttaaggtttattaaagattctataattttctaatgagaccgttattaacacaatagcacattagctcaatttatttatatgttagtttattttatatggagaggtttaatatatcaaatttcaatccctaaatgcaattagtaacttggtgcaatatcgatctacatatcgaattaaatactcccgtaattctattatatatacagagagctcagtttatttgaatgatcatcatttcatgtgtacacctattatggcacccacctacattatttaaatattttaatatttgataaaataggttaataataactttttcttttatttgattttaatatcttgtgcataattatttgtaggattaaatatattcccgtaaatcatatctattgcttaaatgtagttcttttctttattttcttggtgatcatttacggtttggcaagcaatagcaatcataacaaccagcatgatgcaaaagtttaaaaagttcgaaattttcgtgattttcattgtcttgaattttcaggatgttacagtcttcctcagatgattcataatcagagtcagtctcattgcaatcatcatcaccagaactttcaccttccctttcttcagtcccaccttggttctgaggattagtaggaggagggggctggtttggacccatatcaatgtacaaaccttcatcatcaacacccacatgctcatacattggatttgggttacaaaggtattcagtttcatcacaatagggttcagtagattggtgttcagcaaattgattgagtgtgccacttgttgcttcaactaagcttggacatgcaatagaaggggtgaatgggggttgagcagggttcacagtgctttgcttagaacaatcccaatcgggaatcacagaaggctcactacttgggctatgatacgcaacagtcaacaaacatgttcttatagccctatgttttgcaaacatttcaaccaaatcttggtcattgcaaactaggatgtgagatttagtctcagtgcagaaaaagaacaaactgactttgtcaccgtatttatgaggatacttctcgaccaaatcagcaagcaggtccctgaattgagtgcggtctgcatccaccacttggttcaacgaaaaccaccgcgcacgacaatttcgagcaacaatccggatttctaagttgaagctactgtctgggtccatcctacagatgaacaagtagcacgcaatcattaaaccctaacacggatcggaagcgcttggcactaagcatcaatgcatcatgggaggcaattggggcgaaatcagcgaaatcaaaggggaaagcaaagggggaagtaaagagggaagcaaagaactcactcgtctaggaaccaatccgagcggtcgtcggcgccgttccacaccatggctgctcctcccccttcctctggacgcattgtcttcccccttcctctcgatgcacggtcaaatccacgctcccatgcttctccaagcccccggatctgccgccgctagggtttccccgccacggagagaggggaattgagtgggaggaagagagagagagagcggacttcaccgcatcggtcaacggtaacccttatgccagcgactgaaagggcaagatggacaattttcctacccgggcccatatgtcggagctgtcaaacggctcaaccctaacagaatagcgacggaagggtgtgtagggcgcgataaagttcgacgatggcattctgggaggctcaaactttttagtggcacagatgcaggggccatcttttttaatggcacacaggtaaaaacctctgtttgaatgggcctaactctcaagaaagaaataaaaagaaataaaaacgcccgtagtggggaggggaaagcaaacaagccctagttccgccgatggagaggagcgccggcgaggaggttggccgtggcgtcgcttgcgattagggtggaggcgccggacagcaggagggtggaggcgccggacagcaggagggtggcgttccgatgggtacaatctgttgtctccgatgccggccaggagggcggcgttccgatgggtgggaggaggggcggtggtgaactggtgacgccggcgtcggccagaagggtggcgttccaacagaagatatcctagctgttccaggaagctcgcgagcactgcttctctcgcttctctctgatttcgagaagtatatgtcactcatctctacttctagttatctctatcgacatctgtacatcttctagttaccgaaatctgcacagattcaacaattttactctagacaatatatagagtaagaatggggaaatggtgtacctatctctatctgcactggttcatctcattaactaggatatatagaataagaatggggcgatgatgtttttacccaacttaatttggtgctcaatcatgattatgtcctcctttttcttactttgtgattttgtccctgtttttttttttttgcgaactgaagctaccttttgcccctagttcagacttatgataattacaaagtatatgcaatggttatttcagcgaaagacaatctttactaccatctctggtgccactgggcgacgttccgatgggtatgaggaggggcagtggtggcgctggcgctgaccaggagggcggcgttccgatgggtgggagtaggggcagtggcgatgccggcactaacaaggagcacggcgttccgatgggtgggaggaggggcagtggtggtgccggcgctgaccaggagggcggcattccgatgggtgggaggagtggcggtagtggtgccggcttcggcttggattgggtgtgggactggcgtaatcccaacaggtagaaaattcttccatcaacactgaaatgattattgttggtaccagtgaccaagcctgaaatgatatgattgattgcgcaggtctgtgccgccaccaccaacagaagatatcccagctgtcccaggaagctcaggagtactacctctctctaatctccagaggtatatatgtcactcatttctacttctagttatctctatcgacatatgtacatcttctagttaccactatctacgcagattcatctaatcaacaattttactctaacaatatatagagtaagaatggggcgatgttgtacctatctctatttgcacaggttcatctaatgaactaggttatatagaataagaatggggcgatgatgtttttacccaacataatttggtgctcaatcatgattatgtcctcctttttcttactttgtgattttgtccctgttttttttcaaatcgaagctaccttttgcccctagttcagacttatgttaattacgaagtactatatgaaatgtttattatcggtaccaacgacctgacctgaaatgattgattgcagcaaaagacaatatttagtatcatctctgatgctgctatcatctctgcctctctctgatctccagaggtatatatgtcactcatctctacttctagttatctctatcaacatctgtacatcttctagttaccactatctgcacagattcatctaataaactatcgtcctaacactatcgtagggtaagaacactaacaccctaacaagaataggagtccaatttcttttttttctttttgtaatttacactccctcgttgtatggtgtttagacaacaaatacatgcaatgcgcaccaagttatcaagttttaaaaataaggaaaaggattagttaattaattatgtgtatagttatttttcttttgtgcacacctatagtttcattggtgtgtatacttatagctttgcatttggttagtctaacattttaaaattctgttcaaattaggcattctgagaaattatctgatacacatggatcagataaggaagatgaagtggtggattcttcagacgatgattgtgatccatattttaactatttggttgatagctttatgactgcaactaaagctcaaccaaaacagttgtatggcaatattgatcttgttgcagctgcacaacgtcagtctaatgagtatgcaagtagtgctttggattactataacaaggatgaaaacaataaggtaaaattttgttccccttgattgatttgagatgatggttcgcgtacgtggatgcttaaattaaatctctgtctaattaaaattatatgtttacactatattaatacttggtccttagattatacactaatgtgatattgtaaccttatagtgattttaaatggtggtgtcacatatacggatgcttaattagatgagtggttttaaacttctagctaactaagatgctatattgcactatatcatcctcggacctcaatatatactctaggttataatagcattgtattgatactaggttgttgatgtgtgagagagaaaaagagattttctcgataaaaaaggttttaagaggagattttgatatatttgtttaatatatatgtcatgtagctaaaatcatcctatttatatgcaaaattataccagtttgcccaccttaggagaccatatcctaaagttagatgtctggtttcaaattttgtggtgctagatggacttccactttaggtgggtatattgactgtttccctttttaacatttgtactaaaatgtcttgctcgtttcacaagtatttgattcattttttgttatttgcaatgtgttagattcaatacagcttaatcaaagccttaaaaagcagtacaattagagagaagggtgagaaatatggacatgtcaacttcatagcatctttagattcaaaggaagagctatttttcgccgaagtttgttgggatcccaagaactatgatatggtgccgacctgcattgtatctcttgaggagaaaaggagaattggttagtatggaatcactggttaaagttctttgaaccatgtaattattatgttcctaatcctaattctgttaataacagggggacgctcctttattaatgacgagtatgtggtgtgtctggatctccaaaatccgcctatagatggcaagcactgctatggatgtagcgaagagattaagcacccagaagatggatctacgtttaaggccgggcatgtagccgccaccggtttttatgattctttcatgtagctgccatcagttactattctttcttccgagtttgtataaaagctcaactaatctacccttaacagctgtttttactgttctatttattttgcatcttgtctacactagcagacttattttgtggctatgaatggatgaatatgctgcgttatgtatacagagttgaggtgaaagctttgaatggattacgatattataaatcatacaatatcatattactaaaaaaagatccatcccgttcattatgaaagaaacaaaaattttccatgggacatggactatggtgaaaatctgacaaaaaatcacgtgataatgttgggtttagttcacactaaaattgaaaatttgattgaaattggaacgatgtgatggaaaagttgaaagtttatgtgtgtagaaaagttttgatgggatgaaaaagttagaaatttaaagaaaaactttggaactaaacacggccatcatcatggtttcatgcgtttgatttctggaagtctgaactcattaagaacgcggttatttatattaggataaagcaccagagatttgttagccctgtcgctcgagttcatccgcgtatgcttagccgcgtgctgtcgcgtgtcgccatcgctgcgccatcggagaaggaaacaaacactgattaaattaaattaaacactgagaaaattcctccccaacttcttctcgcaaaccacctcttttatatacctcccaattcacaactctgaacatcacaaattcatttcacaagttcagagctccctgaacctgaaatctgttcgaaacagaggccctctcaaaattctcaatctgccaccgcatcaacgaggtggggcccagcctccgtgacgtcacgacactgacttggtgggcccacctatcaggcctgtccacgttgaccacatcgcgtcacaccgtccacgacttttttttttcccctgattccctcgcagccagggcaccactccttctagaggaaaaggatcgattttttttcttccccaatttcttcctggtgctcacctcctcctcccccgggatcttccagaagcttccagaactgaccttggtaaagaatctttctctctctggctttcttggtggaggcttggtttctctgttggtttctcctggtgtgattggaggttggcgtttgcaggtgcgggcgagatccaaggaggagggtttcctgccatggtgaaggataccgcgtactacgacaccctgggggtcagcgtggacgcctcccccgccgagatcaagaaggcctattacctcaaggtgaattcctttttgcgcctttgatttcttcatctttttttttcttgattgattgatttcgtgtgtcgtcatcaatgtagaattgcagatagctattggcctattgagctaatcttcgtgtgccaaattgatttttttttaatctctcttccaggcgaagcaggtgcatccggacaagaatcctgggaaccccgatgcggcgcagaaatttcaggtagttttttttttctttttctcccgtgccttctgttgatatctgtgattctgtgctagtaatttgatttgttggatttgattgtggaatgaaaagtaagactacgtgttcacaaaaacatgttttttctttatgaattggaatagtttactgcaagtgtcaaagctatgctatagctagaagaatgtgaataggctggagtttgcttgatttttaccaagtgatatcagatttttgcaatgcagcgcctgtgttacttgttaagaggcatagttttatcgtcggagatgccatgattttcagtatgagcatcttctgggtgttaagaggcagagttttatcgacagagatgccagtatgttttttgagcggaatgtttggttgtttggtgtatatacattgaagctattgtgttgattgtctattcggcatcaaatgcctgcttaaattatttccctctatgaattattgaattaaatagcttgatgttaacaggaactcggagaggcataccaagttttaagcgatccttcaaaaagggaggcttatgataagcatggaaaggaggggcttcctcagtaagtcacgaattttttttatgtctggtaaacaatgggtgttcttctcaaaagataaaagggtggcaactaaaaaactgtttaatctttaatctgaacaagtgtgctgagaatatagagcgggccaatttggtaaattaattgcacagtgcaacaagaaaattggagtgtattcaaatgacctgtcaatttctatgggttgatacttggtagatcactatttccttagctataaaagcacatctgtttaaaggaaaaggagacttctctaggcacgttatgaaattcaaacagtcagttatggaacacaatattttcagttaagatgatatttatagttcaatagaaactaaagaaattatgcgttgtgctgtaccctttaagttggcgtcttacacattttacacggcatttcagggataacatggtggatcctgctgctgtctttgggatgctttttggaagtgactattttgaagattatgttggacagcttgcactggcatccatagcatcagtggaagtcgaggaaaacttaaacagtcaagaagcaagagggaaggttcaagagaaaattaaagtatgttactctcgaagttccctactgttttgcttaaatagtttcattaaagttagcattccacttaggctctaggatgctgagacacaaattaaaactaaagcttcctgtgtgacaggagttacaaaaagaaagagaacagaagcttattcagagcctaaaagatcgacttcaaccatttgtggatgagagaaaggatgaatttgttaactgggcaaatggggaagctcagcggttatcccatgcaggtacatcatgtgattgtgtactactttgtttttatttgagagggctatatgctttctgcagtcacttttactttgtttgataaatcagttgctttcaccagcagattggcaaattggatatgattacatccacatagacatagattttgtggggtcttaattttaaaacaaattgtatagaactcatcgttgcacgttccctaattcactttattcatacgagtattttaccattggcttatcaaatgaatatttttcagcttttggcgaggctatgctcaccactattggctatatttatgtgcgacaagcagcgagagaacttggaaagagtaagttgtatatggggtgtaccattcatagctgagtgggtcagagacaaggggccactgcattaaatcacaggttaatgccgcttcaggtacaccccgagacactgttttgtttttggtgcaatatacgattcaagtactccttgataattagctcctgttgcaggcgctatcgctctgatgcagctacaagaagggatgaaaaagatggaggaaagtgacaataaggaggaccagattatgaagagtttcgaggagaaaaaagatgccatgcttagttacctatggaaaattaatgtggttgatattgagtcaacacttacacatgtttgccaagcagtaagtttttgcgtatccttgttagtggaagaaggcttgcatagtaacaattatgcactgtgcacgtcaaagaagaaagaactaaaaacatatgagttacttttgtgtaatcttctaccttacaggttttgaaagacgccagtgtcccaaaagatgttctgaagttacgagcaagagcattgaaaaagcttgggacgatattccaggtaagcttatgttaacgccttctgcctgtttcaaccaagtactcatggaaaaaccacatcagatctgcaaatgtcctttgtcttatactcttatgcatggccatggatggacgattggccaatatgcttactctctatgtaaccgtgcatcaaaccaaacagccaaaaacgaaccattgttgattcactgtttcaatattattgatcatcagttgaagttttgcgcatgaaccatcatagatgatcagttatgcataaaagacctctaatcaactagttccaatatataagttatgcatatgtgagtcttacctcatatatatcgtactaaaacaatagaagcagtggattaatccagatttcatacttgtagtgtctttcctgttgcagtatctttgcgtgcagctcatgtgttcttgttttgtagcatcttatctcgagtgagtttgatagcagtgcataggtgacagagcacacgatgattatattcacatgggttgtttttcaatgtaaaaatcagggtgcgaagtctctgtaccatcgtgaaaacagcctacaggtggaaaccagcccacggcagggagcagcaacatcgaactgaagactgcaaaagtacaaaaaggaaaaaaaaaagtacacctgacagacgcaatttctggttttttggaggtgtcgtctctcgtgtccgtttattcatttttgtaagattttagacgacgcgtatcgttctggataaaatttgctgtttgatttggtctccgttttctttgtaaaaatggtgatgctgtcgtgagctctgaacacgaagattttgttggtgctctgcaacctgcatattactagcttgggctatctcgttgtaagatttgcacccttttgttttgtctttcaagctggatgatctcgtgtgtgatgatgccgccatggcacctggcagtgtcatccatctggccacgagaccacgtgtggcatcgtgaataagctaaacaccatatttaaatttttatatacatgtttctagtgatctaaaaacaaaagctgaaaaataaattttgaagaaaacactaaaatcaacttcaagttcaaggctgaaaatttaaattttacttagctgataaatataagtataagtaaaaagacggggcctcacgacggagcatgagctgacctcacggtgccaagctcatgctctcgcggtgccaagttgtcgcgcactttagtgcttgccagtaagctaaacctcacctccgtacccaaagtatatatccaccaccattttcttgtggctcctgatcacaaagacaaaccattttaaccatttgtaatcagggacacaaatagtgtagtcgtattaattagacagcacatgagcggagcccctcccctggctggctttgatcatactaaatattaatcagctgcctttccgctcacttggctggcttaattgctcacatgttgcccgcaaaagtaggcccgatcggcgcggcttaactccaccgctcgctcgctcgctcgcgttcgcagtcgcacgcacgctcgcctcgcctcctctcgcgttgtgtttgtgtgtcgcgcgcgacgctcgctcggttcgtttcgcctcgacacgcgatttgatgcgcgcgcggtaggattcgccggcttttcatccgcgtgcacaccgttcacgttggtttttttctcgcgcggagatcgactgcactcaacgcagcaacactgtggcgggcgcccggggggggggggggtggcgtgatttccgtgtactttgatcccttcgtttcaaaactggagtatgatgaaactagacatgtcttacgtgctgattcttaatccaaggatgagtccaatcttattctggagtattttagaatggttacgtactggtacctctttattcaacgtttggccatccatcttatttaaaatagattagtaaaaaaattagtacatataaatcattattcatattttatcatctaataacaataaaaataataatcatatttttttaaataagacggacgatcaaaagttggacataaaaaataaaaaagtgtcgtctttctaatacggagggactagttttgtcaccatcatcgtcttcgatactgtgtcctggtatgtacgcgttggcccgtctgccgaaagagacctatattttgcaaagaggattccacgagaagccaatgccgcaatggagcccttcatcataaatgaggccatgaacggtcacggacgcatggatgtaattaattaattaattaattaattaattaattaattttagttgcacgctaccataattgggtcctgtttggttccatgggctaatgtttagccctcaccttttagcctcaaattagcccttaagaatccaaacatgtggactaattttgagctaatatgaattagcctctctcaaaacattagcccctccaaggggtgctaatggggctaattttgtatggggaccatcaacaagtagctctctctcctctctttctactctctctctaccttttagccttgaattagcccatggatccaaacataccactctaggctaatgtttagcctactaattcatgactaaacattagctctcaaaattagccctgggctaatctttcaaacagggccctggtagtttcacaaggaaacgctaaattgcaagattagcctagctagcattagcatggcattgcattggcaatttggcatggacagttttaatcttcctttctttagctgggccacacgtagtactactatttttcaagatggtataagcaaatatatatatgctatgctagcttcctctctccgttttcgtgaaacacaaatcaagggaaaaaaggctaaaagcgtgacagcaacctgtgctgcgagctaaggttttgatgatgtagtaattgattagttcatcacacggcggaggaggacaaaaaatcaacaaaaaagtacatgtgctttctcagtgacgtgcagaaattagtagcacaaagcatgatggaggagacgactatttttctctcaaaaaaaataatattattattatagtgcacaatgttctcgtgtgtatagtagtaatgtctcttattctaaccaaccagaaaaacagtatacattttctcaaaaaaaaaaagaaaaaagaaacagtgtgagtagagtccgggctagagaaaattaacatgtagtagtagtaataataataataacaatcctaatcttccaatggttctttatcctgtacgtgtagaatatactgtagtgtggtaaaaaaaaggagtggtaaaaattaattgatcagaagtattccaagttgaagtcgaattgagccaagctctgctcatggcatggtagcgagaacttgtgctccagcgtggcgtcgtcttccacctgatactcgccgccatagccactgtgctgctgctccatgtcggcgaagggctctgccttggcggcggcgtcggcgccggccgaggcggcccagttgagcacctcgctgtcgagcacattgctcacctcggcgcaggtccagttgctgctgttgctggagctctcgccgtagcccaggttctccgacacgtcgagcacgctgctgtagtcggcgacgaacccggcgccgtcgtcggggtgggagccgtacagcgccgccgccatgttcgccgcgccgaggtcgaagccggcgccgaagtcggtcaccgggaacgggtcgaacaccgactgcttggcgttcgcggcgaggccgtcggcggcggcggcggcggcggcggcgccgtggggcttgtgatcctcatccacctgggtgaccgccgactccgaggacgtcgccgccgcggcggcggcggcgatgggcttgtgcgtggccgggtcgaggccgcgttgccggagcttcttcttgaggcagctgttccagaagttcttgatctcgttgtccgtcctccccggcaagtgcgacgcgatctgcgaccacctgcaccacaccattattccccctcaaatcctttatccctccgaccaacctccatggctgccgccattgcaagaaagcaagcaagctccgaaacggcaatgcagaatccaagacatgaaaccgacctgttcccgaggatctcgtgcagcgcgacgatgaggtcctcctcctgctgcgagaagctcccgcgcttcaggtctggcctgaggtagttgatccaccgcagcctgcagctcttgccgcatcgctgcaaccctgcacgacccaaaaaaccaaaattagcccaatcaagctcgccaaatcggcaatggcgatcgatcgatcgatcgaacagttggtgtctcatttgaattgcgtgcgttcttgcttgcctgcgagcttggggacggagctccagcagccgacgccatgtcggatgatgtgattgtacagcttatcgtcttcctcgggagaccaaagccccttcctcagcttcgcctgcacgccgccgcacgacgacagccgtcccattcctccccctccctgcctctacctctagatcgatgtccacaacctacgtagctaccaccaccaccacctcgccgccgccgacgacgacaacgaacactagccgctcgccacgacgtcgatcgatggtcgatcagcctctataacccttctcctcactggctatatcgatcaaccgttgcccggtggtggtcgggtatatatggggaagcttgccaagaactcctgcaacttcagttagagagagacacagagacagcgagctagagagagagaataggtgtttgtgtggtgtggtgaggtgaggcagcgatcaagtggtttctaagcaagctgccactcccctctcgagctcgctggattagagctcaagatacctccatctcgctggataaaaatactgctagttcgcgccaaagagcctcacttaatttctctctctaattacagtgttagttagagatcagagagagagacagagagatttagtttccattttctttttctttttttttttgcctaagattgatttctgctttggacagcaatataatatactaatccagctagtacagttaagagagagactaaacactggttaatggcaagtgtaactgtaagccatcaatgagctcgatcggggacctgtgcagagaatcgcgatgtggtacggagaaaaatcgcgtcagatcatcgcgttttacttgtccaacttgatcaccccctgaaaacgcccgtcgtgacatgatcgaactgactgggaatcactgtgtttactactactgatgacagtaatcagctcacggccactcgctgatcttgagagagataattaatttaattaattgattaatcaaattaaagtcactaatctcactgatcgtttgatggatgtggcggagcgcaggtgctgtattagttgatggaagaaaagcggacacacggtaacgatcggattacagtggcgaagaatgaaaaatggagggaaaattggaattttagacgattttgctttttatgtttctctagcatttcattttttgtttaaatcagtgttctaattatgttttttttcctagcatgatccctttgatttaggcgttgggttacgtgagcatgacaactctataacaagctttgtgatcatgttcatctttttggtacggtcttaagtaatcaaggcggatgccctcttatatatacgtacctttatatctccagcttgccacaaatagttttttttagaaacaaaatagttatatattttaaaaaatatataaatacggagtatactggcatctgataaaaataaatctaaactctatctacaaagtaagaggcagagaaggcaaataccgtagtaaatagttcatgtaacaatctgtagattttttttatctgaatgtgtaggcttaatttaaacttcagaatttttttaggaaatttaagccttgaatcttagtagatagaacatatacttcctccgtttcacaatgtaagtcattctaacatttcccacattcatattgatgctaatgga

SEQ ID NO: 2289 - DNA, 22387 bp, Oryza sativa
  unsure (1)..(22387): unsure at all n locations
aaaacctttttttttgtgacttttacatagggtaaacttttttatatcttatttacttaaaaacatatagggagtaatcgtattctctaatgttaaacttgatacccgagatatcaaatctatgaccgtaaaatttctcttatacatatggtttaagaaaacgaggaaaatatcctcttaacacgtgaaaacactctccccatctctacttaaaacagaaatatcaaatatggtacaaccacaaaagtagcccgacctatgtagtgtatcaccgatcacctcaagcaacataagtttacacatccctgttgaaattttcttttaacataaaatttagtaccgttgatttccgtggccgtgccttgccctgccgaccttggtgtgcccatcgggctgtctcgtccgcgcgtcaatacaaatacgccacatttttccatcctcggacgcggtcaagtagcaattaaccccgctgatcgctgtctcgccgcgtcaccccccctcctttcccgccgacaggtggagccaccctgccatgccaagccatattttataacgtttgcgttaaatatgtgtaaaatgtattataaattaaaacttaaagatgataatagatatagtgtgtctggtatttacgatccttaatccagccagctgatcgagtatcgtaaatacacagacgcactataattacgctaaatcaaaagtaagcttttcgtaatcggtatctcaggatgtagatctcggctaaacctgcctaacctataacgtgtctcttatggtgttctttcgtgtttagttaccgtcggttttataacaactttcgagaaggacgagcgctcacttgctcgtgtgcgcgcacgcgcgcttagattagatagtacgtcgcgcgcctggacactgctccaggctgcgtaggcgatcgttttctgtttgcgtcgtggaggcacgcggcgacgacggcgacggatttaacgtcttgcctgctcacaccacagctgatcaaatctccagtagtaatcagcagtggaaatgatcgatatgacgcgcgatttgggagatcgaccagaaaccaatgggcgatcgagctgtgtctgaattctgatcagctgttcattctctgagcattacccttgctgtcttttataatctgtcgtaccgacagagaaaaaatatccctggcttattgccgtgttcagagaaggaattaattcaaacacatgtcgatggaattgtatgtaaattcaggctttggcgcacgtcctcgcgattgtccaggagtatgttccaaaatatattacttttaatcttaggtagattgaagtattaaaaaagttgatagaaataattggaaaaatactatcattgattgagaaaaagaaatgggtgagttaattaaatggagaatggttgttgagaggaagggatagatagaatagtttcagtcggggacaagctaaatgtgttagaaatagttatattttagaacgtaaaaagtactactgtaacaaatgatgagaaagtaaaatgaagaaaaagatgtgatgagaaagcaacgtgcgtacctgctgtcctgctgtaaattgcaatcatttttgggggatcagaaaaaggaaaacatcgatcgtcgacagcagcgtgtccacagatacggcgttcagttttttcaacccccttttgatttttcaaaggcccagttgttcgttttgttcttgttcgtcggtagcttatgtggcacagcaccaaattctgaccttaccacgatgatgccgtgtaaatcgtgttactcttgttccctttttttttaacaaaaaggtaaaccgtgttaaaaaaaacaaataaggggggtgtttagatcgaggggtgtaaagttttggcgtgtcacatcagatattatatagggtgttgcattgggtgttcgggcattaataaaaaaactaattatagaatccgtcagtaaaccacgagatgaatttattaagactaattaatttatcattagcgaatgtttactatagcaccacattgtcaaatcgtgaagcaattaggcttaaaagattcgtctcacaaattagtctcaattaatctatgcaattagttattttttagccatatttaatacttcatgcagatgttcaaccgttcgatgtgacatggtgtacaatttttgggtgggatccaaacaccctctaatattactcgatcgtagtatagtatatatagcatcgtttgatttttgtcgtgtaacctgctgtcacaaggttgtctgcagacgaaatcaagaaacaaaagcgatagaagcctgagagttactgaagaaaaagggtgagaattacacaatgtttactttggattcagagcaaaagggatgggaggacagaaggacagcaaattgggcagagagggaccagagatagtagcagggaagaataaagaacaaaggcaccatgatccttgtacttgaagggaaaaggagattttgtatacagatgttgcacgaggctgtgatcatcatcagataactcgacaagaggagtagatggatagaacaaaagaaagcaaacagacaagaaggaaaaaaaaaaaggtacaaggagtcgcctgtacggcatggtatatgtgtctgtagcttcaaatgtgatcgattctccaatcatccagcttctgatcgacggcgccaccagaaagtgttctgcacaaatcaaagtccaaaacatcacgttttgatgaagcattttcaactaggaatctcgaaatgcaattcatttgtttctttctttatttttatttttatttttcattcaggggaaagagcagagtaacacgccattgctgctttgcaatgcccacatgttgatcgagatctgcaattatcagcagccgtaccacacgctgtctccccacaatttctctctctcagcaaccgtttcaacacagggtcaaccgcgcaataatcagaacctgtgttcatcttttgaatttcgagtaaattgatgcacgagttgcacggccctgataatgcatctaggtgtagctagagctatgatgacttgaattgcaatgttgcattgttacagttggatttctgttgttagctccgatccacggccggctggttggtgagatgaggaggacggacactgtcactctgtcagtctgttacagtgatcatcatcagatgtaccacttaccttctacctctactagagagtgtcgacaggaagtaggagtactaattaagaacacgttctaaagagttaattgagcttaagtacttatttttcattagcattcttttttaattgctaaattgtatgtttcgtacgaaatctttttatatagaaagtacatttaaaaatgcaaataagtctatttttaaaagaaagttaataattaatagtaattaatcatatgctaaacatgtttctcaattagcgtgtacctattcagtcaaaactatactccgaaaagaaagtgccctaattaagggtctgtttgtcacagctcaaactccaactccaccttttcagcactagtgcacaatcaaacaattttagctccacgttaaaaaaattagtgtagcgaaataaagtgctctcacaaaataagtacttgtttggtttgctactatgtcaaaatattgcaataccaaaccataggcaaattttggtactaccaaatattttgacaacttatgcgtcatcttattggcatattttgatagcaaatcaaacactagtcaaactactattcaaaatacatggtagggcacattttggcatcaaaccaaaatggctctaaactagtagaaggatgaagttggatttaggttactttataactctatttcagaactaacttaaattcacgaattaggatactcccaaattggccatatttgtacgtatgtacgtagcttgcgggataacggcaaatgatagcgtctactcgctagcactacaccgagagcgagtgagagatcgatcgagtaggtgatggatgacttgcaaatgctacaaccacaagccaaggttggaagagagaggaaaacggaagccgtgcggctagctagcgtgagttggggaaagctagctaaaccaatttctagcctggctcgcccgcgtactcgcgcccgcgcgcgcgcgttcggtggcgtgtcgccgtcgcgcccgcgcgcgcgctgcatgcggacgatgcgtccatccatccatccatgcaaccggcgcgcgcgcgcggcgacggcgctggcatcatgccgccatcggcgagggtcgccgtcgtcgcttcgatcgaggctggtccaagaatcgatcgatcgaacggcagaagagaatgcaggagtagctagctagctaagctgatgacaactgtagctgctgcatgagctacgcggatgtgagtgatcagctttgttcgttgcctctacttcccagcttgcctctcgtttttcgcgcgcacgtttttcaatctgctaaatattgtattttttataaaaagcttatatacgaaagttgcttaaaaaattatattgatatattttttaaaaaaaactaatactttctctgtttcataatgtaagtcattctagcattttttacatccatattgatattaatgaatctagatagatatatatgtctaaattcattagcatcaatatgaatgtgaaaaatgctaaaataacttatattgtgaaacgaaggaagtacttaattaattatgcgctaatggaccgcttcgttttcgtgtgcgggacatgggttccaacccaggctgccgagtccagtgtagctggatggtgaggcggcaggctacgtaggcgtacgcgcaccgccggttcggtggcctggccgcgcaagccgcggcgagccttgcgtttacgcgatcgtcgatcgtcgtgtacaatgtacctagatcgagctagccctgcgtatgttcgtgcgagcatgagactgacagtcatgtgatcgatcgatctcaatcctcaggggaaatgatcaggggttcgatcgattcgtgttaaatttcggactcgtcaggcgacgctgataggatcagttggtactattggtgactagctacctggtcctctctcttttttctaagaaaaaatgattttattgtttgagaagataattaatgagagagatcgcgatttgtggtgttaattatggtacatatatattgagcattctaacatcaccaagggaaaaacattaaaaaaattgtcggataaacactgtaacactaaggtaataagaatgtaatagaaatatattgagtttcagactcatcagacgctgataggattagtttggtcttattggtgactagctacttggtcctctcctctctttttttttttacaaaaaaaagtgattttatgattcttacatattgagagatataatttctggtgttaattatggtacaccttgagcattgaagcatctacagaaaaagcattgtaacactaataaaaaataatagaaaaatcggtactatccctcctgtcaataatatttgatgttaggatagggagtatctttcagtgcgactgtaaaaaatatattaaaaaaatatctcctgtatttttcgttttgtccttcttttaaggaaagtcgtttcggccctttgacagtgcagtttgctcaatctcagacactgcagcaagcaacaaaattcaggataatcgacaactcgcgatatgcatccatgagtgaagtgaacagaggcattaacaaacacctctcagctgcaagcattttgttgtcaaataaggacagagagccagttacccatcacacatacgtactatcagggacaaaattaagctcgtaggttgtagggttgtatcttgtcctgttcttttggcaaagtttcaagctacttcaccaaggtaggagcgatttcattttccaatcaaagcttcaaattcagagcggttacaaaaacaaaaacagtggccattttcaaaccaaccaaaaaggcacgaggagactgggactggtgctgcagaaaaggtatcgtaaactaatcatctcgtccgaattcataagttgtcggttactgatcgattggtgcttctactcattcacaaaatgcatcactcctcacacatgcatctcgagtgtgctcgacctaattttcagatgtagactgaacatgatttcagaattcagtgctctagcttagctccaatactcccaacagtaataccagtaggagttaagtagtactcacatgttgggtttttcaatcagttcataaacccatcaaattaagatgtcatggaaaaaaatttcagacgtacgtcagtcgttaatttctagtcccatcacaataccagtataatctgttgactaataaggctgtgtgtgtatatgtaccttttgttctctccatttctttaagaaaactccatgcagtttggtactggctaccacagtgtggtacattcagtattgcagacaacaagtggacgaagaacacgagaccagggtatattataagcttataattaccagtgtgactaatacaaggtcgtaggtcgtgtatatgcagagaattatattgcagattccataacacgtagagtggccaatcgattagcttctacaagtgcatgtccctattgatggacaaaaagatccagccaagaatcttacatgagacctgatcttgacatgcctcctctagaaaggaaagggaaagtgaaaagcagctaagagagaaagaaaagaaaagaaagcacaggaaagaagcatgcatcatgctggctcctctttgaagttatgcaaacccaaagctagctagctaaactaaagccaaaaggaaattttatattaaaaaccgtttttaaaaggggccccaaaaattngtagtaagtgttaattattacatatcggattcagaatcatataaaactataaattggagtagccacatgttgattgtttagtcattgcgacgtcgccagaggagaggaggttggtgtgtgcagtgctatgccgttaccatcacaacagatagcgtgatgtgcacttgccttgcatgagtaacctgcatgattaagctgttcggtacaatggccggagagctagtagacagtggtgtttattgatttaattatattcaagccatgcatgcaaaccaaactgtgcactaattaagcaccccctcacctaatttaggctgctcttttttcttagtagggctaccactgtttcctctgtcatcaatcctttctcttgcttgtttatttacagcaaactgattagaaaattgattggactggttaaggtaggtaatcatagtagctagtgaattatctgatgtcacaagaaagtttgggaacaaaatgaacactgtagttaacattgtgcctagctagctttgcttgttttcttctgcttttaggcatgcatattgtgttttgggtgctgatcataaagctttctcttgccctgttagcaagatcagtttttttattcaacaaccattgagtaatctagaaagggaatcaattagtgtgtgatgagcttaccgactaataattcagttgattgattttccaacagctgaatacaggtgctgactgaagtttcacagaatcttcttattacccatcttgattcctgtactcaaaatgattttgtgaaactgaacattcagaatatttgtactattgtactgtactgaatttgacattgagcctctagttcattacaagtacagcttaggtgtaagatggtaccataatgtgaatcgcaagcaaccactattggaggatcctgcatatctttatctgctggttaagcaacgatatatattggttgaactgagctcaacatcagcagtataagaaatcaatcagcaaacgaagtttttattaaaaaaaagaataatagcaaaaaggttctgaacattgtggcttctgacaacctttgctactctgctccatcatcttcatgtgttgaagcttttttttcttgtttgttttaaaactactagaagctttacatttcttgcattgcatatatagggcatatatactcacttgtttccttcaaaaaaagtccatacactttgtgagttgtccctctctcttggtcactgatctttaatttctcaagtgatatttttgttggtgatcagaagatgccacctctaatccaagtttccatcatgcatgtcacaaagtaaaggcacaatggcaattaagccatcgcaaccaccttagataatcttatcaaataatcaatcctatctcgtccacacacatagccaagtaatattctagcactgtaaggtgcaaggaaatcttgcatgacatagttgcttcccatgaaatctttctctgacattgaccttaaacattttcttatcattcatggcaacctctgtgcatgcatgactactctgtcaaattaattccccttatcaaagccgttgctgtcctctgcttagtactcctactacaactgacaaccagcaaggtctgtactagatgactcagctacactgaattaagtgccaaaaacatcactgcgtagcagttgcatgttacatcagatacatgagtagggatgatagattgacgaactgatcaacacagcaaatcaagcccttgtttcaagcagccaagcatgcataccaaatgataatgatattatctccatggaagatgaaactgcaaccgcatatatatatatatatatatatatgcagattactatcatgcaaattggcatgcttgcagaataatctgcagcaagatatactagcaaattgtgcatggacagggatagatgttccctgcttgcaattgcaaagtcgctggcggcagcacacaagaaagctaaagagagaagaaaatgttcagagagaaaatattcggaataacgaccacgactgccaccaccaccatgcgtcgttttctctgcatgggatcgatggacgacgtcaatggcgggaagcttcttcccgcccttttgacatacgtggcaccggtccatgggccccacgtggcattttcgggaggtttgaccagcgaattcaagtgtcggcaccaacaacgagcgtcgtctgcattagctgcagagagcctgcaacctcgtgagtgaaaaggcagtgcaaaacgcatagaaattatgtgtgctgctttgctttgctttgctttgcttttgcatgcgatcgatcgtgctcgtcagctgtaacgctaatcgacaattgcacagtgacgcattgttcatggatataatcccatgtctgcatgtgaaaaatcccatgaatatatcacatgtaagattgttcataagggacaaggtgtcggattcggagcatgtacgcactaaacagcacgggaattaagatcgatcagttcgatgaatcaaactgtttctgccggaataatccagcggccggagaacagcaaagtgaatgggaagtttggacttattttttttaccgggggcttgtgcattggattgatctctatccgtcttaaattgggtggtgttcttggtgatcaagaatgcatgcatgcgttcctgtgctagctgctccgatcgatcgatcaatcaatcaaatctggatggacgtggtgaggaaaatgatgaacaccgtaccgaactgatcccaaccagtggtaaacggtagtaacgcagcggcattggttgcaaatcgtggtcggggccgtgcatccaattgacttaagggggcacgtaattgtatgattagctttgctgattcgtgacctctgaaaaagattactccttcctatacgtgaggtaatttcgacgcctgaatctgtgtaggatacattcacagagagagagagagatcgatcgatgagcaggataaattttgcggtgttgttcactgcagactgacttggtcccgtgtctacgcaccattgaaatatgggggctagatattcacaacatggagctcacgatgatcgcgctccgtgctagatggctctgggctcagcgggcctcccaatccttgtcctggtaggagccagtggcggatctaggatttatgtgatgggtattcggaattctaaaatagcagatatatcgataccgattgacgcattgactgtacgatacatcattttgatgcataatctttactacgaactatgcacatatataataaaatatatagaaacatttacaatttcctataatcagcatcaaacaattttctattgatctaagtatgagtgaagagtaccaaagaattcggaatttttggagattgtatagcataggtggacagctttatgtagcaaagatattctgatttattgctaatgaaggaaaacactcataaaaccacgaagaaactagtagctagcaaagaaatataacttatttccgtaggacaattgatatcaattagacaacaacatgtagagaaaaacaactgagtgggcaatatatagatgtatatacaatttgcaaagataactattccctctgtttcataatgtaagactttctagcattgtccacattcatatagatgttaacgaatctagacataaagtcttacattatgaaacggaggaagtgggcattaaagtaattgcttattaattgccacaaccaaaatgtaaacaagaaaatcaaattagcatgaatatattacaaaagaaagggagggactaggaagactattgatcttgttgggctgaggagagctagaaaagggtggaattgaattgttagggtataaatatcacaaatctagatagactatggtggtacatatatattatggtcaatatatattaggtttgtgtccaaaattcatgggtattcaactgaatacccatgaattacgtgggatccgcccctggtaggagcttcaaatcccatgttctaggcaatagcgcgagtttgttgccgcttccatgacttgtgttcttggtgatagcaaatatattctcttctaggaggagagatggctacagggttcgagtcttcgctcttgggcacccaaactctatagtcgcaacccgacgcgtgtccaccggaagctctcggtcgctgatgcgttggtcaacaaccaatggatccgtgaccttcgtggctccttgggcatccattcaatactgtaatacctgcagatttggtcgatattgcggtcaacaattctttccgagggccaacctgattcattcatctagaggtgggagtgggacagcttggggtcgtactccacccgctcggcctaccttgccctcttcttgagaagtatttcgttccagcacctacctatctggcgctctttcaccccacctcggttgctctatttcctgtggttggtcacttattggcgctattggacggttgaccgcttggagaagcgtggcctgccgcacccaacctgttttgtcttctgtgaccaaaaggatgaaacaatagatcacattctaattgggtgacccgagtccctacatttgtggtagaccgtcctcccaagtctcggcctccctcattgcttctcctctaacgttgtttccttccatgagtggcactgctcctgccgactcaaagttcagagggagcgtcgccgtaggtttgacatggtcatgacccttggcacgtgaggaaccactgcgtgtccaacaagtgttcccggccttggtccgatgtggttgtaggcatggagcaagagaccgccctttggcgtcttgcccatcccttgacgccaacgctctcttcttagcgtgccaggtcgtttggtcgttcaattgtaaacatgagaataggcttaagtccctttgtttgtttataatcaatgatttatctttgtgcatgtgtgtgacgaagactgcagtggagtagagaaaagatgcgtgcgtttgtatcgatcgctttcgtttttgggtcgccgtcgttttctcgccggtccggctagctcgacgtcgatgacttgaattgcaggagaagaggaggacaccggcgatgcatatgtcatgtctacctccctttcgatcggggggtctacacgtacgtacggggtggcggacgggcacctgtacagccgccacggcacagttgtgtgtgcccgactacctgccgcgacgtgcaccggtgctcgccggggaaggggggcagctaggccggccgcgcacgaggatttgacggcggcgcgtcgtgcgggaccggggggtggcccggcaaaatgtgttgggcctttctgatctgcgcagcgtgaacggcctatgggtatggggtcgtagtaactgaagagtccaggagaaaccgtggccatgggccggggctgtacaggtgaaggcgtgtagcaggagtgggaaaaggtgcacttgaggtccctcacttcgtcgtcaagtttcaaaatcgcccttgaaccaaaatagtactaaaaatcttaaacctccagcttgtaaaacaggaataaatttggtgctcctgctcctgcagtataggttgtcgtggtcatgggcagggtttacgatttcgacgaaatcgaaatttcgacgtttcgatgagactcgaaagtagaaaccgtctgagatttcaagaagtttcatccaaattcaaatttaaattgataaaaaagaaaaaaatcaaataaaatattataaatactatgatattcatagaatctattgggatataaatttttgaaaaaaatgatgtattatgtgtatttactgaaacttacattagaaaagaaaagaataaagaattaaaaaaggaaaacacttacatgggccaaaaccgaccgaaattaaaaaaggaaaacacttaatgattgaaattttgatgatttcaatcagaatttcaccaaaaccaaccggctttcgagaacttgtcggtaaacttatggaatttgtatttaaattttgatttatgaaatttgttcaaaaattaccggttttccaccggatttcgcgaaatcttgaattccgtcggtgcctgaaacggaaggggctgtcggaatcgtaaaccctggtcatggctcccatggcccctgcgcttggccagcacaagcgtggtgactgccggaagcaaaggcgtagccatcttccgtccccatgaggaagacggactggaggtgcacagttgcgagctccggggcatagttgacaacgccctgcagatccttcacctacacgatgcagcttcatcagctgcgggaagggctatgccgtcatcggtggtgtcgatggtgtggtgccaagccacagctggacgggtgcggttccctgcgtcggtgatggggcctgaagcaactatgttgctctgacggcggcggtacgtgaaagggaagatgattcgacgtggcgcgcatctcattttataactcattagacgatgattctagcctacttcacgcggtggccatcttttgccaccaccaccatcgatctcacggcagacgctcttgcgcgccgctcggtgcgaccgtccatgcggagaagaatgcagctagcaccgtcggtgtatcgatcggctgcatcttaacgtctgtgcagacgtatcaaccgatcgagattgggtaacgtacctcgcgcctaccgtgttgcagcaatcgctggccttcgatggctacggtcatggtctcgatcgacgacgggatctagggaaagataagagatgatggaaagtagagggccacttacatgtgggacccacttattttttttaattttcttttttctaactaggatgccatgtcagcaaaaccacctatccatatacctcatcagtcaaaactgggagcaaaattgccttgggaccgaatgtgacccgattttgtaagattagggatgcgttatatttggtatttcagcctaggaacgattttgaaattcaacgacaacatgaagggcccaagtgaacttttttccgcaggagtaaggctactaggccaacaaggcctagttttatgagagaacacacagagagtttggaaaaaagttcactttaggcccctcattgtcgtcaagttttaaaatcatccagaataccaaatataacgcattcctaatcttaaaaaatatcacattaggcagccacgtcaaaacagaaccataattaatatgggtcccacgctaactcacaaccacgtcagccaaaaacaggagtaatattgtcttggtacttaatgtgatctagttttataagattataccttgtatttcggtttagagacgattttaaatctcgacgataagataagggacctcaagcgaactttttctctagagggttacaggcttacatccagttttcaacgacgtggtgcacaatcaggtaaattttgaattttgatgatttggcactatattcgttgtcaaattgatttcattgacatttgtagagatgatacgcgggactatgagtcaataaaagtgagccatgaattaaataatcgaacccacttttatagagggttaaatgaccaaatctctctcgcaaatcaacagtattcaagttgcgtgccgcaggtaaaaaactgtggtgcttatgacgacagaaaagttttatgctgcacgcgcaatagcgtgatggaagaagacacgtcaaaattgtgcgttgcaatttggctgcgttctatgccccaggttggagagattttcagcgcacctaatacgaaataacttattaacatatgaataattaaatattactccctccatcctaaaatcaaaatataagtatttttattgttcagattcataactaaaaatacttatattttagctaaaaatatttatattttagcttgtaatagctaaaagttattacattttagaacggatgtagtaatatttataaattaaaaaatgtacttatttgattttttaaagaaaaattatatagaaaattttgtaaaagacatataatttaacagttcgaaaaagtgctaacaaacaaacgaggaagaactgaaagtaactctacgaaaaacatgagtaaattaaacagtacaaatgtggcacattgacagctggaataaacaacggagcacattgattcatcgccacacgtatctaaaaaaacttgtaaaacctccagtgcctcacctactctgcagtctgcactaatgatacccagccgcctgatagtgcgtcatcaggttttggcactggacggccatgaacgtctttagctatgacctcattcattcctcaatcaaacattttccgtccactctctttcacctaaaactgtacaagtcatgggtcctctttaaatgaatttttacaagttgcagcatttcttaaaatttctaactccatcgaacactatagcttctcacccaatttctaataatatacttacatcccaccgaaatcctttatatggatatttttatctatgtaattatatggatgaaatcctatatattctcagacggaggtattaatctagaaaatatgatattgatttttgataagttttattggtttttatataaacataagcatatttattcatattatttttaatccatatgattttaaataatatagatcgggactgacatgcttaaaccatcaactcccatcttaacaaaaaaaaaagaaagaggcatcactaaggcctggtttagttcccaacttttttcttaaaactttcaacttttccattacatcaaaactttcctacacacacaaacttcgaacttttccgtcacatcgtttcaatttcaaacaaacttctagttttagcgtgaactaggccctgtttagttcaaaagttttttttccaaacttccaactttccatcacatcaaacctttcatacacacataacttttctatcacatcgtaccaatttcaaccaaactttcaaacttcagtgtgaacaaaacacaaacacacccttgagaatgggctggcatctgggatgatagtactgtgcaggaggccaacacccagcagttgaggagtaggccatgaccatgaggaccacgagactgacagctacagtacccatcaacgtgacggaaactataaaaatttccgtttgatactgaattttgtagcaaaaaaacgcagatctggatccatacgaatactaatggcatcgtcgttttggctcgtctcctcccccgcgactataaaaacgggagctttgctgctgcgccggccgccccaccacctccggtccatctcggccgccgccgctgtcgctgtcgcgatcgcgatccccgcctagatagacttccccaagaacccgccgccgccgctgcaggggtggcgtggcatcgcgggagaccagctcgagccttcagccctcttttgcgccgccgccgccgccgccggtcgatccgtgttcttggctcaggcggcgtcaatggcggcggcgaatgggagcgcctgcggcggaggcggcgtggacaaggagaaggaggagttcaagcagatctacggggtgctcaaggaggagctgctcagggaccccgccttcgagttcaccgactcgtcgcggcagtggatcgatcgcgtaatgcttttctccccctctcctttttcatcttgtgttgctgaccgcatgtgtttctcctcccggatcgtttcttccggattttcagtagggtttagatcgggtaaatgattggtggaactgcaattaatttagtcgcagcacgtgtaggggttcgcttgtaaattctggatcctcagttattagcattgagtgattaggcctttttgggaggtttaatcttggttaaataactagtagtgttatgttggagtgaatcagcaagtgcagtaaaggttggctcaaaattcccttttgttaaatgagctgctccaattctgtctccatgtcaaaaggagaaaaaataataatgctcacatttggaaggcaaaaatgtgatattttgggttaagtgaattcttggggtgataaagcgtatgattattaaaccttggcctactgcttaaccatagatggatcatggatggtcggcttagtcgcctactgctttctccatttgctactttttttattatatataatgtaaagcttcacaatagattgggtgtacgacagatgatcttatcagttaaattgtcactgttgggaactgctcaatttaacttgtttattttctttgaagcagatgttggactacaatgtacctggaggtgagatggatttgacttgattagtctataacatatgagtaaaaagtaaaaacacactaaatctccaacctattgtctttgatatggtagggaagtgcaatcgtggtctctctgtggtcgatagctataagctgttgaagggcaccaatgttctaagtcaggaagacatgtttctcgcgagcactcttggttggtgcgttgaatgggtaatgctttaacctcaactttccgaataatgggtgcaaatcaactaaaattgctcctctaagctttactgttgtctatgtagcttcaagcttactttctcgtgcttgatgatatcatggatgattctcacactcgacgtggtcagccttgttggtttcgggtgcctcaggttggtgaatctgaaattgtcctatctgaatggtgcattgcctaattatttactgaaacaaaacactcattttactttatagtacctttctttcacttgttacatatgaaactttatccctagtgccgccatttgttgcacaataggttggctccattgctatcaatgatggaattatccttcgcaaccatatcacgcgaatgcttcggctccactttagaggaaaactttactatgctgatctccttgatttattcaatgaggtaattttacattctgatctacatacacggttagtctgaactttcagatcattgtggtcttactgctactatcttgttttgctttcctaggtcgagttcaagacagcttcaggtcaattgctagaccttatcactactcacgagggagaaaaagatctaaacaaatataacataggagtgtaagtcaacgttgtaacaactttggaaataactattttgcatgctttatttaatctattcttagaaccataagcctaatgtttctgtcatatatggaatggattggttttatctattatatcttcaataattttgattttgagattgttgattcaaaacttcctgtatttttgcagtcaccgccgcattgttcaatataagacatcctactattcattttatctgccggtaaaatttatattccattgccatatcttcgtttatgcaatccttgttttgttaataaatactaattgcgagtggtactgatatgctgttatatcaaaggttgcttgtgcactgttgctatctggagaggacttgaccaaatatggtgctgtagaagacattcttgttaagatgggaatatactttcaagtccaagtaactcctatttctgccacataacaacaggaggaatttgactgccacgagtattattctactttcaattaatacgaatattttcttacaggacgattatctagattgttatggtgaccccaaatttattggcaaggttagtgcatttacctgttgtagcagcatagatgaacatcaatatctatattgatatttgtttagctcttgtagtttgatcattttttatgtcatattatagatcgggactgacattgaagattacaaatgctcttggctagttgtgcaagcccttgagcgtgctgatgagagtcaaaagagcgttctatttgtgagccatctccatagtcttttttgatgctgtgaaggttgttgtctaaacacttgttctgctcctacaggaaaattatggaaagaaagatccagcctgtgtggcaaaagtgaagagcctctacagagaactaaacctagaggtttgccttgactctatatgctttatatgtttcttcatggggtttaccttattgtcaaaagaatcttactctcttgtaaattatgatttctatagcggatgttcctgctttgtattatcatggcctacttgtttagttgctctacctagtctgaatttcgacatctccaaccattatattgagttcataaccaagtctgatatcttgtttattacttcattcttaggcggtctttctggactatgagaacgagagttacaagaagttgattgcggatatagaagcccagccaagcatagctgttcagaatgttctgaagtccttcttgcacaagatctacaagagacagaagtagggggggtttctgtgcaggaagctgtccattgttgcatgtttcttctctagcaactgatgttgtatgttgcaatttgctgatcttggataataatgttgcaaggtgttatttcgggtgtgatggaccgcttggtgtagacattagacaataatacatgagctgtttgtcttgttattagcatcatagccgcttgttttcttttttttttctttgcacgagttcaagcaagtcagttacagggtaatatgcaagttgctgtagtatttcttttttctcgaaaacgcaagaggcttgcgcttaatgaaatttcattaagtaattctgaaggactgatctgagtggtaactggtaaggcatatcgcgttatagaggttaaaaaaaacaatgcaaattcacgaatccaatcaacactcaaaaggagtacataattcaagggtcacttaacacagatggaactcatttccaactctgagaagaaaaaaaaaacaatttactgagctagttcctgttcagtcacaaggaagcatatggtaacaaggacaaactttttatccaactctatcagttcatctcaaaaaaaataaagggaaaaacccggactcccttgaagatgctgaagtccgcggcggtgggaaagcacacaataaagaataaagagaatattatgagatcttgagcccagaatattgtgagatcttgaacccaaaagctttagcaataagaggtttagcttataattttctaagcactagtgccactacctaattatgtggccatgttctatggatagttgcaagcttacaataagcaccaaaagatttggaccagctgtacgatttccatttctgatgatgcactgagagaagtgcaaaggaagattttgggtgactgatgcagaaaattttatgtgtattaacaatagccataagagaatacaatgggaaggtgtacatcatcattttttgccacagatggtaataaagagattgatacttcatacacgatacccatcttgtgcaggaaagaacaggatacaagtgtttgttgaatcagcatatcacacgttccatcctttttgctaggcacctaattcgaactggaattgttgggaatccagaaagttagggcagttgacgcagttgcaaacattgctcgacggggagcccacttcaaagcagtgataggaccgatgtgactgttccaacaagcaatctacaaaaggaaaaacacttaagaggcaaagaacagcatattaaaagcatgatttaagaaagagcacctcttgtattgtattgatgttccaagcatgcaaggtaccatcaccagatcctgcaaaatcaagcaaaaaggttttcaacaaaagctttggccacagcctgaaatattggtatcaaaaagttccaagttttgttaaatgttagagcatatataggccttcactttcagcagtagtggaactgtcaataggcaacagaaactatagcatatataagttatattggtacataaaaagcagtatgagcatatcatgccaacaaaatatttctattcggatggttaaaggcatgttgaaggcgaaatatatgctccaattatcattaggtctgttcttagtagaagcgacggtcgcacaaggtaagttaggagcacttttagtagaagttttacttacaggggaaccagttgggtaaattgttgtgtactactagttcatatcggaatatatatatgccaaatgatatggcatacaaatggaaaaacaagaatatcatacctgaaattacatattggccatctggagtaaaagcagcttcagttgctacattgggagatgactccagactaaagccacacctctgcaaaaggattttgagggtgtcaatgatttgatttgaggaaattatgcacttagttcaatttgaagcatttttttctgcaacagaagtaactgaccttatcccctccatatgcatccagaacatatatatggttgttggttgttgtcaaaagcatggacttgccatcattgctaaatttgatgtcagaaacttcagctgtatctccaccaaccaagaaagtgtcaaagggaccctgaaattgtatttggcacccaagataagaacttccgcaagccttataggaatttacagtttttgagattcaagctgaataccaactttgtcatatgaccgggaatcaaatagcttaatagcacctccttccattgccacggcaaaaacaagtccctgctgatcatatgcaacagaaggcctaccacgcaaacgtagtataccctaatgctaaacaagtaagcatggaaagccctgagatgacaaatggtactattaccctactaaatgcaatttgtgtatatatgattgatcacattaaacaaggaatggtgtccgaacctgacaagcatttacacgaagatcccatatcctgacactgtgatcaagtgatcctgacataaaactatcgttgacaggtgacatacatagtgaaacaaccctgaaatgaaatagtgcacctctcataatttatcctagacataatcgctagacaagaaagaaacaagaacatagccaacctgtctttgtgtcctttaaaatatcttaagcaacggttgtcatacagtgataaataacgaagtgactctgctgactctagattgtatcttgatgaacataagatagaactcggatggtgagtgaaacagacacggtcagcaccatgtttcctatgatatgtagtcttcaacaacctaaacaatagccccccatttataacatcagttcatcagaagaaagaaaatgtacacaacacattattgaatgctctcaacagtttggttaacatcaaacaaagcaaaattcgagcaattcagagcatactgcaggacaggttaaatctaatgaaaaaaaaaagcaacgattacattaatagagaaaagaagggcaaaacaaatgctgccagtatgactgcaatgcatatccctagcaatgttgttaatcagacagaaaacgatcgcaggtcataaaaagtgcatcagtatatatccatcaagcagaagcacagaactgacacacatgaagtatggattctagcagcaagatattgacatctcccgagttccgaaaagtagaacccaccacacataacatccccaacaca

SEQ ID NO: 2290 - DNA, 1074 bp, Oryza sativa
gacctagatgacatccaagacaaattttaaaacccaaaaatatattttgagattttatgggcttagatgacacacccatacaaatttaagaatcactcactcaaaaaaatctatagaaaagttgcttaaaacaatcatattaattcttctatcaattctttttaactaacaaagtacttaattaatcatgctctaatgagttatctgttttcatgtgcaggagggataagacatgtttttagcaccacatttgccatgaaactacatatttgtaatatgtgcttgcactttaagtacaaatcacatacgttgtaaatatgtacttttttggtataaactcaatgttaaatttatagttttgcgatatatcatcttatagttataattttgtagttttgtgataggcaaagtagaaaactagcaggttcatgtgtgtacggttacgccctttttacggatactataccactatatcacggaatagtagcaaacaacaacaaacacaccaacaaaagatgtcacagcaaatgaatgccaatgatgcaaggatccagctacagctgacctttggtcttgactaaccaggttgttgctaatacatgaaacaaattctaatggaagttacacaggcatagataaaccaccaggctataaaccatctgcctgcagtgcgtctgttcaaacatcaaagtgaaagtacaacctggcagcaaaacgttttgaagctaattcaagaaagaaaaaagatagttcaagtttaacctaaacatgactaatcgtcctgctcaaccttcaggctctgaagcttcgagtccagctcaccgtcatcctcttcctcctcttcctcttcctcatcatcttcagcctccccctcagggtcgttctcatctagtggaccaagcacctccacagagttctcaccactcttcagaatatctttcacctcatcaatcccttcgtccgagatgaaattcccgtttatgttcagttgcacaaaacctggcttgtttgcgattgcctgggcaaagcaccgagctcccaccctctgcagcatattcgtgcttacatcaagct

SEQ ID NO: 2291 - DNA, 2399 bp, Oryza sativa
agagtgctcgctctcttcttcttcctcgctctctctttcccacgccagctctactgctccacgccgcatgcgtccaaacctgggagaccgtgctcgcgttcccctctctctcctcctcccagaacggcatggataagcctcccctattcctccatttttccccctttttccctctcggactcgatctctctctctcctatccatgcccttgcgctccggaggcagagccgctgacgccagtcgccagcttgccacccacactttgaccatgccgcgctgctcctcccgcgctcgtgacccaatttttcaccgtccaatccaccgcctttgccgaccaacgcatccacaccgctttcgcactgcccccgaaaccgccgctgccgcccgtgaacaccagctgagctcccttgaccgccaacggttccctctccctaaccgacttcctggccgcctataaagccgaacccctcccctcaatccctcccgcttcactctccacgttgctgcgccattgttgctggtcgccccgctctcgccgtcgccgagcaccggaggggccgttgcgtgcgtggacgtgtgacgaggagctccgggcgccacgcctccctctctcttcttccccggccgtgctcactcggtgccgcgccgtcccgcgggcgttcccatcctcgccaccgccgctgatgccttcatggctgccggtgagctccccggctcctccctccccttcagcgcccctctttttctcgcgccatgtcgctcccgccaccgccgcttggcgctactgcgcgagccgccgtgcgaactgcgccgccgctcggccatgcgtcgccgacggttcctcttgacgttttccccactgtcggtctcccggagaccccttcaaccccccctcctttggccggcccgcctctttcctctagccgccggcctcccatccccttccgtcgccgccgctctgcttccaccgccgccgcgcacaaccgcgcgccgttgtcggccattccccgtcgattcctctcgcctctgccctcttggagctcccgtggccctccccgaaccgccgccttggctgccggccttccctcacgtgcccgcgccgtgccacccatcccgccgccgcatgactgtcttcgctggccgccgtcgcgctgcctccccatcttccgagccggtggatggaaccgcctcgaccccctctggcctccagtgcccgcatccccctccgattcgccgctgctcgccggaactcgtcggctgccgtgcgccgtccgatctccgggcgcgcttcccctcccctctcatcatgccagtgcggatgtcacgtcccaaaacgactctaaaatatatcctttaaattatgcctagaataattaaaatccttgtgaaagccttcaaaaattaaaatgtgcaaagttaaaagtcaatcaaggcttagaggatttttgtatatttcctaaaagcctaaaatgtgtaaataaattttagtggaattttcagagcacaaataataattattaagaaataaacaaagttaaaaaggttttataaaaagaaaaaccctaaaaagtcccccttccctcccttgggccggctcggcccatctccctcttccccctctctctctctctcctctccccggcggcccattcggcctccctccccgcgcgcgcgccgttgacgggcgggcccgcctgccaccctcgctgacgggtggggcccacctgtcatccccgtcctcccgccgccccgcccgcgccaagcgctgccgccgccgccaaatctgcagcatcccgccgtccccgcgtgcaataaagtggggagaaatactccccgtgatcccctctccctttccccccatttttccctctctctctcgtgttcaaacgggcggatttgcccccgcaaatctcgccggcgccattgatggcggccggacctcccgcgccggtttccttcctccccggccgctctctcccccttccaaccctatttaaaccctccccgcacttccttcgcccgtttccaccatttgccgcgccttctcctcgccggaatcgagctcacgccgtcgctctctctctccgccgccgccgccgagctccggtccgccgccgtcgtcgccccggaccgcctcccgcctcggcgccgcctccttcggcttcgccgcaccgtcgccgtccccgtccaccccctcatcgagctcgccgaccgccggagcgccgccgtccccgtcgacccgagccgcgccgccgccttcctccactccgggcgcctcctccgtcgccgccgtcgcctcggggtgagccatggaccgccgcctcgtttccccctctccctcccctctctcggccgccgctccgccgtgcctatggccgccgccgacgaccataggggcg

SEQ ID NO: 2292 - DNA, 2061 bp, Oryza sativa
gtggggcccgcggcgccggccggtgcgagcccgggtgcgcccggtccaccgtggaccgtgaggttcccgcgtgagccccactcccatggacccggtccgcgcgcccctccccctcggctgacgcaataaaccctttttaaattaaaatttaaatgaagaaattcgcaaatattcatttaaagagcatataaacttcaaatggccataacttggccatttgaactcggaattagaccgttcaagtctctaatttttccttaagaagtcaaaaacccttttttgtgctttgttcctacttgttatatggagtttattagagtaaaagacttttttttttctgttagtcgtgtagacgctgcagcttcgaaagatccgctcttcgtggaggttgaagccgacgtttgggaaagcgagcaaggcaagtcacatcatccttgaacatattgaatcccagtttataaaattattttgatttaaaattattacattaccgttttacttaaattcccgcgttatcactgttttgtttagctatgcccatttacctttgtatgaccttattattgttgttattgttattattaccttgttcaccctagaataaacaaaaccccaactagtgggtactcaatttatggtaccactagtatgaatttaggtagatgcttcgctggttaattaggcaacattaggtggttttacaactctagactttgggaatattctcatcacctggacattatggaatggttgaattattgtggaattggattcacacctccccctctattcaaaaccctcaaaatggttttaggctgggctcggggtgcatggttttgatagtagcacttcggccatataaggaccggtcttcgggcctctgttgcaaagcactaccgtacttccacatgtctagtgggtaaggcttagtttgtggctcagtctggttataaacaaaagtacacggatggagatggacgaagttgggggtcgatggacatctctagggcaaatgaaggctacacgagctgcggctcggtagtcgagatgtcatggtacagggctggtgtcctgctgctaggggctcagtcctgcctacctgtcccgggggttccggccgtaggtggggttgggtcggtactcttgtttatggctaggatgggttggaaactatgtcacgtcttccatccgtataccgtggtggtatgtggcacgtggttacacgtgagaaagatgtgtcttgtgggtaaagatgtacacctctgatcagagtataacctattcgaatagccgcgccctcggttatgggcaagccgagcaatgtacccaagttagtgttttaattcttaatacctgcttaacaactaaaatgtagaatggttggtctgggttggcttgggacgagctgggacccagggtcgggttgccagttcggtctgaattatcgtaggccttgggttaaggcaggttcgtgtgggttcacggccttgattaataacctcgtatagctctaggatcgtgcttacaaaatagctttgagcaactaagtgtcttttaatgctgttgtcacgcccagaaattcccgaatagaattccaagcagaatgtgcatcaaaatccccgtccaggaccggccggggtacacaaacgacaatgttgacattcagatccacgtcttataaacatcataaaagtcttacataaatgcagcagaagaaaagaaaggcaacaggagctaagccttaactagaactgcagcgggaacaccactccacaggcatccttgacggcacggacgaagcctactcctcagagacacctccatctgacacatactcgtactctggggttgggaaaaatagagcaagactgagtactacccactgtactcagcaagtcataccggaataggggtatgatgcagggaattatcacagaagagctagagtggttcatttgcataaagcgagcatttataaacagaagttgaaagatttaaacagttgtaataattaattaatattaactatccactgtccaacgctatcccacgttgcaacag

SEQ ID NO: 2293 - DNA, 321 bp, Oryza sativa
gccattgcttgataatgcttatcaaacatgtatgggctccatgaataagaagaagcccataaatgatcattaaataccttcccactgtacctcttcttaaaattctaaactaagtggtacatacattctctatgttcagcacgtggaaaaacatcactaacccccttcatgattgcctgcccacagtctgtgctaaatgtaaggccatctggggtacctattacttccttcaatctctccataaaccagatccaattctcatttgtctctgactcaaacactccaacagctactggatacatccagttgtgcccatctact

SEQ ID NO: 2294 - DNA, 13640 bp, Oryza sativa
  unsure (1)..(13640): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataacaatgtaatggtgtaatgtaatgaaatataaaaatccacatgttattcacaaaaaaaatgtttcaatttgatggtcaatgattttttagtccatgtggtgctattattcaatttttagtcagtgtagattatgcagttatgctgacaaatatcatatttgcacttctcctattttataaggtaaactgcaatatgatcacagtgatacagcatggcaacttgcctcctcatgaacaggggtcaaaaggggatttgttatcaggttccttgatgccataggtgacgcgccatcttccacttcagacccagactccgctgagccatcacttccttttctctgcattggcatgacaacataacaataaatttcaatagaatagtttgaacacaatgctcctaaaaatctccacattaaccatgcttgtagacttactgttgggtattgtggcccagcataacgaattatttttccatcagtgcttgatatggtcacaatttgcctcccataatttgcttcgccattcaggaccctctggacaagccaaattcaaaatccatcatgttagatatatcaacaccaacgcaaagatagtgtgcatgtaataatacaccagcaagcatctattatttttctccctctttctattttcctttcagtaagcggtggactggtgatttggtttcaagatataacctttattatgttaggatccttccaaggacctttatctgattttttgcaacctccaaatgcctcgcacttgcattttccaccaaaaaactctggcaattcactgaatacatggagcggacagaaattaggatggaggatggcatgaacatgaaacatatatggacaagattgtagatactgacttctcatcaattatttcaagtaacttattttggtacttgcttcctagaaccttcaagagaaaaaaaaaatagaacatgaaagtcgttaactactaactatataacggtcaaaaatcttgattaagtatataacagattactcaataatcctacaataaaaaaaatatataattgacttacatgaatctttgaagcagttttaggatctaggaaagattttacagtgctccataacatcttgaagccttggccggcattaataatatacatgcggcgcaacgtctgtgagaggtttcaggatgcattaggcaattcagtgttgggacaacaagcaaaaggcatgcactatgccactactttggaaaataaggtacatgggggaatcacctacctctgggtagttgtcattgtcgatcttctgcagtcgtgtgattagatcccttgcagcttttgagaagttctttaaacccttgatattcatataatacaagtcaatcacagagtcataactatgtgctcagtgttaagagaaacatttggttatgaatacacataccacgccttgcacgtccagaatagtagtagatgaatctatgggcctttttgcagcaatcgagcaggcaggaaatctcatttggaagcatctctcaaactccttcacatgatatttcacatatcgctctatagtagttacttgcattagcttattcgcatcaacttttcctattaactctatgtagataggccttccttctttatccactccatggtaaaattgtggataatatttcataacctcatccgcctcggtgtagtcaaactcctgagagaaaggataaacaagtgtcatgatagaatggcatatttatattagatatgtttcttcaacgcaaccttttacctctatattgtcagccccaaattcctttctccatttaagcatatctgaccacatactctttgctttctcaacatcaaatttccgtgctttgaggaacctatatgtgaaggagataaaatgaaaatttcacacgaccagccaatcattttcttcagggtagcctcttaatgatttgctgctccaaagattgccactctagattttttccactcgatatctagctagcatgggggccttaggacccacaagacagacatcaagttgcaaatctagaattcacctcaatgaaatggcatatcctggatttcccaactataggtgatttatagtgaagccacatttccgggaaggaggcaaaacagatacacacagcctaaggccaaaagtaaaatatgagagaagccaagcttgtacctaagcattgtgtgataatcatcatgctgttgcggcaacaggtcctcatcaactaaacattgtcgaaatgcatcaacagcttgaagatcttgaacatcccttatgtcctcaatggaaccccgaggttcatttttctttttgcttcttctcctcagggaatgcctgaatttgttcccggcattaatcgcctttttcttgaaagaaccaattttagtcttcttctctccttcggagttgtctgcgtcagatctgatctctttcttttcatcattatgcgtaaaaccttcaaaacctgcaccagcaatagcatctcatgttatgacggtatgaactttttttcttaccggcaactgataggtggcttagccgcttagggagaatgacaaataatagagctttacagggaactaaacctagaacgtaaaattaacttagtttcagaaccaacagtaatgtgagtataggtgttcatttgaagattaagaagataaactttataaaaagaggacccatttgatcaattaatccagtgcctttgtgcaaggcaataccaacagcacatgaattattaaatggaatttaatgctttatacatgtgacatcaacatcaaaatgtgctgattctttgtgttggtttgtagctttcctttttgtggttattcttgaatgcataattagcttgaagcatcagcttccccgtaatttttttttttttgaaaaaacttgaagcataagctattatgccctctagtgagaccaacaaaaggaaaaaaaaatcgaagatgagcaagaaacttaaaaaacggagagtgaatggacttctgcatgattttttttttacaaacattcgattttgataggtaaccgttggtgttaactgaatggggaaatccccaaatcctataaacagtgcaatcgcatactctcacgaactcttttgccatatcctccattaagaattgatccaagaattcaaatatgaatatatttgaatcgtacaataccacatacacaggtaatcacaagataacccactaatttaagcccaataaatcgattcatcctggtcttaaatgcaaagaaatactctatttcctagtaattcgtactcacatggcctggcaaatcgatcgagtggtcctgacatcccctcctccgattccaaaatcaatcgcccgagcaaaagctccaacctaaaaatccacaagaactatcatgccaagaaagggaaaaaggaactaatccatcatctccgaacgataaaattgcatggcaaaatacttttttaaaattgtttttttcctcaacgaagatatttgggaaaccgataagtattcaaacaaactatttggataatatctcgaatttcatttacctcggattttgggcgatgattttggaccaaaaagagagggaagctcctgctgctgccgctatgggctttaatggtgggaagctctcgcgagggagacgagacgagacgaaaaggattctatcactctcggtgcatggacccggtccatagactcgaagcggttgacctgtgccgcgcgcacgtgctgggttcatggacccggtgcacgggtccatcgatagccgcccctgggtacgattgcctgggcccaccttgcgtgcgttaccagccgtcgattcgagcgattatagtagcttttatgggagaaacggacggctgtgatgggttctggttcatggaccgtgtccagggagatgtgttggtttatgtgacgcgtggaggggtttggctggccaggtcagactttggttggttagaggagttgggcaactcctcctccactccttttttatgctaagacaaaaattgatggatcaacaagattattagttggaggaaatgtctaagcacaactgattggataaaataactttattttattattgtttggtactcatggtttaaagctgcttaaatgcttagagatgtacttgctcagagatgttcaatcttcaacacacttacgatttctttctaagaatgttgaagggatgtcttttcgtctaaattttttagcttaaatgtttaaaattataaaaatgtgaactaaggctacgttgttaccaggagttaccaactccccctttctttttccgcgcgcacgtttttcaaactattaaacagtgtatcttttgcaaaaaaaatttctatacaaaagttgtttaaaaaaattatattgatctatttttaacaaatagctaatacttaattaatcacatgctaatgaacagctccgttttccgtgcgcagcagctgtgttgggaatgtggagtaatgagcgcagcctaattctgctggatatatatagtactagtttaccctaatttagtggccctcctcctcatgaacaaaacaaagtgtgtttgattgactatgttagtcacctaggatagatacttggttggcagtttgttcatagattgtttcaccctggtaattttgtcatgcatcaaaccaggcacaacagtcttgaaccctaaatggacacaagctggaccattccattaaattttaccagctaaaacccctgttataataccaggagctaattcttgttgagctgaacactacttaattagcactgtaaatgctactcaaccagaaggtacactaattagtagcctctgattcttctatccagaaaagaacaagaagctagggtccaagaatctattcaagcactcacagggtctcacactatccttgaaaaaataaatttatgtttgcaacttttgcatcaattaacacagtgacaaaacaaaatgggcaggcaggccaatgaagtgggcatcatcatcaaggacactttttgtccgtgtctatcccttgatttgttgttacattgatatactttgtctatgtttattagcttatgcttagttgttacactgattgcaatcatatccgtgaactgcggttaagctttttggatttcatcacaaggggaacagggtcgttaggccaaaaaaaaaaattaaagcgagtctctggtgttagatgatcaaaaagtccaaagcacacgagtatagaaagaaacatatgctttattagataggagagtgtttcgtgagttcaatgaccaagcaagacatatatatgccttgtgatatatcacctaatctggcagacttatgtatgtgtttaaaaactttagaataataataatataaaacgtggaaaaggggtggaaacatagggaaatattagataatgaaatatcaaactctcatataaaatatcttgagtagtctcattgtttttttcctaatgatggagacataaacgacaaaactaatgttccaatcttcttcaatgtgatgtacatatggcaattttatttgctctatcacatccaaccagtcaacctgtttgatccacgcaatggtacaataatggaggaaatatgctacaatgacaagtcatctcttgatagcataatagaatatattcacacgtctgtcattaaccagccaaatccattgctaattgtcattaacaaagtgacacataattatataaacacgatggattccacactatcattttcaaatgtaaaagaataatccgctgtctgtcttatggcccattgcaaatacacaagcaagaagaccaggaatttttcaatgatgggtaggcaatactcaccgactcacacctgcatttgttcgccataaatatttgtagtgggattacatacatactccacttcgaaaatggaactagtataagaaaatggcctcatcagagaacagtataatttcttattaaacattctgtttactcttgattcagttaggttgtccctgttcgagcagttgctgaatctttctttgctgaagtgcaaatgtaaatgcctgatactgacaggagtgacatgggtactgcttctgaccttgcaatctcagggatgggagtgggtcagcaaaaaagccctgtaactgaggacagatgactattcccctggttcactttaatcaggtgaatgataattcagacatgtggtagtatagattgatgcttggcaaagcttgcaccatgtgttgaactttgccattgaaaatgctactactattcaccattcagcaacagtctcgtcgtttacatgccccatcatggcctgtgctattttcattctaaaataaacaaacttagggcctgtttagattgtagccaaaataaaccaaaaatttggtaagatgataatattgtcaaaattttggcaggatttcttatgcattgaccaaatttgacaacaaactaaatgtaaatattttttttgacaactttactaaaaaatgatatatttgaaaatggcattaaagtgaacatacacttaatatacgacataacatatcctatctcctgttcaaattcgtatctaggatgtattatatttcgtattagatttgtttattttgaagaaagtgagtatgaacatgcaacagtccatggacagatgtgcagcgatctttatctgatgatgtgagttctctgcattcaggcgttgatccctgaatatgcatatgcatcagaagcttgatcgaccacctacagaattataaccataataacggaagcaaatcaaatatggacacatatcctcatgccctatatgtcctcggcggtggcgacgaatccgtacgccggatgctggtggcaggtcgccggcggcgagaatcaacggcaggatgcggtgggccactagtcgctcggactcctgggccacgtccacgcatcaggcggcccacgcgtggccctagactcttctcccattttgttaaggacaaagtccactttgtgtccctcaattatggggtcagattggattcgcatccctgtgaactacaaaaactggagttccgattgttttcttaatgaaagtaaaaactaacgtaaaacacgaggaagtcgaatactagtagatatatagtgaaactaacacaaatatacggtagctagttaacaaccgactcgtatcgtattcttcattatctttaatttcatgtacttataattacttatgtcgtatatatacccgtttagtcgtatatatatagggaaaactattttaattcctcgagggaatgtttcctcgtttgctaaaaaaccatcttaacggttatgaaaaattctagaaaaatttgacaacattcatacaacatatatatacaactccacaaaatcttaaatccaaactcaactcacacgtcgagatataaaaaagacaaattcagcgtatgaatagtaatgtactgtttatatctaaatttgtcttttttttctcgatgtgtagattgaatttgaacacaaattttggtggactagtatgtatcattatactctacattgtcgatttttttaaagaaattttcataactatttgcatcgaatttggaagaaaaaggtatacgaggggatatccctcgagggattagaatccactcccgtatatatagttttatgtgttgagttactagtgtatttatttatttatttattcacgaatagctgatctctcttgtgaggccggtatgcacaagccgtcgtcgtcgtcgtcatcacctacagaaaaggatgcggccgtcgccgacttcacctgcggtaaccacgagcacacggtaaaaaaaaaacagcgacgctatttcctttcttcttttgttcttgtcgcggtggcgcgcgccggccagcaggagggttggcgttggggtgggggcggtgtttggctccgacaccggcggcgaggaatgcggcggccggcgttccgatgggaaccgagagtggagaggttgagaggggaaggggcaaaccagccctagttccgcgcccccgatggagaggagggtggcgttccggtggggcggagaggcgctgttggctccggcggcggcggcggcgttccgatcggtggggacgacgacgatggattgtgggggtaatcccaatcgaattactggtactagaaaattattccatcgaccgtggtactggccctgttcttgcgacccctgctgatatctcaggagcagcgaccgatatatcccacaaagatcaggattcaggaagactgccttcctctcatctccacaggtatccaaagcatacctctgtcccctcttctcttgccatcagatgaactaggataagaagagtagattaataagagggatagtgatttgattggtctaatagggaaaacaaagagtatgatttcttctcctccttgcaatttacactccctgcgtgatatggtgcttagaccaaaaatgcatgcatctcgcactcagtcatcctaattcaattaatcaagaggttttcaaaaataaataaagttaatgatttctttatatttgtggcaatgtatgttcctcccgatcacagttggtctttttggctcagagatttgtgccctggtaatgcactcgtgcagaattggttggcattgaaccattagtgctcctctgtgtttcttttcttgaaccctgtgttccagtcacagtactgcatttcttccttgagccatgtgtcccagccacaatactcatcttttctcaacacgggacgggagagagagagacctgtatggatggacatgactcaccagatacaatggtagaactgtgataaggagaagtgtttgatttagagagttaaatcagtaatagtaaattgttttttgcattggaaaaattagactgtcttttgccttattttgtgtcaaatgttacctagaatgttttgcgagtaatgatgttgctgggggctaattctccttatctttcttttttgcacctctagagtgaatatagttttactaagtatggattattacaacttttgcatttgtttttatatctaacgctttaaacttttgtttaaatcaggcaatctgagagctgggcaacacatggatcagacaaagaaaaggaagatgaagaagtggtgcaggctaaaaatgaagaagtggattccttcatcgctgcagcagaaaaaacaggtccaccacagcagaatatcgactgcacagcagctgcacgacgtcaggctaataactatgcaaaagttgctttggagcactacaacaaggatgaaaacaacaaggtaaagttctgctaatgctttttttaagttctgcaatacgcattatataatccctatactggttttagatggtgtatacatgcttttcatttaactttatactgaaatgtcttaattgtttcatcaactattttatttatttatatcttttttttgtctgcaatgtattagattcaatacaggttcatcaaggccctgaaaagttgcgctatccaaaccaacgaatcctatgggcatgtgaactttgtagcatcttcatcagattcaaaagaagagttcttttttgctgaagtttgttatgatcccaagagcaatggattggtaccaacatgcatggtatctttggaagaaaacaacagaattggttagtcctgcaacattgccactagctagttttagccgttcttttaccgaagtatttcttttttcaatcctaattacctatgtcattacaacaggaggacttcttggtgttggatttgtagggtgcccagatcttctgaatcctcctgtcgacaacgatcactgctatgcttgtgacgataggcttaagcacccaaaagatggaactctgtttaagggtgggcatgtagccgccacgggtttctatacgtcctactgagtttgtaacagacaaaaaaaaacttagttatctatcctgtgctatattttctagttgtcaattgactttttgtttatctctatttaagcacacttttagcaaacatcaccaatcaaactgtacaatctcaattgcactatcatattttaagttgtagctatctcaagagagcttaagattttttttcagtggttaacattttcatataggtaagggaaaaaaaggctagggaaagtagcgaacgaagcagctgctggacgtctttaagcttttttacataaaaattgttattgacattaattacttaaataactctgaataggcactggaattaattggaattaatttgatagcagctgtgacattgaagaagttgattggggaattttttttagaaaaataattattttagtgaaaaatacaaaaataaaagctgatcggctaaattgcaagtttaatactctgtcgaacaaccacagttcaacagatacttgtcgaactagagcatagcagggggcctatggaacaatgtttgatagcatgcagagttcgataggtccttcatgcacagtgctgcacaatagtgtacagtgtgcatagtgattgttctcttttttttattatgttttatcccatatcgaacaaccacagttcgacagggtatcgacaggggataaaaaataccatgtcaaactacagttgttcgatatgtaccctgttgaattttggctgttatatggttatatggtgtactaaacttgcaattttagtctatcaacctctatttttacaattctctattaaaataatattatttttaaaaaattcgttgattgggtggattttgcaatccctaagggtgctgtgcgtggccctttcctttcctttgtccatttaaagactttgtctctttgctattccctccgtcccaaaaaaaaaaagacaaatcctggtttccatgcccaatgtttgaccgtccgtcttgtttgaaaaaattatgaaaaaaaataaaaagacaagtcacgcataaaanatttttcatggtttcttctctaacggggggganaaaccgaattataaaaaaatttcatataagacacacagntgaggggggacacggaaaccagggtttgccttttttttttggggacggagggagtacctcctactctcctattaacacctctattcaagacaatgcggttgattgaggcagtgcatatttttcaaagcgataggtaaatactaattatttatatgtagtaccaaggggtgagtggtgacaagacagagttaaaatttcagaagagaataaatgctaatcttaactatatttggttggtgtaacgccccgatttctgcgtggcgttaaaagctaatttacaaaaaaccctaattgcgaaaattttgattccttgagtgctgagtctaagttgtgccaaagatctcaatttgaatccctcctttagtccatcttcctgctatcaaaaatcgtctccttaaatttccatcccaatgtaatctcgaagctcgattccttctattcagaattccctcctaaaaccccatccgtgaacttcgtcgaatgctcaaaccctaactcagtccaatgattcacctctgcatcctaaactctcccttgggttccttcaaaaaacaattctcaaattcgaattcaacctcgattcatctacctcctcctccttatatgtctgtctacctaccctaagtttctttccgattaatcaatctcaactcctatatttataatatctccctacctatcgctcaatcaccctttgaaatcatctccgagtatttgttccaaatcccaaggtatagatctatcctcgggataatacccgttccaaataatctcgtatgaacctttctattcatatttctcttcaaaatccttacctgcatatctcgtcgagtagtcaaactcaaactcccaagttacactctcttcctctaaattatccatctccctttaactcgtctccgaatattgtttccttcctttgactcctccctattctcccgagtccgagtatcaacttcgacattaaaacctagactccaactctaaacctctccaattaaacctctctgtgaaagtctaatttacccgcccatggtggtggattcccttctttcatttcctcccaggtccacctcttcctgctcttccggcccatatctctctccctctaaagtctagacctatcaaatctacctatttatttcgtccctctctctacattgatctacctagcgatctatctatctatctatctatctatctatctatcgatcgatccttttatctatctactatacctacctatatgtttatctatccatccgtcaatccatctgtctatccgtccctctacctatcgacctatctctctgtccacctatctatcaatctagcttatccatcgatctgcccgtctgcatatctatcgttgaactctttcccaaacaattgtcccaactccaagaatacgaggttccttttgaatccctctaaaataactcttgagccgcctaatacagatatattccagaaatatataattcccgcctttgaagcctttcctcgacccctccatatttttccgagttcaaaacatccgatttgaattcaaatcccaactcaaattctcaaaatactccttaaagaaatttcctggagaaagtctactcgccccccttgcggttttgggctgatttctccctccccagcccaacactcccttcggctcacaccctccacgtgcgccgcacgtgatacgcaccgaggacaccgccccctttcttctctctcgcgcacgcgtgcctccccgtctcgctctccgctcgccgcttttgatttccgccgcccgtcggcgatttgaatttcgtcaccgccattgccgctcccgcgcgcggcgccgctcatggccgaccgctgtggccgcgccaccgtcacccctgccgcgtcgaccgccttggtccgcgctcgccgccaaaccagccctcctcccttttcgctgtcatccgctgcgtcaccatggccccgcctccgcatgccacaagccgccaacgcggcgacgccaatcccacgcgcctccccagcctcgccgcccaaaaacggaaggagcaaggctccctttcctcctcctcctttcgctttttcccttgcgggcaaggccgcctcgctctctcccttgtcctggtgcgggagcggacacagggtgccgctgacgccgcctttgcgccctgtcgcgcccacgccaccaccgcgaccatgccagctcgccgcccccaccttgaccgcgctagcccgcgctcgcggtccgattcccaccgcacgatccaccgccttcgctgcccaatgcatccacgccgtcgccgctttcgcaccgcccacgaaaccgccgctgtcgccagccgagcgcctcttcgcctataaaatcccaacccca

SEQ ID NO: 2295 - DNA, 19078 bp, Oryza sativa
ccctgtccttttccgcatcgtgtagctctcgccaccgccgcttggcgctgctcgcgcgagcagccgcggcgagcttcgtcgatgccgcacccggctgtgcgccgccgtcggtctccctctcttcgaacccgctcgccatcaccttcctcggggccccctcgacctccccaatccattcccctggccgccgacctccccttttgctctcgcgccgtgccgcccgactggcagccgcagcgcatggatgtgcgccgccgtcggccatcccctcgccgtatcctctcgcctccgccctcctggagcccccttggcccttcccagaccgccggcctccccaatcgctcccgcgccgtgccgccccttccgccgccgcatagcgccgccgcgcgcgcgtcgccggcgaccattgggttctgcgccacggcgtgtgcgtcgcaatacctttccacgtcagccgagcccgagcccgcgcgcccttcgctttcctcgcgcgcgaccacgtcggacatccggcgagcttcgcctccgccgccggccgccgtcgtacctcctctctcaaatccaaaccgttgaattcattccccttgtcctcctctcgccgccagtgctagccacttcctctggctcgccgccgttcgccggagcgcgccgagcgtcgccggccatccgatgaggttccggccccccctctctccccatccgacgtggctgcccacgtgggcgttgaccgggcccgcccctgcccagtcagccgtctccccctctctcctccccgctcttggtccaggcccatcggccaacccccctcctcggccaaaaggaacaaagtccactcttactccctccgtccgagcccagtgaacacactcttgaatcaaagttcatatttcgtccctccaccaaatcagctcccttacacaaaagtccacctatctcccttgttggctccacacgtcaatgagtgactaaacagaatattctcgggaatattcttttccataagttcaaaaaaatcatttccccttgctccataaatcatttcctatattccaaattccataaatcctttctcttaatcccaggatttcaataattcattcccttggtcccgcatgtcaagtgattgtcaataatattcttgagaatattatttctataaatttcataaatcaatttcccttgttccacaaatatttcccttaattcaaataaacttccaaaattcatatctcgcgatccgtaactccgtttgactccgttccacttccaataattccgtaaaattgtgatctatctaatggcactattaattagcctaaataggatcttttatttggtcttttgtttaggttttcattgtttgtgcctagttgcggttgcggattttcgtcgatcagggatttctcgaagattcgtgaagatcaagaccctgagcaaggcaagccacctttgaacatcttgagcctataattgaacttaattatattacttgcaaaatattatgcattgataggattgcacataatatgtttgccccgtctgcgaggcatattagtgggcatacctaacttgttgcatttgatccttccgttgttaaattgttatgtcatgtttccttgtaaccacctggtcgcgcctcagtattcttgcactcggtgcgagtatcgacggtcgccgtcaaacttaaaatatggtaaacatcttgggtaaaacttggtttacaaaacgattggaaaaccagacgcctgggtcggtgccttgtgaaagaaaatgagctttaaaaataaaactcgtgacacaaggccattcctaggcgggatgcttgtgcggtcgcatttaaggaccgattccttcggaattatatccaagcatatgatagtgcaaccacatgggtggaatgggacacccctggctgagtaattagctaatcaggggagccttgatgctgagagacaagtggattcgccggggtggtgtcggggaggacccctgggcttcctggcacagtatggtctgggacctaacctgttgttggtctgggacccctctcgtcagcatatggtaaacctgtgtcggctttggaaatgccttgtcatgaaagcttggaggtctcccgacgtggctgatccccacgagctgggtgatccgggttagtaatgtcgtgtgggtaaagtgtaccccctctgcagaggttaacaaactgttcgaacagccgtgcccacggtcatgagcggatgtgaggtgattccttagcgtagttttcatttttaccctgttttatgaaaaagtgatgaggtttgggaaacccgatatttggaaggcaagtggctgtcagggagacagcggaacagggagtccctaaaagtgactggttgtttggagacaaccaaaactctgaaagtctggaaaaattggtttggtttgggaaaccagctttgaggccaactctgggagttgtgcaaatcttgataaaataatattgttcactcctcacccccggccgagctgagacttgtctcgctctggtcgcggaatgcacacacttagattgtcaaaatgcttgcaaataaaactgattgaaaaataacagccttcccttgaagcttgcattaaccacctaagttcccttggcttgctgagtacgtaagtactcacccttgctctctatatatacatagttctgccagctctgaagatgaagttgaagcaaagattagggtttcgtcctagttcccagccttcgcctgtggtgttgggtgttagaccgttggttccgctgctgctgctgttgttggtgtttcctcgtccgcgtcgtcggttgcattctctggctgttctgagctgcaacctaagttaagataaataagtactctatttaatttaaggattgcaatgattcatatttgtcactgttggtaccagcgctatgtcctgggactggtactgagatcgcggtttcgtaggaagcggttcacgccgtttttcttacgacacgctgctgtcaggcgccgttgtacgacggtaccggattggggtgtgacagttggcatggctcgtaactcttgaagatttcattagctttcgtctacattttttttgttctgaacaggcactatcatatggtgcatcatgagccgaaactccatcaacagttctctgcaactgtttttttttttgaactggcaactgtttgatttactacaatagtgaagcgtttgatgacatagccgcagtaacaaataatgtttctatccagtttactgaacacatgacattaacatcacaattcatacaacaaaaataaacaatagtactccaacctcagttctggccatctgttcctacttcctatccgcagcacgtccacataacagaattggcccaacataggacggagatggcaatggggacctctaacccgtgactcgacgggtttttactctattagaagctaattgtgttctaactcttatacccatgggtctactaatgggcaaaactcttacccattgggtacgcgggtatggatctattctttacccacccatacccaccaacccgtgagtgaaaaaacccgttgattgagcctaaaactataagcaatataagtctcaacgactactaaatcagtatgaaactcctttcacatcttaagcattgttacattctagttatatgaaattattattcgatttcttgattatgtaatgtggttgtataatttttttacttgcctttaaacgctaatgttaatagattgttgctagagaaaatattgatggtttacaactctaatatggctaattatagtacaaaactataaatgctacaagttaactatatgggtatgggtacccgttggatacccgttacccgcacgggtgtgggtatggggcaagggaacccgattggtatgcactcgttgccatcgatgggctcgaggcggagcgagagagcgacccatcttcaaggtcaatggagaagcgcgaaagcgagtagcagcgggagttgtaacaatcggtgtggatgaattaggccctgtttagttcccaaaaactttttctcaaaaacatcaaatcgaatctttggatatatgcatggagtattaaatatagataaatttaaaaactaattatacagttaggggggaaatcgcgagatgaatctttcgagcctaattagtcattagccataagtgttacagtaacccacatgtgctaatgatagattaattaggctcaaaagatttgtctcgtggttttcaggcgagttatcaaattagttttttcatttcgtatccgaaaaccccttccaacatccggtcaaacatccgatgtgacacccaaaaatttccttttcgcgaactaactaggcccttaatataacatggattgaattatatttgctgaaaatattattattcgattgatatttgaatttacattcaaatggatattagggtgatcatatttaagggaaacactcatgtttgtagattataaaatatacccaaattttacttctactacaaaaatttactactactactagtcaacttgcatgcaacattaaagaaactggacttggacgagagtcagtcaataatatatctagctaactgaatcagactgatcgcataataaagccactagcaaggctatgtttagattttaacttttttttcttcaaactttcaacttttccaccacatcaaatatttagacatatgcatggagcattaaatgtagaagaaaaaaaaccaaatgtacagtttgcatgtaaattgcgagacgaatcttttgagtctaattacgtcatgattaatcataagtgctacagtaacccatatttgctaataacagattaattaggttcaaaagattcgtctcgtagtttacggtccaaatctataatttattttgctattagtctacgtttaatactttaaatgtgtgtccgtatacgttaaaaaaatttttagctctgaactaaacacggcctaacacgacaacctatgtgaatcccattaagatggatcatggatgcaagaagacttcgccgagtcataaagaataccctatccgtttccatattaattgacgttttagataaggttgaggttaaacttttataactttaaccatcaataactttaaaaatatttagtttaaaggaactagaacaacatgcatttatttattatatatatattataataaaaaaaaagatcacagatgcatcttgtataccgtgtcattgtccaaaacgtcaattaaaatggaaccggagggaatatggtcattgtatctagtgcgcataccacttgtttgtctttttcttttttttttttgaaagaaattaaaggcaagaagataccacttgttagtcataatgaggacctctacttgattgataatgaggacttcactgcgtcataaacaatgataatcaatgtacgtatgaatctgatttagtcccttcgattgcatagaggaattcaccacatgcacaaatcaaattaaatcaatgcatacggtttaaagaaacactgccacaaaatgaaatcaatataggaaatacttttaagactgcggtgtagcgtagatggcatggtgcagcactgcagccatacgttgtgctcttcgcgacctgcgttcaaatctggctgaacgtactcaccctctttcttaataaattcaacattgggtcttttccagtataatttttttttgttattttacgcacagaaaataaaaacaaaaagaagcgggcacacgcatttgtactttgtagagcatttggttagcacactgacactcctgtttgctctcctctagctacttcctcaatgccttactcaacggaaaggacaactcaattatcttagctaagtcatgggtggtatctgtgcacagatgtagctgtgcagtagcaatagccagtgcaaggatctgagaccttgggtccctttgcttgtactaataatgaagaggacttcacttggtcataaaaaatgatgggcgaggacagcctcaacctgtaaatcatactatatactccaacctgtatatcacctacagagggtgaagcgagtcagtgtgagcaagcagagaagagttttctaaaggaaggagatgggatcttcaagtgttgtgctatggtgggaagagtggcagctccgtatcctcgtcctcggcagcctcttcctgcagtgcttccttgcatttgctgcagttcaccgtaggcgctccatcccagcatccttgagattctttatttggttagcttaccttggaagcgatgctctagcgatatacgctctcgccacactattcaaccggcacaagaccgataatcaaggcggcagccatgtcctcgccaccctggtcagccctcaggggaagggcggtggcgatgacactggccttgaagtcttctgggctcctgtcctacttctccacctcgctggcccggactccatcacttcctacaacatcgaggacaatgagctatggaggaggcatgtcctgactgtgatttcccaggtgacagtatccctctatgtgttttgcaagtcttggtcgggtgagaacaagcttcttagagcagctgttctgttgttcattgctggaaccctcaaatgcattgataagccaatggctctcaagagcgctagcatatatggcctagtaacctcatctcctttccatgaccaaaagtcacaaaataatgaccaaggcgagaatagatcacttgaagcctacatacaagaagccaagggttatttttccaacctaaagatcaatgatgtttatactgagttggtagcagctgcccaaaacaaagacctacgggttatgccgttttggttattcgtagacctcgcatctaccttgtgtcatcgtcttagagtcttgcgtttcttcttggttcttgacaacaagagcgcggattcactgctacagacggcactgtgtggttcctttgttcgtctttacacaaagaaaagcatgctcctcagttatttttgggcaaaagataaaaggaatgctctcatatctacttattcccacctgaacaggctcttagcagtatgcctgactatttcagctgtcgcactattccaccagagccataaacaaggctacaataatagtgatgtcaaggtgacatataccttgctatggtgtaccgctgctctagaggtgtacgcacttttcggtcccaagtacaaatttttcacctggtgtaagaatgttgcccaatacaatctcgtaggattcttcgcccgggaccaaacgcccaccaggttgctcaagttggccagttgtttttggtgcaaggactatgtggaccagcactggtatgtcaaccaatgctcatcgtctttcgccatcacagagcttgtaattgaacaggttaaagccggatggaagaactacatagaagatacctccacctactggatgttcaacgatcgcagaggccaactaaccattcagcatgagctttgcgatgaagagctgtgcaagagcttagatgtgccattcgatgagagtatcattgtttggcacattgcaactgacatatgcttctatgagggtgcccctgcagctaatcatcatcatctcaaggctgccactcgatgcagagagatctccaactacatgttgtacctgttggtggttaacccggatatactaatgtcgggcaccagagcgaacatcctctccaatacatgcaaggagcttcgtagcatgtttgaggatgagaagccaccgtctgatgaaagtgaccttacaagggagatacacagaagggcccaaagctcgaatgtcgacgctgctgcaaccgaagaactgattccccgtgcatccaagcttgcgagccagttgttggccatggatggcgacaagaggtggaaggtgatgcaaggtgtgtgggtggagatgttgtgcttctccgcgagcagatgcagagggtacttgcacgccaagagcttaggccagggaggggagtacctctcctacgtgtggctcctcttgtggtacatgggcttggagagcgtggcagagaggcagcagagatcagatttcaggagtcacgtagaaagagtagccagcagacaactaccgtgtaccgaaactgagagctctcaggaaccgagattcaagaggaggaaggagcagttgtgccattgtttcaggagggaaacataggtgtggccgttagatcaaatgttgaagatgaggaagcaggagcagtcacattggaaattcaagatgatgaagaaacggcgacgactacacatgcttccaaagcaactgtcccgggggacaacaatgtctgaaattcgtgtggtttgtctttagtttgttgcatctccttgtttttatttttcaattgtcatgtttgttggtgttagtgttgttgctggactcttttatgttgttgctactaatacttctctagctttgtagccttataataataataataaaagactgtgtgtctgatgatcattgctacagtaagtgacctttactgttatttccaacttttcaccacaattgtgtgcatattagttgttgatataaatgtccacgctttttgtcattaaactcaacgaattgttctggggtgctatgaatgcaagctattcttgagtacctcaacctccggaccatcctgagatctttgaagcaacccactgatcaaccggattctctttcttgaaagtgggaaccatcgggggagtacacttcctggtcggcttaccaggtgctatatctggggagaatcccattccaaccaacgccaatttgatattccttggctcctccacgttgtcgctacttcgtttgggtgaccgttctgaacgggtgttgagcggccgaccgtttacgcgctcgagggttgccgcaccctgatcgttgtgtcctctgttatcagcatgagaagtcgatcacattttggtcatgtgtccggaatcccggcaactctagtggctcgtgctcacaacaaacggatagcccggttgcctgccaatgaatgaagactcctttcacctgtggatttgcaatagtcggaagaagattgataaagcccactgatgaggtttcaacaccattgcaactcttgtagtgtggacgatcgatctagaaggaaagaaataatcgggtcttcagtcaacaacagaaatctttgtccaaggtgacgtaggcgatagctgctgacgcagcactttggcgcttggccaatgcggtggcaccggcgataggattgtaactgcctagagcccatggtcgccaaatgcttttgtgagaataggctttggttgcttaggctgtgttcggcagccttggttgggaacccatgtcccgcgcacggaaaatagagtggtccattagcacataattaattaattattagctgtttttttaaaaaatggatcaatacgatttttttaagcaacttttgtatagaaactttttttttaaaaaaacacaccgtttaataatttgaaaaaacgtgcacgcgaaaacgagagggggagttgggaacctgggcaacgaacaaagccttagtcgttcctgtttcatgtctccttcctcttatttttcctttgaattaccttgtaattaaccttcatttcttttaatacatattccttgcgtactcccaaaatctttatgtgctctcacaaattgagaaatacaattttgaccaatctcgcccagacaagttctggtgagttaagtgtctgttggtctgacactaattgttcgtgagctcggaaccggcgtgtgttatgttttcattttctggatatagggaaaaaaattgcaaggcccagaaaactcagaacaggatcccgtgccttttccaagggacatggactatggtgaaaatctgacaaaaatcacgtgataattagttcaacaccatacctacggctgtgttcctagaacagtgcaagcacccactatgaggtaccacagggtgacccgtaggatgaagagttgcaaagacattttctccactgtgcaagcaccgataatgggacccacagatactactttaccaaatcccctcgtcagagcagcatcctccctcctcacattacgccctcacctcccccaactccactagctctccccttgcccctccgccggcgccggcgcccctcctccctccgccggcgccggctcgacgatgccgcctctcccctcccggccctgggcggcgagttgacgagctccccggccgccgcgccgtttctccctcctccccatccgtcggcgcacgatgcagaggagcgtggtggcctcggggacgagcggcggcggcggtctcggggccgagcggcggagctggcggcggcctcgggaacgagcggcggagcttggcgtcgaccttgatttgtgttaccgcgatttgtgttggcgatttttccaaatcccctcggagccgagcggcgagcggcgattttgttgccgcaattttggtgggcgtgttccttgatttgttgccgcgattttggtgggcgattttggggaaaacccttcaatgggcagcgcgagggcacgagcgggcggaggcgcggggcaacgcgctccacaacgtagaaaagctgtcaattcctcgcctggcatgggcctgcggcagggaggaatcgtgcttccctccgtgggagagaacgtctctgctggggcgcggaacctagcgccacgcaaagctcgattccgacgtggcgccccatagcgtcggtccacggtgttgcactgtgaagggccttaccccatgtttcataacctatctctctcgttttccgcgcacacgcttttcaaactgctaaataatacgtttttttaaaaagtttttatgcgaaagttgcttaaaaaaatcatatcgatccttttttaaacaatagctaagttaattaattacgtactaatgaaccgttcccttttcggtgcgcactgttttcgattgggaacacgctagaacacaaccctaacgtcatatactaatactcgtattctttgttagagagttttttttattattttaatggtgaggagtcgtactcgtactcgtattcggatcttgagttatttatcacgaacgtatagctagtacgcacgcacctgcggacctgcctcttgtgaaggccgtagagaaaccacaggaaccgggaggatcgccgccgcctacagacaggatgccgtcgtcgtcttctacgcctgcagtaacgataacgacgagggaaaggtaaactaaaagcaacgtatctccgttttaaaatccttgtgtttctcgttttatctcaagtcaaaatatttatatctttaatcattaattttgaaaaaattatatagtttaaaaccacataatttatgttttttagattcatcatgagaaacacatccataacacgtaattcacaagttgttaaactacataaattttaaaaacttgatgatcagagatagaagtactaagttcatggaaaaactagagcgtcaagtaatttgagaaacgaagcgattatttatttggttggctccgtcaaagtcgaaccagcagtgttataccaaattgttatggttatggataccacatacctaatagtagttgactaaacttagcagggtccaccacatactgtcttatacgaaaacaaacctcgtatacagaaagagtttcggataagaaaggacgaatagagttctatatggaaacaacaaggactactcgtattgtatctatattggtctccataggataagaaaggacgaatagagttctatatggaaacaacaaggactactcggattgtatccatattggtcttcctagttctatatggagaaggggacatctatgggtataaatacaagcccccctaggaggagaagggacaagtcacaagacataacacacacacaagccaacacacgccgccggatatcaacatcagaaataagcctagacataacccatccggtgcctacgtaggttatcccaaatattgtatttgcgtgatccagatgaataaagagcaacacctgcctacgtaggttatcccaaatattgtatttgtgtgatccagatgaataaagagcaacaccggctttggccaacaggatatatggctattacctatcagataagataaggggcccgaacctgtataaaaatcctcgtcttcatctcttttacctcaatcacgcatatactctggtaccaacgatccccataccatccaaataccgtagtcgcgatcccaaccgtcgacacaaatgatataaaatttatcaataaatataaatacaagtaatttaaagtattaccctaacaatcgtccctttttaaactttttttcttatctcaaacaacccctcctacttcaattcatcccttatttaatactccctccatcccttatttacgttctaaatctctactattataaaaattaaagacgtttctgccgttactttagtacgtcatctatgtatgagtcggtttttaagtttgtttatttttggaaatacatatctatatttgagactgtttttaaagttcattcgcttttagaaatacagaagaagtgaaatacagaaggagtcgtataagaaatctttctaaaaaaaactcgcatgctaacttgagacgaatggactcttatatatagctcatgattttataaaaaaatatatatccaagcaaattcccacagtaaattttaccttaactaaacaataaacaataataagattaaaatagtatccatctgttgtaacacatgggcattttttctagtataaaaaaatactccataagcaagggcttgtttgaatgaggtttttagctatgtgccattaaaaaagatgacccctgcctctatgccactaaaaagttctagcctcccagaatgccatcgtcgagctttatcgcgccctacacacccttccgtccgtttttggtcctaacggtgtcaaatggtgcagcgaaatgactattttgcccttagggtgaataggccattttaacatggtagtttccttgtgtgccattcggacggcacccacaggcctatttttttggcgccaaagacagggctggttggcgccaaaggcaaggcccttctccttctatatataactcttcccaatccatctccatctcattgtcctctcttcttctcctatcttcttctcacctctcttcttctgtagccatgtcccaagcatccaacagctatggtggtagggtgaagcgggtgctttgccccaactgcggtgtgcttgcaaaccggttcatgtcaacaacagagaagaacaacaaccgtgtctttcacaagtgcccttattttgcagtttgtgcttcattctttgctgacatcttgtattttggttgtttttttttgctctttgctcacaatgttttgatggtctggctttcagattgggggatgtcagtattatcagtgggaggatgagatggtggacagtgcagtgcaggcacttcatgcccttgcttcaatgcatgctgttcccatacaggcagtggcaccacctggtgcttttcctactacactgactagaggcaatgctcaagtggatgcagcagattaagtggcttgaaaagctggtctatgtttgcatttttcttgctatgtatgctattttcaagaagtaggtggctcagtagtcatggatggatgtatggatgtatggatgcatgaatgaatgaatgaatgaatcaatgaatcaatgaatgaatttgcaatgatagtgtaattgcccagaatgtaagaaaatatcataattagctgtttcatcacatgacagcaccaaatgtgacagcaccaaatgtcagcaacagacattacatagaaactacttaagtggtggtttgcaatgttacagaccaaaagaacagaacaaaagatgtttgacatcacagaacaaaagatgacagaagtttttcgccatcacagaacaaaagagcccacagaatgttcagaatgctttactgcagctggagcttcctgctcctggtatttctggcggggctgtctgggcttgatggagtggctgcaacttgcggctgggtatcctgttcaatggtctcatcagggcaaggtgccacacattgtagtggaactggatcatttgaaccagttgcagaccttgtgctaaaacaaaagcatgatgcattaggtgacatggatggattatttgttctggtgagttgaagacttgtggcaaaaagaaaacaaacatgttggacacactgattggttctgaggttgtggttgtaattgtagtaatggcagatgacccctttttcttcttgttggcaccagatgaagaagaagtcttcctttttttgtgggttgcattggccactgcttcattggctggaaagaccatctgggagggattagccaacactatactggtatcagtgttacatggtacagctttcttcaacctcttctttggtagacctgtcacaccccaatctggcaccaccgtacagcggcacttgataggagtgtgtcgtaggaaaaacggcgcgaaccgattcctacgaaaccgcgatctcggtaccagtcccaggacatagtgctggtacccacggtgacaaatatgaatcattgcaaatccttaaaataaatagataacttatttaccttaacttaggttgtagctcagcacagcccgagaatgcaaccgacgacgcggacgaggaaacaccaacaacagcagcagcagtggaaccaacggtctaacacccaacaccacaggcgacggctgggaaccaggacgaaaccctattcttcacttcacttcatcttcacttcaaggtggaggaacaatatatatatttatatagagcaagggtgagtactttcgtacccagcaagtcacggaaatttaggtgtttgatgcaagcttggaagagaggcaaggttgttttgcaaatcctttattttgaaatcattttgaaatcactaagtagtttacttctttctaagtttgggccgagaagagacttgcgtctcgattcgactttaagagatgtttttcaacaactcaattggtaatgtaccgaccccccgggtcagatcactacttctcggctcccagagccatttcacttgattaagcggctcccagagccttttcattttctcggactcccagagtccaactacccagcagtacaacaatccgcttccattcgggaagcctagtctatgatgcccgtagacatcccgaatcacacagattcgtttcttgaccactcaggtcatccatctgccacgtaggctgattctggtaacgattcccacaccacaacaacttttcacaaagcacatgcaaacaaatctacactataggaaacacctcacatccgcccatgaccgcaggcacggctgttcgaacagttagttaacctctgcagagggggtactctttacccacacgacattactaacccggatcacccaacccgtgagatcagccacgtcgggagaccttaaggctttcatgacaaggcattttgaaagccgacacagggttgccatatgccaacgagaggggtcccagacagacaacaggttaggtcccagaccatactgtgccaggaagcccgagagttctacccgacaccaccccgttgaatccacatgtctcttggcatcaaggcttccctggtttgctatttactcagccaggggcatcccattgcacccgtgtggtcgcacttgttatatgctcggatgaatttcccacaggaatcggtccttatatgcgaatacgggagaatgccacataggcacaacccccgcatcgcgagttttcacaatttattttattttcaaacacgccgacaccatatgtcgtgtttttcaaggtttctcaaacccatttcccaaattatcgacaaacaacggtgtatgtggaatagttggtatacgcgctcagagagcacgaataccgaagtaccacaagggtggagcgacaaggaatcagggtagtacagcctacaggaattagtgcgactacttgggtaggtccgtcggtttggcacacaaaccgaggccaagcaagttagacgggtgattctaataatgcaagttgcagaaaataataatgtttttccaattataggagcaattggtcaaagggtgacttgccttgctcaaggtcttcacgaagcttcacgtatcttcgagaaaacccgcgatcgacgaaaatccggtaaccgcaagtatacgcaaacaattaaaaacctacacaagacccaaaataaagatcctatttagactaaataatagtgccattatatagatcacaattttagagaaaaactggaagtggaacggagtcaatcggaattacggatcgcgagatatgaattttggaagattaattgaaatttctggacaagggaagatattttgtggaacaaggggaaaatgattttttttaaatttatagaaataatattctcaagaatattattgacagtcattgacatgcgggaccaaggaaaatgattcatggaattttggaataaggaattgatttatggaacaagggtggaaaggaaatcaaggagggatatatactagacttgtttcgggtggcattggtgcggcccaaaggagattggcccattagagcccgggtggggagagagaggtggtccggtggaccaagttcacctcgcagggtcccgagtggggcccgcttgtcggtgagacggtccacggaagaatgggcgcacgcgggacgcgttgccttggatcgttggatgcggctcacacggtgtgcaccggttagacgggagagcggcggacccacgcgcagccattgggctcgccatggaccgcgcgcacgggggagagggatggagggggaggctgactaggcgccggcttgactcggtcaagcgggcccgggggctgaggtggcatccactgtcacgaccggaaataacccaacgggcgttccttatgtgcgtgtattattccttgtcccaggaggcaaggtacaccaaaagttgatacaattcagagtttaacaagcggaagcgtaagtaagtaatttattacatgggcggcgaaggcccagcacacaagaagacaaacgaaaaacatcggaagactagggcgacgaccacaggcgcttgacggcaggcacgagctagagatcaaagccttcatcttccaggaacttctcttctgggtttgggaaaaattgagcaagactgagtacaaccaccgtactcaacaagacacacccataagtgcagaataaatgcaagggagtacaagggggttataatataaggggttagtgtttgcggtaaacagctgtcacaccccgaagttctcctcccaagcctaaaatttaatttataagagaccctaagaaaataccggtgcaaagcaagagtaaacccttttaaatcaatgcaaataataatcggaagtgggcatgtggaatttttcttgagttctacatgtcgaaattcactaacaggatttttagtggaattttcagagcgctcgaaataattttaaccaattaaaattgagcaagcaatattttaattccagggaaaattcttttctcctttttctttttctttttcccttccttttccgaatgggccgctggcccattctctcctttcctccccctcctccctgctgggccggccgcaggccgaggcccagccaggccgccccgccgcccttctctcccggggtcgccgacaggtggggcccacctgtcgggtccttccccaacctcccgccgctcccgccgcgccgccgcgcccgcaaccgccgccgcgcccacgtctccgcctcctccgggccacgtcgaccacgcccgcgcgtgcgccgcgttccccgcgcccactcccctctctctcccgctcgcgcccgcgcccgagatggccgagattcgattttcgaatcccgtctctctctcctcccccacttcccccacgttagccggcgaaatcccgcctctcccgggctatgtccgggcccccctctctccctatttaagctctgccgttgcccccttttggtttttccccaatttgcccaactcccttggggtccccattggttccgggccggggaaccaaccgccgccgccggtttcggtaattcggcgccggtaaccggccgctaggttggccgccgccccggccgttgccgccggtggggttggggggcccaagatccccaaggtcaaccctcctttgccgaacctcggccccggaagcgccattcccatcgtgcgacggtgagggttgccatgtccgccgccttcggccggcattcccgtctcctatggcccctctcttcctctctaatctatttcttttcgttctaaaggtcgtcccggtcgccgtccgccgcgtgtcgacctcctccgtcgctcctcttcgccggtcgccgccgtcccattcggtgaggactccctcccctttcctttccttccccgattccccgtgcgtcgccgccgcccgtgctcgccgtcgccttcggtcgttgccgccgtccgctgccgccgctgtcgcgtcgcttttgcgccgtcgcctccaccgccggatgccattaccggcaacgcattcgcgcgcgcgtgccatcgctgctagccctggccggccggtcggctttgatgccgagccaagcccggcggccgcctctatcgccgcccgtccgatcggcccaagggcgatctgggccgtcggtcccgtggaccggcggtggaccacctgcgtggtcccggtccacggtgaaccgcccccccctgagccgctgaccagtgggccccgcttgccggcgccgcaccccctccgtgctgacgtcagccctgggaattattgcgcaataaatgatttaaggtttttcttttatagtaataaacacagtgaatctcttaaaattcataataattcatccgagctccgtttaagcccatcaaagtctcagtaaatcaagaaaaaatgtgtagaatccattaaaaaa

SEQ ID NO: 2296 - DNA, 33000 bp, Oryza sativa
  unsure (1)..(33000): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttttaataactatttaggtgatatgcaaaagacgagaggacatcccttgagggtttagaatactttcccttcagatatattaaaatgtgtatttatttaatatcatattccctctgttatatattatgagaggttcaaagatggacgcagttcatatatgtatgaaaacagtttgtatcaatatcatctctatagaaatgatagtcagtcggtcaaggattttttattttgtcaatttaactatttaatgatgactgccatacgtctgtgatagaaattgtaaaagttacttttttatatagataaaataaaaaacggcctgaaattttcgccaccattatattttcatcatctataatataagtgtcttcgtctacatagtgctttctatagtggagctggtcctgttggttgcagttgcacttacacatggcaggccaacgtaaaacatatatagttgcatgcattgtatctgtatagcagtactcctacgttgtatctgtatagcagtacctagaatcgatgctatggtgctagtcgtcgacccaaatggaaggggactaccgactacaagtgcaacgtacgtaaggtagccagccagaaaatacaatcctctaactttgtgtaggttgtagttacgtcacttatcagaatatcagatgcacttaatagtgcagtggtaaggaatttatagttttaagggtgaatagctaatatggtccctgaagttttgtttcgggttcagtttagtacttgaaatttcaaatcatcgaaacaagtcctctaaattaaacatttgggttaatgtagttcttggactcacaaaaagtgccatgtgagcatatcaagtcatcctcacatgcagcgatatgaatgaaatgaccattctacccttatataccatatagaaaagaataaaaaaagaaaacaaatgttttcacgcgtgtatgatcgttttacaattgtcacttatgattgctacaaccaagcaatgatcgtataaattcttttgtcggccaccctccgcaataatattgggcatgggctggcctgtttatttttcctgtttgtcttttctttcttttctatatggtatataatggtagaatagtcatttcattgaggatgacttggcatgctcacgtggcattttttttggtctaaggactatattaacccaaatgattaatttagaggacttgtttggacgatttgaaatctcaagaactaaactgagctcaaaacgaaacttcaaggaccatattaactattcaccctagttttaatcgcactcgtgcaaagtaagtattccctatgtccctaaatataagagattttggtttgatgtgatatatttcatatctagatttatcgtattaggatttatcatatctaaccaaaatcccttatatttagggaggagggagcactacggcgcaccgactgaccgacctatggggcttacccatgagccccgaagttggacgtgtcaggtgagatacgcgcgtgtaccgatgccacaatatgtacgtatggtcgatgctgcaccgaggctagcagcacgaaagggcctccataacctacgcctagccctagcacgatggatggcacagtgcgtgcccatcctgcatctgcatgggttagtgcgtgctacgctgcgacggcgacgatcgatgtagcctagccggtgtgtgcagtgcagtgcaggtcaggattgccactatgaccaaaggatgcttgtgtgcgatcaataatggccgctcaatgtgtcatcgtacggtgacacaccactcatcctttgttgatctgtggtgatcgacttgagttaatcggcaaggcccagcccatggtttgaggtcagggccaggctgaatttggcccagtaattttggtttgagaagcccacttcgtcacagcgtcaggccgaattactggcccatggtgagcccatggcatccattccccatgattgaccttgtctttctctttttctctcgatctcgaaaagatgagcagatactcgtaattaaaccgcaaacatctgccacccatgtaatgataacaatcgttaacaatgccatgcatctcccgaagcttctgtgcctactcatttgagtgcgagaccttcctaacatgtgtccccttaacattgtttactccctttgccgccaaagtggttactacacactccaaacttttgtggcagaagtacactcaaaagcgaaaggtagcagaacacatcaggcatccaaattaacaacaacaccatttacaatcagacctgaacacgttgatcggcgacatcaggcgccgcacatggcaacgacacccgatcgatcaccaagtgtaaaaactaaagccgcatccaacttgtactcgccaaacagccaccgatcgatcgacgtttcgatcgcctgtatcgacacactgatcgatctgatcatgatcagtttcaactcgctgtgcccacgtgtcgagagatcggcacgtgcctgagctctcagccgctcataaatacacttgtttagtagcaacagtatactatagtagtcctctcctgtttggcttttagcttgcatcgatggatggatggatggatcgcatgagagggcttcgcgaaggtacggaaccttacacaacgcgtgtcctttctacgtggccatcgtgtaggcgtctcgccatgctacgtgtcccggaggatgtctcgatgccaacccttataaatactgttccattccaatcccatcgccacagccagtgcaaatctgatcgatcaagataatcgagcaaaatccatcagagttctaacattcgcgcgtgaatttcgaggttaatttttgaagcttaggatcaatggcttcccaccaggaccaggctagctaccgcgccggcgagaccaaggcccacaccgaggtcagcgtcagccaccaccggccggccatcttctccagctccggcgagcttccagttaatttgttgatcacttgattgttcttggtgtgcaggagaaggcggggcaggtgatgggggcgagcaaggacaaggcgagcgaggcgaaggacagggcgtcggaggcggcggggcacgccgccggcaaggggcaggataccaaggaggcgacgaaggagaaggcgcaggcggcgaaggagagggcgtcggagacggcgcaggcggcgaaggacaagacctccagcacgtcgcaggcggcgagggacaaagccgccgagagcaaggaccagaccggcggcttcctcggcgagaagaccgagcaggccaagcagaaggccgccgagaccgctggcgccgccaagcagaagaccgccgagacggcgcagtacaccaaggactctgccatcgccggcaaggacaagaccggcagcgtcctccaacaggtacacacaggattaaaagcaattctacctcctttttttttttttttgcggggagcagaggtaccgtgagataaaaaaatacggtaccagttattaaatttacaatagaaaaagtagtaccttcttaagcactgtaaaattgctctttgattagtttctcctcgtcgaacaccattgttgtggatcttgaggagaattgtttgtgtttcaggcgagtgagcaggtgaagagcacggtggtcggcgccaaggacgcggtgatgagcacgctggggatgaccgaagacgaggccggcaccgacgacggcgccaacaaggacacctctgccaccgccgccgccacggagacgacggcgagggatcactagacgccgtgaatgatttccctttgggtctatttatgtatgttttcacttcaaattcggtgcaagtttgaatttgtttttgtgtcgttttgagtctgtatcgatgctgtatgaagtggtggtcgtcgcaggggaggatttctgacgggtgtgggtgatgtgtactgatgatgttcagttgttttcgtcagagtttctcgtctgtgttctgtttattatggcgtaacaataataaaagtttgggcctaaagcccgcatttgtggtttatcatttcgatgtgtttacattcaccgtatcatcttcccttgtactcgtgatcacagaatttttttaaaaaatactttggatcattcatatttttatacactcgaccataagaggctctcatcggatgccctagatgccctatttattaagccaacgaaaaagctaaaatttaaaatttaaattttaagagaaagctaaaatttaaaatttcaaacttaattttgacattgtaacattgattttgagatatttttaatgtatttttttcagcattggtatttaagtcaacgagaacatatataaaagtttaaccaacaaatttatttttattctctaataaaccgttttggcttattaaaaaaaaaagccaaacgatgaggccctcctaaggggatcaggtgattcccctagtcagccgttggatcgaccatggacggccgagagcaagccagcacttcaccacgcttggcactgccacgaccacaacggtgcatcggttaattgggccgtaacacacttgcagctcttctcagtcgggcctggaacggggattccggtccatatatattgggctgtaacgggattgcggctcatgtgaggcccatatgtactaggccgtaacgggatcgctgctgacgtgtggcccatgtagtttgggcctgaacttccgttgtttgtgcatagggaaaggtcgggaacttctccaaacgaacttagcgcctgcagcttctcctaaaatttttaggtgctaacagctctctcaaacagtccagttttttacctaaattctcaaggttcccaaattttgagaatttgtagttataaaatctgaaaaatgaactagaagcgagaaaaaaaagcgagaaactaggttttctagcttcttcagattcccacaagttagtttttcaacaatagtttctcaaaatcttaaactcccctaaagacctaaacaggcaggctcacagtggggaactggtcgtggattagccttctccaacataggggtggggcctaataagcgggattgctgctgacgtgccaaatcgaagtgtcacgactatagcggcccgtttggttggagtgagtttttaaggagggattgggagtttagagggatgggctattaagtgttttatttggttgggagacatgaaaattttggtgggatagggatggggaattgagaaaggaactacctcattttcaataactgggtaggggcaggtaattaggagggaattcctcctttattttgtctaagcaaatatcagacatatgtttttattaatgacctaatctccaactaaactccctatcaatttccatctcccctgtcaaacaagatattgggattaaaaatcaaattcccatcttaatctcatcattaattcccttgtgtaaactcctaatccctttacgtcgagttaccaaacaagccgtagcaaaatctactttgaggtaggccccacctgcagtatctgccggctacatcagaccagggccccactttgcagcgaaacacgtaacagaaggccagggagccagcggcgcagccgtcatccgaccgagaggcgagcgagagagcccatttcgcacgagaaagaaaaagaaaaggaaaaaaaaaaaccgagcttcaaagaggcgcagcgctacaagccaaatcgaagaggcaaaccaaaccaaacccaacccctcctccgccgcggcccgaaaccccaccggatcggcggcggcggcggcggcaggaggccggcgggcggaggagatgtcgctgacggaggtcaggatcggggaggaggtgtggctcacctgcctctcccacgccctcaccaccgagacggaggaggtcatgggcctcctcttcggcgacatcaaggtcacctgcttctcctctctccccgttctcctgctcctcctccagcgcgaatgcgtggcgcttgctggtgttgagatcatggtggttttttgcctgcttcgcagcattcgagcaggggcggggtgactgctctgatatggggggcgtcgccgcagatgaggtgcgagcggaagaaggacagggtggaggtcaaccccgagctgctcgcggcggcgacggcgcaggccgagatatcctttttcccctccatttctgtgattttgtgtgtttggttttgtgttgagaagcctaatgttggggtttcgggagttggagttggacttaactctgttcgcacagcttgtcggccaccatcggcgagaaaacgagggtgattggatggtaccactcgcacccgcatatcaccgttctgccttcccatgtaggtaggtggttcaagttacctccaatttgctgtgcttcactaaggctggagcgccttctgataacccccttggtgtgcagtactttgtcgcattccgtatttgtgatgtcgtgagatgatatggaactttgcacggttttgaaatttgattgcaattgtgttattgtactaatgccattttgaatttgaagtgatgtgaaacctttcgttatcctatctgatgtttggaaaacgaatgttaattatgctagagcccatttcctttttgttggtggtaatgtatgctttttttgtatttgggaatgctatatttaggcatgtgggtttactccattttttccgttatggcaccaacttatacttccctgagtacgaaggcagtagagggtccatatcaggacaaattgacgatgacaatgtagatctagggaattcgctagtgcatctgcttttatgctttatttgtctcttatgagatgctgcccgtttgcagtgagggctggactttgcttgttatatctgacttacatgagtcatatactgcagatgttcggacccaggcaatgtttcagttgatggagccaggttttgtgggtctgatattctcttgttttagcgaagatgctcaaaaggtatgattcttgtacttcatatgcacatcatgtttacttctagtttggggcacccatgacatttaattagccctgctgaattgatttcttttttggttcccacaggttggaaaaatccaagtgattgcttttcagtcacttggtggaaatcagcaatctgttgttcctgttaatgatccagtcattaaccttgaatcatcttggagttcgttggatgatacctcacatccggcattgattgaaggcattgaacaagacacgggggattctaaatcttcaagaaatagcaaggtttattcttgtattcgttgtactctcatgtcatgaaatttcttttcaattttattaagaaaatatagggctggtctctaagataggattccacaaccgcaatttctgtactaaaaaagtaagcaataagagtgaaaagtggattttagatctggctctttgtggcgctatagaaattatgtttatgaaacttaacagttccatctgtttgggcaatatatatagaccaagaatgaccttttctcttacatagcagtgatatgtgtccttctagaagcctcccatgccttcccttttgatgggcaacatttaaaccacactagcaatgttctacaactacctgatcatgtggcaatgttagtcgttgcactgtcatagcatagtatgcaaggatacctaagtggcattgttacattttttggattaaataaaacatctaattaatgaatgaataaagatgaaacagttagctaaataggaaatgtgcaaagatccaaatccatttgggctttgccatttattaatagcaacctagtttgattttttgagaaattctatgttttgtcattgacaagtgatcaatcctacgaattgccatcgacgaacgtgagttctatgaaataccatcgcacaagagatttccttccctattgccatcaccgttagttgacatccatgaaccccatacaaaaagtccattttaccctttggactccatccatctcaaaatattgctaccttcaggtttttgcgggaatattaagaaagtaggtggaattgaataggggatgattgtgattggttgaaatgaggtggagagattgaatgggggatggttttgattggtcaatgtgagggggtaggtggagaagtacctatattttgagacaaaatttgaattccaaaagtagctatatcttgagatggagggagtatattctaggggtaaaatggactgtttgcacagggttaatggagttaaactaatggtcaactgacaccgatggtattctgtgtaacttatgttcgttgatggcaattctaaaagcgatcacttgtcaatggaaaacatagaatttctattcttttttaggtatgaacatcatgacatgatgtagaacattttgaaaacaaactgaaataagctcatgatatatatttgtagtcataaaatatccatctgattttacattgggatatgatactgtctcttataagtgataaacattatgtaataaagatattgtatatgggttttgtatcttaagtattgacaccaataaatcagccaagccccataacagttatgattgttatgctcagtagtatctggcagatgctttttcattcttgaatatacaccagcctgatatataacatccacaggatgactgctgacatttatgactatgaccaattcttctgatggattatacatgtcctgatatggttttacatgaaccaatgtacatcagatattaacagatagcatgcactacattgtttgggcaaccctgtccactgatccatatcaattggagacacattttacctctactgtaattgttgtctgaaaattacacagctttgttgaatctacgtagcttttaggtatcatttaatgataattccttattgtgatgcgacaggtgtgaagcatggaaatttctatactatgtatgttaaaatgggagatgataattttgtttagatgtctatttatgcaatacaatttgtctgtgtgccttcctgcaagtatattaatattggtaaacttactgtgcttgtgcttattatctaggtgtgggcaaaatcttctgatgtggatttctatcctcattttgacgccaatcactcagcaaaacatcaatccaaagaaaatgctatagttgcatacgatcccaataatgcacctgagacccctgttgatctagatgaatcagatatgaccccaagcatccaggaggcgttgcacaggtcaaacatggacattaggtattatagttgaaaacttgttattcccgtaaaatgcatttatcctttttatgctgtagaaatgtcagttgaatgatcaggctgacttactttctgtgacacctgcttctataggatctctaagtccctatcagctagaaacatacatttaataaacacaattccagtgacacttctttctcatggagctatatccacgtcacatatgttctgttttgaaacaaaccaattgtagcatgactgatctatggtctcttaagtttgccaaatggcagtgtcctttttctttttcctgagcaaagcatggcaatccctaagatgctatctaatagactgtgctttattttacttcttgtctaaattctaagcatgttctactataaaagaacagctgtagttttctgcattttctaaatagtgtatgatatatcacaccagaagggcgtatttggattattgtctttttttatatatcaaaattgtacatgccaaacagtttagctagtgtggtgcaatataatcatatattaacttctaactagaatgtgttgccaatagtggtgcagaatatgtaagaaaggaggtgccactttatgtatttccgaccaggcatctgctaaagctggacaccacattaacttcttactgtgatatgcaacatgtcgttttcgaagaggaaaaatcagcatataatcaagccatgcatcaaaatattcggtaactaaagttacttactttgccttatatagtactacgtgtttattatgtggtaaaatgcacatcttgtatggttcttttgcagtgatgggaagatccacccacttacatctattcaccatgcatctacatacaactcatctctctgcaaattaatggaatattggttagtagcacaatctctgtctgttaattggctgatatgtttatttatgtgcagccctctgctaacttatcttgcattctgctattctagtttgagccctgctataactgtacttcaggatcgtctgaaggaaaatgaacttcgggtgagtggagcctgcatcttattacactgctcttaaagggagttgccactaatggctacttggttctgtgaacagttatctatgctaatggaggaggctaaacaacttgaggcagagaaccagagcatgagaaatgattctcctcgtcgcttgatgtatcatgggactagtggcaccagttctctgatggcacaggataagcaaatgagccccagaagtcctagcggcaccggccggagaaaggcttcctgatttcaatcttgttcacttgacatggtgaatatcgtgagctgcggttccaccccttgctatctgcaatccccatttttccggtgtatgaaggtgtgtacagtggctttgtacatacctcaactcctcagcaccagtgctgttgtaaaagttactgcggcctcccttggctttgtactgctgttcctcgcgctgctgcttaatttgcgccaaatccctttcccttccgagggcttattccatgagcttgtagtttgtgctggggtggttgctttctttgagctattgctaattaagatgcaatgcatttcccgtgcaggcaaagacgaagcttgtttttgctttgctgttggaacagatcatgtactattaccaatccaaaagctgaaatgctcaggcacacttgctgccaaagtgtcaagtgggcgacattgactggataggaagtactccctccgtcccacaatataagagattttaagtttttgattgcaatgtttgaccattcgttttattcaaatttgttttgcaaatataaaaaacgaaaagttatacttaaagtacggtagataataaaataagtcacaaataaaataaataataattttaaaaaaaattaaataagacgagtggtcaaacgttgcaagtaaaaacttaaaatcttttatattatgggacggagggagtattttgtgtatacaatgcatggagacttctgttatgatcagtatatctgcaattatccactgtacttgaaccatggtattcaatggggtctttgtccagtgacgacaacatgctgtcgacctgcagtttcgacagatgacggattcgtttcagtggtggtgccatggcatggaaatgtatttggagcttttccgtgaacgaaactgaatgtcccaccttggaatggaagccggcagaagctatcagttccaaggttcacacttcaagcatcacatgggccagtgttgcccctgttctttgacatcgccacccggtaatgatcgaattggaaagcaaaatcgatcgagacaatacatctcgcgtccaagttacggaggatgccagatcggagccgtgccgtactactcatgaaagcttagacgccacctagggtggtgtnnnggtgnanggactaaagtgtnntntatttnacaaaaacataagtccttatnatagggacttattttttttgtgagaggaactaaatttagtccttatttnncaaacaccccctatatccacgtccaatcattgtttaggccgaacgaatccatcatgaaagctgcaaaatgcagctccaggttcaccaacggtgcaagtgtgcaaacactggatggtgctcgtccgctcgaatcacatccgtttttcccaatctccactgcacactacagtggactagtgctagaataattcttcccacacacacaaggtcagaatctctactattataaaaacgtcagcttttagtatgtcatccatgtttgaatcgattttaaaattcaatcgtttttagaaatataaatctgtatttgagccggtttttaattttgttcgttttagaaatacaaaaggagttgtataagaaatctctttaaaaaaacttgcatgctaatttgagacaatcagacccctaattgcggctcatgattttataaaaagaatatacaagcgaattcccacggtgaatttcaccttagctaaaccgtaaaacaataataagattaaaatagtcttcacccgttgcaatgcacgggcatttttctataaaactaaaaaaaagaattaacctcgtggttaacctaacccaaaacggattagagcttgatcaaatcatccatgcctgttcttctggtcaaatatgaatgaactacctgcggtggagtaggtccacgttcttggaccaagccgccaccgtttatatccatttgcccacccgccaaccagcgttgccgatgagaaaaaaaaatccattattttctctcctttttcgcctcggaacagttgagctgatcgatcgccggatcagagtagattatctccggagccaagtgaccggtggcggccattatttttcctttttagtttatatttttttgaattatttttatttttacgctcatcgtcatcacacgtcgccgtccctttcggtttcatcatcgatcggtttcatccactatcttcccctccccaataagaattcgatctttcggttctcggtgaaccaccccccgtgttttcttcgtatatagcggatcttctgggtctctgatcctgtgaatttcgggaatttttgtgatcgatcgatcgatccatggcggggctgcagcggtcgagcgagacgttccggcggtcgggctcgtcggggctcgtgtgggacgacaggcacctgtccggggagatcaagccggcggacggcggcggcggcggcgcggcggcgagggtggagcgcagccggtcggccgggcacggcgggtacagggcggcggggcgcgtccagccggcgctcgacccgccgtcgccgcgcgtcgccgtgtgcggcttctgcaggttcttcggcggcagcggcaagggcgggaggagcggcggcggcgccgccgccgccgtcgccggcggcaaggccaaggctaggcgccactcgtcgtcgtgatccgtcgagagctagagcgactcatcgtctcatcatctgtacatacatgcaattccccatctgatcggatcatgctccaatccattagtccatttcgtagcctttttattttttcatatagtttctttgcttatcttgtaaattgtttcatgtcaagtaggtgattagcactagaaaactatgacgtgcaagcaactatgaactattaagtatttttcatgtgaacagtgaatgtgtccgtggagtatcatctgcagagcttgataatcttatttcttgtaattaatctattcggacgatatcagattttctttttcatatgcaacgacgtgctaaatgttgtgttatctgggaaaaaaattgctctgcaatatccttttcctccactttttgtatagttttttttttttggaacctcatgtgctagtgcagaatttggcaggcgttatgcctgtgctgcttgaaactgaaactcattttttctttctgacgaaggagagctgaaacctgaagctacccaagttgctcctcagctggtgtgaatcaacttttttgttttctgaattctctgaaacttgtttggccttttctgtaatttggattaataatgaatggcatttcttcgtctttttcttctttctttctttcctgttacgcgtggcattaatcatcctccagcacccttctgaagcacggcacctgcgatgatggtgagctgcttcctttgaagattcaggagtcagaaagctgaacgtttttgttcagaatttgccatttgcacaaggacagatcgtgttcaaacttgccggccaaataattcgcaaaagaggagagcatttagcaatgccaaccctggatatctatgcggctctttatcagctagtgttttcaatgcagaaatgattctgttcctagtaacagagttactctcagtcctgacagcatgaagatggatgcattttgacagcatgaagatggatgccggccaaataattctgtgttcttagcacatagaacagtactgcactgtttggtagttgaaggtggacttttgagcgtgtgtttggtttatgtctgtaaatgcaaaaccgtacagtagcaagtacgtactgaattttctttacctgatgcttctgcttctcatattgtaaacgaaggcttcagctcactaataacatttttaactgagttcagtggatcaaaactagaatcagacaaatgcatctcaaatactccgattagaaattatgcaagacgtcacctacacctagattatctgacaaaagcaactgagtgcttagattcgcttgagccactcatttaaggtgccagaagcaggataatgttctcatgtggatgtttttatcatttgatgcttttcaagagctagaaaagtgtccctgagaaaacgagagctagaaaagtggctacttgattcagagggaggaaaagggcaggtgtctaatcggtgcattagtagtggaataatgcttagcaaggacaaatcagaatgggattctggagagggcaaagtttggtagttaggatttaaagcaacaaactgattgatagataatagaacaaaaggtacagacagttgacaaacaacagaacaaaattacagtaaattcacgctgtaactagctgtttggttaggtcaggtcataacaggtaaatgctttcatcattgttttataaacttcagaaaagaaaaagtgaaataagaggtgaaactgaagaagagccgatcggtctttcagcttccagcgctttcagttccttgacgcaagagctctaaacagctaagcagcatagcaggcatggaaatatggaatgcaactcttgctctgctaccgtttgaaatgcaaaaaaaaataatattaacattttaccataacagtgcataaattattactacatgcctcatgtcatgcatgcaaccttgccagttgccaccaaatggccctgattccttcccccatttggagaaattcttactacctttatgtctatttaattaccttgaaaaaaatctctaataaatagcacaaaggaaatgacttatgcagctgatttattagccatcacattcagttacttaccaacctacacaaagtacgtacacaagcacaaaagttggaatcttttagtcaccaaatcaatcagcaaaagtcgcaatcagggtgtgcaaatgtgcaattgcccaatccacagacggccatgcaaaattccccccccccctcgctttgcatgcttaaatctcgctatccatcgccatggatggatgattcaaccgcaaaagcaacctagttagtacaaggcagcacatgcgctgctattagtagcagctgctaggtgtcctgctattttgttgccctgcttcctctaatcttcctcttcttcttctccttcaatcgtgtcgtgtcgtctccttgttcggttctttggtgcaggaagcaatggcgattcttcgtgtgtccgtgatgcggctggttgttgcggccatggctgttgcagctggtgttctcttcttctccggcgccggcgaggcgcgcgtgctcctcaccctcgacgacttcggcgccgtcggcgacggcattaccaacgacacgcaggtgaggtgttcgagctcggtgcaatttttttttttggtcggcgagaactctggcacgacggtgcactctgtcttttcgtgtctaggccttcttggacgcctggaacgccgcctgcgcctcgacggagccggccgtcctcgccgtgccggccgggaagacgtaccagatctggccggtgcggctcgccgggccctgcaagaagaagctcaagctcatggtacgtacgtgcttgccccgtgtcgcgccgcgcgccggcggcggcggcggcgttcgtctgttcgattcgatgacgcgagctgcattgtgtttgtgacagatttccgggacgatcgcggcgccggcgagccccgacgagtgggcggggcgcgacccgacgaagtggctctacgtcttccgcgtcgacgacctgtccgtctccggcggcggcaccatcgacggcatgggcgccgagtggtgggcgcgctcctgcaagcgcaagaagaccaaggtaacaacaacaaccaattcgccattgttaaccatcaaagcatcatctgaacgtttgctcttcttgcgttcttgcagccttgcagcacggtgtctgctcccaaggtgagcgagagcgaacgctcctccattccggccgccggagtacggtcgccggcggcgaccgtgactgattcttctctctgcgattgcattgcattgaattgcaggcgctgcagttcgaggagtgcaggcgggtgagcgtgcaggggatcacgatgcagaacgggccgcagttccacctgatgttcacccggtgcacggacgtcaaggcaagcttcctccgcgtcgtggcgccggagagcagcccgaacaccgacgggatccacctcaacgacaccacccatgcccagatcatggacaacctcatctccacaggtcagtgtgctgtgcatgccaatgccatgacaaaattcggaatgtacttgcttgcaagcttggactaatcttcagtttcagatgctgactttctgagacagtgtgtcagtgtctctcctacttctggtcaaactaattcagctatctgattccatttttcgcattttgttattcaagataagatcaaatccgccaagtcggcgcccaaaatcgaataattgacctggaaaaggaatacttgaaagttgttaaattaatgtagttgattgataagagatcaggtcatacattgctgctcttggtcagaatcttgggcttcctttgaagtttgaagcaggcagtgattaccgctgatatttggatgattggttaattaatctgctgtttaatcactttcttcaggagatgattgcgtgtcaatggttggcaattgctctgacgtccgagtgaaggacatatcatgtgggcctggacatggcatcaggttgcagtactttccaggattccatgccagtctttgcccatgatctctgatcagtataacaatagatttttctgtttctaaagaggattctgttactggaactgccaatgtcactgacacgtggcacttgtttgattgacagtatcggaagcttaggcaagaaccggaccactgacagaatagagaacgtgagggtggacacctgcttgctgacaaacacaaccaacggtgtacggatcaagagttggcaggttagttgcaggacatcacacttctgaattctcacaagaacaatctgatgaggggaaaaaacacttgcagttcttggttctgacaagaacaatctattcagaaaaaggagtaattatatgacaaaatgcaactttgtgcttgatcagggagggatggggtatgctcacaacctgaggttcgagggcatcgtgatgaagaacgtctccaatccaatcatcatcgatcagtactactgtgaccaaccaacaccctgtgcaaaccaggtaataatctgcattttcacctgcaaagcatcgtatcatctctgaaactctgaacttttgccattgttcagagcactagttcatcatctctgaaacttgggaatttttcgtctctgtggatgcagacgcaggcggtggaggtgcgcaagatcgagttcgcgggcatccggggcacgtcggcgacggagcaggcgatcaagctggcgtgcagcgacgccgtgccgtgccgggatctggagctgaggaacgtcaacctgacaatggtgggcggcggcgcggcgtcggcgttctgccacagggcgtccgggaaggcggccggcgccgtcgtgccggcgtcctgcctcgccaaggcgccccacaggatgctcggcgacgccacgccggcggccagagtcggttcttgatcgccgccggcaatgcccgatcctggcaacgatcaccggaaaaaagctgaagtataaataccgtacacgtaggtgtagaaactgttgccgtatttgggagagtgtatgagtacagagagttgtaagctgtatacgacgtttgtgtcaagaattttttagagggcattatgtgaagttaaaatggatacaaaaaaacataattttaccggagtttctgctactagcagtgatgggccgatgcccaattatattggccccacgtaacgaaggtgtcggtggcccacggcccacggcccacgtgttttctcgatgtccacgtggtgatgtggaattgtggatccaagattctcccaagaaaagaaaaaaaataaatcgtggatcagattttcgtcaaaataatatctcgtggacttggacacttgttgtcagaaagtcgaagctgctgatcttggatgccacctagttcaaggatggcgccgccgccgctcgccggcgtggtggtggtcgccgccgcgctcctgctcctcctgccggaggccgccgagccccgcactctcctctcgctcgacgacttcggcgccgtcggcgacggcgtcgccaacgacacgcaggtgagcagcagctagccactccagcttcactagctcagctcacaatggcgtcttcactctttctgccgcctcgtccaggcttggtgacgcctggagcgccgcctgcgccaccggagaccacaccttcctccacgtccccgccgccaagttctaccttgtctggccggtcaccctcgccggaccttgcagggaggagatcaagctcttcgtacgcacacaccaccacacactatctccgcctcttccatttcttgtgccttatccacttcgtgaatcgcgtccggttcctcagatctccggcaacatcgtcgcgccggagagccccgacgagtggccggagggcggcggcggcggcggcgaatggctccacttcgtcggcgtcagcgacctgacgctgagcggcgggggcgtcatcgacggccgtggccaccggtggtgggcccggtcgtgcaaggcaaagcacaacgcgaccgaggtaaccaatggtctcctccatgaccatgatgttgccaattgcaacacagaaatatctgaattattctgaagttctgaacaatcttgtctctgcagaattgcactacccaggctgctccaaaggtgagattttcgctttaatttgatcagagatcttggctagctcgagaggatttggaccaaaaagatggagaattcatgcatggattgcattttcgcggtgttaatttgcaggcgctgcacttcgaggattgtcagggtatcagcgtgatggggatcacgctgcagaacagccaggagagccacctgacgttcacccggtgctcgcacgtcaaggccaactacctgaggataacctcgccggaggacagcccggacaccaccggagttcacgtcgtcagctcgcgcaatgttcacatcatggacgactcgatctccacaggtactacacatttttttttcttctgaagaaatggagctttgctctgaatttctgaatgatgtctgttgctgaaacagatgtctcgtttgaaattagttgatcagatatgttttgcaggacagtaaaaaggctcacaaagaacattttcttccccttctttttgcctttttaaggtcatgattgtgtctcgattgtgggcaattctacggatgttcgtctaagagccatctcatgtggacctggccatggtatcaggttagcatttttttctccatcttttcagtggaatttgcatcagattttgaactaaattcagacaatgactccacccaaacacactccacatgaccacatccatttatagtagcagttcgtaacagagctaattaacagtttgtgcttgtcagtattggaggattaggcgagaaccgaagttaccacagggtagaaaagatcaagatggacaccctgttcatttccaacactgaaaacggcgtacgcgtcaagaccttccaggttaaccgtaaacccaacgcccacttctcacatgaatcttcgtcagaaacacccaagattacactgaactctgaactcaaaactgcctagctagctaacttctgctgttgttcttcagggcggctgcggcaccgcccggaaaatgaagttcggtgacatccttatgaagaacgtcaagaacccgatcgtcatcgatcagcagaactcctcgagcaacgaaattccctgcggatcaaaggtacagtgagctcatgatcagcatctgatctgatcagcacatagtagaagatcaacatctctgaacattttgcctaacatctctgaacattgagttttttggggtggattggatggtgtgcagaacggaagcgcggtgacggtgggggagatcagctacacggacatcaccggcacgtcggcgtcggagcgggcggtgacgttcgcgtgcagcgaggcggcgccgtgcagcaagctgtcgctggagaacgtgaacatcaccatggccggcgggcagaacgcgtccgcctactgccaccacgcgttcgggaagagcgtcggcgtcgtcgtcccggactcgtgcctcgggaaggaggactacctccgccggcaagtccccgcctccgccgccgccgccggcggcggaacgcaggagaagggaggagaagatgacgatcggtgaaaccgtggcaggttaagtcagcgtgtgtagtggacgtgttcacatcctttaccataataacgctattattacatgtactaacgtgtgaggataataaaagtttagaacccacataccatgtatctatcgtgtaatcgtaaaaaaaaaacttttaataaaacaagagaaggacggccacgatgttaggatgagattatcgtgcaaggaggcgatgattgggttgttcagattgactagcattttctctacatttacgcacgcttcatcgtacatcttgctacttctactctttttctttcaagtgcttagcgcgttgagcggtaattataagatatactcactccattaagaaatgtagcaacctacccatcttagaaatatgaatatggacatgcctcatgtccagattcgtagttttaggatgggtctcattccgttctagattgctatattttgtaacggaggtaatagcgcttattagcagaaaaaataatttgcgagtaaaacattcatatttgttatcagcaattaaaagctagtaatgctgaaaagataaattaaaatattagaaaataaaacatcaaaattaatgtttttaaaattgaaactttggctgatgcggataaatcgagaaacaaactttggagcttatggtttcctgatttacactactgtaattctatattttttgggtgaatagccaaagtagtcctccaagtttcatctgaggttcggtttagtccttgatgtttcaatctatccatattagtctttcaagttttcattttgggcaattttacggttcttgaggagctactatgaggtaccttttttctattgtaaatttggtacctcttggtacctaggtactatgaggtaccatggggtaccaaattttacactaaatttttggtacctcatggtacctcctcaaggactgtaaaattgctctttcattttagttcaaacttatccttgaaccaacaactctcttcataaatgacacttatatccctcatcattcacatatataagagaaaaattgcatgcttgaattttttatagataatacatagtatattatgtaaaacgaaaaaaaattatgcactaacaagtgtatacgatagccattgcttaagtttcatgtgcacatattgaaataatgggaagtacatctataatgttgtttattcatgttggctttctcttttctagtatatagatgtatacaaattaagggcaaaaatgatattttctaatagaaatattgactagaaatagccatatggcatattaagtggacccaaggatgattttaagccaaaacaaatatttgaaggacctatgtggacaaaatgaaacgtgaaggaccaaattgagccttcgctaaaacttgagggactaaattagctattcacccatattttttcacattcgtgtgtttctaaaatcctgcattccaaaaaagctgggattttgtgcacatatagttacatggacaaatttccctctactttgagagaggggtaggagttggtactcttagttaggagcatttacttctatagagtaaaacatgtagtaagccttcaaatttattaataaaaagataactgtcgctcgatcaagaatctttacccattttgcacatagcaccatgcttttccttcctaagtcctcaaatataatgctaacttatctttttttaatacgattccaattattgtttaagatgtgagctttgttttattatgaataattagatagcatataattattgggagtcactaacccaaacccattttcagatcaaacttgagattgtagtaattacaacgatatctagattacatatgaacaataacattcatatatcaatacttgtattgtaatattgaaggtacatatgaagctacattagtattttgtatatacataggctgcgttcggttgttggtgttgggaactaaatccgtcacgcacgtaaaacagaaagatttattagcatatagctaattaagtattaactattttttaaaaaatgcattaacatgattttctaaagcaactttcgtatagatttttttaagaacatactgtttagtagtttgggaagcgtgtacatggaaaatgagggagatgagttaggcagatagggtaaataacacaaccatagagttgcatctaatcctttagaactttgattttggttgacgatagaactaatgaatcccactgtaaggcgcacacatggtgccaactagtttaattaaaatgttatggcgggcaagcattgcggaaatcatggtatagatttttgacatgttgcccttctgtactcttataaaaaaataaataaactagctggatggtggtgcaaattatacggctagatctaatttatttttagaaaacaaatcatacatcgctaattttggcgttgtcgaaacattcataaaaaaaaaataagttacaagtttaattttaaaaaatatgtacaaagttcttataaacaataaaagaaaaaaaaaaggcaacaccaagtttagccaagacagcctgaaaccaaggagagcccatggtatgcaaccaccaaaatctgaaaataaccatgacccatggcatgcaaccacccaacctgaaagaaaccatggccattcatttacctttacctctcccctatataaaccgtactcagcttgtcggagaagccaagccatcaccaaaccttttagcttctcagccttttgcctctctttctactctctttcttggccgtctctcttatatccctcaatttaaccatcgagggcggccaaaaaaaagagagaaaggaagagcaaaataacacattacaccatggcgcgattcgtcatcatctccgtcgtcgtcgtcgccgccttcgccgctgccgctgtcgttgaggcccgggttggacctatcgacgtcgctccgaccaacctgatcaccaacccactcggtgccatcatcgacaatggccgcaagatcaccggcgccgtcgtcgacgagtgcgcctggacctgcgatcatgtcgcggtgagtgacgacactattgtccatggaagcttattttgatcgctcgagagggtccctcgtatttatatgtcacttaaataattataaaaaaattaaaaaaattaagaagacgtgttaacctgtgatatatcaccccacaaacatacacgttcaaattcaacttctgtatctcgcaacgaaaaaaataaattaaaccaaatatagatgtttaatttgaacttggatatttgtgaagtgatatataacatgttaatacatcttctcgaattttttttaatttttttataactatttgagtgacatgtaaacaatgagggaatgatgttcctcgagggattaaaatccactcccgctccagaaatggtcagaaaattacttactgctcatgtcatggatgaacagtctgtctattgatgttgatgcaggcgggtaacaagaagatgtgcaacacgctgaggaagctgccgggggtgagctcgccgaaggagctcctgacggcggcggtgaagctgtcgatgaggaaggcgaaggcggcgagggcgaggttcgaggcggcggcgagggcggcggagaaggggacgccgatggagtccatcctggacacctgcaaggaagggtacgacagcacggtgtcggcgctgcaggaggtgcagcgctgcatcgacgccaacgacagcaaggcgagcctcatcaccaagatgtcggcggcgaccaccttcaccggcgactgcggcaacgcctacgaggagcgggagctggagcccagcctcgcgctcaaggccaccaagaacaacgtcaaccgcgtcgtcaccggcgccctcgccatcgccgccaagctcaagctataattagccaactgatcatcaatcgatatgaatgattgatcaactataaaattacacctagctcatgcatgcgtccgcgcgttatgtgtgtacgcacgcatgcatatgtgtaagatcgatcaacagatcacagaagtggtggcgtatctcgcacttgtgaaaaaaaaatataaaaaaaaggctggagaacaaaaatgtagtatgctatcttaatttttaaggtgattaatatatatggcgaattcaacgaccgacatcgtatgcacttctcttttcttttaacgtactaacaagaatatcttactttgcaacgagtgaaggcaaacatattaaaccacgtattatttcacgtttttacaacaataataataatcacatgacgtagcttatcattgtaaagatgcaacatcgataaggttcatcgataagataggaagccattgccagacctcccctccaccgcctcctcacaaagtagccgacactgaccgagagctctcttgtcgccacatgttgctgcatgttggccatgcatcgcacccctactcatatcgtccaaatcacctcagcccaagaaatcaatcggtcgatctcttcctctcttttttttggtaatactgattttgtttagggtgattgaaatcggatccatcaacaaatcaacactcctctttccctctccatgtccgacatggcttctttcctactcatcaacttcgactctgactcgggaagtgggggcagaggcagtaagcgaggggaaggagtcgaggagtagcgatctagttgttggatctgttggaggtcatgaccgttggattgatggacgtaaaaacactaccaattttttaagtaggtaaagataaagatacaatgtccgttaacttctagacatatatttaactaattattttatttaaaactatcacgtaattgtcatttatttactattaatgattgttttatcatttaaggtattttatacatggcttaaattttatttgtataataaattgaaaaacatgacttatattttattggtaaaagaattgaataagaagaatgatgaaatgcctattcaaaagtcaaattaaagatgttatatactccctctatcctataatataaggcgtgcacacattccaaaattcaactttaaaaacatttgaccaatgattattataatataaattatttttttactaaaatttatatcattggattgacatttaaatttactttaagatggttataattttgttacaataaaccttatagtatatgagaaattataagtcaaagattagtgtcgaagattatgccaagtttggccatgctttatattatgggatggagggagtattatacaatgaagtgaatatatattaggcatcttgattaataaaagaatattttcaatggacatgattgtattcatcattcattagaaattcagaaccaatgactcaatgagtcaatgagctagtaaatttctggagctctgaaaacaggaggggtgtagcgacaaggtggatgtgtcgtacaccgtgccctccgtcgggttcgtcatcgtcgtgttcattgcctcgtcacttgcaggagaagtaagaaggggacaaggggtagggtggtggccctatctcctacccacgtacggtcatgatcgagcagcacagctcaaatcaagcattcctgctcaacttttgccttgtttagttacaaaatatttcttcaaactttcaatttttccatcacatcaaaactttcctacacacataaacttctaaattttccgtcacatcgttccaatttcaaccaaattttcagttttagcgtgaactaaaacacattgtttttttatccgtttagcttgtcacatggactggtgtaggcaaccaaacgacccaaagctgcatgagggatgcgagccaggcttgatacaggcaaccaaacatgacattcatgaaaagtatcactagacattgatagaatcactacatgctcataggctcccctacatgccacataatattttttgaccgctcaacatgctgctccggtagaaaaaaaaaaggtgttgtttggaatttggatgctatactaaaattaccatttttttccacaattatctaaattgtatagctagtaaaaaaatagacacatcttagctagtgccatactttttttagttggcgatatatggaccatgagactgagagagaatcatgccacaggtatggttatgaaccaacaagaagtttacttaatcaaacttgtctaacatgagattgacaacctctagcaaagtttgagagtaaatcaaaccacccctaggacccgccagcttggcagatcggtgagtgacagtcgaaggctgcatatacatcagtgatttgggccttttttttttatattcaggttcccaactttatttcgcggttggctcagtgatgtcacgagcaaccaggcgagttacaaactcggggaggggatcagtccatatgccgaaccaatccgggtcccccttcaccctcatctgggccagatcatgagcacaagaattactggaccgaggagcatacgagaaagcaatgctatcaaactctaacatagcctgagtaacatctgcctgaccagatgcatgccagagatacgcctgatgatgcttaaagcacctgcctgacctaagcttatccgccaatttcactagcctggctcatgcgctcgaaattagtggccggagctaatttcaagcgcgacaatcctgtttagtccagggctccaggccttctacaaaaatgagaaaactcagggacgcctcatcaggcaaaaagcataaaaaaaattcattgaagtctcaagtaccacttttactcaggcatacactcagggtagcaaccaaacatgcccttggtgcagaggctttgccgtagcgctgctaagatcttgctacactgttcatgcccatgcatcaacctgacatgatcaaacttgacacaagaaagcatgatggaaaggagagatatacatagtggtatacatgatccaagcttgttaattaggtacaggagatacaaaaaaaaatccaagcttgtgacatcagttgattaaataaattttacaatgatacaagagatatcggctgggaacaaaacgcagaaaagaaatgaagattctggggacctatactgatgacaaacttgcagcaaaacatgggtaaaatcaataacatggctgtcagcagctttcctcgcttgcgcgagatggaaccatgaagcctcgggagcccatccagcgagtgaatgttcgtctgagttgcctctgtaaacgccccctgggaggcttggactccaggaaatcaatcatttcttccagcaaccagaggtgtgaaaatcagatgagtctcaactcatattcaccagccattgtgatgtatcgaacccaaggaagggcctgatatccactcttttcgatgattttcagatagcgaacctgcaaaagcacaaagtcaataaaggagtaggataccaaaggaagttccaaacatagtggtaagagatgtgcaacataatttggtatgttacctgaatacccgacacggtaaaatacggtatctcaaatttcacacgtatcggagccttcttttcaggcattccatcttctgatgttatgcttggaaggctaaattctgctctacacatatattcctaatggagagattctaggaaattagagttgatggacatagcacaaaagtgaaaggcaaagtggtaagttggtatcaactcagcacttaccttgccaccaggaaatgattttattttccagaccatcgcatctctctcaggtgcatatgccgcagagcccattgaagttcttatatttgggtttgtcgaatcctcaggcactggtacttcaatttctacatttgttgctgtgctggaaatgagaaaaaacaataacagtaacttgtctggaactaagacactgatgcagagacattatcgcttttttaagaaaataaaataaaataacacctcctttctttgaactgacttcttgtcttcactgtgatctgtatccgacttcttgaatgtttctccacttgtgcttctacccagataagaggtttcacctgtgggagggaccagaggaagatagattaggtgaaatatagatcataacctagcgctatactagcagcaaagatcaagcagggacaaacctgggtgctaagtctgtaagtcatcagatcaaatgatccatctggaggaatgaaggatatagtcctgtcattctcaaatctggccaaccgaacacacctaacgaaggtttggccaattcagagttgtaacatggatgatgtaatagaaatgaattacatttgataaagaaccatcatagttatactgtatgttagtatcttactgatggaatttgatatcgtccaaatctattgcttttcctttagttgttcggccttgagcctccaagagaaccctatcattcaaccccagtttgcactcgggcattccactgtacaagcagatggatattagctatgatgcataagttgaacatatattttggacaatctaccagatcgtctgaaaaacaaactagtcagttcaatggctagtccacttagcattcataacgtaactgggtacttgggaaacatatagtctaacgatatcttggacaatccaacagatagtctgaaatacaaactagtcaggtcaatgactagtccaattagagcattattacatactgcaacaaagttcatttttatgtactgtttgatgctattatctggatgagaattacattacctacatttatttgacatggttgcaacatatatgtcgtagactcatagttggcagaatattgtatacacaatttaatagtctttattcatcaatatcaacttgcttcagtgatgtgataaacagttaaactagaagttcacaataatgggttggatacatcatataaaaacagtgtttcgcatccctctaactgcaactcccattaaattattactgaagcagctgagttatcagcacaatgtgaatttgtgatatgagaatgaccatgcagttactaccttagaaaggttcgcattttcagctcaccgatgacatcagacctcactatctgcccattgctgttaacgaggatattgacactctccaccacatccaagaacacctgcagcacaaaatgttgataattttctaaatccatcacacgttcatgtgaaccaaaaaaataaaaatacaggtgtagtgtatcagacttcattcttcttgtaccgaatcccctcgctcctccatgacacagcatttgtcactgccatgggcggcctctgagtgacctccatcctgtacgcgtccgttttaatgaactcgctcaggatcattgcttccgtgtattgtgggtacccgaaatccatcatctcatcaagcaactcatactacacacacagcaaatgacatcaaccctccaatttcagtgacacggcaattccgattgaaccagacccagtactcagttcacgtaacacgcaagcgcacataccacaacgacgaagttgtccctcaatgattcctcctccagctcctcgaagtaatgcttgaacacctacgcccacacacacacaaatcatatgaacaaaatccaatggcattgtccatactaacaaacgcagaatgttgctgtgaagatgggggcagcaacccatacatcgacgacgcggtggaggaagaggagtatgctggcggcgttgcagttctgacgggacgcggtgaggaggaacacattgttgtgctggatgaacatgtaggagacgccggcgtcatcgtggacgacgggggagagcacctccgcgtcgctctgatcacacagggcaaaaagctcatcgagaagcccggcatttgcacagatctaggtgaaatggagggggcattgcattacctccttgtcgaggagcttggtgaagaagcgctcggcctggagcgcggagacgtcgccgcggtagtcgcgccagacgaggacgcggcccttgatgtcgagcaggaacagcgccgacaccgcccccgccgccattgctcgcgccctcgctggatctggatctgctccccccacccccaccctccggagctatcgacaccccgcggcgcccacctacctaaccgcggccggctaccattcgtgctcccccacactcgcggcgcggcggggttcgcgtcgcgtcgcggcgccgcggtttgcttgccggatcagcgaggcgaggcgcggcgcggcgcgcgcgctctcgtgcacctctgggcgttcgcgttggcggaggcggagagggagatggacggggagatcggagacgacgttggagttagatggattcaggaattattttgattacatttcacaaaactattataaaaaaaactagagatatataaaactatatatttaacgtgaaatttctctagaactacgtcttaaaatgtttgctattccttacgtcccattttaagtgcagccatggttttccgcgcctaactttgaccgtccattttatttaaaaactagcatattggcccgtgcagattgcgccgctagcatcattatattttctctcatataatagcatatatgttttctcattatattattcaaatatattaaaataacaacataattttaaattttgcaataactttacaaaaccactaatatgtaatattcatattatattttatatacgtgttagttattaattatttttaatatcaaattttagttatttgtaaattatatatattcctatatggactctacactcgtcttttaatattttattttaattctgaattttctgtaaattgtatttctatatagactctatgctcttctttcaatattatttatttttatttctgaattttcatattatattttatatatctgttagtcattaatcatttttaatatcaatttttagttatttgtaaattatatttattcctatatggactctagactcgtcttttaatatttctttttttttaatttcgaattttttataaattgtatttctatatagactctatgctctttttccaatattatttatttttatttctaaatttttattatttttaattgtatttctatgttcactctaaactcatctttcaatattctttaatttttaagtttgaatttcagttacttctaaattgtattcctatattgaccttaaactcttcttcccatgtttttcttaatttcgaattttagttatttataaattgtatttttatatggactccaaactctacttttaattttatcatgtttatttcaaatttttgttagttttaaattcctatatggactctatactctacttctaatattccttatttttaattccaaatttatattattttctaattgtatttctatatgtactctatactctacttctaatattccttatttttaattccgaatttcagttatttcctaattgtatttctatatgggctctatactctacttctaatattccttatttttgattccgaatttcagttatttcctaattgtatttttatatggactctagtctcctcttctaatattccttattttttaattctgaatttcaattatttcctaattgtatttctatatggactctagtctcctcttataatattccttattttttaattctgaatttcagctatttctaaatgtatttctatatggaccctagtttcctcttctaatattccttttttttaattccgaatttcagctatttataaatgtatttctatatagactctagtctcctcttctaatattcctttttttattccgaatttcagctatttctaaatgtatttctatatggactctagtctcctcttctaatatttcttatttttaattccgaatttcagctatttctaaattgtatttctatatggactctgctttttctttttctccgattaatgtgagaatttctaggccatgagagcgaacgtgcaggcttcc

SEQ ID NO: 2297 - DNA, 2205 bp, Oryza sativa
actccactccagacccaactcctggagttaaatttaggagttggagctgtaccaaacatgcccttacgattgtatttataatggaacggatggggtatttaggatgggcaatattttggtagtgaggaggtatacaaattcaccacagagtatcacaaaagtaataaaaactatagatttagtgccaatttaatcaccaaaccatagcatctatagctataacatgacagattaaactctataatatgtagttttatgataaattatattgtaatgtatcgattctgtagttttgtgatagtctaatcgaagcatcgctagttctatactccccctccgccccataatatagcaacctaggacgggatgagatccatcgtattttaggttgctgcatcattatacgacggagggagtaaaatttacttttttttttctgttcccctcccgctacttgttgggccgtgggacccacggttcagtggctacggcccgggtcaccgagctataagcctcgcctcgcctcgccccgtccgcgcccgccgcatcaaccaaaattccaaagagccaaaaaccctagcgcgccgcatcccccgccgccgcctccgcctccgccgcgggtaaatccctcctcgtcgtctcctccgctcctcgtgccatctcgcggctgaacaggggaggggatcctggtgagcatccgcatcctctttctgatgatccatctctctcccccgacctacctttgcctggaatttgcctgcgttcgttaaccctagcttctcttctagatctggaagaagctcttctcttaatttcagatccttagccttaatacaattaacagtttgtttgtttgttccccaaaagtttggggttcaactgaattgaaccctcgtgtcccaagttggatccgcccctgcttgtagtagggtgagtagcataagcaagtttagcctgattgataatggaatagcagcatcacacgttttcgctttgattcttttctttcagtgaaactctgatatcatgatcctataactgctaaatgaatcttctgacgaagcgcttggtgatgcctgctaaaagagcagttgttgttgctgctgctgctgttacagtgcaggctttttttttcagctagctagtttagttgtattcccattgttactatgttttggcggatagaacttcagttgctagtatgcaacactgcttacattattctatttaaatttgcagctattgcctcatcttctattatagcaactcatcctataactgctgaatgaattttcagagaaatcacttggtgatagctatttttcctgctattataacaattgttatttttcctgctgttacagtgcagagtttattattctttttgctagctattgtttaggtttactcccattggtactatgctttggtggatagaactccaagtactagttttccacactatttgcatttttttaaaatggtgcagctattgcctcatgttctattattgcaatcatcctaataattgatcatctgtcatttaggttgctgttactgccatattttcacatggattcgactaagcaagatttccaaccccggacattctccatcaaactgtggccaccaagtgaaagcactcgtctcatgcttgtggagaggatgaccaagaacctttccacagagtccatattttctcgcaagtacggccttttgggcaaggaagaggctcatgataatgctaaaaggatcgaagaggtatgctttgcctctgcagacgagcatttcaaggaggagcctgatggggatgggagttctgctgtccagctgtacgcaaaggaaactagcaagttgatgctggaagttctgaaaagagggccaaggaccactgtggaaccagaagtacctgttgctgatacacctcttgagcctgctgattctgtatttgatatatctggtggcaagcgtgcgtttattgaggcagatgaagcgaaggaacttttgagcccgcttatcaaaccaggaaatgcatataaacggatttgcttcagcaacaggagctttggtattggtgctgccaatgttgctggacctattctggaatcaatcaaaaagcaactcacagaggtggatatatcagattttgttgctggcagacctgaggatgaagcccttgatgtgatgcgcatcttctcaaaagct

SEQ ID NO: 2298 - DNA, 1065 bp, Oryza sativa
cagttttgttataatttaccacgttattgttgcagcaaactgaaacgtgacgctaatgttgcagcaaactgatagttttgtcactaaaattgctgttttctgaaatctacactttaaaaaaagtatatcttttttcctctctatctacgatgagaaaatctagttataattctatttgtatatgtatgactaacatgtgggtcccactagtacgtcggcgctaccgtggcatgacacgttagcacttggagcgggtcaaaacccgtttggacctaaatgacacacaagacaagttcggagacctaaaaatatattttaagagtttagggacctcaataacacacccgcacaagttcaaacaccgtccacgtatttcactcaaattttgtttttttaaaaaatgcatcgtttagtagttcagaaaacgtacccgtggaaaacaaggaagtaggactcgagaaatgtgagaaacaaactaaaagccaagtctataatgcaccacctacaatctaacataattttgctacaatttggttaaaaaaatttagttttgcaaaatttactcaaaattggacgatattagtatgaaatacgtccaaccaaaatactggagagaactcattggacaatcaacggtagataagcgcacgaagctacctcacgttcccagatcaacggcgtggattgcgccaccggagcccgcatccgcatccaccacctccgctcgcaatcactctacaacagatcggaaacctcgcgggcggcggcggcggcggcgcgggtaagcgagcggacaccggcgacgagcgcgaggaggaggaggaggaggaaggagaagatggcggcgacgctgtcgcagctcgacgacgggatcgtccgcgggatggccatcggcgcggtattcaccgactacgtgagttctcccgccgcgaaaatcccccatttgtttcgactgattcgccgtggtttcctaatcgaactggtggtggtggcaggctgggaagataaactgcctcgacttccaccgcaaggaggatctcctcgtcacctccagcgaggacgact

SEQ ID NO: 2299 - DNA, 7927 bp, Oryza sativa
tgtgttatgatcttttgcttgtaacatagtgttctatgttgatttataattatgcatagcttgaaatgctttgaagagcaactttttttttttgaaacgtacaatttttttcagccatggaacaaaaatatgttcattcttgctctgttactatttgtattggctatttcaggactagaggtgtattttaccttgacatagcatgtgttttcccactgtctgctggacttctgttcctcaatgctatattatcatcttttgcagtttaagcgacaaggaattgagataaggcgtgtggtcgaaagtgacagtgagggatgtcttcctgctgacagtgacttgcacgggtccaaacataagaacatacatcagaaagtgcgtaaaccaagagccttccgtatctcgcgcaatcatgcctcagagaaatctgaacaacaaaaacagcaacatgtgagcaacaatcaagaatatgaagagattgaggagggagaactgatcgaacaggaccatcaggatactgcttccagaagcaagtctaaccaccaaagaaaagtagtactgaaatcagtgatagaagcaagctcagcatgccagggaggggtgattaatgcaacatcaaaagacgctgattgcagcaacggagctacaggggaatgtgataataaacatatacttgaggtaatgaaaaagatgcagaaaagaagtgaaaggttcaaagcgtctattgcaacccaaaaggaggaagatgaagacaggaaagaatcgttggccgtgacttgtgatgtagatgacatcaagaatcagcgacctgcaaggaaacggctttggggttgtagtggttaagatgctagaaacctttaacaaagctcaaacaaaccttgtgtcaggcatagtttatcacagaccatcaccatttggttgagccagaatgtctagtaaacatctctaaccaggtttgatcaagactctaacgctccaaaggtattcaggttcagaaaccgtagatcttttgtttgtttggaatgagaggaaaaatatacagagcattcaattttttgcctatgtaatacatttacaatgttgacattatctaccataattcttcatagtaatatggtagaaaatggaaagaaaaactgaaagtttatgcatatgtctgtaatggattgctcccttccaacagagtattgacttctggtaaactgggaactgaactctccatatgtatttatacacaattttggatctgagacgctgttacatttctgcttgtcatgcaattttgcgtttatttcaatagtaccgaagttaactttctttcagctgtgatgtcgtccagttatacacctgtgcacttgttctgatatttgaatgacatttcccgtggatatcctcagctttggagatgttgatattgagcttttagctttgtttggaataatgggctagtttggtttaaggcctaaattaggcttaccaatatttggcaatttcaatagtgtttagtgtctattttgtttgaagccaaattttggcatgctttcttaggccatttcaatagtgaacttaggctattttggtttcaatccaaatacaactttaccttatcaaaattagtcatgcaaaacttatcaaaatttagcattgtcaaaatttggtaaggcctatttagaccacaaaccaaaccaacccaatatgttctctcctttttttccctcgagtcctgcacgaaatatggtgccgtgttcctgtaggtagcttcaatgttccagaacgcattcggcatccactcgcatttgtgaacagtactgtttgtttgactggagtagtagcatgcagtagctgccgtgttgataacttgatatatctccagtcccttccgtaaaattttctgtctccaactcgagatgggcattcagcctcgtacctctaaaaggaaacacacacaaaaaagaaaaaaaaaagacagaaaaaagatagagagagaaaaaaaaagctttctgcaacagaaatacgccactcgtaccgacaaaaatatcgaagcagttcagtgaaacccggcccgaccccacctgtcagcgaaggcaattcgaactggcgcctgcatcgccgacgtggcgcgtcgtgcgcctccaacccgcaccccccaatcccccgcctcccgcttttacccctgcacccgcgggtacggcattaatggcaccgcatcttcgagggcaatcccgtaaatccggtaaccgcctcctctcccttcatcacaaaggacgcgcctccctcgcttccacctcgctgctttgctacggccggagcggcagagcacactccggcgaggggggccatggcgatgcggctcttcccgtcctcgtctccgctcccgccgccgccgcctctgctcccgagccccagcgcgaaggcaccgccgtccgcgcccttctcactctccctccgcctccgccgcgcgcgggtggcagcctccgcggccgctgcggcggggggccccgagaggggggcgggcgggtacgagggggatgcggaaggcgagggcagcagcggggcgttcgacaggggaatgtcggagatcgcgaggaaggtgcctctcttcgagccggcgaggggcgacgccgcggcggtcgccggcgagcggccgctgcccatcaacctcgagctctggctctaccgcgcaaaggtgcacacgcggaagtacgagttcgccgacgcggagaagctcctaaaccaggtgcgttccttgagaattgtggatatttcgcaacgaaagcagaataaacacgcacaaaaaaaaatgctcccacagcttagcaaattgacaaggcatatatagctagttgaagcctgaaggaagcgaatgttttcctcctatatcgataatataggggtttaacaatcctaatttgagttgtttaatagttgatggatcttgcgccgcgtatctgatttatgcagtgcatcatgtattggccggaagacgggcgtccatatgtggcgcttgggaagctatacagtaagcagtcgaggtttgacaaggctagagcggcttatgaaaggggttgccaagcggcacaaggtgaaaacccgtatatttggcaggtttgcaccggatcacttctcagcctccatttggtaaattgactggaaaaaactgtacagcaccaaaaaaaaaagtagcgcgtgaggtttcttctttaacattccctaagatatgttaatattccttagctgtgtttggagttcaactttcaaagttctccaaatggatgaccatgcccattagcaattcacaatgaagagttattttaggcatttgagcttcagttgcatacattgctttcctctcaaatatggatgcaagatgaatagatctagtccattgcactttgttcacaggaacatcaatgtgattgatggctgatcatgagatatgaatacactgctcctatcatggccatttgccctcttcttttcaagtacttaactcatatgtcaaacataatctcttggattttctgaataagtctaaagacttttggtttgatacaccgggctgggatcatctttcacgatccacaatttcacactgaacaaaccagtccactgttttcttatgatcatatcttgttcatgttatagaaattaagcatataattaagttcctgttgtccttttgctttgagtatgcagtgttgggcagtcctagaacgcaaaggtgggaatattcgaagagcacgggagttatttgatgctgctactgtagctgatgcaaagcatattgcagcttggcatgggtgggctattttagaaatcaagcaaggaaacattaaaaaggctcgaaatctacttgcaaaaggtctaaaatattgtggaggaaatgagtacatttaccagactcttgctctgcttgaggctagagcagagcgctttgaacaagcacgaactttattccaacaagctacccaatgcaatcccaaaagctgtgcaagttggctagtaagtatttgcttcataatttatccattttagtgcaaataaaaactgcatagtttttttgtctaaactgtgaacttatgtacggcaacttctagtaggcatgggctcaggtagaaattcgtgcagaaaacaatgccatggcaagaaaactctttgaggtaataatttattttctatttataattgttcccatgaatgtttgcgttagttcttcggtactcatacttgaaagttttctaacagagatccatccatttccacatggcaaattagaaaagatttcccaagtagagatgaaataatctttaatccaacccagagaactgtgctttcaaaatgattttactaccacatatcaatgcaatgatgtggcaataatttttataacttaataatatgctgttagtgtgattcactccatagttcattcacacctgcatgggatggtttcagtcaacacaatgctgtctacaaagtataatttcgaatttctttttacagaaagcagtccaggcaagtcctaagaacagattttcatggcatgtctgggcactatttgaagcagaacaaggtagcatcgacaaagcaaggaagttacttaagattggtcatgctgtgaaccctagggaccctgtgattcttcagtctcttgcactactggaatacaactactcatctccaaataccgcccgtgttttatttagaaaggcatctcaaattgatcctaggcaccaaccagtttggatagtatggattttctgtgcttatctctcttttttttataagtaatatattactcatttgagccgcatttgtttttttacacctctggttaaattaacttgtagggtttgttttagtattatttacctgacatttcgcaaatagctatgattaattagtttatggcacttcttgatgtaccttgcacacttgagctgcatcttgcaacttgcaagtgctctggctgttcaccttcctgtcacaaatcacaactgaatatgcacacgatacaaataatttgggatttgatggatgtaaaggttcagttgagtgcagttgtctgaattattttgttttagttactttcaagatgctatatatctcatcgttacatttgtccatatttgtgctcatttaggctgttacttgggatctcccgttcaacactacctttagaatttcgtttttctatttgcacttatttagacttgtgcaaagcactatatatcttacaatcaaggaagcatcgcatgttcctggccagagtaaagtaaaaatatttgttatgaactgttagttggtagaggtggtattaagtgagcaaatctattacaccaattttaaatccctagatggatctgtcttgttttatcttgcaaactgtcacgtttgcatttgtttatggaatctcttttatttggactatctttgaagcttagctctgacttatggatcatgttataggcttgggggtggatggaatggaaagaaggaaacgccagaacagcaaggacactgtatcaaagagctttgtcagttaattcaactaatgaatgtgctgctcgatgtcttcaggtaaatgatctattgatggcaatccagctcatattgaactggtagctatacgtttttgctggccgatagctataggagtaggtttttgtctcacgtggtaatgtgttactattgaataataatactatgagtttcatggtttttggaagatgaatgcttctatgtgtgaagtttcttctttactggaactgctgtactcatttgtgatcgaaagactcaaatttctgtacacttaaaacatatcctgccctatttttgtaggcttggggagtcctagaacagcgggccggtaactacaccgctgccagaagattgctgagatcttcactgaacataaattctcagagtgaggtaacatggatgacatgggctgcactagaggacgaacagggtgatccagttcgagctgaagaaatacggaacatctattttcagcaggttagtcccgggtaactacttttagatatgagtactgggtaactttagagtagcatctttctcaattcatgtttattgagttaaaaggcagtaaaatggaattatttttcttcatgttttgtgattaccaatttcatttgcatcacccatgaacaacgtattaacaacaattgctggtgttcgcatcatctctgttgaagtttctccctgatcattatccatcctgacagcgtaccgaggttgtggatgatgcctcctgggtcatgggcttcctcgacatcattgatcctgccttagacagcgtgaagaagctcctaaacatagaccagccttcggggcctgcaacacgagacaatccgaaaagcactggagagccaagcaatacagctaccgtccggacttctgccgatgcagagttttctggcggttcaagagcagaaggatcggacgcttcggaccttgctaacgccgatgacaaggagagcgatgacgctgcagagacaccagagagcgatttcgacgtggatggattcatcaggaggcggctagccctggacccggccgagctggacgcggtgcttgagggttctgatcccaggggagttgtttccaggaggaggacgcagaggttgcccaggaagccccttcctcttctccctgttccgtaaatatttccacttcagttcaacaatgcacatttgccatctacgccgtgcgaagcatcgaccactaacagtaacaggtaccgtgactcgcgagatagttgaacatacatatctgtgtatatctctcagaagaagagcgcggcggctgccattagcagccacatgtttgttactagagttgttattggtccacccaggtgtatgtaattctatcattcttcaggagcagtgtatctgtgtacataagcgcaatctatcaatttgtatgtgctagtgaagaattcaaaatctgcggatatcacttcaatccatcttatgccaattggataggataaagaccatcacaaaggggtcatgaaactagaaaatgatttgattctaaatctgagttatccaaatgtgcgccgttcatgttgccgggtagtacaaattaacaacagtgacaggaagtaaaaaattaggaatcagcaggagaacaaaagctgcaattagggggtggtaaacgatctaacattttaggcttttagcctacaaaatttaaaggctggttttaaaataggatgaacaaaatttctgtttattttcaaattgggtttaaaataggatgaacttttctatttatttataactaaaaatatatgagaattagatctttatccataatgatcccatagctgcaacaggtgattacaaacaacaattaggatcaacagtacatacatctgtgttggctcgaaagattgcaagaggacaagcttagcaatgcactccctccctaatacgccggcctgccccagaaaactcccggcggcggcggcggcgattgctgctgctgcagctgcaaggtgggaggaggtggctgatgcagcgctggagctggcggcgatctgatgtggccccagtgcggcagcggcgacggccgcggcggcggaggttgagcaccccagaacggcgcgccccagaatggtgccgggtaacacggcggcaccgtcggtgggctccagaaaggtcgctgtcccgccgggggatgctgcgcgaacgcaggcgctcccgggaacggcggcggcgccagtggcaccgccgccggcaacggcaggccccacgacagccatggcaccaccgcgggcgacgcgccgaagtgtacgggtcggggaggaagcggcgccaacgtcgggtggccgcaatacggtgggggaggaggaggaagccgcgccaacgtgggctggccgtaataccgtggggga

SEQ ID NO: 2300 - DNA, 9933 bp, Oryza sativa
  unsure (1)..(9933): unsure at all n locations
ggtggcggcaaccactccccatcttccttctccgccacctccatcgacgagccaccgtcgtcgggctcgggcggcctgtgaccgtaggccgagctgcggctccgcttggaccgcgcgcggcgcccggcgagcacgaagtccgcggggcggggatcgggctccaccggctccggcgcgtccccgggcgacgcggccaagacggccacggagccgatggggcactccgtccacccgatggcgtccacgtcggcgctcaccacgtcggcggcgatgacggcgtcggacggcgggccctccgccgcgcggtgcagcgtggagcgccgcggcggctgcaggtccacctgccccaccagccgacgcatgatgtcgccctgctcgcaactccgcctcgtcacacataacgctcgcaacaacgagagagaaaaaaaaagaagaagaagaccgaaacgtatcgagaaggcaaccaaccaaccttgttggagcggtggagcttgacgaagccgtgcatggagatgatctgtgtgccgcccgcccaccgaagtacgtgacatgcatgccgccaacacagaaagatcaagcacaacgaaatcagaagcagcaatctagactaaaaagaacacaacacaagcagacgacggcgtgcgggcgtgcgggcgtgcgggcgtacgtacgtggttgaggtggtcgatggtgaggcgggtgccccatgggtcgacgaagaaacggtggtacctctccagcgtcaggggccctccctgcatctccctccctcgccccctcggcaccatggtaggttcttcctccctcctctgtttctctcctctcctctcctcttctcttccccgacgcaactctgctttcacctctaggagtctcctcctcttgtttctttccgctacctctgctctgctctgctcagcgctgcacaagggaacctggggagcaaaagcttggttgttggtgggtggtggggcccacctgcaggctttcgcacaggagaggaggattggatacattttactcttgaccgggcctgaacaggaggagatgatggaggagccgaggtgggaagtgcgtgacgaatctcgtcagatcattcatgctgcagcagggtggttgcaccaaaagagggattatcaaagccattgctgtgtccggttcgtttcgcgtgttgctcatcagttgatcgacgagaacgataaggtgaaaatacctgcccgggcgacgcggcatgctgccttgccggcagagggctagacagagcagcttttgccttgcctttccttgccggcatgttgccattttcgttcaccaatgtggtggataggtgaacgtgaacactgctgcacacctctgcgtttcactattctttcctggtttcaatgcacccatatctttggtttcaatgcgtaccctgataaatgcaggactgcaggtgcagttccaaagattggaaaagaacgttttaccacctaccatatcatgccacaggacaagaacattgcaacccattcttggacgaaatggatgaggacgagagcattgcaaacatgattcttggaggaaatggatcgaccaatacacgtaataagtgataaccacgaaacagcaaacagctttaattgagtaagcatgttaggtttgatcctttaacacggatggattcatctaagccggtaaaatttacagaccagcggtaaagcaaaatgtaggacgtcaactgaactttaaacaccagagctaagctgagcacaacccaaaacaaacactaatgcaacttagtactggcggtgattagtactactagtaagaaccaaggagaggccatggcgtcgccgccctgcagatggaggagccccgggctccgtcaggcggtggccgccaagttctcgacggacgggagcgtgagcaactgcacgacgcgccgcttcctccccctcatggccgccttcccctggcccttcttgcaccgcttccggatcaccaccgccccggggggcgcgggcgagcaggcgctgagtatgctcggcggggagacgcgctccacggcggtggagccagggcggatggccgcgatcggcatgtgggcggcggagggcgccgcgtcgccgccgccggcgcggatggagaggagggagccgacggggcactcgcgccagccgaggtcctcgatgtcgtccctggcctcgtccatggtgagcagcgcgtccgacggcttggcggcgccgcgcggtggcgcggccgcgttgatgccgacggtggagcggcgcgggcgcatgaggtcgaacttgttgagcgcgtccacgatcaccggctgcgagacacgcgtcacgggtttttgcggaagaaccgaaccgaaatgggggcaaatagaggtggattgggggggtaccttgttctggcggtggaacttgatgaacccgtgcatgaagacgatctgcgcgacgcgaccagcagcagaggaagacgatgagtggagggagaggggggcgggacgggagtcgggagggagggaagagggtgtgggtagtacatgtacctggttgaggtggtccatggtgaggccgtggccggagcgggtggtgaagaagaggatgtagtcctcgagagtcagccgcggtcgctggtccatcggcagcttcggcatcgccgtcgccgctccctccctgtctctccacacgagcacaccaactacgctacacgccctccctccctccctccctccctcccgcgatccggcgaccgtggcacagcgcggaatcgtttataggtgaccgtggcagctttgcgaattttggggggattgggaaaccaagccgggagcgggcaccaaaaagtttccgcgcgctccagccccggcccgtcccccagaacgcaccgccccagccagctgggtctggatggcccacatgtcagtgtctcattttcctcttggacggtaatcaaagccttgcaccgaacacccaacccagagaaaaatttcatattccccgttcgaacctaatgttccagttgtatattagaaatttcatattccccgttcgaacctaatgttccagttgtatattagcggcatgcagctaggtcatacgttggatataaacaacacaaaactttacttatttcgagacggagaaattaacatttaaaaaataaatacattatcaaaatatattaacgttatatttaatgaaaataatttaatgttatagatgtcgttaagtttttcataaatttagtcaacctatgaagtttgactagaaaagaaaagttgtagtttgaaaaaaaagaggttaaaacgatttataatataaaacatattataaacggagaaaatagttgtctagaacagaaaacgggcgtgcacatggttgatggaaggacgttaaacagcgagcaaatggggcatggtcgcatagatatacaacaagcgtgcaagctcaccaggaaattgtatcattcacatcatgtaatctacatgttacagtcaatatatgtttcatcagggcagaagaacaaaaatggagagaattttggtacattgggttcccccaaggcctagcgatcccaccccgacggccgctttctctccctcgtgcgatccctcgagctgcaatccaagagaattttgaccgttggttagcatacacaacatataacaggcgtgtcataagtactaacaaaattaccagggaagcagtactatgcaagggcacgcacctttcagggtttgggttcgcattttcaacagtgttttctgcaggtctggaagcagggacaaaggagggcgcaggcagtactgcccgtgcttggtttgcgtctcctcctatggtgccaccagaaacaaaaccacggagtgccggtctcacaaaggaggaaggagcacctcttgaaggtgcgctgttgcttggtgtatttgatgaagaggcagagacaaagctgctcttaaaattttgcatcatccctgtcttcaatgaatttaatgcagcagatcttggagcaggcaccgatcctgattcagcattgtaccctatgccaaggccaaagtcaaccccacgtacaccacgcccacgaccacgggcaccgctaccgccgccacccccgcctcctccaccttttcctttgccacttttcttcccacctgatgaggataactaattgtcagaacaatctgccacaaaaaagctctatgccatctgttctgcgatgaaataaacaagatataccttttcttgaatcccggtttgctctgaatcttccatcctgcaattcatatcaccaatggatcagaaaaggaaataggttgttcatgcaatagtgactaggagaaagtttagtgatagcatgcacatgttgcaacttttcaatttaaattcactgtgttttaactaaaattgaatgcaaattactctgcatagagagacaatacaaaatgtttgtgcataagcaaaaactcaccttcattgccagatccattagttcatttggcacatcctgtcctgcagcaatcaaacaatgaaccaattcacctgcaaagcgcacctccttctgtgtaatcagagtatatgcagttccatctttatcaccagcacggccagttcttcctatccggtgaatatgcatatccatttcttttgcaatatcgaaattaacaactgttttaatnnnnnnnnnnnnnnnnnnnnnnnnnnnnnnnnnnnntgctactaggacgtgataaaccccggatttgaacttctgcaatgtctccatgcgagaagcttgatccttgtcaccatgaagtgctgcaattctgaaacctctctgatttaactggctctcaatctcatcaactctggccttcttagctgcaaatacaagaacgtctccatcatcaatcatcccaggaagtttttccagaagccaaggcatcttctcagcatcagaagggagtacatttacaacttgcttaatgtcttcattagcactgccaacctgacctactgtaactctaatagggtcagtcaaaatttctctagccaaacgttccactttgtatggcattgttgctgagaaaagcaaggtttgtcggtctggtctaatttgaccaacgatggatcttatctgaggctcaaatccaagatcgaacatgcgatcagcttcatcaagaaccaaataagttgccctaaacatcttcaatgccttcatcttaagcaagtctattaatctccctggggtagcaatgactatttcacagcctgccttcagttctttgaattgatcaaatttggaaacccccccatatacagcagcaactcgaagattgtaaggttgggcaaacttcttagcttcaaggtatatctgatgtgccaattctcttgttggagcacataccacacctattggcccttcttctttctcaagctcaggctgatccataatgtgaacaatcatggggagtacaaaagctgcagttttgccagaaccagttttagcaataccaatgatatctctgcctgaaagtacaattggtaaagcctggcactggattgtagttggtttttcataaccctgcttggcaatggcattcattagttgtacaggaaacccacaatctgcaaagcttttgattggtcttggcacatcaaaacctgaaactcgaattgccaaacttttcatataatcagccacctcttgctcactcatccctacaagagaacagtaaggtttcattcagtacatgactattcatatcacgcagaacgaaaaaaaaaggcataattgtcatgatcaatcgtgtctgtagatgttattaccatatcaaacatgaacaaatatgtgcataactcaaaatttcattgacctgctaatataggaaggtacacagaacaggaaagagacaaccaatgctcaactagctgaaaatgatggtccttcatttggacatacaactaatgtaatgtttaagctggaacagggaaagtaatatttgggcctatgactagtaaaactaaattctctagctagtattctcaaatacaataacaacagaaaaaaatccacaatccaagcgggaaatgttgttacatatggcactaaagaccggaagattctacttgagcacaaatacagagaaaaacgtcccttaggtcatgtgatgcaaatgcaataagagtttgctcatctgtcctttcatcatgagtgtatatctcaacttctatatatatacagttaggtaggccagatcaatcttgctattgagtattgacaatttgacatatgccagggctgcatttatccatttagaacactagcaagtagcttcataagcaagtctagagacagtgccaaagtaattcctgaattcctaatgttgaattaacaaacctattggaatgcattacaatagtacattgtaccattgtcaaaaggggttatggataatgatgtactgaaaaattgcttcattgcgaagtgcacggccacatgcacatagagattgcaaaaagttataagctagcgcatgccttctcaaaataacaaagtggcaacatctattataatctccagtgccaaaccataaacaacgtatcaaattatcaacatagaagaaatcccagaactacaaacagtttccaaatcctatttcatgacgatgattttcatttgacatggttcaagctggtaatttcaccattgagatttcagtatccaaatagaacagtagttggatttcctagctacaggtgagacctaattaacctttgcaccataaaagcagagacccaggttatcataattcataagctcaatgagacatgaaatatgctattatacggggcaatgtgcttcacctgaaaccgagggcttctcctcgtagaaatccttgttgaagggttcatactcgatggtggaatggtcgagcggcggaataggctcgatcttcttcttgtccaccactatggggttgtcgtcggagtcgtactccatcatgccggcgtccacggccttggccgcagcgtagacctcctcgtcggagtcgtacccggcgtgcatggcgtcggcggcgagcgcgagcccggattccttcttggcccggaggaagctctccacggggtcgtcctcgtcgtcggagtccgcgcgccggagcgcctcgggcttgggcgccggcggcggcgcgcgaatctcctcctggatctcggccatgaaggcgtcgagcgggtcgatctcctcctcatcccccgccgccccgcctccccccgcggggggcgcgtccgacggggccgccgcgtcgtcggagaaggcgatgtcgtcgaggtcggggtcgtcggcggggacgtagaggcgctggggaggctgggagcgctcgaagctgtaggaagtggggcgagggatgctgaatcccccgagcttgggccgcttcgacatggccgggcgggcggggggcggtaggtagggagaggcggaggcagcgggcgggggagcgcgcgagctagggtttgcgacgcgaggaagagggaggaagacgatggcaagcgcgcagaatttcggttgggtcgtcgactcgcggctcgcgggcgctggcgggctgggccgtggctgtggtggatctacgacggatggaaaaagtacaccaaaggtacctcaacttatcggagagagagcgctaagcgtcggacgtacggcgccagacgaaaaatcgaacgtctacttctcgtgcgaccgtgcgatgaaccatccatctcatgcagtttgcgtcagccatgcatcatacatgaattaagctagctttaaactattttttctcttaaaatatttatctaaatcatgatccgattgtaccattaaatccgttgtaattaaatctttaaaacaagaccacacattaatataatccaacgaaaaaaaattttagcttattattaaattatttttaaatattgcacgttgttgcactaagtatatcggaattgtttcactaagtagatcgaaaatgtttcatcggacgctatttcaccttatatgaaaataattttcagcgaatagtgaaaggatgtttcaattcactgtgatatttgatccatacatagtgaaatattacgagtacactatgtgaaacattttaaaaattgaaaaaaaatcgtacggtcaaatgttgcagttgatcaacaagtgaaacagaaaaatagcaactgaaatatttaaatattttatgaaacatgatgaaaatacacgtcgaaacatgccgctgtcacatatgaaacaacaagtattaacggtttgaaatatatgtttttcttttatcaaaatataatcatgcaatatcttgttgtaaagatttaattacaacgaatacaacgatgtgatcggatcatagattgaataagtaatttaagagaaaaatcattttgaagcttgctaaaatacatgtatgtatgcatgcatgaggtggagagagtagtagcaggtagtttcaggaattttatgaaacacactgaagacacgtattgaaacatatcactatcatgtatgaaacattttgttttaatggtttgaaacacatgtttttcttttgagataatataattatgtgatatcttgttgtaaagatttaattgcaacgaatacaatggtgtgatcggtttgtatatcggataagtaatttaggagaaaaaatatttaaagagaggaggaaagaatgaaaagaaacggctagacatgtatgttacagtgacaagggttcatccaatccacaggcctgatttgacgtcaacggagaaaaagaagaaattaagtaataaggagtaagctggttgtaggtgttcgatgttttctgtctgatcggatgttcgaagagaagcattttcgcagcttatcatcgagttacaaaatcgtcccccaactgcaaaactagatatatgacatctctcaacttacaaaaccgttcactttaggtcattcggtggttttgaccccggttttatcctacgtggcagctgagtcaacatgggacccacatgggacccacgtgtcaggatgtccacgttagcaccttttcgctttccctcttccttctctctcgcactcttctcgttctcgttgccatcgtggtgctgcatcttggatgcagaggatctcgccctacgcgacggcgagctgcatctgcagctgcgacgcctggttctgcaggaaggagatggcctcgacgtagccgtaaaaaaacggagcggttcattaatgcgtaattaattaagtattagctattaatgcgtaattaattaagtattagctatttttttaaacatgtatcaatatgatttttttaaacaactttcatgtagaaactttttgaaaaaaaacacatcgtttcgtagtttgaaaagcgtacgagcggaacacgaggaagaagggttgggaacacggagcaaggaacacaccctaagatttaaatgtgatgatatgttttcttctttcctcaatccttatttcgtccacgaaagaaggaatgtgcggtacataggagtattattttaaagacaaacaaatgtgataagcatataggtatagtaggctcccagtaatgattgcgttcgtttaagcattttgagtgggctaaacagtcgcacatgaaatgaaaaaagtcactgattaattaagcagtattcgctattataaaatttaaaaataaattaatttgactttttaaaaagaaaatcgtacatagaagatattttataacggaattgctaaccttctttcgacagaaattgcacctccccaaattttgcaatttttggaacatcggatgagctttgagattcgtgctccatgctctcttccaactccggcaacctcctcttcttctccggcgctggcgacaccctagactccggcagaggaccctacgggttagggtcccggggtggggtgggggtgggagggggaggggaagga

SEQ ID NO: 2301 - DNA, 5430 bp, Oryza sativa
cgtctcgccggtgccgttgacgcccttcggacagccggcgaggcgggcggtggcgatgggggatcgggcggagcagagaaaagagcgatgggggcggcagaacaagcgatgtgaggggaacggaaggagaagagctagggttaatgtctttgcacgaatcttaaagcatatccgatggtaaaaaatttgaaagatgggagatttgattttctatcaacagatatatagacagtcccattttataaacaatactcccaccgtttcacaatgtaagactttttagtattacccacatatatataggtgttaatgaatctaaacacatacatatatctaaattcactaacatataaatgaatgtgagtaatgctagaaagtcttaaattataaaacggaggaagtatatctttatccgttcgaataacgtactcagggcaagtactataatgctccataagctgcccctaaatgtgccacattggattgagtgatgaggtggaggagagaagtgaggagagagatggtgaaccacccctaaatgaagaggtaacctccacacaaatttcaagaggggtgtgagagtataagagacattggtatttgtgtactagaggtgacatattgtataggttacctcttaatttatgagtgaatgatgtggataaatttagatgtggcacatctaccataacacttgccctcgtgagaaaataaggaagtggctggcaaaaagctcaaaagaactctaatgaagcatgaatgtagtgggaccgaaggctgcttatatcctgatcaaaccatctctttcgtaggagtaccaggcaagccaattgagatcctctgtagtactgcacgtgcagtactgctcactctgtagtactgcacgtgcagtactgctcactgacatgtgggcccgggcgcggtactgctcactgacatgtgggcccgggcgccagtgctgcagagtacctgcatcccaggcaagcataccgttatctgtcttttctttattaaacaaacaattattatgttctctaaagtttgaggagaaggggattgagaagattgggaagatacgcaaaacgaggtgagccattagcacataattaattgagtattaactattttaaattttaaaaatgaattaatataattttttaaataacttttctataaatttttttttacaaaaaatacaccgtttagtagtttaggaagcgtgcgcgcggaatacgatgggctttctcacccaatccgccatgaacgaacgcaccctagttcaccaattaagcgaccctaggcgctgagaatatctccttttcaccgtgcggaagacggagaaatttccttcatgctgtaacctgtaatgtatcgcctgctttccttcatgcaaagaaatttccatcatttatcctgtctcgtttcaaatggtcctttgctccacgagttaatccatggacctattaaataaagcataaccataaaaagaatccgatgtcctgacaaaacactgaacaacataattcagccatgcatgtaagcgtctggaacgcaccaacctgggtgaccagggactaattaaactactaccaatgtcctaggatgcatcacagtgtcttaatctaatgaatgaacagtaactgtagttactaagtaagctttggatacataaaaaaaagatccttttcgaagtccacaagtttcaactccactgctgctccgtagaccgtaggtctatctattagcaatatttaataggtagtattactaatttagttgtatctgtatatatatccacactataacttttactatcacatcccttttgagataaacatagttttgaaataactacagtcaattcttaaacttttagcaactaatggacggcgtatcatgcgaaatgttttacgattttgatttgtaaaaagaaacacactttggcatgattaactttcaagatcgtgtcaataggaatcgctctttggtttcaacgagacaacgacttaatgatgtgtggcgcattgaatggcctattgaataaatttacatttcagccccttgcatgtttcagcccataagcttaccaataattcaatatacagtacacatttgatttacaaccatgcccctccggacccacttgtcagccactcgaaatcctaatttcctcttatttcacgcccatctcgatctcttcctcccccttttccctcttccccttctctctcccgcgtgccctcctccgccgccggtggatgccccggcgtgcggccgctctccgctcccctgatctccggccaccgagcgccggcaatctctctctcttgccggccttcgccgcctcagccacggcgccaccgacctgcatgcgcggtctctcacccgcttcccaaaaaagccctcgagctgtactgaaattgtgaaaaagcgagtcccgttgggtagagacgggtggtgtgtgtggaaagcgcggggcggggcaggggcaaaggcaaagaaaaaggctgctccaattggccctgccaccgaggcacgtggcctcttctgtccttgcccctctgcgctgcgcctcactcccggcctccctccctccccacccaaatcttcctcccccttccccttcaaggcctgggcctgggtgcttctccggggcggcactctggacggcggcggctgcgaagcgggagtgtggaagggtaacttcactgctgcctcgctctcctgcgggtttgttttttttttctcgttttttttcttgggcggcgacttcagggtggtatgttggtttcgtcggtgagacgaagattgagggtttttttttgggggttgtttttgaggtggatgttgtcgtcggtgcgtcgatttgaagctggggaggcttggagtggcaatgcggccgcctacgagtagtcctcgcgcttcattgcggtggtgtattttggtctgtgtgcttgtgcgtgtgtttttttctgggtttgtgcagatttgggattattgctgcttgtctcgcagtttttaggttttgtttggggggtttagggatgccatgtcttgcccagtgcgcggtgctttccctgttgctgcaacctcgatctagtgccggtggttcaatttgctggtttatggcttcgctaccgccgcatacttttaatttttacttgttctcttggagttcatctcaggccttcattgcctgcaatgagtggtaccttttgatcattgaaccaatttttaggtgctttacttagacgttgtttaagaatcaggatggtgtgcttagcattccttgctattattctaatggtaacccgccgtgcttgctgtttttttaagtgcaaagtttctacctatccattactgacatccaggttcgcattaagtaaaacatgaggctcacctagccaagggtgcaaaactctaataacaaccacaatctttggcagcctatgaacctccacattagaatccatacccttgtgcatgaaatgcatgcttagctgtcatatttcacaaaaacaagtgtgcaacttgccttaaatcatgaactatcctctagatggtatggtgttggactgggctgtgagattcagagactaatgatctggtttgtggatggagtagtggcatgggctgtacataacatagccaagatttctatctcccttcctttctccttgttcttctactcctaatctcctatacctctcttcttcacagatccttgccagtttctcttttgattgctgccaataaattccatgtatattacaaccaaactacacgcatgctagcacattagtcactagtgctattggtgataagcattggagatccataacactttgatgcctttatgcaggttgaggtgtgagaaccaggtggttgctccaacctttggggttcaaggaagatgggtttcatgtcagcgaagctctttccttcgtgtgagagtatgtgcgtgtgctgtccagctctgcgcccaagctcgcggcgccctgtcaagcgttacaagaaactgcttgccgagatattccccaagacgcctgtatgtgtttgcttttcactttatttctgtgcaagtttagattagcaagtcctgtttggacattgttgctgcaactttaatgcattgtgctgtttttgatctataagcagttaatagtccttgttaacctgctctatggagtttgcctatcaaatggttatattctccactgacgacatattcgtggacaatgcaacttcactgtcaagtgtagcgctgctgattttgcagaatttacttgcaggatggccttccaaatgagaggaaaatcatgaagttatgtgaatatgcagcgaagaatcccctgcgcattcctaaggcatgtgctgatatcatattgctaccttttattatactgataaaatactcctgagtatgtggttaatttttttcatgtttccatttaccgttgcttattgcagattgccaagtttctggaacagaggagtcacaaggagctacgttctgctcatgtgaactttatcaaaattatcactgaggcatacagcaagctactcttcatttgcaaggagcaaatgtgagtgtgcaaacttattggctgacccttaggtttcctatatcgaactgttatttgacaggaagagttcttatttcttgttattgtgtgcatgtgatgatatagggcatattttgccattagcctggtgaatgttcttactgagctcctggaaagcaagcaagagaacattcatattcttggatgccaaactttggcgaagtttatttatagccaggtcaggcattgtaaatactaccctttgatcatttgttttctttagtgtatgtatcagaatcattattatggtacattaacaggtggataacacgtatgcacggaatattgaaagcttggttcgcaaagtatgtgtgctctcacggcaacagggagtggagcacagtcttctccgggcagcaagccttcagtgcttatcagcaatggtaatatatgccttttcagatccttttcctgactttctcttgcacgacttagtttcaaagtgtagttctgttaactactatcataatattgtgcagatctggttcatgaaggagcattcgtacatatttgtggattttgatgaggtagcgacaataggttccttgtgggaaccacctatcgttcattccttgtaatctattggaaattaaacctatttgcttgagttcaagataccatactagcacatgaacctgtttactgggttgaggttatccatttgcactaacttagagatgccaatttatccccacatactagagcagttatttttcttgtcatctgtgcaaacacacatatccaactttttagttattgttgttctgacatctacctgatttatcgggccataatacattaacag

SEQ ID NO: 2302 - DNA, 4160 bp, Oryza sativa
ttaataactcttcttagcagctgtttccagaagcactcctccagcagatactgaagtccatggtacatccagatgttgacactcgtgtgggggcacaccacatgttttctgctgttattgttcaaggaccaagccgtcagaggagtgaatcagactttctatatgaaacaaaaaaatggcagtctcggactacatcagtatttgcttcagctactgctctacttgagaagttaaggagagaaaaagaaagtttaggttctgataagacaggaaacatggatgatgagaaggaaaaaagcataagtgaagaggaaaataaacatgtttgggcacgtaaaaactcggcttatttttcaaagctggttttctctttcactgatcgatatgcagcactaactagttctgcagaggtattttttctttcagtgagtttgattgtttgtcctgcttgcagtgacatggcacttctactagtaattgaagcacacatcctttgttcatttcttgctttagtgtcattgtctccgatgtttttttttttgtgtgtcggacgtagtaattgaagcacacatcctttgttcatttcttgctttagtgtcattgtctccgatgtttttttttgtgtcggatggggcatgcatgtatataatcctagagtatggtaatcgtgatatttgaataatcctctctatgtatttcccaggaggctaatattgtcatgctaactgaagatcaaaaaaatcaattgctctccgcgttttgggtacaggcaattcagacagataacactccttttaattatgaggcgattggtcactcgtacagcctcacggttatttcttctcgccttaaggtacgggttgatttgaaaatatataactattactgttattcctgcatgcagtggaagttcacatggtttgtctaagctatatttttttttgccatggaaatattttttttggtgctgcaggattcaaggaacagtaataacattcagttttttcagttgccgctgtcccttcgtagtgtttccttaacctcaaatggtaggacccacacagtgaaatttgtgattgatctcttctgaaccacaaaagtcacttgcctttatgtatgtttttccaggagtcctttccccttcttgccagcggtctatttttaccttggcaacaagcatgctagcttttgctgggaaagtctgtcacattactgaattgtttgatgtgctgaggtgctttacatcttgcaatgtaagtacctaattctaacacagatgctatcttttcacggaatcatgcatatgcatgaaagtgcttcattttggcaatagtttttatttgctgtctagttttttgctcattgcccaattatttgtgtaccaatttttgcttacttttactatttgacaaataaaaatagtttatgtccatgactgtttagtgaaaataactcatgaaatattttgcagatggatccttatctaagaattggtgaagacttgcaactctatgtaaggttgcaatctgatctaggtaactatggttctgatagcgatcaagaaatcgctagatctgtactttctgactgcaggacaaaagtggggattaatgatcagcgagtacttgatgtagttgcttgtgcactgtgtaatttaactgaggtaaaggttgattttgccttctatttgctgttgacactgcacgttgtgttcttattgaggtcacatgctgttgacagcaatggttgagtgcagttatctaatattcttggaattgctattgccagatggacaaggatgtactggtgaaggagctcacagaaatgtttacacctgaagaggtgcccttgtttgggtcaaattcagcatttgactgggccaattttcatgttcaggcattttctgatgaatccctttcttttgatgaggtatgtacattaaaactggcgtctttaatgattcatctggtggaagctcttataaaattctttgatggtgcaatgatccttgtaactgtaccttaccattatgaaaattattgttactttttgtatcttctcagttgtcttctgcattgtaggagtgttcaagaacctcttcagtagatggtgggttgcatgagtcaccaattacaaacaccggtagctcgatatcaaagactacgatgccacaatctgttcctcgtgtcttaggtgttggccagttgcttgaatcggtgagtacttatcagctgcctttgcacatggtttgctagttgctgctactcagctagctctagttgccctaatcttattaattgttaaggtggcatggaaccataacatgttgtgtttgtacccctttctgctgctgtcaaaatagtatttatcacgtggtggattcggctacaaatatattatggagcatttgaatctatgtaacattttctctactgtgaactcatatctttgtaatcaggcgttacatgtagccggccaagttgcgggagcatctgtttcgacctccccgctcccatacggcacaatgaccagtcaatgcgaagccttgggatcaggcactaggaagaagctctcaagctggcttgtcaatggccatgactctacgccagacaatcctgctccaagccttccatctgcgcagcatttcatcattcctaaagtacatgatttgtcctgtctttctcccatgtcattctggaatgttgcctattctgcatctgtgtgtatcatctggccctcacgatcgcaatcgacattcatccaggtaaattcatgcggtttcgagagcagcatccggacgactttggagccttgctcggcagtgaagctcccacccgccagccccttcgacaacttcctgaaggctgcatatcgtgcccagtagcagccatgacaagccttcgagattatgcctaaccatgtttagtagtgctaggatgtagtacctgagcatcagaactagattatcttttgaaagacttggccgatctggcttatcctttattatctgtagcactgttagttgtagtagcttgtgtatcaatgtatggctatgtctgtgtccctccagtaaatgacaatcgtatatgtactatgtagtatgaccatgtagcccactagtaaatgtttgtagggtatgtatgacaatgtatgaccatattgtttttttgagatgtaggattctatttcagactcgagtaatctgtgggggacatgttcgtcgacctccggtgctatttttccttttatcactgcaaggattagatggtttcctgcaatatttgcatgctattcgcgcggatgaaattgtgaagtcatgggtttctcaagtccacaatcattagttcacattattacggcgttcatgaatattacattttggaggatcttatttctatagtttttctatatagctctttgaatcaagaaatgtttttcatgtgatctaatcaaaaggtcatttctatgtttgcaattatctattttacatttacatttctatcaaaatcttttttttgttttttttcctatttatctgttttttttattcctgcgattcaaagtgacgcttaaaatttagggaaaattgcaaaaaccatcctataaatcacttgaaacttgacattccactttataagccattttattgcaaataccacccatctactctgtctaatcgaatcaacatgttttcatgaattatgagctgtcaatgaagcttttaccaaaattaaatatttatatagtacagtcttgacacttttgtattgagtttcgctgtattttaaaaaaaattaattaaacatgaagaataaatctgatacaaaagcacttggacaagattgactcgactagttttaacctgtggtatccctaccccagcgataatgggttgattcggttaaacacgttcgcactagaatggtttttacaaaaaaaaagaactgagtaggggtggacatttacaataaaataacttatgagatgtaatgtgaaatttcaagtgatttatagggttgtttttttttaaattccctagaatttaacgggtgtgtgtctggtggacgtccgtggtgcgcgcgcgcgcgcgagggaatgatcaaaaaccttttcggggcgtcacgtaagcccatgacccgacgtccaaaggcctaccaaca

SEQ ID NO: 2303 - DNA, 1102 bp, Oryza sativa
tgatatcgttaattggcaattgatttgcatttgtgacgctctgcaatttatgcatcttataatgtttaattctttagcattctgttcaattattcaagtaagggtttcagttgatatattatggtcaacatgtaaacatgcacctgtttccagttgtatatcccgcctaattccttctcctttcataatgtgggaagcacaccaaatcattgattgtatcaggcatgttctattcagtataatcagcctcaatctaggattttgggttgactgagatcaaattttgtgctgcgcatgttagcaaagaagctttgtaccctcatacctccttaatcaaaatataatttttcaaactttatgtttgtgagaatccatatggatgttgataacaggagagtttcttcatttcatgtactttatcaatgtttagccaacaatgcaaattcaggagtgcttatcagtattccaggcacacagtttattagtaaaacatgataactgttcagctgcaaatctgtaaccatttctttctcattgtacttttggaatgctctcttttagctatccatcttgccttaagttgcattgatttcggttatgcactcattttcactgttttgtttccctttttggcagtatgggagcttttctgcttagtgctgggacaaaaggtaattgagtgattgttaatgcaagtactacatttattctacaactagactgatctgaatccttgaatactgtacttgtgaatgtaacacagggaagcgatacagcttacctaactcaagaataatgatccatcaacctctcggaggagcccaaggacaagagactgatcttgagatccaggtaaatccacaaagttaaattgtgtttttatcaagatcaggacgacatctcaatagcaaataattaaccatatcattgtttctctcttgccggtatatggttcgatctacatgaaatacatttatttccacaagcgaatagcaactccgctggctttctattgttacttgtatcaccagaagatttttctgtcactgattttccattatttcttttaggctaatgagatgctgcatcacaaggctaacct

SEQ ID NO: 2304 - DNA, 347 bp, Oryza sativa
atcggttatataaccggcgatagtaatgatctccatcctgtccagtagagggcctggtatcatctctatgacatttgcagtgcaaacaaacagaacctaatttctcaagacaggtgtcagcttataataagttaactcaagcacaaatgagctattaataaaacatgactgtagtataaaaagaaataccataaaaataccatgcatgcacctatatacatatatatattctggttttgttgcatgtgttaatgttatgggttagggttcatagggggtaaacaccgccaggaggatagccggacggcgatgactactagggatgagagagggacttaggttgggga

SEQ ID NO: 2305 - DNA, 979 bp, Oryza sativa
atcacagcctaatctaggactaacaaggactcatatataacccaaagtgagtagcaatggtactttagtgtctggtattgagtattgacagataaaaggaccattttatctggggattaacaacaatcatccattaaaacaagacaccatatagttcatgtaaaattgtaaatacagtgagcaccactcccttcatcgcctcagtatttttagagtaagcagttcgtaacaaagctttggcagctattggtataggaaataggaattggatgtcggatagcgtcttattcatcattttcaccttgttaggatcgatggcatcgagatatagcagctgggcaacgatgatgttcgccatatcatcctccacgggtccaccacaccggataatcctctgttccacaatcacacagagtcagacagcacacagaaccctccacaaataaacttgtgcaacaatctagtgctcccgtacgtgctggaagagctggctgacgacgctctggaaccgctccatcaccatgggcgatggcccgcgttcctgccccgacgcatactccacagggaagtagggcgacctcggcaccaccaaatcatccctacgaaacacacaacaaccacagcatcatcagctccctcgcatccccacccaaccctcccccaaccagacgatgcagagctacaaatggttcgtcacaaaatcaacccccccccccacctgatcgaccaaatcccgctcctctgatgagcggccccgtggccagcggcggcggcggcggtcgccacggcccgagcgcacctccggctcctgcaagaccgagtcagttagggtagagcgagtggagccacgacagagtaaagtgaggagggagggggaagaggggagtgaacctgaggagcggcagagatctcggggcggggttcgcgttccagctcgggcggaggagaggggcggtgagagaggaggagggggtggtgg

SEQ ID NO: 2306 - DNA, 737 bp, Oryza sativa
aataacagataaacatataataaaaaacaatatttagcaagggctcacaaatagcatggtgagctaacgcagggaaattacagaccgtgagcagcatgaatgatggtggcttaaacggatagtccgatggcagctggatccttccatggtagattcctccctcaaactcactgtctcgtggccccaggatcgcaaattgccactcgaagatgtcctcctacacaaatacatacatttaaatcataaaaaacacatcagcctcgatcagaataccataagtaaatttgtaatccgaaaatatatcatggaaacggcctaagtaatactggaatcccacttgattcacacaccagttaatcgaaatgacgtaatactacccaatatcaagagtcatcctgcatacgatgatctaatcgcaacattgatatacgctaacatcccaacatttcgttattgcacaaactgcacaatcagatcaagaagaaatgcagatgaacccccaaggtcaacgcattaaatcaagcctctaaatttccgcaccctaaaaacgccatcaaaaccagatctcgccccactagcgttcgattcggacacaaccaagaccagatcgggcaggaatgtaaatgcaggatgcagggttaggatcggggacctcgaggggcatggccatgaagtccggggacgggttggactgcattctctttgacctcctgaaggatccccttcaccgcccggtt

SEQ ID NO: 2307 - DNA, 11507 bp, Oryza sativa
  unsure (1)..(11507): unsure at all n locations
tttcattccacattagtgggacaatcataatgctgaatgcaatactccctaatgctgaatgcaatacttctcgtttcgcttctagcaacttttcatttcacattagtgggactgtgggagaatcgtaatgctgaatgcaatacttctcgtttcgcattagttctagcaaattttcattttacattagagaagatacaatagcaggctataagccagctataaatatattttaaagagataaatgaaaagagagaaaaacagcgaactacaaatttgtgtatgacatgtagaatcaggtattaatagtatagtaagtaactattgtattaattgactattacatgggctatatataatttaaagctagtagttgactatattaaacttagttctcgttctcgcaacaaattacatcgactctcgtgaactatatcccgatcatttatcaaagtagcattaacatcattacatcaactttgattaacagtagtgcgtagctgcattaatgaaggctagagaaatgctttgaggtgagaaatgacaagtgtcttgataagacaaactgaatgctagaatggcagcaatctgaaagagagggagtaagaattttcatgcccgtcaagaacaaacggatcgctggccattgcacaacatacgtgcagttgcgcacatcatgtaatatcttgtaatgattttcatgagtaccgcatatacaattgtgcacatcatgtaagaccttagaacgattttcatcaggtgtactgcatatacaataaggtacgggtagtaccaatggaccaattcaacttcgtctataactaaacagccatttacaattcttaggggtttataacttatggtaagcatagcagccgctcagacaccgaatggggtagtatagctcttatcaaatctatgcacaaacctacctaaaacttgccctcaatgtaaccggccagaccattgattttgaagaacttcttgatcacaagggccataatagcaagagtgagtccaaatgcagccaaggtcaataatctgtcatgctttggcttctggattgcaacaacaggattctgtggcgttggagcaactcttggaatgttttctctgctcaagttggcccttgaatggttgctaaccccttctgtccgaccttcaacaatgtgttgtacaatttctgactcagaatcaggccttggaaggtcattattaacagagtctgagttggacccagccgtgttcacgcctccaactgccttgtgtgcatgctcatcagaagcatcagatgcaggcaattggttagtctcctcattagtttcatttgtcagcagctgaggaacagggggagccctactgagcatttgctcatggatctgtcattgcaacagttctttgcatcagaaacagaacaggtgtgcgtttgttcttattaaacaagtgttaggaatttacctcatcaattactttttggcgttctgcagagccaaactttggtggtgtttcacgtgatttgatagctagtgcccgtctatcttcctttttgaagtccaacgaacccaatgccccaccacctggtgttggcatgaatgcaatcaaagctacaagagctgtgcgcactgcaacacaaacaatcgggaaaaaaaggaattggtatcagctggaggatcaatgccataatggtttctaacactaaattggcaatccctcaatgggtaactaatatattatttgcggacatagcacgaatatcctccccaaagaattatgaatctgtacatatatatactcactacctatctaacttactcccaaccatgataaattgcaataaaatcaaaagttccgtattgaggctatgacgctgtcttaaaaacacaaaaagtactactattccttcacagcaaaaagatatgcacaggacagatataaaaagggaaagcacatgtccctcctttggtccagtcatgtgctaaacacttgctacatgacgattcctgaaagaaccaaagaatagtttcatttggcaccatgctcgtatagtacacatagtaaatatttgtatactatgaaaaatggtgcccaccatatgaatggatagaaaaaattacatgccaatccttggttgtattttaagattgaataatttggtgtacaagctttagcatatatctctcattatacaccaactgacaaaaggatatgataagcagcaaattgtaaaaaacaagaacaccatggactgcctattgtatcttagcagcattgaaaggaagctgctgaacacaaagttttgtaagaactgcagggagaagtgcatgtttcttttggcctggtcatagggcaagtactcgcccatgaaaatcacaaagaccaatacaaaaagaaggcattacttttgcaccatgctcgtatagcccacaagaccaaatcaccgtggactatgaaatatggtgctactcattgcattaggtaccccaacgtaagggcttacttgaacaatccctttcgaaacaaaatgctactcagtactcaccactccatgatggttgccagtgctcagggtggtaattggatatgctcaaacaaatcttcttttgaatctcaaatcttccacttggctgaataacagataaacatataataaaaaacaatatttagcaagggctcacaaatagcatggtgagctaacgcagggaaattacagaccgtgagcagcatgaatgatggtggcttaaacggatagtccgatggcagctggatccttccatggtagattcctccctcaaactcactgtctcgtggccccaggatcgcaaattgccactcgaagatgtcctcctacacaaatacatacatttaaatcataaaaaacacatcagcctcgatcagaataccataagtaaatttgtaatccgaaaatatatcatggaaacggcctaagtaatactggaatcccacttgattcacacaccagttaatcgaaatgacgtaatactacccaatatcaagagtcatcctgcatacgatgatctaatcgcaacattgatatacgctaacatcccaacatttcgttattgcacaaactgcacaatcagatcaagaagaaatgcagatgaacccccaaggtcaacgcattaaatcaagcctctaaatttccgcaccctaaaaacgccatcaaaaccagatctcgccccactagcgttcgattcggacacaaccaagaccagatcgggcaggaatgtaaatgcaggatgcagggttaggatcggggacctcgaggggcatggccatgaagtccggggacgggttggactgcatctccttgacctcctgaaggatccgcttcaccgccgggttgccccggttgtacttcgccgtggcctccatctccgccggctccgcggaagggaaccctctcgcctcgtcgccgccgccgccgccgcttgccggtgcaggcttggcctccgaattggggaatcgggagaggggaggaaggagcggaggagtgggaacggtgggtggattaaaaaggaggaagagctggttctggtctttccctggctcgtgggaccggttactatgttgggcccacgtgtcggcgagggcagagtgggagggggggcgacgtggatgggctaacgtggcacgtcgctattggttttataggtcgtgcggtgagtgaatggaatattccgattggtttggtgcgttgggccagctgggcggctgggccttaaatgttgggcctaagaagcttctataatagaggtggttgtttcccttcaatttatgtcatccatcaacaaattaagagctatcatctatccataaattcatttagtttggacaaattcaaaattgtaaaaaatggaaaaaaagatcatataggtagtacctaatttatagtactagtttgtgaaaaataaaatctaacaccatattttgcagacaagccgaaattgaaacttaaaatagaaaaaaaaacaaaaaggctaggccaatagtgagcactgttcattaagtccattaggctcacttgagggggaaatggatttctactttgttcaatgtccataatatagcaaatatcatgccaaaactttctacatgattcatattcttttacatttttctgattttcctctacattttctaaaattatctacaatttttatttttttaaatagttttctagggagagatgggggacgaagccatcgcggcaatgcggcagtggaggcctgaatcaccatatgcttagacacccgaggcatttcaggtgaatcacaccagtaatctctccagaggagcaaactcatctctgaaatgatgaaaaccgtgaagcatccctattccctaaccagaatcagtctctgtgtcaccttggatatgaacttgggtggcgttgtggcactccaggcacaccctaagattcttgattatcctgatttcagatctcggttctgtgctgagaaatccgaaggcaattgccagcttttcactgtgcactttcaaacatatgctccttctcttcctcctcaacatcgtacaatgctagctctgtctcaggtcgatacctagcgtcaaatcgtctttgaagttaagattttccaagtatggcctcacactgtggatgggcacagtcgccggccatgaggaagtttggcttgtcaactatctcgattagtttaaccagcttcctgccttttgccgctgcttcagagatttgcttcttgactacaagtaaattagagagcagaacatagtagccgctgttttctgggggtgcaatttgtgcaagatcgctatccttatggaccatgcaagcaccannnnnnnnnnnnnnnnnnnnnnnnncggtcttggggaattcagaaatgagcttaaaaacctccttgagctggccagctcagccaaggaggtccatcatgcatgtgcatgctcaatacttggaattattgcaaaatgatcggtcattgactggaagactttgcgcccttcctcagccaaccttatgtggctgcatgcatagagtaccaacaggaaggtagcgtttgttggaataaggtttgcatccagcatgtccttgtagagcttcaaagcctcagcaccttggcccatgaaggccatatccagctaattgcattccatgagaccacattcttgctatccatactgttgaagtgaagatgctccgagcttcggaaatgcttccacactatgcatacatgtcaatgagcactgtcatgacataaacattgggccccaagtcctcctcagcgataatcctatgcagccactttcccagggacaaagctccaagctgtgcacacgctgaaagagagctagaaatgatgattggatttggtcacacgctaagtaccagcatttgctcaaagagggcaattgccatctccgtccagccattctaggcataccctggtattattgctttccatgattccgattccgtggtcttctatggcatcgcattgaaggccttccttgcagactccatatcatttaacctacagtacaatatggtaattgctgtcgacactggagaattcgcagtaaatccagacttgagaggaccatgtaagcattgatcaagcagttcattcccaaacagactatacgggatcagtgccagtgctcgagtttggcttcaattccaaggccatcaacccaataaacagattaactgatgaaccaaccatgcaattcgccgagcaaacatagattaagcattgtaggcaaccaaatctggattctccatcaagtcaaagagacgccatgcagaattccacatccccgctgtatacaccgagatcaaccggtcagaacatgctcatactccgccaaccctctcttcagaacatgctcatactccgccaaccctctcttctctgcaagaggcatcctccccaattccccattgttatatctgttgctggtaagaccgttgccagcgtggttgtgtcagaccgaacagactctgcactcgccatcctcacgaacgactccagggcctccgaaccaggaagcccggccggccatcagcgtgttccacataacggtatccggcgactgcacagtgtcgaacaccttgcgtgcgtggtcacctctggacagcatgaagcgtacaggctacagcttggccaatgcggacgccacgaacgtgtcggcggcgtaacccgcgcgtgcagcgcgccgcgcgcgggctgcggagtcggttggagacgacacgccgccgccatgagagcaatgagcgaggtggcggcgaaggcgaaggagaagtagtcgaggcaagcggaagagaaggcggcagcggagaaagcgatcggggcggcggaggaggtgggtgggagggagggacgcgtagcggaggtcggaggaggagggagctgaggtttccggggcgggggtcgagagggtagtgtacggaggcgagggacacggcgaggatctggtcgaggtagcgcagtgtgaaggaaagcgcgatgaggcggagggcgccggcgaagagcggcgcggcggatagcgggaggaggcggcgccggcggggtctcatccgattggaaacagattgggaagggggagggggtaggaatacgtggcgtcggcagtattaggtagagagagaaaccctttccatcctttgtctcttagccccgaaggagagagaaaaatcagaaaaaaaaaaccctccgcgtgtgggggaagcagagctccggacgctggcgccgctcgcgccaccgcacccgcaccgccatggcgtcgtcctcgtccaaggcctccgattcctcttcccaacgccccaaggtgcgcgccctcgcctcagtctcgactccccgcgcccgattccccactccgatctccttccccaatctgatcggcctcgctgtgcagcggccggatcaagggccgtcgggcaaggacgcggccggcctcgtcgcgctgcacgggaagctggcgcagctgaagcgtcaggtccaatccacccgcctcgccgcgatcaaggcaagcgcccgcccgccgatcacgcatctctacagtttcagctcgcagggggaagtgtgagtagtcggttggattttgctcaatctggcgtggattggtttggtttgtggtttttgagcaggagagggtggaggcgaacaggaaggcgctgcaggtgcacacgtgcgctctgttcgacgtcgccgcggcggcggaggtggcgtcgcggggcgccgagggcggcaacgcgctgtcgcggggcgcggcggaggggcaccgcaggttcgtggggtgggactcggcgagcgggccgggggagagggagttggtgcatgtgcaggaggagaatctggtcgccgggacgctcgtgctctcgagctctggtggtagcggcgcctcgcataggaccgtcgtgcagcttgtgaagctgcctgtggtcgacaagattccgccctacaccacgtggatcttcctggacaagtataatgcttctacacgctcattgttccaatcagatcacttgtcgctaggttcttgaacttgcagtttaagttttacaagagttcaggagaagttggtatattgccatgtaatacttcttaaataaaaagtagggtatgccatgtaatgcacctagatatgatattgtggaaaatatactactcaaaattcacttatgatgcatgaagcaaaattgaactatttacccatacaagccatagaaaccagacaacattttcagacagatattgcaaacttgggactagtagaaatatttggaatataagtgttagctcaaacattacactcaggtagtggtgttcatgtgtttttatgtttgctgatgagcgagagcactagtttgtgttaggatgatggtcagtttgaaaagattcagctacttgaacgatgtgtcatgctacttatcttcagtttatttgcttgattaattccaaagtggtatttattttctcatatacgtgctgcattggtgtaacaaagaatacttgatccctgttgtattcgatattttactctggtttaaacaacacagcgcagaaaccaaagaatggccgatgatcagtcagttggtaggaggagaatttactacgacccaattgtcaatgaggctctgatctgcagtgaaagtgacgatgatgttccagagccagaggaagagaaacatgttttcacagaaggagaagatcagctaatatggtaaaaacctggacattcaagaattctctctttttttttcattgaatatgctgtgatttttcccaatcatgatatctttctgttgcattttcttttcaataaaatgattcagatctaagttaaacatggaagaaggcccagagccatgaacttacattaacataacaaaccatccgtgcaaagttagttgcgctgtgcagttgttttactcagtctgcatgattaatccacctgttttctaccttaaggatcgtgcatactctaagagcttccaaccttcatgtaccctgttaattctgaaatgtaggtggaaggtaatgtgttgtattaaatcatctttttaggatggatcaacggatgccattttaatttaaccaatgcattattggtgaaatactggctggtttgactttacacttccagttgtgacaataatctgtaacccaagggcacccttcttttatttaccttttacacaatataatcagaataacaatttctattataaattatactggtaaaaatcggtaatcatcccaatactatccgctaccttcagaataaataaacatttttatatgtaaatttatgtctatctgatcttgcttaactatacaggaaagctactcaagatcatgggttaagtcgagaggttttaaatgtcctctgccagtttgttgatgcaactccttcagaaattgaggttgcccatttctcttttatgaacattttagttcgtcattactattttttttaactctgcagctgttttttattatcctacaatgtgatcatgactcttattccgatcaaaatactaggaaagatcagaagttctttttgagaaatatgagaagcagtctcaatcttcttacaagacagatttgcaacttttcttgacaagnaaannccccccaaaaatttggngaatgtggnctttagattcttttgataatctcttctgtcggagatgtttggtatattatacttctggcattctgttgcttacagttcttttttgaattccatgttttaaacccctttgttcaactacattcgcaaggtctgaattacttgttgatatctatttattcaggtttttgattgccgtctccatgggtgctcccagaacttggtattccctgtaagtcataagttatttcctgttggactcttgtaaagttttgatctttctactttgctcatcctatcaatgaatggaggatgttgtcctgccatttggtccaaagtgagaattaaaaaaataccgctaactactaaccttttgcttaccagagcgagaagcaaccatatggtcatgaacttgatgaaaacaagagaccgtgtggcgatcagtgctaccttcgagtatgtgccccctcaagttttgcagttatatcaattaataaagttgtttatgattcctgaatttgcataatttgccagtccccccctgtgggaatctaagtttcactggtgtggaatattgagattgtattaaaaaaacttcgccaagatgtgtagttaatataagttttgccatcccagcagtgttgttcaaagaaatttcatagcctaggctttggttaaccgggtgtgagccttgaccagacctacatatacttctacaatattaaagcaatagaattaggagtatattatttttctaatgaaaaatctaattaactttatgttgaagatatactattagatctgttgtcttgcttgttggacttcaggacccaaaagtagaccctccatacagtacatacactgttatgaactatggatcgtacaagtggcatcagagctaacaccatggcttctgtgggaagtactttttaaactatggtatcatttttctcctaaactccttcactcccattcggccatgctatctgatgtaacttttagtccgtatgcttatcaacattttcattgacccttttaatgggtttgattgatgcaacttctttagtttatttgtctattgaagcgagcctatgaattattctgagaattgcagcaattgctgcattgttgctaagactgattttgattaaaaaattcacagaggagagaagtatatcaagatacgtgcaatgatgaccgaaatgcttgtacaacatataatatggattcaagatcttcctcactcaaagatagtgctaccatattgtctgaatcagaagattcaaacagagatgaagataacatcaaatccacttctattgttgaaaccagcagatcaaaaataactaattctgaatatgctgacaaaagtgtgacaccacctcctggagatgcttctgaaactgaaaatgtgtcccctgacatgcccctaagaactttaggcaggcgtaagatttcaaagcatgcctccaagtttaacgatcattcacctgatgtaaggcagaagatatataactcaccgattgccttttgcaatgagtgtactgaacaagcaatcggttccagaaattggtgagacatgtccagattccatagaatctgcagttgatcaacttccaagtctggatgaccctaacaagaaaatttctaccaaagatatgtgtgctggaagcacaactaacactactgaaaatacattacgagataataataataatttgttcatctccaacaaggagcactctatttctcattggagtgctttagagagagatttgtacttgaagggaattgagatatttgggaaaaacaggtaattcttttatatttcccatgctatttgaaaatattgtttattgaaaaacgtaatttaattttaagttcataatggtatgccacagttgtctcatagctagaaacctattgtctggcctgaagacctgcatggaagtggccagctacatgtacaacaatggtgcggcaatggcaaagagacctctatctggtaaatccattttaggtgactttgcagaggctgaacaaggttacatggtacgtattgactggcctcgttaggttatgcttttatccagatcaaagaagtcaaaagaatctataactttggctagtctatttttttctgaatgttttcagcacgtctgcattatagtggctgtatttggttgttgttcatcctcctgatattcagttctgtagtcgctatattatattaaatttctttcggcacccacaattaagatggacatggatctttttttggaaacaagcgtattgttcctaaaactggctagtgctagaattgtaggttgtctcatgttttcatatattaggcggttaggggaaattatatt

SEQ ID NO: 2308 - DNA, 1479 bp, Oryza sativa
tgggatagtcttttaacagaaactaacaaaaatattgattggctatcatgtgctaatttattcagatttattttgtttaattaattacacgttacacgcatggcgtttattctcttcagctgcggagatggctcactaggtgagccactggcaagaggtgatggctatcagtgtggaaacatgaaactcctcttaaaacaacaacaacgtgtgagagctctagtcttgtattgcttgtttatctttccacatcattgtgctgtactatcttaactgcgttgtttgttgatcatggatcagatattgcttggaaaatctgatgttgcgggttggggtgcattcattaaggttagatcaatgaaaaagcacctttggatatgatgcattttgcattttggctaattccttttttttctttctttcttgcaacatgtagaacccagtaaatagaaatgattaccttggtgaatacactggcgaattgatttctcatagagaagcagataagcgtggcaaaatatatgatcgagcaaattcatcgttcctatttgatttaaatgagcaggtgtgaactaggtcttcatttctggccagttggagtgtcctgggtttgttaaaagtgaaacaggtaacctttatttgatgtgttcttgcagtatgtactggatgcttatcgcaagggggataaactgaagtttgcaaatcactcgtcgaatcctaactgctatgcgaaggtaatgacttatttttactgaatattcatcatgctctgttgcctttctcgttctgattccgtctgcccgtccaggttatgttggtggctggcgatcatcgagttggtatctatgcaaaggaccgcattgaggctagcgaggaactcttttatgattaccgctatggacctgaccaagccccagcttgggctaggagaccggaagggtcaaaaaaggatgaagcatctgtctctcaccaccgagcgcacaaagttgctagatagtccaacagcagctccagatgataatatcaactgtaaattataccgtcattgaaacacatagttcaatcctagtccattatacggccaatcgttggcataataagcatattctatattccttagttccttggtaaataaactgagatatcgagtatgcgaataaaagaaaaataaggcactgtaagtttatttgtacaaagtttggaatttatgctatgtatagttttgcctgtactctgacattgattctactccctccgtctccatattataaggaattttgggtaactactagaatatgtcacatctacccaaaatcccttataatatgggatatgtcacatccacccaaaatcccttataatatggatccacccaaaatcccttataatatggaacagagggagtacaatattaggcatatgaatctttatattctgaatgggtgtattttattttccagctattattgtattcttgta

SEQ ID NO: 2309 - DNA, 2747 bp, Oryza sativa
aatgtcgaaacgaccctgttctcaaaattgtatatagacccttttgttgtgaggataccagatggtagaacagcagctcattccatgtatctagcttgttacacccttttgttgtgaggataccagatggtagaacagcagctcattccatgtatctggcactccaggaaggcaccagtggctgcaatcctgaacgctcgatgctgtcaaacctaccactgccttcctcccatacacagatggatgcccatctatcctgagcccagatagattggtaatgttcagaattgtcacagaagtcttcatttgctgtgctacttgctccaagatcatgtttatctcaggcaccggccttacacgagtgtcactgagaggcagtgtgctctctctgcagtgtccccctgaattccactccccgccgctgaactcatggataagacaataagttgctatgttaccgcatcaagtttctagtgctacaattgaacagatgaggaagcaaacctgaaatgcgacggggatgagcttcggaagaacactcgagttttccttggattgatgtaatggtcgacccatgatgcccatgtggttagtgctttaaggtaagctgtggaagcatcgagatggggatatacatgatcaccttcttgatagtagttcactctgaaaatgaaatgcagctgtaagaggctatcattaagctgctacatctatataataacatggcctaaaaaaaatgtcaatagctgcatttaccgatcaatttggttgtaccacggtaaggggtgaatgattcattattgcccctatttataaacactcacccagcttttgttttgtgatgcgaccaccaatgagcagtgttgaacacaagaacatcagcacctctccattttgacgaggtgcgatcaacagtatcgatccatagtgtcctcgtgcgctttgagccaattcttgctttgccttcatgcaccaagaaatgcgtcacatggtactccacactgcaattgtaatcctgcggcaaccttaccgagataaatattgtgtaccgaattcaaacaccgaacatattccaacagtagaaattagatcatacaaaccaaaaacttgaagttgtaatctcctctctccttagtaatcctgcggcctcgagcttcatgaatccttgcaggatctgagactgcccctctcagcaagcacatcatggattcccactgatttctgttaatggagtctccgacaaacactagccgttttcctcgcaacatctcaagcattttcctagcatcaaacctaaaatttcattgcattccaaagtcagcaaatgttgagctcaataacctaagcaatcgataaactgcacgaatgcaccgtaacgcagcacctcggtatactgcaatgagttggctgccacctccacttcctgtagcttccatccattcttccatttgcttcgcagctgaatccttcatctatgaacgggcaagaatcactcgtgtaaagtggatagctctcatcgaacacccaccttccatcatagacattgcatagtgccgcatcgcttctcgccgcatccaccttgctatccaccgtttcctgaaccaggtcagtcttttgcttgcttgaactgagtggagctgctccagagctgttcctcactgtcgaatgagctgaatgttccccttgatccactcgttgagaagtatgtgctcctgcagaggaatttccactttctccctgcaagaattcaccgttcgacccgaggtctgaatctcccatggaggaatcgacatcttgcacagacttgggtttcttcggttcctctgctggagcggctgcttcttgcgaagcggatgcattgctaacaagtaggttcgtctccatcgccgaatcggcaacttctttggtggtattctcgccttctgcggagttgccatccccacctccagcaggagctccttccgcccccatggccgaaccggaatcaccattggcaggagctccgccgttttcgcttcccagtgccgcctctttcacctccattgcggaacccacgcctcccgcggacggaaaacctccggcatccgagcggcgggctgcttcccccaagctcccgctcctgcccctgcccggaagaacatccaccgccgcgccgctcgtggagcggcccccaccacctgcagcaagaaccgggccccgcgcaatggcggaggcgttcccggcgagggaggaggaggcgacgaaggggaggtggagcgggcggccgaagcggagggcgaagagggagaagaggaaggagaagaggagggaggaggaggcgaaggagaggaggatgaggcccttggggctcacgacgccgtagtgcgaggtggacgacgagccactgctcctctgcctgtccattcctgcgcggcctacggctaccgtagcggcgccgcggcggacggcggcggcgatgacgccgagcgagccgcgtaggtgaggtaattaaggcggcagcgaggcgtggcgaggcaggagagaatacgaagctggcgttaataacaagtttaatactagtatagtcaattattatctccaaatcatctataactaatgtaatagctaatttatacaatagttgtttattatactagtattaatatctggtttcacctgactatagatctgtagcatgttgctcttatctcttttgttttatctttttaacatatgtttatagctggcttagagcaggtacaatagca

SEQ ID NO: 2310 - DNA, 10770 bp, Oryza sativa
tttgttttatataataaaaaagaggatgactgtactagaagttagcaattgtaaattgtttgtatcaagtacgattgcacccactaataaggaccacaaatgaacagctaactgaaagtgccttcggaaatcggaaatatatttggtttatgattctgaactttctgatggaatcattgaagcgtatcatggatgtagcaccggacacacggcacgcttcggtctccagaagcatcacctaaattactagtaatataccgtactaacggaggtgtcataacatttttcttaataagttattaaaattcgactgcaatgaaaataatgttcctagaatctgtccatttaagcttttagtccaaggtcatatataaaaaattattataatataacttaaaattatttattcaagataatataacttaaaattatatctaatcaattcaatatacactatacgaggacaatgcatatccataccaaaaagaatggttgagttattcctcaagaaatcaagatagataagtatgaatctttttctggtaagtatgcaccatgaacgacccaaccgattactgcaaaaaccattgacttcgggtaaaatatggttgaattttgtcaaaaatttaaagtcagtttgaatttttaaacttgccaaaaaatcaaaaccaaacatttttgttatcaagccagtctaacaagtttgattttttcgtaaaccttgccggagagtaaacatcaaatatttataagaggatgtatttacaacaaaatatacaactcttcttctcattacttcttttgcatgtcttaaatcaatatcctttactgaaacatatattgtcttttcattatttgatttgcattatcaaatactgccgtgactataatactcttttggttatcactgattcaagcattcaagctaagtatttgtcagcaagctgcaagccattcctgatgtatgtttctgctttccaacggcatacatccttcccagagccaaaagttcaatcaaagccatctgaagaataaatagccagccacatcctttgattatagttgagttatcatgtgtaaaaaaaaaacaaatacagtattacctcagattatctttctactgctacaactttattaattttaatatagtttgcttcgtcgtagcatccgccactttggcacaaccttcatttaacatgtcaaggttgtcagcctacatgctacatcacggcctcaaccctggttccatgcatagacaagctctcttccaatgccatttttggccttaaccctgcttccatgcttagacaagctctcttcactcttctaagaaatatatccttttaatataaagagctaatgagtttcagcattattatatatctcttctatataggaaatatgttgttaatcaaaacaatgcaacccttatcagcaagaggcaaagataaacataccatccagtattattacatatctcctttttttagatacatactagtatctcttatgtacaggacatatgttaattaaaataatgcaaccctaatcagcaagagacaaagataaacatgctatcactgaatatgaggaatagattttctggaagttgcgccaaccctgatatcatcaactctaaaaagtctctccagtgtaatttgatcaggattaggaaccaacatgaactcctctgataattccaaaagatcagctatatcaacctcagcacatccaagcaaagaaataagtccagtggccgccccagaattagcaacagcaagaagagttcctctgctaccgttgcaaaccagacttgccaaagcttgtgcagcaaagtacctgtatctgtatgcttgttcatctgacctgaacaagtttgagagcacaggaattgagtgcaatgctgcattagatcgatttatctccctttcttgaaatagcaaagcaagaagtaaggcacagacccatgcagtgctatcttcttcacgctgaaaatatgatcatacatttaagcaatcgcagctatcaaaagaatttggcaagatatataaatagtatgtaaaaagcaacaaagttaaaaaaaatatctgagtagatatctacagtcaaaattagatattatcacatgagaatgaagaatttacggaatcacacaaagtccaatattctgaatactgaactagaacaacaggaatgcacagcattcctgtttcctatatgttgttatttgttgcaatttaaacttgatgtgattataagaatattgttattgaatatttgagtttgtgttcaggaaaccaaccccaacactgggacaaatgttttgttccagataccctacttgtggcatcaaagaatgtgtagcaactacagcagggttgctagtgcaagatagacgatgggtctctagctctctgctgactagaagcaaaaagcttcaataccaaagtaacagatagaactagagataaatggatcgagaatagatacaaaagaaggatgattgaacacacttactgtgtaaatgcacaggtgatgattgtgcacaaggactatattaatccttgagacttcaatctattcacatcaaccccaagaattcaacaatacgcattaacaaacgactattcaatggaaaagtataaatttgttatagggctctgatggtggcaaagggatggaatcctttgaggagttaaattattcactctagcaataaactttaacctggtctcttagctgggttctccaacaacctgttcaatctagctccccactgctttctatatgcgactgttgcctagactttatgcataactaccaaattgacataaagttttcttttccttaaaacaatgaaaaccctggttccaattctcattacaaaagagaaatcagataaaccaaaagaataattaacggaactacgctgcctacgtttattttagaactagcatgatgttaaaatactaaagtgcacaagagatactagcattcacgtaccacatataggaatgcattttgagaaatcttctccataagcatttcgactgctccagcttctagaatttcagcccttgttttgctgtcatggcgtgcaaaaacagcaagcagccatagcggaatcatgttacctgagattacagcagtgcggcacacagtttcatcgctgttgttattttctttggagtgtctagaaattttaatgtctgatatgttttcaccactcccattttcagaaggcaagtttgtcatatgaatcatactgactagagaatggattagttgaatgtataagcttgagtcactgagaatctctatctgcttctgacaatgctctttcgctgcacaaacaagaagagaacatccaccaactttaactttaagcatgttggacccaatgactcgccgtgcaactgatgatatgcagcctgggatttctgaaaccaaaccacccacaatatcatgttgatcagaacagagcctcgataaaacttctatggccttgtcttgcaatgaaggtgctgcatccgctacacatgacacaagaggaagtatggtgtggggattttctgcaagaactgtccatggagctttggtatgcccacttgacacctttggtagttttgataatagcaccagcgcatcaacaacttctgatgttgcggcagcttcaccattcgcagcttccaaaagcccagctagagcaaggacagcacctgaccggttaatagtatctgaaagaggttggttaattggccggcactgtaaaaggcgagctattgctgctgctgcatgagttcttccatcaatagatccctctctaagcacatgtgctatggggaagataatttcttcaaaagatacttgcagagataattcatgatcaagaaaaaggtttgccaaaggtcgcttgttctgctacttctagaactgtagaatttgcaagtgagacaagtggagctaatgcatcccgcccaattgcagcaacatccttattttgcttgattgacagaaaaatggcagcaaggcaagatgaggccgccattagtattttatctgtctgcccatcaatcagcttcatgactgaccaaagtgtcttcactgcaatatgagtttctcgcaagtccctgcgacaatgaaacagtccagcaagagcagatgctgatttagcctgagtttcttctttaggtgagttgagaattttgatcatagtctcaactgcatcatttgcagcacttccttcatgcagaatatcattaaggggtgccacagaaagcaagcttttcaaagcatcaggacatgaacttttgattcaggttgttcactagttaaaagagcagacaactgactaatagttcctgtatctgatttgtgaatgagatgattcagtgttttagatgctatctcctttccgtgtcactttcatttttcagaagccatagtaaagcgggcacagcatcagcactttcaacacatgcccgtatgtcttcactgtggttgcacaaattgccaaggatggttgctgaatcttctttagctttgaatatgtcacatgatgaatgatgaatgagtaaaaccatttgttcaactatagggtagatatgaaacactggcaaatggaatcaacttggactgttatacaagtcaccaatcaaaatacctgttgacaaaataattgcattcttgcgaaatttactctcctacaattgaaactgaaatagtaggactagttcatagtcatacttctattgacaatcaagtgtgcactcttcgcatattaatctggtatttgcacaaaaataacacgtgcaattgcaagcagagattgttctaatttctaaacaaactggcaatggattgcaaaaaaggacgttggacgagcatatgcatagatgcataatcctcaggcataaaacaatcaatctgtcaccgaagtaacacgagatcaaagaaccttgaagcataatcctcaggcgtcaacaatcagtccgccagcgcctacaaaggcgcgaacgccgccttggagatgacatgcgtcttcttgccgagcccgaacccgatgatgtggttgatgtacacgtcgccatccttcaccgtcgccgacgagccgatccggtgagccgggccgacgtaccggccggtgacgacggcggtctcccagtcgtcgtcgctctcgaccagccggctcaccaggccggcggcgaccagcctcgtcggggacagcagcgccagcccgtcgccggtcttcagcgagcccttcaccttgacgacgtgcacgctccccgtcttcgggcagaccttgaagaggtcgccgccggaggtgtggatgacgaggaggtagccgttggggtggtagacgatgccgttcaggccgacgaagttgttgatccaccctggcctctggaagaaggtggcgttcttgatgacggacagcggctcgccgtccgggctcaccttccagatcttgttgcccttggcgtccgtcacgtacgcgttgccttcctcgtcgacggccacgtcgtcggcgagcgttgaatcacctacaaaattatataaaaatccattcatattctcgaaatttcttgaatttcaaattgaatttactacaaactaggaaaatataataatcgttgtaatttgctcagaagagagtaaataaacaatagattggtggctccctttccagtgaacaatgctcgaaatggacgcctagaagctacaaatccatggcggccatagatggcgcggactcacggacgcacctggccggtcgaggcggacgaggaaaaggcggcgccaggagccgagctcgtaggcggccacggcggcgtacccgaaccacggcgccaagtcggtgtacaccacgagcaggcgccgtctcggcgcgtccaaggtgagccccgtcgccgacctcccggccgccccggggtccgccacgaccacccgcgcctccaccttcccctcccccgcacccgcgccgccgccgccgggcacctccacgacgcggccatcggtcatggtggtgaccaggaaccgcccgccctcggcgtcccacctgacgccgtcgtggaaccacccgtcgcccacgtaggacacgcccctcgccgtcccctccaggaacgcgaccaccgcggccgccgccagcgccgcgacggccagcgacgcggtcccgcgacccccgccgccggcgccggccccgccgcggcggcggcagcatccaccgcacatgacacagccactacaagatctggggcgcctcgcgtaattcgggtggttgagtagcgcgcgtggcgtaattgctgctgtcactgttagagctcccaagtgcgccgtggggttaagaggaggtttggccccaccgcgcgctccttgagggacacccatgaccagggcggtgtcaggcctctcacagtggcagtacccttagtttagaaagttggcacaaagaacacccccacctaattggatggagagacaagtaaaggaaacgaagctcacagtgagcgtgacctagccaccaaatccacaacttaatttcccaactacccctctctctgtgttcggccgtctctttttcttctccccggtgcgcaccgcatcccctcccgcatctcgcttgcatcgccaccgcttcgactcccctcctccctccaccgacggccggcgccggatctcctccctccgccgccggcaccggctctgcttctcctctcctccctccggcgccggcagccgcggttgccggctcgcgcggcgaccgacgcgcgcgggaggcgccggatctcctccctccgccgccgccgccggctctgcttctcttctcctccctccggtgccggcagccacgattgccggctcgcgcggcgaccgacgtgcgcgggaagcgtcctcgggaggctccggcgccagcggaagacgatgcgccgatgggatgtggtggccgcggcggcggatgtggtggtcgacgccagatctcctctccccgccgccgccgccgcgaggaggaggaggtagtgttagtcaaggaggacgagcagaagcagaagcactgcggccgcgttctttgatcttttttcccaactcgattcgatcgatcacatcacttgctaataacaagatgggattagctgttcttatctttgcatgttctgttctctaattcttgatgaaaaaaaatcaagaactgctctcgcttcttatctttgcttgtcatgctgatgtttcaagacccagagagatccttcacgtggtgaccgcttctttttgatttttttgcctcttttttctttttcatttcttcaatttttcgttgtttaacctacaaacgatctcttccaatccccaagattttcttgccttttcttgactcggtgacgggaggagatttgctgcggtgccgaggcgggagaaatcagtggaccggaataatgggtggcgggaggagatttgctgcggcgggagtggttttttggagggcaatacggggatttcgcgataagatttctgggcgagggcacgcaagggcgagcaacgccgcccacagtggttttttggagggcaatacggggatacgccgctcacgccctcgaactgacgaggtttcgcgtggctttgtttggtgacgagcttcctagctaaggcacggttgcacgcgacacgttagcaaaattccgacgtggcacacgaggttccccctccagctaggagcactgtgagaggcctcagtggggacgtgctcccgtgaccgcggatggagctagcagagttgcagctcgtgcctcactgcctcggccttggtggtagtatgatcggatctctgcgtctgcgagcagaagagacgggaaactatgggccgggcctcttggttgcctggtttgcctagaagggtagaacttggcagtggagacgacgggcattgtcccgtggaaatttgatgatttgccgcttttagcggctgtgtaaagagtgaaaaatcatcatcaagataactcatctgtgttcgattgcaccatggaatcgcgcctctattctcgtggtaagaggagaagcaattcgctaccaagcctcctctgtcccctcccaagtacgaagtaccaatcacttatcactcactcgttgcttcatgtacatcctccagtacttaagcacatggcgtcctcgtagtcgtaaagatgagtcgcgggaccacaaatagatgcatctaaatcggcaagattaacttcgatggcggcggacagagaagaaattccggtgttccttgcaacatgagcgtcacattggtcaagtgattaggggatggcatgtattgacagcgaaatggagtggatgcccaggccggtctgtgtcatgagatgaggagcaagggaggcttcgtacatcctagagatcaaggggaagaggcagccaacgcgcgagcagtcggtgttactgttaggccaggaaaaaagccacttctggattactaataacttgagtgtgaactcgcagcttctcctcattggtttttggttgattttagtagtatgcgacaatgcgaaaacgagaggacggggagtccagaagtgttcagttcagtcagtaaaactttcgttagatgtaaactggagtagcgaaagatggaagttggtgtttggtgaccaacaatgaaggagacggcatggtcgggtaaggaaaggaaaggaaaagaagcttctgacttttagtggatctaaatggcaaatctagttgggttttaggcctgaaaatatgctgctgctcttcatatctctcttgtcccagagaacccaaacagaagtgcaaccaaccaccattatattcttcatactacctgcgaagatctccattcatggacgttccctacgaattaaatgcacacgagcaaaccatgcagccacagcgaatctgtccccatgtcatactgtaccttctcgtggaaggcttttcgccttttcggcgccgtcaaataccaaggccccaccgatcagttaaaaaaaaatactcacacgatcacacgatgagtccatggaggaggtaaaggtaaagatcgtgatcgatcacgcacctggtccgtcgaggcgggtgaggaagaggcggcgccacgaggcgaggtcgtacgcggcgacggcggagtacgcgaaccgcggcaaccggtcggcgtagacgatgagcaggcgccccctcggcgcgtcgacggtgagacccagcgcgaccctcccggcgacgtcgggatccgccaggaccacgcgctcctcctccttctccttccctttcgcctcggcgcggagctcggacacgccggcgccgaagaagttggacacgagcagccgccgtccgtcggcgtcccacttggcgcactcgtggagccacccgtcgcccacgtaggagacaccgccggcggtgccctccaggacggcgaccgccgcggcggccgccagcgccacgagggcgagcgccgtccccgcgcacccccgcttcctcccgccgccggcgccggccgcccccgcctcggcggctcccccggcaccgcggccgcagcagtcaccacacatggtgcagcgattgggtagcctacagcagcggcgagatttgagtagccaacagcagcggcgagatttgggtagcctacagcagcggcgacgaaggggaggaggatttggcccgatccgatttggtcaatgtagggcgagctggtttgggtcttcccgctattaaaaatgtatagtactgatttagtgaggattttggtgagctggtgtgttttagcgagtattttggtggcattttgacgaccggcgtgggccgcgggggagcggaatctttcagtttgtccctatccatccatccaactccaacgctggttgatctgcgtgagttttatgggacaagtttgagtgcggacggggtaggaacgcgcgctgtgaccgcgagtggcggcgagccgagccggcgagtgcatggagttgacggcttttggcaaggctggctagtggctggctttggaggaaagcaccggaagtcaaagccgtctgtgcgactttttgcctcgtattttgcttccggggggtcacggctttgcgaggtcatggtgtcacacggctcacggggcagggtgatcggtgtaccgaaaagttgaatgctttttgcggtgtaaccctcttaagtacgagaaatcaggtagaactccgtagagaggactcaacgagagtgatttatgcgtagggttggcaacaaggcaggttggaccagagcgcccccgcccctgctccccggccccacagagatggtcgggtgaaaaccatcacccgtcaagtcgctgcaaggacccgtgggtgcgtggggccaggcaccacccggctgacgattgacgagcgaggagccgaggagcagcgacgaagccaacgccaacgagggacaacgacagacaggtggctgaggactgggcgtcactgccaccgccgctgcggatgcgcctccctggccgccgccgccgtggatgcggtgctagcccttgccattgccgtcgcggatgcgccgctaacgccaacacggatggtcgtgcccctggtcgtcgacgccgcgactcacaagaagccgccaccgcctgctgcttccgctgtccgcgcgtgtccaccgtcgatggcttgccacccatccgtgcgttttccgctgtccgcgtgtgatggctgggtggggtgggagggaaatgaggataaggttaaggaagggaatatattaggaattaaggttagagtaaatgggcccttttgg

SEQ ID NO: 2311 - DNA, 2812 bp, Oryza sativa
attaaggttagactagatgggcctttttggctcataatatgctagtatcaatagtctaacatacatcctccggagacccgcgtgtcgcccgcccctttgccctggctcatgatcggggcccggccccaactccccgcgggttgaaatccacacccgcccctgcccccgtaggggcagatccccggccccacgggggaaattgtcatccctacttctgtcagatcgctcaaagtgtgcttagcttattttttgacgggatcaggtgtgtttaactaatgcttattagtaatatgcccgtactaaacgctacggtgaaattctatgtctttaattaaactttaaaatggattcggatgccgtgaataaaaaagttatatagagtacaagaaaatattttttccgcatgtcacgaattcagatgttccatttcatttttgttatgtgtgctttttgaataaaattaatacaccctgttcggttcacaaatggtaattggttatatccctgaatgaaatccacgatccgctggcaaagatgtaccattctttgttgcaacaaatcatccaaatccaaatctaaatgtaaaaattttgggaatattgtaccattcattattgcaaatttatagtgcttagattacttaaaatttatcaaaggactatgtttagattacaatccaaatgtacaatggactcatacaaaaatatggtctcgggcttaatttgataaaatttcttctatccacatcagcaaaagaacatcagtgcactgtacattgtctatattgtactatacaacaagaagagaccgatccgaatggatgatgctttctggtaatataaacattacatcaacttaacacggtgagtacgtcttgccaagacaacagattgcattttccactggacattaggatatgatacagctgattgcctgattctatgctacaagaccaacaaactgatttccatagcccatcgagttggtcgtaattcttaacacaaggaacgtacaacaacacatggagaaaactgtccaactattttccggtgtccgctgaaggcccaaatctgaaaatgttcaacaagcagcaactcaaatgttaacatgctggagtttgcaccaaattattttcttttgctttcacttctagaacgacatggcaaatgctaaacacaaaactcagtaagttctgctgggatctttataataataaatcaaaatgtccagatgattaagtagtggatgcacattagtggatgaatggaatagtacagtaaactttataataatacaatctacagatgattaaatattccttgtataagttaacaatcacatccacaacaaaaaggcagattgcaaagttaatatggcaccgagatgaatttgcaaaaagaacaacttaagaacaaagtggaaaaggtgattatcacagttctagtgctaccaaagtggaaaagaacaactttattttttttatataaatcaaaatgtacagatgatcaagtagtagatgcacattattggatgaatggaacagtacagtaaaaaggatcacgttgtcgaatgcaatatctcaaagcggtacattgaaaaaaaaagaatccctgatacaggaaagactcccaaccacagaaagtaaacatatgacaagcaaaatagttgaaatggtcctgatccttgcttaaagaagtagcacaattttattccataaatattttctaatgacatggagacatagttcagaaagtcaggtaataacaccaagcagagtgtggtcataggtggtcacacttaattgattcctccatagtatataaatggatctaagtttctaaattacaataaaggacaggacgttggtaatttgaatagtaatttcagtaatcgatgtacgtgcagaacaatagtgcagttatttttaggaaaaatctttatcctgaaagccatgaacacatatctatctcatagtcaaagtgcagtcaagaaaggaaaagaacatttgacattgaagtggtacaaatcaaccagaaaaaaaagtaagagggggaacatactggatgccgacacggtagtgtggatgttgaggaatcgcctctgacctgatggatgccctatagggcgacggcacgccgcagttctggcggcgggagttcctggtggagatcggagacggtgcagagaaaaccggcgacgagcggcggagtggtgcgcgacggcggactggcggtgttcggcggggaagttaggtttagggtttggagagcgatggaggaggcgggaggagcgagaggcagagggggcggggcggcggcgcggtggggagagcaatgcccgcgttgcggtgctgggggaggagagcggaaggatttcgggggtatgggagcggagtgattttaggaaggcgcgtgattcaagagtgctgggtgagggaaggcgacgcgtacgcaggagctaatcggcacgttagattgagataatctggaccgttcagtgaagaataaaagaatgagtgatgagtgaaaagtatttattgaatgaaaaagtccactttgactcccttaattatcggcggaatctaattcgtaaccctcaaccgcaaaaccggataagacgactccccgaattattgaaaccggtgcaatttgactccctcagcggttttggagggcagttttgctgatgtggcactgccatgtcgatgttgaactagtcttcgtctcacgtggcgtttaagtggcattcaaattaaaaaatatatatatgtgggacatgtctgtcattcacacacagaaatagattatggggg

SEQ ID NO: 2312 - DNA, 10546 bp, Oryza sativa
  unsure (1)..(10546): unsure at all n locations
tcccacaatatattgtgtgtaaatgaccgatgggttccacatatatttttttaattcgaatgctacgtaagcaccacgtgagacgaaggctaggccaacatcgacacgtcagcgccacatcagcaaaaccgtcctccaaaaccgctgagggagtcaaattgcactggttttaatagttcggggagtcgtcttatccggttttgtagttgagggtcacgaattagattccgccgagaattaagggagtcaaagtgaactttttcctttgttgaatagggtagatagggtagattatgaggagagacaaggccgtcccatcctggtagactaacgagtcgtcggtatttgtgggccttgcatacggccttcaggcccgtctgctctatgaatctaaattggaaaaagtccattttaattcccttcaatatatgccgaatatgattcgcatcaatcgatcgtagaaccgggtacgtcgatactttcaacttttaccgtgtaaaatgactcattcaactgttttaagagcggtattcaactgttttaagagcggtttagactgacgtgacgtccacgtgacaacctggtcattaaataaattaaaaaattgggtcgtgtttagttcgtgtgccaatttttttttaagtatacggatacacatttgaaaaattaaacgtagactaataacaaaacaaattacagatttcgcctataaactgcgagacgaatttattaagtctatttaatccgtcattagcaaatgtttactatagcatcacattgttaaatcaagacgtaattaggctcaaaagatttgtctcataatttacatgtaaactgtgtaattgttttttttcacatttaatgcttcatacatgtgtataaatatttgacgtgatggaatttttggaagtttgaagggaactaaatattgccttagttttttttctaacgtgcctttggatggctacgggacgttcgttagtttgtatccaacggagtatattcagttctctacttaaaaaataatttttcatggcgtcacctataattttcgctggcggttatacgtgaaaaccgctactaaaaatgtaacaaggggtgaggggttacagaccgccagcgaaaatcggttttcactggcggccacgctaagaggtccgccattaaaaattaaaaatagctttattttcgctggcggctactctaagaggcccgccataaaaaattgggttttcgctggcggccgattttcgctggcggcagctaacttgcacctactgtgaaaaaaatattccctctagtaaaatctcctccaatgttatcccttcccattcacctctcccattccttctcttcctcctgcagcctctccacctcctgtcctccagcctctcctcctccttctcctccaccacctcctcctcctgtcggcgtaggaaacacagcggattagcgacggtgactacggcgaccgggaggggccgggaggggtgccgtgatccacggccgggaagggcacgggcgcaggtgcaggcgtggcggatccggccaccgcagagccgcgggcggcggatccggccgccggaggaccgcgggcggcggatccggccgccggagggccgcggggagcggatccgggcgcgggcggcggcgcgcggctgatccgggcacgggcggccgctctcggacgccggcggcggtgcgcggcggatccaggcgcgggcggcggctatcaggcgctggcggggaggctagatctgccgccgccagatcggcggcgcctggctggtggtcaccggggagctgcatgctagctgcagagaggaggcacgaccgcacgagaggatcctctcttcagttcatgcgttttgttctgatctgtttgcacgtggtggggttcaactgctcattatgtttgacgtttctggatcatcattttcttctgttcacgtgctcattttcttccttcgaattccagaaaccatttctgcagcgggctgcggtggaggctgcggcggggctctgtgcagcggcggtggaggccggcggggctcggcagcggcgtcgtcgaggcggaggcagtggaggcttgaatgcttgaatttttttatgcttgaatgcttgggggaatagaaatttttgactgtaaatttaaattgtgcttgtgtgaattgaattttttgactgtaatttctgcttgggtgaatggaaatttctgtggatttttgaatggtggagcgtcgacggaggcagacggagcggtgtcgctccgtctattattttttttaaacttggccacgattaacactggcgggtgacacagtgttactcgtattttcgctggctggccagggaaaatgtgtctttgctggcggttgggcttaagacgactgacagcgaaaataaattatcgctggtggccaaaaaccgctagcgaagatagtgattttcattggtttttgttttttggcggctcaaaattctgtcagcgaaaatccaaaatggccgctatgaaagatggttttcgtagcagtggttatactacacactgtaaggcgtgtataaatctgtgaaaggataaaattggcaataaattagatgtcactagagtaaattagtaggtccaatcaaccttaatctaataacgttagcacatatggcccgccctaaacttttgtttgtgtcaaatcgaaggccatgccagttcaggtagacgattcatcgtccgccatggacacttaggccgtgtttacttctttggctaattatttttaaagtataccgacacacatttgaaatattaaacgtagactaataacaaaacaaattatagattccgcctgtaaattacgagacgaatttatcaagcctaattaatctgtcattagcaattgtttaccctagcatcacattgtcaagtcatggtgcaattatgcttataaaattcgtctcgtaatttacatataaattgtgcaattattttttttcgtccacatttaatactctatacatgtgtctaaatatttgatacgatattttttgtcaataatttttgggatctaaatacacccagatctatggatagttgcaagttgggcaatttgtcatttattttatcaatatacacgcgatcttcaggaaggcaaagtggtgcccaccggccaccgtccacttcagcaccatccgggagtgaccatacgcgagaagcatgaaatcggccttgccaagcgctacggaagcgtgaagcgcgccttattagcacgcgccgcttgcagcctcctctgtccagggctccaggtgttctaccggacgcagaatgcatccaacctaagctacccaacacacctgacgacttgctataagtatcccctttacagccactccatagctcatcaagcagttcgaacactccatttggttgtcattttcaactataatccaccacaactcgtgcaacatcagctcactcgtgttcccaaccgcgacaaagcttcacagatggaggctcagaaccaagaggtcgctgccctggtcgagaagatcgccggcctccacgccgccatctccaagctgccgtcgctgagcccatccgccgaggtggacgcgctcttcaccgacctcgtcacggcgtgcgtcccggcgagccccgtcgacgtggccaagctcggcccggaggcgcaggcgatgcgggaggagctcatccgcctctgctccgccgccgagggccacctcgaggcgcactacgccgacatgctcgccgccttcgacaacccgctcgaccacctcgcccgcttcccgtactacggcaactacgtcaacctgagcagnnncttcgtctttctggggcgctacgggcgcggcattgcccccacccgcgtcgccttcgtcgggtcnggcccgctgccgntcagctccctcntgctcgccgcgcaccacctgccggacgcggtgttcgacaactacgacccggtgcggcgcggccaacgagcgggcaagaaggctgttccgcggcgccaacgagggcctcggcgcgcgcatggcgttccacaccgccgacgtggcgcccctgacgggggagctcggcgcgtacgacgtcgtgttcctgccggcgctcgtgggcatggcggccgaggagaaggccggggtgatcgcgcacctgggcgcgcacatggcggacggcgcggcgctcgtcgtgcggagcgcgcacggggcgcgcgggttcctgtacccgatcgtcgatcccgaggacgtcaggcgtggcgggttcgacgttctggcggtgtgccacccggaggacgaggtgatcaactccgtcatcgtcgcccgcaaggtcggtgccgccgccgccgccgccgcggcgcgcagagacgagctcgcggactcgcgcggcgtggttctgccggtggtcgggccgccgtccacgtgctgcaaggtggaggcgagcgcggttgagaaggcagaagagtttgccgccaacaaggagctgtccgtctaacagccggacgatcgaaaggcgcactatattatggcaataaatcatttgattatacttatgctgcatttgcgaagctaaggtatactatgcaagccatatgtttgtgttcgtacgtgttgtttgggacgtacagttgtgttgttgtacgtcgtgaagtactgaagtgttcacagtagatcacaagttcacagcaatcaatgaggaccctgtaagccagtgtaaacgaggaacatgccatctgtgtatgacagtgagaaattatataagaaaaacattttgtgacaaaagtaatcagggctacctttttaaagtgctgttctggcagcccttcgctttttctttggatttttagagtgttcatttatcttgtgctgaaaataaatggtgtagcaaaaggtacagatttaaaataggaaaaataatatattttactccctcaaactatttcaccggagcacttagcctcctaaattattttttttggctcattttacatcccgaactactgaaaacgatataccttatcccttacattgtttctctttgtgtaagtcaaattttccactaacgtttttgtaggatgatatatgaattacaactatcgtctcaacatttttataatttttttctcactgtttacataggatgaaaacacctaaaactaattttatcatcaacattttaaagttcaattaaatagtaatgaaaaaaattgatttttttttgaacttagataatggcgtcatctatgattgtaaaaattttcagcttagaatacaacttgtataaagcgtaacataaataaaaatattactattaggtaataaagtaaactattttcaatagtttaggtttaaaatgaggaaaaaaaatagtttaagggttaagtaatcccatgaattagttcgggggagtaaggtggattttctttttatttaaaagtctgacgccaacgatgtcgagtggcgctgagacgacgcggcgctgcagattgccttggtgacacgttatttagctaaccagtgcatgcaatgttgtatagtaaattctctaaaaatatttatatgtcagaagtatgcaaaaagttcccacatattaatgacaaaaggggattatatctttgagctcctttagagcacaagattaaaaaaaactaggaatatgatagagattggtgtgtaaatcagaggattaaaatacagagaaattttatcgaatagaagtatgtgtttggatagagcataggaaaaacatagaattctttgtaagctttcgggcaaaggaaaccgaaaggagagctcggagtggattgttattgtcctgtggaatcagtagcttaggaaatgttctttggttttccgttgttttcccaatgagcaatttttctgatccaaaggacactatagtaacttaattcatagaaatacaaatcctctaattttttattccctttgtttttcctccgatcaaaggaggcagggagctctcccaaaaagaggaatatctataccattaactaacgagggtccatattatatatagaaaatccaatttatttttttcaatgggtaacagtctatcttcactgtgcgtgaaattcgggtagttttaattagagtaaatttcacaaaactattgatacttttactacaaatatttaagatggtatatcaaaaatttagtaacaaagttatagaaaaaatacaaattaatgccaatatagcattagtgcaaagaatttaaaatctaaaaaatatattttgtaaaagctttttatactattttttatgatgctctgttttaaatatgtagcttcgtgataaatttgatgttaaatagtttcatgatgtaccgccttaaatctctagctttgaatagtttgatagttttgtaaaatttatttacaaaaattatgggtcttgaagtggtaccacacgggtacctactcaagactgtcgtgatcgaagttcacgtagataacccttttacattattatttcagacggtgacaaacacctcttgctttctcagcaccttactcgtcgttgtcccctagagttgcaccgaaacacggaatgcattggcacggatcaatgcccaggcgcctagcatcatccacacaacaagaacaagaaccccacagaagcacaaacacaaaccgataccaataatgtttcagccggccgatgtcacggacagcgagacacagccaggattactatgcacgcactcagacggatagcctcttggcggcgaactcttccgccttctggaacgcgccggcggccgcctccatcttgcagcacttgcacggcgggctcaccactggaaccgcgccgcgtgcgccggcgagcccgccgccgcgacgcgggtcggccttgcgagcgacgatgacggagttgatcacctcgtcgtcggggtggtacacggccagcacgtcgaacccgccccgccggatgtcctcgagatcgacgatcgggtacaggaacccgcgcgccccgtgcgcgctccgcacgacgagcgccgcgccgtccgccatgtgcgcgcccaggtgcgcgatcaccccggccttctcctcggccgccatgcccacgagcgccgccaggaacacgacgtcgtacgcgccgagctcccccgtcagggtcgccacgtcggcggtgtggaacgccatgcgcgcgccgaggccctcgtcggcgccgcggaacagcctcctcgcccgctcgttggccgcgccgcaccggtcgtagttgtcgaacaccgcgtccggcaggtggtgcgcggcgagcacgagggagctgaacggcagcgggcccgacccgacgaaggcgacgcgggtgggggcaatgccggggacgtagcggacgaggaggtcgtactccagcttgctcaggttgacgtagttgccgtagtacgggaagcgggcgaggtggtcgagcgggttgtcgaaggcggcgagcatgtcggcgtagtgcgcctcgaggtggccctcggcggcggagcagaggcggatgagctcctcccgcatcgcctgcgcctccgggccgagcttggccacgtcgacggggctcgccgggacgcacgccgtgacgaggtcggtgaagagcgcgtccacctcggcggatgggctcagcgacggcagcttggagatggcggcgtggaggccggcgatcttctcgaccagggcagtgacctcttggttctgagcctccatctgtgaagctttgtcgcggttgggaacacgagctgatcagctaatgttgcacgagcacttgagctgtcagtggaaaacggcaagcttgtggaatgcttgagctgcttgatgagctttgaaatgggaaagaatggggcaatatatagcaggagaattgcctcaaagattggctaaaagcgtagtcgaagaatgtggaacgcattatgcatgcatggaaaattggcaaccttcttcatgcgtgcatacccaatgaggcttgtttcatgcctctgcgcacccctggctggtgttgaagaggacgacattttcctttgcttattttgtcttctttagatcgcatatgctttttaaaaaaaaaaatcttatgattgtgctagatgtttgtgaaacgtgatcgatttatcccgggccccggtttagaagctaaaatcttgcaaggtttgggattgcaacggtaagtgaattggattcatgtgggtaggcaatggtgagtggttagatttaaatttccatgatctttttcaccttttacagtagtttgatccgattagctaaaacaaggtttgaagaaattgaagagatcatacttccatgcccccaatgaacgagaggtgagcttctattaataagttgtaagaccatcttccctacaattctacataccggccaaaaatgattgtttgtcaatatggtatgatccattattaattatgttgctgtcaaacaatagcacactgcatactgatgcaagcataaagctgactaacaagttcaagacaagtggatccatcgtctatagtcctagtaggcactagtttatatatacttggacagactacagagccattattaggtgagaatatttttagatttaactggtttctataccaacagaaaacaattgagtaaaatcaatcagggtgcaatatccatcatcaataaggcctttccatcactggaatggcaaccttcagcaaaaatccaatcgaatactccataatgtagtgactccttgccacttgcagcaagaagaaccagttctggttcaagcacaaaactgcatttatgatcctttcaggcttgtacaaactgtccaatgatgagctcacaaacagccaaccgaaaccacttcatctgtgtgaattcaagagaatatgtcagtcattttcttggttaaagcatcaatgtttatatagagtattggacaaaaaaaaacagggttcacatagccaaagcaaggcgatattctgaagactgatgcagcataaataaagtataaaacagaagagagtatagaatgaattctcattataacagtatcaaaacgatttttgctatttctaagttgcctaatttttctgtctttggcctcggtatacggattgatttctcatttcaatccaataatttagaaaattaacttatatcgtgaaaactcattttcccatcttcaatagctatcctgttattaaataatattattcatcaccaccaaaatgttaggctgctactagatcagatggcatacatttctgctgcttaagacagcactgttccacctctgcttcatgagaaaacaccaggataggtaaagagccacagtaagcaacaaataattgtattctctcccatgagaaaagcggaaataaaagagaagttaccacagaagcgatctttgcattgatgagaacccctcggcctcaggaccttcacatggtgctccaccaccactagcggacactgtcttgttttcggtgtcagctactgaatctgaatcggttttactactaccgcttaagcagtacttctgcagccatctatcagtctcccacagaacatgcatgatgctctccctcgcagaatacccatggctttcaaaagggagtatcaccaaacgagatagtgcgccatggcctttcaaggcattgaagaatcggtctgactgtaagaaaaatatcactgatataattagataatattaaaccattagccaatcactggaatcataatctacgaatgatccactaacaatgaagtaagacggtatcctggatagagatgatgtgacgaggtcattccaggggttgctagaccataaaattcgtaccacaataaccatgtaagcactaaggtgctgaaaaacagtcgacctaatttcatatatgcaaaattacggccctgctacagtgcatgtttagtactccctccgtcccagaatataagaagttttagagttggacacggttattaagaaagtaggtagaagtaaatggtagagggttgtgattggatgagtagtggaggtaggtgggaaaagtgaatggtggagggttgtgattggttgggaagagaatgttgatggagaagttgttatattttgggacaaatcttgagagctaaaagttgttatattttgggtcggagggagtatttgcattttctaattctatcatactattgtaaaggttttggatgcttgtaatactttcaaatgggatactaatacatttactaagataaactatgtacatgcataaataatttttgggggcagaactgtaaaaagtccaaacttctgaggggcaaaatattaaaggtgacacaactcttctgcagatctaggtaatatgttttaccgcataagagtaaatcagttacatgggactttacctgcatcgtaagtgttccagagttgttgtcctgctctccatgaataagcaaaattggtttcttgatcttgttggccgacatgaaagggctcatctcgacataggtgttagtcgcctcccatagagttctgtcctcattctacagaaaatgcaagttgttaataagggctg

SEQ ID NO: 2313 - DNA, 373 bp, Oryza sativa
ctgcgagacacgcgtcacgggtttttgcggaagaaccgaaccgaaatgggggcaaatagaggtggatggggggggtaccttgttctggcggtggaacttgatgaacccgtgcatgaagacgatctgcgcgacgcgaccagcagcagaggaagacgatgagtggagggagaggggggcgggacgggagtcgtttggtgaagatgcttaattggttgtttacctttcataccatgagtgcttttttttggatctggatgtgtgaccgtgttactgtaagaatatgattcattcttgacttgaaaggccccatcgtatgggaaatatcttttgcggttctcatctagtgctttcagcaactttagatcctgagggg

SEQ ID NO: 2314 - DNA, 4889 bp, Oryza sativa
  unsure (1)..(4889): unsure at all n locations
catacctgtatcacatcagaatccctttgtcttggaggccacatatctgctgatggaagacgttcatgcataccaccttcaacatggattgctctaccctttggctatatgaacaatacaagttagctatggcagatagcacataaagaataaattgatccattcactccaaaatatgacttcataataccttagcaatcccatttccttctttcaatacagaataaatctctgactttggcactgatttactcaatccaagattgtaatggaactcctgaatgcagagatatgtaaacaattcttttttctggcaaatagaatgattgaatgaaatttcaggttatctcacctgttgcaatcctgacaattcatttgcaagtgttctggttccatgcctgaagtgttcctacaggagagaaaaaggggctctattatcatctattggactaaaaaattataacataaatgtgaacaaaataatgagtcaacaaaacattaaagcctaccatgtcaaaacaatattttctccagctttcttcatccagaccgaaattgaagtagtccgtgagatccacaccatgctgtctccagggcttctcttgaaatgcttcaatgtctacgtcaaaaactgtcctgaagtaacataccataacgtccaaatcagaggtcaagtgcaattgcacattctagttatggtatgcatatagacagaaaggccaacttatgcagctagtaggcataactaataactctgcagttagcaggaatatcttttaatgtctattggccaaattaagatcataactatcatgtcagagagatcatgactttaaacgttgaatattccagaaaactacgacgagaattacaagaatcagttgtttgttcttgggccaaagacagaatggcacctgttccttggtaagaaaaaattgaattccttttgaaatgcatgctggtggcttcgatcaccttgtcctgtgatcggtgctgttgttttctcgaaaagccccttccggtgaagctcaccaagctggaacacggaacaccacataaaaaaacaaatgtcaatagaattgctcccagcaaaatcaaatacataactcaatgtgatattgtgatataccattcatcctaattagtaacagaaaagagatagaaaatacttgcaaataatacgatggaaatgaaatctgttaggccttgttcagttaatccccaagaggtagggatcgaggggattaattcacaccttattcccctccaaatccctctcaattcccttgtggggtgggattaactgaagaagtgagctgtgccacagactaatgacagacgattctggaacttcccctgcactttcgatttccaatactgtctacaatttctacgaaattttaccctacgggttattcgccaattcgtgaagcataccttgccccgaccgccatcagtagacaggcctttcacacagctacccgaaacctccccttcctcgctcccctcctcgcatcggccagcaggaggaggaggcggcggcgcggcgccatcctcgttgagcacgatatggaggtcatcctcgctctcctcgtcgctgctgatgtagcccgcagtcccgtcgcccaagtccaccgcctcgttcgcgtcggcctccgtgtggtgggctcccggcgcctcggcctcggcctcgccgtcggtggccgggttggagcctccgctctccccggcggcggcaagcgcggccgccacctggtcgtcgaggtccgcgtagaggtcctccacgtcgtcttcattcccggcggcggcggcggcggcggcgtcctctgggtcggccatggggtaaagcagatggattacgagcgacgccggagtggtgagagcttgattgctgctaagccattggtgatgccggctgccgcgaaaacctttgccacgctgctgctacagaagctaaaaccctaagcccatggagacgcgctggttggtgaatggtgatgatggatggggcttgcaactgcaggttgttgcttccgggttctcatatcatgggcctccactgctgcatcggttcggtttcctttgggcctcaaatcaaccataccggtaatgggtattgtcaaatttcagtacatttttacgtggaactgcctgacaaatcctatccttttgcgggtgatttctaaaagaacttagatttttttacctttagatttacatccaacagactacaaaagaaaataacaaatatatatttgcttacacaacatttttatcaaaattacagtacacttacatgttatatcaattgaatttatgttatatcaattgaatttacgaatgtatttacaaatgtattttaagttataggactgtaattttatattttaaataaattaactaatacatatttacttacacaatattttttatcaaaattatagtgcacttgcatgtcataggagtgtaattttatattttatttcttcaatctcttcacctagccgcatcgacgtgcaatgtgtgtactcatcaatactgtgccaagctagatgttgctgacctcatgcgtgcgtgggaaagaaacgcatcacagccgctaactaaataatgcagagactaatccaagggaagcaaatccgagtgatttcgggccaaaaatttgtcgccagatgtttacaaaatcggttttatgtttacaaaaatttgatagtgctagatacgttctttttgtagccttatcatttttattttcgaaacataatataaacgtagacacccacgtacgtgcgtacactcaccctttatcaaattttggtagtgtttatatgtaagaacttctaaactactaaattttggtagagtaacaatggtaagagtatgtttggtttgttaataacaaactgagcatgtccactctttcccgttcagtttaagaacaagtaaatcaattaaatgagtaaagagggaataattgtcttttgaatggtaaaagaaccatgctgtaggaaaagaaactttgttcagccatcacatgaagcacttcaacatttgtatgaaaatcatctgtgctcaaatttaagaacgtaaaagtgtaagttctagatgtgcatgtagccgacatacatcatttacagaaaatgaaccgtacaggtataaaaccaaaatctagtctgaaattctgaatcgtatgtattttcagtgtcctacactagattacaaagatgcaacacagcaatccctcgacgtagaagtgttatgtaggatcatgaaagtgcatcagcaacagatgaaatagcgtcccttgtcgcatcacaaataatgaaactcgagaccatcaaattcttttctccagcaaacgaactagatctgctcaagtggtgtaaattggacgctgctcctgttcttagaagccccgtagcccacaaaaacggatatacagattgctactaccgaaagaagcaaggcaaaggcagttgcagcatcccatgaacgatttggagctgggcggtaatgtgcagcttccatggatggttgaatatcaagaaccaaccagtcgcagctggccgaataatgctcggacttgctccatggtttgccatcgtttgggtaccagaaagccacagccatactgttgggcccacctatcgtgaactgtgcatcctgcatggccaaaggaacatttaagcgcaaaatctagtaaaacaaatttggtaatgcaaccataccaaaagctattccatcccgtgggagcgattttcaggttgggtaaaaagatgtcactcgctagtagtgggctgagcctgaaagcatgggttaagggcttaattcccgaaccacagggggcggcatccccatgtatgaggggggccggcttctgtgacctttcttggctgggctccggttgagctcttctttgtgaaataccatggggggcaatctttcccccaccagccaagttttttactcaattcaaccttagataccaagtaatcaaagctatcatatgagtatatgaccaaataatcgataatactactagacaactatcctgtgtcacaaaaaaaactggcatgtatcatcctaatctgaccaccttgcaaatgcctggttgtacaagtaacctgaataatcacgtggttaaaacaattactatactcatacgcaaagaggttacatgttaggtcaagtagagcagtgtttagaaccttgctaacggatcataataaggtgcacgcgtcttagtaagaagaggatgagcaggatggccacccaactatggcaatgttatttagacacaatcacagttgcaatactggaaaattgcagacctagctgtcggtacattagaaatataatgtataactatttgttggtaacttcatatatgcatttatgcacatgtctctaggcatgctggtgctcatggaatattgggaagaattgaaacaatagtagataactacctgctgtaatcgatccattgttcttaggggccttgaaaactcaaaataatatgtgcccttctcatcttgttttccgtaaggactgtcatcatccacaaagcctggagaggaagaacacatgatagtcagacaatataattttatttgggtagatttcccttttccatcaaagcttatgcaatgataaaaaaatgtttatttgttgactgtctgaatggtcttaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2315 - DNA, 1043 bp, Oryza sativa
acttttccttgtcactttgccatatcctctctttacttcagtatttctgcaataacaaaggtgtcaactaggatcgggcacatattgttcaaacatatacttataaggcatataactattgatggatatagacatacatatcaaacaaatcaaggaacggaacatttccttctggtgtggcacccatcccattcagcaagatgtaggtattttcatcttgcttcttaacttttgcaataacatatgtccccatggcagttcttcgtagcattggtgagccaggatcagaatatacatcttcagaagatctatcgaataagatgcgtggactgacatcttttttatctggggagataacccatgttcttgttttccgtgttttgtaccaagattcatacactaatgcaagagattcatcacaccaagaggtccctctgcatcaacagaatataacaggagattaattatctgatagagttagttaagaaggcaaataaatcgtcacaaaggattagcataactaacattctaaaaggaagtgtcatttaatcatatctgagcaccaaatatagataattttgatgtaagagacttatactatatatatggtttattggtaggaagctttgtattaatgtccttgtttatgggaagtttcctaccagtagtattgaactatgccagatgcagaaagcttaaccatgatgcaaatgcagtgaacataatttactgatcctactaaagtaggctaacacatcgctcaaaatacatacgcatatcggaggtcaagtttatgcagaatctctggttgttcaccatttataggctcagcattttccatgtaaactatgtcacgaggtgacacctctacttttgcatctccaccatcctgtgtctccaccctgacaaaaacaaaaatatataaactattttgcatgcaccacttaattatatgatacttttgcctggcaattcatttagatagaattacgagtagctaagccaagtaggaaaatgaactctttctatatgctcataatatg

SEQ ID NO: 2316 - DNA, 9865 bp, Oryza sativa
tctgatacgcatttgtttttattttgcttgggaactgttcttattctaatacacattcttttttattttctcagagtttttttttttcaaacaaggtgaaatagaacattaccatgtctatttacatcaaataacatttttcagtaaaaccaatagagtaaaagttgtaacattcaaagcttcgaaacccacatactaaataatagtcccaacaaaagggcaaataaaaaatttacagctgcgataaaagtttgcattattgtctcatgtaaccttaagttctcaacctgctatcctcttgatgaaaggatagactctaaggaacaatccaagcaactagtgtctgatcagattggatgggcctccttccagatctgctcctattttgatatgtatctactccttcgcttattattacttaattcaattgaacgctactatcacttgtacaaacacaaatagaacggtttaagtttgaaacaaccacataatacacaatttaggatgtctgagacatgaaagctactttttggcatatgggaattaaattgtctgatgaatgttattttttcagatgtgaattaatggtgtggtctgtgttaaatttgttttcagatgtggatttcatgcatacataaattagtagctagcctgaactgaaaatattgtctgtcagtaaaaaaaaaaaaactgcacttaaaaaaactgatgattgaaattctgttctacataccagtacagcatcgcaggtttatctggcctccagtagattgaacgctttcccttgcggacactgcttgttgctattggaatgtcctcagcaaggggcaaatcacaaagttccctaatgaattctccatctacagtccataattcaactttcttcggaaaccttccacaaggtacaatataggaatatggacggtgaatagaagaaatcattaagtatttgtcatctggtgatgggtcaatagatgtatatacagcaggagggccaattggctttactgttccatcaaaagaggccaatacaagctgcgaggtcgcataataatcaaacagatcggcatcatattcatctttcaaaagatcctggaaagttctcacttggaccacatttgatgtctcattggactgaattttcggaccagatggaactgagggcttctgcggtggagctccacgtgacagagggatagtgcagacaagcaaagtagaattgttaacccatacaaagctgcaacagcaaaacaaaagttctttagaagtaggacaggagaaaacagcagaaattgatattcaatttcacctgtcaaaaatagcatttaagtatatctcaggagatttaaaaagtggtcttgcttctccagattccacatctgcaatccacaaacgtagcttgccgcttgtgttgtcctcctaattgaatccacactagagttcattatatctaatcatttgaacaaatcacatccatttttcaaaggcagccaaccaattacctcatcaactctaacgctgaatgataaatggcgtccgtcttgtgacctaggtcaaatggttcagtgcatagagttaggaataaagtaatccataatacaagtaaaaatcatttctgaaacagctaaaactggaagcaaggcaattaagaaccagaaaaaaaaatccttgaagttccttgatggaaggtccagaaaattaccaggtgacaaaattaatccttgcgccttcaggatatccatggaccactttctctggacccaaagtcccatcatccatcagcttatggatacctattccagtgtagaaagacctacaaattatgtatatcagatttccaatcataacatgtcttggacatagtactaaacttgtcacagataaaaacgattagttagacaatgaaaatttacccaaattatttattgtacttacattctgcttctagtattagaatagccatcaattctcacaccagcaagtttctcttcaggctttgcgagatccgacaatggtggcagtgctcggcgcttcaggaataaaatcttgtccttgcttggcgagaatgatagcacgggtagcggtggtgcatcaacgatgtcttgtatttcttttggaggaaggcggtagcccatcatcgctgatgaaaggtctgcagagcaattaaatgcatcaattgttggctgtaccactggtctacattatcttttctcgttgacaaaaaagccaggacagaatctgctcatacagaaattaaaatagatgttcaccaggcatatacgttaactatgtcaactaagacaatctatcattgaacaagccaagcaagacaaactaacctatatgcagctctaacaggtctgtcaaacctaaaaaaataagatgccaatcaacttcttttgatctttttgaaacatgagaagctaagcgctatggccttcaccaatctatctagcgttaaactcataccacgaacaaaacctaaacaaatttgaagcactcaaaatcaccactaaaaaaatccacgatctcttcacgaaccgatcccctaaccaaagactagtgctccaatctcgtctccatcaaaaccactcaaaatccgctcaacccacagcctccccgcgattccactcactacaaaagcaaaaaaagatcacgcaatcaacgaagtcagcacgaaccatcgtcctcttgggcaagaccggacgctgcagccgccgccgccggcggctcgctggactccccggccgcaccaccggcggcggcgacgatgtgggacagccttgacgccgcggaggaggacatggcgctccggcgaggcaggccgagagggcggcgaggaggacgaagaggagcacgcagaggcgggactgggagcagagcgaagcggaggcacgccctctggaggaggatggtgagggaagacatgatttttaggtctctacctttcttctatagatagcattacaatagtggggatggtgggtactcgtggtcgtgggattgatggaaccgggaaaaagatatttctgctgttttgatatattcaactgattttctttctatgcttgaaaattgaatttcgagtataaaagtttttttttttggcttttgtcgcaaacatagatgatgtactccatccgtctcgtaatataataatctatgataggatgggatatttcatagtcgaatgaacgtagacaggaggcaggtacagatttgttgtactatgaatcgttttgttatattatgggatggatggattattactagtagtagttttaaatttcaaataattttggtttcttattggcctaaattttgacacttttattgagtgtgatgtaaaatttaagtgtgtcaatgaatgtacgccgaattagtactcccttcgtcctctgaaaaacaaatctagaactggatatgaatctggatagagatatgtttagattgatagtacatggaagagctatttggcaaagtctcagagcccctgtgaatcgcagggtagaaaaaacggagtaataggaaaaacacaggattctgacaggaattgaagtgtaaaacagaggattgcaaaacacaggaatggtcgtttgattggagcgcagaaaaaatacacgaatcggatgagagagatagactcaaagaaaattttccaagaggttggagctcttgctaaatttcctccaaaatccacatgcaatgtgtcattccataggaatttcataggatttggaaagctacaatcatttgaatcaaagggccaaatagaaaaattttctatgaaatttctatataaattctttgattcaaagttgaccctcgtaatggatctatcagacatggtctatttatctcttcgatgagggtcatggagaggataccgatgtatttggcagctagcgtgtgagacatttcagactgtttatgtggcgatatcgcactgccgcctgagcaattaccggatgactggctagaagatccccgtttatttttctcccctgctttattcgcattccactacagatcgtccagtcctagtgcgtgtgtttctggaacgcgacctgcaacgaaccgcccgccgttagcaaagcttgaaggcttgaagtctgtccagctttcaggtactagtacagtttttatccgtccctgtccctgccatatagtagaacaatatcttgtcagattatctgaaatctaaacgagtctagaaggctgagatctaaacttcaactgcaaactataacttcctcgtttttcattagcatgttttctgatacattttgtgtaaaagaaaaatgtatacaagtgtttaattttgcatatttataacaattaatttataattaaccatgcgctaatgaatcaccatgttttgtgttttgtgtgctgcaaatatactactccaatataaagtttcaaacaggcctaaaacttcatattgatggtaaaaaaaatggaaccagctgaggagtgaggactggagctcagaaagtcacaattctgctgctctaatcaaaatcttcagtaactgagaagtcaaaaaaaaaatcttcagtaactgaaatgcttggcatttgctcaactttgtcaaattggaaactatctttgaagtggaacaggaatacataaacaggaaacaaacgttggagacatatgctccctaaaacatatctgaatatgatatacatccctatgttattctgtagacgttcaacatcactgctatctttttaccatttggcaggaccgcaagggtttttatatacagtggctgaaacaagaattacatagaagaatcatatcctcacttaaaaataccaaaaaaaaacctaaacgtgttactcaaaaggagacatgctatgctagtatcaaagtttgcagtctcagaacaaactgaacccctgcgattcctcctgattctcttctgatgtctcataatatgttggctcctctctttccccacttctataactatatgcatactctgtactctcttttgaataatatgctgatgcttcatactctggcttgacaaactgaagcatatacttcaagccatttatgacatcgtaaatcatcaatccaattcttccaccaacccaactgcccagatggcttcctgtaagataaccaaacctccccagcctctcctcaccatggaacccacctacataggttccaaatagggtgccggtacctcggagaaaaccttcagtcatgcttccaccgaagtacatggcttcaaagaagtcccaaccagaagaaattatcggccccaatatcctcttggcttgacgagctgccacttttgcggctttcgcaccaaccttctgagcttgctttgctgcctcagcggcagacaggccttctgtcacagcatcagccaatgctttctcaatggcccggtgcctcaccctttccgtatgtgcagtttggaggttgtagacatacaacttgatgccctccttcactgcgcacgcaaggctgcctgagcccatatcaaaacagttcatgaacgtaaactggccactctttgatgcttcctccttcccgacaagttccctgaacttctcagctgtaaaatgcaaattttcagagttcaaaaaaaaaaaatcaaaacatcaacagctaacagctatcaacatagaactactactaatttttttcatgttcttatcctggtgtacccacttatcacaagctgtgttttcaagtcgtccgattagtcgtccttatagctaccctgacctcgatcaggaacttcgaagtgattagttcgaccagaaaacttattgtccgactaatcacgactagtcacgattagtcgatcaaattagtcgtggacgactagtctgttagggctaaaaatatgtgttagactttacacttcagtggcaggccttttgcccagcccaagaaggcctttacccctcatctaaccgactaaccctgaccagacatctagatctagtcacgagagagaggggagaaaagatgaaggacttattgcaactaggacaggtaaatgatttaacttttaagaccttaagtcaagtgtgaactgtcaactgtgaaaatctgattatccttagtttgtactatactatactagtatactatggtaattcgtacttataatcatctatatattatcctgggcacccctagcctatagtcaccgactaatctcaactagtcggtgcccttacgactagtcccgactagacgacttgaaatcactgatcacaagatcaagggattggttggcagggctcccaacttagcttcttaacaagacttcaccattaaaaattgatatataacacatggatttagtatttaaactatgaaaaagaagaacttgatatatgatgaaatgtctgcaaagtgtgcaccataatatcataacacacgtacaccgcggtcggccacaatatacaagggtaggcaagatacacctaacaatcataattggttcagctgatagacaattttaagaatataactgaatatattggcagttggcatccccagttcgtcacagtggtaatattctaaccttcaataccaagattatatacttgtactgcttgttcaatgttccacccatccttcctatcttaattacattgaatgacctccttcggtcattccagcaaaaacatccgtacgcattaataattaaataattataccaatttagtaccaatttcaaccaaatttacgccttcctaaattatggccaaaagaattatgaaaacaaggactacattggcagagcatctttttaataggcactcaaagttcgggctgaggactctatcctagctggaccaaatgaactaggctcgacctaagggcacgataattattagtttttgtttacctctaattcgaaattaatacaggtaccaatcattttcagttgactaccttattctgcaatctccacaactacaatgacgtcattagttttgcaaacgagacggtaagaaaaccatatcatttggagtgcctcctaaagctatggccttcactcttcgaagcaattaccaatcgcccaaaagcccatcactaaaattctctccactcaaaaaaatcaaccaaacaacacccaatcctgcttgacaagaacagcgccctccttgtcccacccaacaacaatacgcgaattacaggatgaaacgaaaaaagcagacatggaaattgcacatcaggacgtccccaatcgacgattaacctactctccacgaggccgtacaaatccacagatcaagaacgggaactaaccggtcatgctgagcgcgaggacgcccacgatgaacagcagcagctggacgcgtcgcttctggatgtccagcatcttcgccctcctcctacgccccttgcctcagacgctgcggagatcgattgccctcgcggatcgcatccaccggaggaggaggaggaggagggaggaagggaaaaaagaaagaataaataaaaaagaatggtcgcagcgtcaactccgcggttgccgcgtgttactctagaaacgaagaagacgatgcgcgtccagctcactggcacgtggggtcgtgggccccagatgtaggaaaagcttggaggactgcgacgtcacggggctaaaagctcgagggcctaagtgaaaaaacttcggggtattgagctgatcagctgaacagaactgcccccaagacttgtggagttgtagcgaagctgcaagagtgacgcggcggcggcgatggacggcggcggggtcgaggcggcgatggacggcggcggggtcgaggcggcgacgacggcggcgtggatggcgcggcaccgggggatgtacgagcgggccacgaggcacccgttcaccgtctccatccgcgacggcaccgtcgacctgtccgccttcagacgctggctggtcagttcctcctctcggtctccaaaattcccccatcgcttattaggcagacaaaagatctattgtaattctcgtagaaatatcaaagttctaaatggtctgaagtgacaccgttcaattgttccttctggttagcaaaagtcctagttggtattagctgattagccaagattggaagggaggcacgatgaaggttcattgttagaatttgcagtaaaaactgtgagctgcgagaacattgttggattcagtaattgaccctattgtgttatcttgagtgttggatacttagaagatgttggtacctggccagtccagtaatagcttcaggccctagcatttctttcaattatgagcatctgactcattcttaatattgtatgaaaaatgaaaaaaaaaaagctttattccaacgactgaacaaaaaaacaaatagataaaggtggttcctaaatgggggaacatatcctatgcacactcacttcccatgcacatcaactaataaatatcacggaaaattttagaaaaaaactgatatgtactcttaatagtattacacgtatctacaaaatcttatattcaaattgattatattttaactgtaacaaaaaggtgaaaaatctaacagttttaagagtaaaaatctatcagaattttgtcttttttacgactaaaatataatgaatttgaacataatatttcatagataggtgtaatactatttaaagtatgtgtccaattttttctataattttttggacatttgttagttagtgtgtacggaaaacttgtgtgcataggatatgttcccaatggatgaacggaatacaataatcacattttcatgccttactcagggccaggactacatgtttgtgaaggaatttgttgcgtttctagctagtgtactgctcaagtgttgcagacagtcagatggctcggacatggaaataatactcggtggcttagcttcccttagtgatgagctctcttggttcaagaaggaagctgaaaaatggagtgttaatctagctgaagtttctcctctgaaatccaatacagaatactgcaggttcacgcctatcaaacttttgcataactttacagctatagcaacctgaagaattatttctgtggttctaatcaggtttctccaaagcttcagcgagccagagatcagctacgttgttgccataactaccttttggataattgaaaccgtgtaccaggatagctttgctttctgtatagaagaaggcaacaagacgccacctgaactcctggggacctgccagagatggggaagccctgagttcaagcagtactgccagtctctgcagagaattgcagatcgctgcctcgcagaagcgtcagctgatgctgcgaggagtgctgaagaggccttccttcgggtgcttgagctggaaattggtttctgggacatgagctcttctcgatcatgaacggcaacagcatctcgatcatgaactacttgggagaaataatcgaataatggtgcagccggttccataccgaaccctgcagtgtactactgtgttttcctcttccttttatccccatttctctccttactcccatgaacattgatgtatcatcgtaactatgaaataaatgaaataatgccgtttcctcctaatcaaaatcatcgtcgaatttcaagttcctggatagaactcatatatcagtatcaccgccggttgatctgcctgagacagctttgacactgctgaatgctgatcatcatcaattgacagaattccatttcaacgtggcaaatatacgatggaacatgtattccaaaagcacatcgtctcatgcacatgctcctaaaatgtcaagccagagtatgaatttgtattccaaaggatcgcttgtcctgcaatcgcggttactgaatactccctccgtattttaatgtatgac

SEQ ID NO: 2317 - DNA, 15530 bp, Oryza sativa
ggcgtcatacattaaaatacggagggagtatttgtttttgtaattaacaaataaaaaacctcgcattattgcagactaagacaaattaacgatcaaacttacacgcccaagaggcaaagtgtacaccccagtatgccatgctgctctagcttgcttagagctgaaatgtgtaacacagtaacagcaatggcgaaagccatggatgaactggtggcgctcgtgtgggctcagtcttcgtaggtgcggcactcgtcggtctccgggttgtccttgcagtactcctcgagcgggtcgctgtccttcttgcggtcgcgcgcgtggctggcggcggcgctgagctcctccacctcgtcccacgccgccgcgcactcgccgccctccgggtcgcccgcgcacgtctcctccgcctgcttgatgctctccgacaccttctgcgccagctccggcggcgtcggcgagcccgccgcgaccaccaccgccagccttcccagcgcgcgcccctgccggcggccggcgaacgacacgacgttccggcgaaccggtagcgtaggagccaggggccccgggagggtcgtcggagcctggaaggtggccatggcggccacggcgaggatggttgccatggctctggctgcctgcaccccgaagagtgttgcagtgaggaaggagaagaagaaggaggttttgggttggggtttggttgtttgggctaatgctgtttttatggctgcatttatcttatctctatgtggccaatagcgttgtgacaaatcagccttgccagatttcctttctagaaggcatcgtccgttttcgatcgaacgatcgagcagcacgcagttcgtgcacaaatgcttagtactagccccattagattaacacgaattaatacaatgttgaagatatcgcaaaatgtacactcgctagctgccaaattcgtagccgtaatactgtgagtaagatctcgttgaaaccggcagttattagctctggatttcctgaactactggccgtgtattaccggtgggtcacatcaacgagagaatagtggcccgactggccgtatgtgcttatgtggcgagcgcgcggccggcacggcacgcgtacaccgtagagagccatagacaccggccgtggaggcggggaagacgacgactcgatcgacgaattctatggccgtacgtggtggcggtagtagccagaagcagatggtttcccacagccaggaccggcgttacgtgccgccgctgatttcgatcgacgtacgtacgccgcgagggaatcactgctcgtcgccgtcgccgtcgcgccacgcggaattaagtcgccaccaccgccaacacgtactacgtacgtgtagagcggccggaccgtgaccgtgaccgtgaccgcgcggtgccgtgcgcggccgatggatggatggatggcttagctactggtggtggctgcgggttccgcggtgggtgatgacgcatgcgcgcggccggcgggtcgtcgggatgcgcgcatgccccgcccgccgacggcgcgcgacggtacgtacgtccacgtcggcgtcgttcgcgtcaggtgaccgagctggcctcgtctgagtcgtctctctcctttgtttatttcctttcttttctgcagcgcaccgagcgacccgggttaattcacaggatctttttgccgaccgcgcaacatatatgtgctgggtgtcaccgtgtccatgtcaggtgccttctttttttaattacacaaaatacgaacacgcaccaccgcaagtgtgctctaatacatgttcaaagagacgaattaagaacagtgacacatcacaacctctattaaaaccctattaaaagtactactgtgcatgtattatttgggagcatcagggttttgaactatagtagacgaaggctgtgttctttcccccactttaccaactcacatatctcgttttccacgtgcaagcttttcaaatggctaaacggtgcgtttttttataaaaaatttcaatatgaaagttgctttaaaaaatcaaattaattcattttttaaaaaaaatgctaatacttaattaatcacacgctaatgtaccgctctgttttccgtgtgaaggagatgggttcctaacccaaaggagcgaacacagccgaagtcatgttcccaaaactctaccataccatagtagcataatttaatcttcttgagctacgttcggcagtagaacaaagtaagaaagtttgtttcgttttccgcgcgcacgtttcccaaactacttaacagtatatttttagcaaaaaaatttttatagaaaagttgctttaaaaaatcatatcaatccatttttgaaatttaaaataattaatactcaattaatcatgcactaatagctcacctcgtttttcatatcttcccaattttctctatccacttcttctcaaactcattacttctgagagcaggtacaatagtagattataaaccagctataaacatattttaaagagataaaagaagagagagaagagaagtgggctacagatctatagccagctgcagcacggactccaagacgtaatgtgtgtatgacaggtgggaccatgtattaataatgtagtaagcaactattgtatgaattgactattaagctgactaaagataatttagagctagtagttggctatactattaaacttgctatgagaaagatcacatgcgattgtcaggcatttcggattcttatttctcttgggatttgggataaaaaagagtacacttaacggttaaacttgtagaaaacttattataaaactatatttttttacaactttaaccataatttatgattgttctgaaattttctttaaaaaaacaagtcttaagttttgtaatatgttcaaacgtggagcgtacagttcgtttgaaagtaaatgtataactgatgtacaactcttatttttattcagtactactctatttcatattacctgtagtaatcaatataaactgttatagcaacttaaaagtcattcgaaatagctttttttatttccatcaatgtttgtacagggcttttggttccgatccacaattcatattgctccatttcttcctcttattatatgatagctcacttcagcaagcttatgcctctgtgaccataatagacattaaggttttatatcatggtctcttgtaagagttaaccatggtctctaattttatataacaaaaactcatgtagctgtggtggattgggtgcatcaatgcaacgaggtaaccatttgggagacaataatcgaatggttatgaggcagcaagaggaagtgcaagtgaattaaagggcacttagtgagctcttggagaagacgatgaggaccacatggctattttatgggggacatgcaatttgaaatttaaaagttattgctagtgcatagaggctgtcaagacatagttgccaccctattatgttgagcatgtggtggtatttgttggatgtaagatgtggagataggttaagtttagggcattacaaagttgaggggaacctagatggttggatcttactccaatgataagaaaccagtattggggtatcactattatagaacatgcatgcatcgctattatttggagagacatcaattagaagtttttgaaaaagttggtcacttttcccattacttgcactattgaaaaggttaaacaataaactacgctaacctaaacacaaaaataaattgataactagtaaatacaatcatagaattacaagtaaaagtatccaaagttagatagagaacaacataaaaccatatacaatgataaagctttagttaaaatgggctaaaactgcagattgcatagctctgattttaggcttggaaatgtttagttttagatgactgttaaattactctctttattttatattataagtcgctttgattttttttctaattaaacttaaatacgtttgattaagtttatagaaatactcagtagcatattcagcataaaagaaatatattatcaaaatatatctaatgttagattcaatgaaataaatttggtgttctagatattgttaaatttttctataagcttgattaaacatcaaaatattttactaataaaaagttaaaagcgatttataatataatatgaaatgaagggtgtatcaaatcaaataccacgagaacacattacacaatctaagctaactgaagtttatacaatgttcacacactttatttatttctccactcttgtacctcgcaacaagctatactttttactacacaatcaaaacaggaatatggatcgtaaaatcaacaacagtattaacgtacagtagctagatcagaccatacaaaccgaagacacgcatgtggcaacaatcataagtcaagtactttatgtagagtttcatatgttttcgtagccctgcagcatactgaccggatccatgaccgagtctggctggaagtacagcatctcgatctgtggcggcagcggcggcagcagcggcggtggcgagagcggcgtcatccccaggtcgccgccgtagagctgcacgaggtggtcggcgacgtcgggcacgtcgaggggcacgcctgccacctccccgagcaggcggagctgcgaggcgcggagctggagcgcgctgcacagctcgcgcgcgtgcgcggcgagcacccggttctcctgctcgaccaggcggcaccgctgcagcacggcgccggcgccggcgcgcatggcgtcgttctcccgccggagctgctccgcctccacggccagcccgtccacgtactgctgcttctttatgcgggacctctgcgccgacagccggttcgacctcttccggttgcgctgccgctcctcctcctccgccgccgccgccgccgccgagcggcgtgcggacccttccgtcgccggcgcaactgacatcttgaatgtatcacagagcacaaagagaaactaacactcaccgtggaacaccgatcgaacacgtactaggcagaaatatttcgtgctccaagttgggcaatcgcgtgcaggaacaaggcgatactaggaaaggaacaagctagaacacatttagtagaatatatatttttttggatcaaacaaagcttcagtttttggtccttagtttcagcgaagatggatcgtgcacgaagctttgtttgatcaggtttggagaggaagcggatgaggcgaatcaggaaatcacgtagaagaagtagaggaacacgacggagagcgagtggaggtagcagaagtggaggctagcctccgtgatcgacatggatgcggctgaacccggcgaacaagaagccacagggagttcgtcgtcgatccttcaaatcaagaactacacggagtgaaaggatcgaagaagaagcaaccaagatcggttgatcgatcgagaagctcagctagctgaatcgatcgagccaaccgggaggagaataattcatggtgctatgtaatctataacctgaccaaagaggctagctagagctaggaggacgaacagatcgaaagggagggaggaatggggaagcagaagagtagtagtggtgcttaggtttgcgaagttgattgtggttttgcggatacacaagattgtgtgggggagaggggatgatcaatgaatacttatatatgtgcattgactagtactggagctagtactgtctaatatagttcaattacgtgtgcaccgactagtatcttttggaaaaaaaaagttcatcttttgctctaatcaactcggttggttaagtgaaatgaaggttttattgattttaccgcgcagatctgaaatttccagagatgagaaagaagattcgagtgaaatttccataacacaacaagagaggggcttcgttttcctccccttatgatgtgttttcacggctgctctgagatattcttttttcgatccacaaacggacaaggcatcatgcacataggttagtaattaactccagcaatggcagcaaagacgtattaagggaagcattgccacattgacactctcttcttcttttgttgtctgaccagaagcgagccggcagctgcgcagcttaaccagcagcgtcagcacgcatgctttcagcaggatgaagattgcagagtttcagaaagagacagacagcgctggcatattcagaaaaataaattcagaattcagaacgcgtttcctcctgtgccgatcgatcgatgacttcgtcgcggtgaagttagccccgattggtcgctctagcttctgggaagcagcccagggcaaaagatccaaggagtatgacgaatcaattaacggctaatctagcacttatttgtcatttttcactctctctctctctctctctctctctccgacgtagcaatgttaggacaggtggccactgcgtttgctccaacctgaatattcggttgtgagattcagatgtcctagttgcttctgttaattagagtatggcgtcaccgccacgagataacattaacaaaactgcgtggccaatgcccaaatagtttttacctgaagggtgaggaaagaaacagtacatgtcattttcgattagtagggcaccacttcgccgtgacatggctggcaagttgcttatgtgctaagggaaacagaagtaccaaatgtttgtacttatgcatgtacagttgaagaccctgattagccaaaaaaaagtgtgtaatttgagatcgattagctgaaggtaattgcttgctaatgtgtaatcatgttgcctcatgtgatcgactcgtgtcttctgctcctggtagcctggacgctgatgctgttggggatgaaaggttgagctctgattgaagcttttggaggctcaattcgtgcgaccttgtcggagcaaatatgttcttctaagagaaagtgaagtgtaactttgtttatgatccactgaactttgtctagttgatgtgtgctttggctgcatgcttgcagatattaaaggtctctctcgctgacgaattagctgactttggagctaatttactcatgaccatgcatatatagcatatcagtgtgtacctttcagtttccttctacttaattggttccaacaaagcagaggtgattagatgacctataaatttatctcttctttttccaagatgacatgaacttcacctttgccccagcacttgtttaccgaactaccgtgacgtcgcgaatgatgtaaattggcatccttgcgtggattcgtatgatcttattaatacttatattacacagtaaaacatctcactgtcaatgaggggcccaaggagaagcagaagaagattctttctaaactactagttgggtgttcattgtaacggaaaaaaccacgtcgagtgaaatgatgttaaataagtgtaaattgactgtataaaaaccttaatatagtactaataataattatataacatatttataattttcacatctttatagtattaacatgttagtaccatataagtagtaatagctaaatgcacgtgctttgttatggataaaagaaaacatataaatgtgttgcctatcttttttttttgttatagggaatattcatcgtactctaattttttaatgtgactatccatttagatttgatcttttttaatattaaaaaaattagggttaacttttaaaatttacaatggaagtacgtagggtgttactcttgctaccatcaggatagatctgtccccttcctcggtttccccccacatatgggatattttaagaaataaacgtctttcttcatagcagggtcgggggaaagaatggaaaagacgatttcactatatttcttaccgggaacagggcctatcacaagaatatttttttattgggacgataactctgaaaagagagatttcctgtcttttctttcaactcaggagaaatacggtcgggcggcgctaattcgaatccctcgggcaaaaaaactacagttaccgccatagacaatgattcatttgtgaatgctaaatagtagttgcccataagaagatccattattgggtgaatggagaatggatccaaggggctcgccaaatcagttactggtcctaaagaatttgtgctttccgcatctgataaataatttggtctctcataggtcacagcatcagccaataaatcctgtgtcaacggcttaggttggtttaccgatgagcccgacaggagagcctttcactccccactgggcttgggctccctgcgtcattcccattggctggggcaggtccatctccctctttctctaaaagctctacagcgcgaataagccctatgtatgggctctgcgctattgtatccagatttttacttgcgaaaaaatcctctatttcctgctctatacttttatcaaactggagtcccatagcaaatacatatttttatgctccctctacttcaatgaaagctcctcctactactcccccttatccttctcactcgtcgtttcattggtcttttatatacccattttcattccatttggacccctagcaaattcgaactttcgttgaaattgtctctattcatatgtatgaaatacatatatgaaatacgtatgtggagttcccgagaatttcatgtgatttagtaaacaaaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggtttggcagaagaacttgagaagtttccaacaattaaagatccagatcacggaatggatacgaaatctagaggcggcaggtaaactagggaaacagaaactattgtttttggtgaattatcagtgtgcagatgaatttcatccactgctattgaagaagcttttagagggatatcttgtcttgtcgggctaagagctcttatctctttcttttcccacggtaactagagattgaataatagaagccagattcaataatagaagccagattcaatatcataagaaaatagagattgtagcgtagagtcaggctatcccatgtttgcaataacagctttgggatctttcctgttaatgatgaatagcttgcctcaacagagaatcagaattctttttattcggtataacaaccttaaaaacgaatcgatctagatgccccgctcttgccatctttgatggaattgaatcatcaactgacttacttgaggaataaaaaaatatgcagctttcgattcttgtctatcggattctattgagaagaagggacaaccatccatcctccccgaaactagtttagtgcctgaacgagattggtggcacttatgacgagaaaacaaactctttcttctgttcaaaagctagtagtgccatagtgccaatctactccgaagaacaagcttctttgcaaaactactttcttctacggagctacctccgtctcactcttgtaccgaatgctacctggcataacatccttacttaaatatcttccgctctccagacttcaacagtgccatcttccagtaggaagagaatcttttcatcctcccacccaaccaagtaggtttcttttctataagaaatgctgtcaatatttcctgctaaatcctgcttatccaataagtttcggatatctatatcctggagtaagaaggattcaccttctttttagtggtgttcctttagaaaatttgttaacgttagggcccccaatgaatgttttcactaacacttgtgataaactcatcatcaaaagtaaatcctcttgttctttgagccaatacacagctatccctaccggattattattttcaatcaactcttccagccctagatatcctctatcacactccatatgaactagcttatacatgaaagcaggaaaagccaattcatttattctctaataataaattaccgataaagggtagttgtttcgtagggataatacccttattaattgatccttacagaatggaagtaagccccttcttcataagatcaagaaagtacgagcgtctttcgaagattggaaaatctaagtcgtatcgaacactatgtcctaatagtaagggatttctttcaacccggtggtaagccggtggtacccggagaaaacgttgcccgaaggaagggactaaacccatctgttcaattagtagccaagtagtaccgaaggagtatctccgagttaaggagtaccgaagggaaggcagaaaaaccaagtgaaagaaagagatcgcaatggtctaagatatagtcagtactgtgatgggccgcaaacgtaagttggttgttagcgccaactgaactgcgtaaccaaagcgattccccttattggaagatagggttaacctatgtcagttcgactccggcgagtcgccccccattattagtttggcgtgctgtcagttccacgggcctaatatatgatatttagcatatacgagtgctgctacaacctcctcttctattcaattgtatctttatacctatccttcgataaggggtaggtaattagaggggagaatgttattaaacataggaaaaagtttacatcgtgatgtgcctcgagatggccgtctcctgtctccctgctcgtggggaatccgctcctggggcgtcgctctgctgcgtctggcccgtcctctaggcacctttggggggcagggagtgtgacaacgtacacgcttccctttactccatagggccttttcctcagttgcagggtttggtggcccgaaattgacttggcttcgccaaaaggcctcatctccaaagcctggctcgcgaggcgtccctctcgctgtagggcggagccccctcgccttgctcttgtgacatgctatgtttcccttcttccattctcaagtcaagggtgagtcccatgcgtcagtttgtggatcgcggtctcacgcactaatctctacaggtgcccatagtaggccggccgccctacctaaaccaatcatcatatcggtccctaggccccattgctggaaaggctcggcttcaaaaccgtacgtggagcttctgcctcatacgactcctcggctggtcaaactataggattaccattcacttagtcaacttattggatagacgggtcatccacttgaccgaggagagtaaggttcgtcaccacagtcccgagaagaatggaacgctgcttcgctctgctggatgcgtcggatcccatataagaagctcgctctttacccgatcattcaaacattttgtgggcggcgcgcctgctctattgttgcgtagcaatagaagcctgcttatgctgcttcggcggatagattcactgccaccactactacaatgttcttctaaaagagtttctaaaagagtatagatatatctttctcagttccgagggggtgagccggtgagtacttcatcttcatgtattagtccatctggtttgatgggctccgagatgggccaaatctcacctcaatctctccaggcccaagctcaagacaacacatgacaagaggctccatgtcattgctggcctgacccgtttccaagtgagattaggcagtgcccgttttctcgtaccgatcgatgttcagacttcagagtcgagataatcacaagagaagaatcagctgatatgtctgattctttttttacgatttttttggattctctaaaaagggaaacaattttggagctgtccgtggtcttaagaaaagaaaggttcttacaaaaatttgggcctgtcgaccagaatgttgtaccactactgcatgccagaagaacctgacgatgtcttgctgagttgctctatcttgaaatcaagggaaagtacgaatgcctttgcctcgtgcttctcttttgcatctatccctttctttctttgtgatttttatttttctttttgaacgaagctatcccttactttgtccaaatgacaaaaaaaaggctttgttggaccatttcaagttctcggtaatcttccgagaaatccaatttcacaagagactacatccagaatcacactagtgtatatatatataactcaaatgcataatttggagcacagtaatttgctagaaaaaactgtcaaatcgctctaaacaatctgaagaaatcaacccgcgcgcggatacagagatcaacggccggcaaaaaggtttctcgtcgacgaaaccgccgcggccgccccgaagctatcgggcggcaccgccgcaatgctgcgcgccgcggccgccaccaccgccgggttcctcccgccgcgtctggccgccgagacggcgcccgcggcaagggttgtggcggcggcgggtgccgaggtgaggtcgtcgccgctcctcagggctctaggggtgccgagaggcggcgccggcattgggagcgccacgccggggaggaggatgtacttcgcctccggctccgactcctccggaagcgccgccgacagcgactcggaggcgtcgtccgccgctggcgctggggaggaggagagcgagggcaacaggtcgtcctccgctgtcgctcccgccattatccgacccgaggactgccacacggtgcgctctctctctctcgctaaaaatttgatcagcattgtgttgttctggtgtctgttcggattatttgctaaggagtttgtggggtttgaacttagcctaagcctggaagtagcttaatgggaattcaaccagattagattatcctttgaaacttctcgcgttctagtgctgaaaaaggtatttggaaaacagtatgtttttagtggggtatggagggaatgaggagctggctgtccagagaaaccttctggatcctttctattctatctatgagcactaatgctctgggaattggaaacatcagaattcagaacatgtatgtattgctattgagtgagttttaccaaatttctattgtgccatttgggtgaaatgtgtagtgagattttcagctttgatgtgatgttgtgactttaagcataacttatatttttgcacatttgcactaatttttttaataagattaatgttcaaacgtcatgtccaaaaaacaacagtgtcatatattttaaaatggagggggtatttgtttaggggttgttgctgtgaacttgctcaattcgcatggcattcagctcacatgggtggaggtctagcaacaagatttgtacaaattgaactttgatgtttatttaactcgttgagaacttgttgctatttttaaatttttatctctgttccacctggtatgggtctattctaataatgcgacgttgagattaggctttgtgcgtctttgacacaactgccggtttatccattatcttaaaacttaactcaatttgcatgccgagaacagagagtggcaacttgcctctctaaaaggctcaggaagttgaagccctacctacaacaaatattattttttgtagcaacatgttactatatctagaaggatcttttttcccctatacaatggataattcgtcgcctgcttattttagatcattcgcattacttcatttcttcaagttgtcacttttggtttcagatgagtatatttagtttagcctgtcatttaacataaaaatgcaatatatatactcacactgatgaacatactattcatgtgagatccatttagtatgatgtgactcggttaatcatctaggtctctctctctctctctctctctctctctctctggtgattcagttaatcatctacttcccaactacaggtcatagctttgcctttgccacatcagccactatttccaggattttttatggcaatgtctgtaaaggtatcttaccgaactatttacaatcactcaatgagcatatcactttcccaattttatttgctttagtgctgcgatttttgttcctttctgctactaataatttatcatattttccccctcaggatccgaagttgttgaaagctttagttgaaaaccacaaaagatctttcccatatgctggggcctttcttgtcaagaatgaggaagatactgacagtaacactgtcacacgttcagatccaaagaaaagcattcatggtctgaaagggaaagaattattgaagcatcttcatgaaattggcactcttgctaaggtatttagctatttacctgggcttgggggtagcatagaaactttcattgcatcaatctcaaactgttctgtctgtcattccatgtagataacaagcattcaaggagatcaggtgttgctacttggtcactgccgtttacggataactgaaatggttagataccttggactgcatgctattcagtttctcttgaatcttttgaatttttttttgagtttttttgtcaaagaatgcaggttgaggaggacccacttacagttaaagttgaccatctaaaggtacatatgccatcactattattttcttctctgtctgtcttccactgtacatatttcaatcctaccaaacccctgccaaactccttccctctcaaaacaggattttatttcattgtgtgcctgtgtttaaattacaataatataccataaaaggttgaacatatgtcacatttgctttcttgaagtgtaagaggaaatgatcttttagttcaataattcttatttctgttgaagttggaaatatcagctgcttccagaaacaatacaagtattacagtctagtaaaaagtggttgcatttattttctaacttttggcttgatttgattttaagccactgtgtaataacttttcatacctgaactgcagcacacatttcagattatatgactttaactaaattgaatacattttgcaaatcttgtccttgatttataccacctttcagtaccagctgaaaatatttagtgtacaattgctttgcactgttgagaagcctttgattatgatctcttcatactagcggagcttctgcaggaaaagccttacgataaagacaatgattccataaaggcaatatatttcgaacttctatcgactttaagggatgttctaaaaacaagttccctttggaaggatcatgctcaaatctacacccaggttgccttactatttttaactcctttagtgtacatctgaatctttcttatctatttgcatgtaaactctgtttgaaatctacttaaatatttctactgtaatgattaattttacaccatctattcactgaacttaaaactttgtgtttcagcgtggtatatcattgtgttatcatttactttgggtacatgtcacttgcaattcttaacgtcattattccatcattaagttctgaatgtgcaaacaatatttgatcagcacctactatagcttttttatccatcaatccgatggcaaaggggcattttttccacactcattcccttactaacctacttatcatggccggtctatgaattataccaacatgactctataccatgatc

SEQ ID NO: 2318 - DNA, 716 bp, Oryza sativa
tgatgaagatcactatggtctaactgatgtaaaagaaagaatattggagtttatagcagttggaaaattaagaggaagctcacaaggttccataattctatcctgtttttattttctgtgtattttctatgtattatttatgtgtgtatgggaggcctttagcaagccattaacatcgatgcaattgggtcttcaaatgcatagtatgctatttttaagcaatattgccgtggcatagatatgaacacattaataattcgaattttgcacctaaatgtcatgtgcagtcctgttagagtaaggagaggtcggggcatatgtattgttcacaatttgtactgaattttgtagccagcatggctcttgcagtattcctttacctgcttttgcatgttacctgtgattaatccatttccctatcattatcaggtaaaattatatgtctctgtggaccacctggcgttggtaaaactagtattggacgatcagttgcacgtgcattaaaccggaagttctacagattttctgttgggggtttgtctgatatagcagaaatcaaggtgcaacgctactatattcactatatgctgttttttggacaacaacgattgtatctacacaggaattcaacctgattagcattttgaaacaaccctagggtcatcgacggacctatgttggggcaatgccagggaagatggttcagtgtctgaaat

SEQ ID NO: 2319 - DNA, 805 bp, Oryza sativa
agcaagcttctgaacacaaatgtgtgcccatacttctggagattcacgctcctccctgcattgacgattacatcacttggttaagcataagggaacagataagatgcttcaaatatttatgtagcacaaagtatgactagaagaagtgtgttaaaaatatagatcggtaactatcgcaagaaatgcacttatgaaatcaagtccacattcatttattgattggtgaatcaatcagcaagataactctgctattcttccgaggggaattttttagatggggaatgcattcaatatccttctaccttaactgatagataacttctggcatgctcttcttataaatcttcatacgcaacactacttactttagacaaacaacattaaataatagttgaaatacatatacagcttaaagtgtgtcagttttccaattatagaatgtatatatccttcaaaataggaaggataaagacatgatttattgcattgacaacaaacaagactgaaataaaatgaaggactggggtatcacaataattacacttttctgcacagagattaggaaacgagagtgcagaaacacttattatctacaaagtatacaatttcagcacaaagtttaggaaattgtgtagcaagcacataataaagatacttcacctggtcagggctgaagaatccctagctgatcgcagtctaatagctgtactgttgcaatttacatcattaccaccacctaagccagctctcccctcacgtcttactatttcatcaacccaattatgctgcggtgcatgtctttctt

SEQ ID NO: 2320 - DNA, 283 bp, Oryza sativa
tggtgcttgcatggtccataaggatagcgatcttgcacaaattgcacccccagaaaacagcggctactatgttctgctctctaatttacttgtagtcaagaagcaaatctctgaagcagcggcaaaaggcaggaagctggttaaactaatcgagatagttgacaagccaaacttcctcatggccggcgactgtgcccatccacagtgtgaggccatacttggaaaatcttaacttcaaagacgatttgacgctaggtatcgacctgagacagagctagcattg

SEQ ID NO: 2321 - DNA, 448 bp, Oryza sativa
  unsure (1)..(448): unsure at all n locations
gccgctgcttcagagatttgcttcttgactacaagtaaattagagagcagaacatagtagccgctgttttctgggggtgcaatttgtgcaagatcgctatccttatggaccatgcaagcaccannnnnnnnnnnnnnnnnnnnnnnnncggtcttggggaattcagaaatgagcttaaaaacctccttgagctggccagctcagccaaggaggtccatcatgcatgtgcatgctcaatacttggaattattgcaaaatgatcggtcattgactggaagactttgcgcccttcctcagccaaccttatgtggctgcatgcatagagtaccaacaggaaggtagcgtttgttggaataaggggttatttgcatccaaagtgtcttaattgtccttgtaagcttaaagcctagcaccttggcccatgaaggccatatccagctaattgcat

SEQ ID NO: 2322 - DNA, 319 bp, Oryza sativa
tgccaaccttgaacaatgcgtgggctactatcggactgataaggaagccttgctgggttgttattgacatagtctgagttggaccactccgggttcactcgtacagctgccttgggtgcatgctgatcacaatcatcatatgcatgcaatgggaggctcctccttagatacattggtctacatgtgaagaacatggggagccctactgagcattagctaatggatctggcattacgacagtattttgcatctaaaacaatacaggagcgcggccgatcttattagacaattgttgcgaatacacctcatcaattacttt

SEQ ID NO: 2323 - DNA, 643 bp, Oryza sativa
ctactgcatgccataagaacctgacgatgtcttgctgagttgctttatcttgaaatcaagggaaagtacgaatgcctttgcctcgtgcttctcttttgcatctatccctttctttctttgcgatttttatttttctttttgaacgaagctatcccttactttgtccaaatgacaaaaaaaaggctttgttggaccatttcaagttctcggtaatcttccgagaaatccaatttcacaagagactacatccagaatcacactagtgtatatatatataactcatatgcataatttggagcacagtaatttgctagaaaaaactgtcaaatcgctctaaacaatctgaagaaatcaacccgcgcgcggatacagagatcaacggccggcaaaaaggtttctcgtcgacgaaaccgccgcggccgccccgaagctatcgggcggcaccgccgcaatgctgcgcgccgcggccgccaccaccgccgggttcctcccgccgcgtctggccgccgagacggcgcccgcggcaagggttgtggcggcggcgggtgccgaggtgaggtcgtcgccgctcctcagggctctaggggtgccgagaggcggcgccggcattgggagcgccacgccggggaggaggatgtacttc

SEQ ID NO: 2324 - DNA, 584 bp, Oryza sativa
tgccactcttacaaactagttcatgaataacatggggaaaaaatcaaagatactatatgtatgaagggctccatgaacaaaggtagaaaagctcacccctctcctaacaacttcctcagctgcagcctcagcactagttactagctgctccacgtacctacaaggtagtttgcaatactaaaataataaataccatggtacaactgtagcatagattggaagtttctaaccacaaaagaatggagttaagtataaaaaacaaacctgtcattggcctcttcatcgccttctccaataatcgggatggttggacctgataaaatagcaaacctggcaacggaagtgatgacttgttaagtgacaacacgcaacagaaacaaaaaataataattttgtgataaatgcatcaacaatttgaaggtgagaagaagatgttgtccttgagaaacagcagtaggaaatgtggtatgcatattcttgaatagaacgaaaaataataccctctagccaaccaaagcagtggggatgtagcaccaatccctggaaactcattaggtgagccacgcacttgtccagcagcattc

SEQ ID NO: 2325 - DNA, 5902 bp, Oryza sativa
  unsure (1)..(5902): unsure at all n locations
nnnnnnnnnnnnnnnnnnnnnnnnnnnnnnnnnnntaccaagtggtctttaccaatgtgggggtatctacaaaatgagcagcataaacaaaagtatgtgaaatgctcagtgtcatgtgatcattgagaaaataaagcagataataactggtctgccacggcaagggacagttgtatgtgtttgttcatctgttatgctcaaattatatcctaacacattaacaaactagcagcagtttaagaaacataaagcttcatcagttcaatatttgtcccaaaaatacgaaaacgttgtatgttcaccttctatgttatacaatgcaacctttgcagaatacaggtttgagaacataaagtttaatcaactctaggtaagttacacaaacactgaaaaacatactagtattctttctgttcactcccattgtgaaatgttatatatgtaataccattacaaaaaatctgacgtttcagaaatagtatgattcatcagctctagaatctagactagcacaccagggaagagtgatgaagtatgaactccacaggagaagacaaatggatacaataccagatatttttcaattgtttcccaattttactctaagaaactgagaagcatctccagttcactacaggcataatattatttttatgtgctccgagcagaatgaacctctagtttcttgcgtcataaaaatccttaattaacaataattaatataatagcacaaaactggtctggaaattttcactttgaattccagacctcaacatcctgatgatctttcagaaccaacattggaatgaacggataaatagttacctctcaactaactttaggtatcccaaagggagtgatatgccatcatcattttcttcaccgctatgaaaaccacctcgtgaataccaagcatgatatcttctaggtagcagctgatgttcaaggagctcattgcagagttctccaacagtccgcttaaatggaccatgtgataaaaaatgcatgatgagaaagtaaacttccctcatatcaacatcaacatcagcctcaggtggaacatctgttgctaccactggattgacagaattaaccttctcaagttcctgacttggaaaatccaggggcaccatactaatggaggccgcattaccagaaggttggtgttttctaagagccatgtatacagcaccaactgaagtgggaaataataacaaataagcatatacaagctttaattactgaacaattatgaaaatccacatgtcagaaaggagcttaacaaataaagaggtaatgaaaatgtaagaatatattgaaggacatgaaacatggagaaataagacttctaaatattacaccaataacatgttttagaccgatacagctgaattaacttttctagtgaagtaatatgattgaacttagttactagcaataggttcagatgcagccactcaacagatccaataagggttttagctttgagggatcatggtataacccaattataatgtttagttggggaccctgacgctcttttcctttttcgattagccttgcgttggtgatggatcaaaatctatctattccacgaagtgtggagttagatctgatggcacaatcatcctctagttcctcatcaagccatacacactattagttctctcatcactaaaaccctaagttccagagcatcagaaaaccaagcagatacaacattcaaaccaggcaatcatgtatatcatccaccaaagccccaacgactacgaacccaccaaggtcatatccaaaactatgacagcgaacaccccccccccctatacacacacacacacacacaaagtcctcaaccctagccgtagtacccgccaaattcgtcgcaattctctgcaaatcggggttctagaacgtttccgacgaccgccacaaccggcatcaccacatcctccgcacacaaacgagcaacagagagcccttgtgggggaacaaaatcaaaataagccgacattacaacgaacctaatcaaatccgcgactaactgggcggattagggcacctcgagaaggaaggacacgatctcccgcagcgaaaaccacaccagcaacagcaatccaggcaagctacgttagggcatccgtaccagcgccagaggaggaatcagcccggatgcatcgcccgtccgtcctctcccccccacacgccggcccagcggagacgaggagggcggggtcccccgccgcctccgaggtcgccgcggcgtcggtgcccgcgcgcgcgcttcctcctcgggcggtggcgaagggaggtgggctcggcggcgacgggctcgcgcggggggttgggccaaggggaggagaggagagagagggacgagggagatgggagagaaggggggagggggtgcggtgcggaaggggatcccctctctgcgctcggactacagtgttttgtgttacgccggatgcggccctctccaccgtccgatcaagccccaccgcaacatcgaaggctaatagatgcggtgcttttattactgaaatttttacatttggaccctttcgagaaaatttcaggttttctaatggcttgttttagtacggcacaggactatgtcaaatatggtccaagctatatattgggacggagtaaatatgaagtaaactgatataaaatcaataataagtacataccatgtatgtcataatttacatgcttacataataatgggccgaatgagaaaaaataataatgggccgaatgagaaaaaagaatatgatggtatgtgggactaacatggaccgaattgatttcggtatttttacataaatggaataaagtttaaggtataaatatggtcttttaatccttacgaggtgttgcgtagaaataacgatagctattaaatgtaattgattatagggacatagtatttatttgtgtagaatagtggggccacttagaaaatagtggaatggcatgtgatccttaggagtatgcatattagtagttcatgtggtatagtgtttttaagactttataaatatattgaataatattttacaaaatataattttgacgagaataattgttgcatttaaaaaaatgcgagcttttttaaacatgttatgggcatgtttgaaagtgttgatggataatagatgaaactgagttcatggtgattattcgatggtcgaaatgaatgtattaaatattagaaagatgataggttgatttaaaaggatttttctaataaatgttgagagaaagtgtttgcaaaaaccacaccgtttaagattttgggaagtgtgcttgcggtaatatggtgaccataataataaaaaatagtcatatgccttgttggttagttgtaaaaaaaaaagaatcccatggtgctactattccaggttcctttggaagatgggattttgtaggattttcaaaggactaaaatcccatatgaactattcctgcatgctcctttggattgtaggattggactagcaaattttcctatggcaccattcctttcctccaccttttgaagtatttcaaacatgagctcaaaccacatgttttgatttcctttgggaagtcaaggcaccttttctcttcatctattctctcaactctaatctgataatatttctcctctaaaaaatcatgcaagtttcctatggtgtatccaaacaacatgtttgattaattcatttatttttcaattcctataagattgctcgtgtcatgacattcgattcctgcattttttcccattcctaagtatttattagtgatatactgtagatttatattgttgtatgattaagtaaccggtacaaatacatgccttaaaaagattcaagacaaatgttaagcactaaatttgggtaaatccaaatgatggattgctatacatgcaaaatggactaaaggcacattactaatgtcattttagatattgccatgatatgtaataaataataataaaataagaaagtttgactggagacttgttgaaaacaagaagtacttgtgacaaaaggaagtatttattggtataactaattgataccctacgatgtgttgtgcgatacgtggatgaatgcatgttatacataatataaatagtaaatgtatatgtttaaataatgcaaaaatgatgtggagataatgatttgacatcgtttgcatattgagttctaaaaatacaacaaaaatgtaaattatgtgtcatgtttgcatgatatttaaaatactcaagacaataattgctaatgggtgatgatgtggcacacttgtatgtgatttaaaatactcaagataataattactagtgaatgatgatataacacacttacatattgagctttagaagttagtggacaacaattttattgtaagatagaataactgataaatcataaaacccagtaaacatggaggggtgaattgagtgattaacaagtctctgaaataagctagaacaatatagcaaagaacaaaccaaggctacctttcgctgaagaaagtggataccagctagtaggtgaccaaatacaatatgattttcgtactacctccatggctccgtcccatataaattgtatttataggttgtttaacatatattaaggtttaagaaaaaaaatactatgatgtcccttattaaatggtgtataggtgagagtggaagagtagttgaggataaaatacggagaaatttaaataagaagtgattaatgggaccattagtactctattgtgataattattttaggacaaattcaaatcctaaaaatacaattattatgtgagagaggtagtagttttttttttaactacgcaagagagttgtgtgttatttgatcaagtggtggaaaataaagtacaaaaggtcaagatggaagtaagtttgcaagtccttttgcctcagccaagcacccaaggaagccttcacgagagatggatcgcaggactagaactagatagatgctaggtgttgtcccatttaaaacgcaaccaccccttcacccttgcacacgtagttcccatgtaacgagagtgacaagagtatgaaaaccctttctgagtttgtcaagtttgtctgggacttgcttagcagcgccacaccatcaggtagagaaatagcagtatccaggcgagatgtcaacaacacaaaaaccactcaactgataaatgctcccttcgtttcatattataaaactttctagcattactcacattcacatagatgttaatgaatttagacgcatatatatgtttagattcattaacatatatatgaatgtgggcaatgctagaaaatcttataatataaaacggaggaagtatcaattataggcattgacccccccaaaaaagtattgtgtttttcttaaccacattatccttaaatttagctagctcagactttgcataatccatagcaggtccttacagaaatgccagatgctacagcacctttcgttctcaacggcacattgtattcaggagtcatatttatgcaacttaggccaagttaatgtcacagaatgcctgaacttgtgagctccagaatactgaaaagaatgctttatacatgcatcagaccctacacgggtgttctgttcacaattcagagaatgtctaaaataatgcattctcactgtttctgaatttacacatggtagttgactaacagaaaaggagaaaaggaacaatctatagattctgtacaacttgccaagctatatttgggaagtgcgctcttgtgagatattctttctgtagattctgtataatttgccaaaggaattgcaagcgacaacgaatgaactccatattctggtcttcaccctggtcttgatgcaaactgctttgtagagcatgcgttgtcgataca

SEQ ID NO: 2326 - DNA, 1999 bp, Oryza sativa
ttatttggttctttctcatgtaatatagatctgcaaattgtatgtgcaatttgagcactctctttcatgacatctccaagctggcctgtcaccacaagtgcaccttttttttgccgtcctcaacttttgctgtctcaatatacaaggtagaaccacccatagcattccaagctaaacccatgactaccccaacaggagtttgatcgtatatacgctctggttggaatacagccttcccaacaaagttatccagatttgatgcatcaacaactactttctccacagtcttgtctacaagtgcttcatctacaagtgcttccattacttcctctgtgtgttcattggccttcagaaatagcaaacaacagtttattagaactaagccctaagaaacaaagaaacataagtctatgaatttatgctaactaagatatattcatttcaaacttgaaatatccttggtaacaaagtttgtccagggtttagtttacttgacatctttcaaaaactaacaaaaagtcagcaccataaaaaccagcagaaattgtgctatcagcctatgaatcttccttttcttacaggaattatatcataattttaacacaaaaacttgaccatgagaaatgcctaggggtcttccggctagctccataaggtggtgggctagccgacctgggttcgaagcctcaccccttctaattatttgatattaggtcattccctaatattcgtgttttttttaacacaaaaacttgaccacgcaccaatagtaatagtgtcatgaaagatcaattccttctttttctgacttaaagcatcactttcatttaacctgtcacttgcctgtctgatagcaagtttgacttcagtcagtattcagtgcacaacgttgtaacactcaaaaaattcatgggcggccagaggtcagcctggccactgcacatttgtaatagcttctcacgcatttaatatagagacttggggagatttgacatacaagatagttagattacctccattttgcctgatgtattcgttggtgtagctttgtcatctgcagaagtttctttagatactccttttggatgctcatagtggtctacttctgacttggttgttaaggatactacattaatcttctcacaagaaatatcagttggaataacatgcactgaaacatcttctgcaagactgtccctctggctcttgttttccacttctgttgcaatgctaacaccagtaggttgttcacttggttccaccaatgtgatctcccgagctggctcatttgataccccttgacgaacaagttgcagagctatctgcaccagaggcaaaggttgaacagcaaaagctgatcacaagtctatcatggatgaatggatccatatgaacaattctgatcattggtagaataaatgctgcgagataatggaatgcattatttgataaatatgagtcttccaaaagctattttcttgccattttgggggtcttccagaatattaaaatataataaattgcttgccacactaccacattagaaacaacgcctcagtaaaaaacagcagcagtgattgtggagggttagcatggcaggcaagcggtgcttgacaggattggaacagagtgcagaggtaatactggtgtgcacagggaaggcaatagcaagtgcagggcatatggagtgtggaccgaagggtggggagaacaatgggatgcaagaaaggaccagtttgtgcccttatgctgtagaaggacaggacacatcactcaacactcaccgatatgctgttgttagtaaatataatagaccccagtgggagatgataccttaagaaataagaatagaatctacctgcttatcagtcatagacttgtatatactatcaaggtatcaactactggtgagttgcaggtctgtcaagagacttgagacagacaaatagcccccgttcttctccacactaaacattagctacaaatgtcaatattgttt

SEQ ID NO: 2327 - DNA, 499 bp, Oryza sativa
  unsure (1)..(499): unsure at all n locations
tcaaactcacggtctcgtggccccaggatcgcaaattgccactcgaagatgtcctcctacacaaatacatacatttaaatcataaaaaacacatcagcctcgatcagaataccataagtaaatttgtaatccgaaaatatatcatggaaacggcctaagtaatactggaatcccacttgattcacacaccagttaatcgaaatgacgtaatactacccaatatcaagagtcatcctgcatacgatgatctaatcgcaacattgatatacgctaacatcccaacatttcgttattgcacaaactgcacaatcagatcaagaagaaatgcagatgaacccccaaggtcaacgcacattaaatcacaaggccnccttccccttaaaaaaaaaaaaatttttttttttttcccccccggggcccaaaacccccccccccctaaaaacgccatcaaaaccagatctcgccccactagcgttcgattcggacacaaccaagacca

SEQ ID NO: 2328 - DNA, 768 bp, Oryza sativa
ttcctgcagccctgttgaaaccggtgcaatttgactccctcagcggttttggagggcagttttgctgatgtggcactgccatgtcgatgttgaactagtcttcgtctcacgtggcgtttaagtggcattcaaattaaaaaatattatatgtgggacatgtctgtcattcacacacagaaatatattatgggggccatatgtcatcctctctctctttctcttcttttcaccggtctgcaggggcgagagctagacaagcggcggcggcggacaagcggcggcggcaggcaagtgacactagggcggcggcggtcgagggagtggtcggcagcggggccagatcttcctcctccctctctctccctcatccctttctccctagtttgtgtggtcggctggaatggtcggcggcggcgggatgacgacgggacggccggcggctgacgcctccgccatgccgcgcagcagccggccagccttgtcgcggcgcaccgacaagaacgccctcgccacgcacggcgacgacaccaccacgacgccgcaggcgcccatcttgaggtacacatgacaggcccgtacttgcgcactagcgacgcctggtcggcgtgcggggccaggccgacgagcggcagcgcgccgaggacggggacgcccggggtcccgggggaggcggcggccgccgccggggaagggcgggcggtaggagcggagggagaggtggaggaggaggcagaggaaggcggcggagagcacgacgaggcggggcgg

SEQ ID NO: 2329 - DNA, 1320 bp, Oryza sativa
ttagtagtatattaaaatctaccatctattttatggtaaatatattcctttttttattgtaggatgatctaaattctcttacactatatatatagtgattatatatatagtgatgtatgattccttttagcattctttttttaataacaaataagatgcctgtgcatctatgcaaaattcttttctgatttatattccggaaatgttctacaacttatattccgtcgttatagagtttgaaacacaaaatataatacatgcccacacgaatgcgcgggctacctttctcgttatctagaatgtgccatttggtaatgcacagctcaaacatcggtgcttggagctgtttgacatgtgcacacgcaatctttatatacgatttcaggggtggaaatgaggcgtgtgatttggccacgtggctcactgattatttagggttagttcatctgaaaatcagccacgtgtccctgtgcaatctcagatagtcagatcagtaacttctcgagctggcctgtcttctcctacctgattggtccacatggacttacaaaatgttgacacatggaacaaagacaagatgcagcctgcagctagcctgctagctacgctctgctttcatggttacaatcctctagatacttccaagctcgtagaagtatagtcaataaattaaattaagaacacctagatcgtttggacgatctcaaaaatattaaccctagaataaacattacacagcgaaaaacgatacagcacaaaatttaggaaaaactagaagaaataccataaattggaaaataaataatgacatgttatagtgaaaaaatagttgtcaaaagaaataataaggccaagactttcttttgagaaaaatcaacaactcaagtctagagcctagatgcttttgagctaagggtacaagcggctacctacaaaaacccacttataggctaaactaacctccgaactcgcttatcttataaaccgatttcagggttctaaccctggccagggattgggccacgtggcaccacgcatagaacaccagccggattctcggctggagaagcgtgacacgtatcccacatctcctgcagccatacgatagcatatcaacggtgagaaaaaggtccaacggacgtaaatatatattgcaagtttgagatggtttttttttttacaaaatgtgtgatctcatctaaaacggtctagaacagtcaggagtggaccaaaaaaatcctataaaaagaatctaataaaaaaatcaacgagtggttagccccccaagtggcctaattccatatttttgtccctaagcat

SEQ ID NO: 2330 - DNA, 11040 bp, Oryza sativa
tagatctctaaaattgaagctccaaaaaataaagataacacaactgaaaatcaaaatatgtaaaaaaaagggagctaaaaaatagagaaacaaaccaaaatccaaaatgtaaaatttaacagcggtgcctcctctactgtgttccttaaaaaaatcacaatgtaaaagaaaaagaaagcacccatggatatcagttgcactgtatagctctgacgatttcagatgctagatgtggtcgattgactatgataataattgaaaatccaacagctcgcaaacaaaattttccaatttatgaaagctacacgtaatttcttactgaacatgcatttttaaataacaagtaggtaacataataaggcatatattactattgtatttccactctcaacctttgataattaaattaattatgtaaagacttgcaaaattattctgatcatgtcacaggctataaattttgaagcacgccaactggcgtgctgatgatttttctagttcttacttatttgtctgttttatcctttcctggccacttcgcatttccaagcagtttggtaagccccaagcagaaaaggagacaaaaattgatactctaatcaatttaaaatgaaaaaaaatcatcaaccacaaagttgatcttataacgtgtatataaaatttgttcccaacggacttcatatgaaacagtttacattttaagaggcagtgacggttctcctatgaaattttttttccacatgcggttttagaccattggtccctcttgtcattatgacaagtggatgttcttttgacccacttgtaaaatgaagctggactttttgaaaaacgatttttttaagtagtgatatcaaggtttggccaagaacatgatgaaagatattcacaatttaatcatgtaaatatataccatgaaatagttggtactagtctatctcaaaaaaaaaaagacaaactctagctacgaacctaaacacgcataagtccaggttcatagctatgattggttttttttgacacaggggcgtatgttgatacattttatctttttttagggtaaataaataaatccttacatcatgagtaatcaatgattgtgtgatgatgtaggccattgagattctcttggaaaatattttttttcagctaccatgaactagaaggtatcatacatttcagccgacgtccttctacaccaatttataccaacagattgaactgtaatataagatcaaattgcagtccaagcttcatcctatctgcttctctctgtacacctacccactagatatattgaactccaaatcaagacccaacacaacacagaatgcaaaaccaaccactgtgacttgaagtacagaggtcgcgtgtgtgtgtctctctctctctctatatatatatatatataaagtttatcaaaatactatctaggtatccacattccttcaaaatctatatattgttgttcgtactgcaagtatgatgccactattcaaccttgttctgcttaggagtgggcggcatcaggaaatgagatagaacttggcagctgtggtaatatgcacgcacaaagtgtaggccttcaaaatcatcaaactttgcttgtctcactaaactttttgttactaaagaagtttgtccatcttagtcatatcaccaattatgtatccaatggcaacatcagaaagagagcagatcagctagccgaatatgtagtgtacgttgtgatggcagacattgcttcctctgttcccagtcaaggtccggcacaaagtttagtctattttgagattaccgggttatgtcaagttggaaaggaattcatctaggaattgttagcgctagcgctgaactccgatcgaacaccttccgggcgaactgtagccgtccggcacagaaactccaagcacagctaactaacgaaaatgaaaacagagcaagaacagagtatcaaggaatttcagaacttagcgaaatcacgaacaaatgtggggcaattttctagggtttttcattcaactgaattgtaaaaccttacaagggaaaaatgaactgattgctacttatactctagaaacagaaagaggaatcctaggcctaaaatcgtgccatcccacgactcagtttctcctggactccatgcagatgcaaaatgccactccgcacgcctgacgcaatcgtcgccaccttccgcagcctcgctgccaacttcgtgcatgcataacaaactccaaacggattttattcctccagccgttacaactgtcaagactggatcacattggggccacagctgaaataaacagcaacaggaatcatgttattgattacatttgtggtgattttcttttgtgagatcagtagagacaacacacagtgtccggaaggatataaacacagactgatcgtatcacaaagcatcttgatatatcagatactatgtgctaccgagtgctgagtgttagaatgatagttcgtcatcctttccagattctgagatagataagattgaagtctcgctgctatatgtacaaacggtttcatacgtaggatcgaatcataataactaagccaaccagaggggggtgaatggttgttatacccaaaaaccgaaaacttttagcagaaataaaagttaccctcgaaatcgatggatcacggtctgaccgaaggtgttgcaccggtctgaccgcctaatgaacgtcggtctgaccgagatcgaactccggtcgaaccgccgagattgcctgccgcgtctgttgccgccgccagtccgaccgcctcgctcccaccggtctgaccgccgccttgccgctggtctgaccgccggtgagtcgtcggttagaccgccgaaacccggtgaaacacaaatcgaagaactcttaaagtagatgacgactttattgattctctctgtgtttacaaagtgcaccaatagcactctttataaaaattttgactaaactcgaaaccctaactcaaaactcaactcaattgctctctaaagtgatatcgagaagcctcacgctccccctctatttataccgaggtaggcagcctaaagccacaaaccaaactcatactagaagtcctaaacactttaggaaaccctctagtacaagacacaaacattacataaccaatcataccaaatttggactccttccaaattcgactccgcatcccatacgcacacagtacctctatcgtatgccatatggaatttacatcaaccacgtgcatcaactctgaccaccacggacgtcgtcttatccccaagacgactcccggtccatcaccgcaaatactcacccgaggcatcgagtcacctacacatgaaataaacaaagaaaccatattccgagaccaagctatctccaacttgactcattagtagcaaacaatagaattacatacgtatagtatccatctagaagccataatcatgaaacaatcacggatatccaaactaacaacccgaaaccaaaaccgacacagcgtcggccggtcagaccgcgggctgcgccggtctgaccgcgtgatacacgccggtctgaccgacagcacatgcccggtctgaccggtcacataaaataacagtacctgtgattcacatgtaaatccaatcatctccaaaaccacttcgtaaataaattccaaatatcaaaactaataatctccaatgccaattgttcatcacagaataataatcaaaaacacctttgattttacatcataatcaatcgatatcttctcatgtttaatcttacgtcgaggttgttcttgtgtgctgctagcttagagtcttcagagccttacgtctggcatatgccctaaaggcaatcatagagatgattgtatcacatactatatttacatatttatccgacattgttccttgaaatagataactcattattggttaataaatatgtgattctttcatgagactctttatgttgtttgttactatttctaaaagatccctgatcaaatatcatatgtggaacaaatatgtttatatgatcagcacatgtattaattgatgatcatgtctcatggatcatggtatagagataccaaattaataatgtggacacatgttggtgaacatattgttggatagacccaacatgagacactgcatgagccatatgtgttgtgtcatcagtgatctcatttagtgttggtgttgaatccttagacctgagattctcatggttcccaacatgtgtagtagcttacttagggactgctaaacgctactccgtaattgggtagtaataaaagtagttttcgggtatgctatgaaacatgtagtaggatataaataatcaagatgggatttgcccctcctatggagagatatctctgggcccctcgatgttgtagattatggaagtgcatggccataccaaaggtgattgaggagtcaatcacaagttatataatatatcaataggttcgagtgaatgattgagctattagaggacggcacatatctaaccttgagcttaatcgatatcgtggcgcaaaggggttcatacaattatacactagaggttcagccgatatgatctttatgtatgcccggtgggtcaatacattctgctaggggccgctgttgacgcgtggaccaaaaaggagttttcgggttacagccgagtatacatgaacctacagggtcgcacgcttaatggaccggaatagggggattggatggagatccaatatgagcttaattcggatagggatccgaataggagtcctacgggccatggaggcccgagtaatggatcttatatattcgtgaggggtgtgatcggcggaggcattgcatcacgtgagaaaccgtagccgtcacttccctccctgagcaagaccctagccgcgcacgggtgctagcacatctgtgcgtggcgttccgtccttgtacgtgtggataccggtagaggcgtcgctggtttgcggtgctgatcggcgtgggagtatggcgaggagatcgcacgaggaggagaaggtcgagccgatgtgatcgactacttcctctacatcaacgcgcgatacttcgcgagagttccttcgacttctcagcgtcttcttccgctgcgcagcgcgtcgagtagtaacgatctatgatataataattgcatggttcctggtttacacgatataaaattttgagttatgctatcgtagcctacgcgtatcccaacatggccaccagtgaaattattctattagctaatttgtagtatatggaaagcaggtaggagtacggttcagttactgagcaccactattttccttaattgccgaagatatggaatatattttcgctaccattcactcgcttccttaaaaatatccttgccatgtcaagcctgtgactctcacaggtgcagatagatcaaaggccctgttgtaaaaagggctgaggcaaccgaaactttgtagatagatcgaaggccctgttgtaaaaagggctgaggctacccaaacttagggccttttcgttttggaggaattttaaaggatttggattcctaactgggaatgagtggaattgggaaaagattgtagacgtatagagcctgcacgagttgacaacagtgctcaagtggtggaaagaaggtaacattcagcagaagatggaaacatggatgaaaacaacaggcaacaaccgatcgtgctgggataaatcattctaaggataaatcaaaagtaataccttgtaccttatagttccatctaaggataaatcattagtaatatcttatagtaccatcaaagacaacgataatacatttacacattactatcaaatccgagtacgttcatcgatggaagaaaacagatgaacaagatctaagcctctgtttgctatgcaggatacttcatgattcttgaggaaattaaacttctcatgtgaaattcctagtttctaatataaaccattaaatcgtatatcttcagaactgataataaccccaaaccctcaactactaagtggaaatttcatttttagtagcaaggacatcttgaggatatttttagttgaatttggtaaatcatcagaattcttaacataggggagggagggtgccttttgtctgacaaaattgacattcagccatcgtctaaagaaaattgcgaggcggaggaatcaatacctcatcgttgtcgacgccgacgaggaagaagagggaagcgtaccgccggtacaccaccttgtagttccggtgctccacgaacgaacactgcaaccgcacgaatcatacaaatcacatcatcacgaggaagagaacgaacacccaagaaccagcacagattcagatcatataaatctctatttaggatctgtttggctcagcttcagctctcaaccaaacagtttcagctccacccaaaatggaagcggagctgtgcggagctctctcacaaaatgaactggagttgtgtggagctgggtttaggcagctccacaactccacttcagacctaactcctgaagctaaatttaagagttggagctgtaccaaccaggtttttaatggcttatatattttaaatcacatattactttttaaaatctatttacatcatatattctactcaaaatttgtgacaaaacgagatccatgcggaatatattcaaacattttattaatttaaaagtaatttatttaaattgtagaagtaactcagatatgcaatagaaataactctctattacattagaagtaattataatataagtgagttgtagcaagaaaatatgtcgagtaaattcacaagcaatgtgtacagaagattttcaagtaaatacatttatgaaagtaagttacataaagtcaaaaaataatttacataaatcataaaagtaactttgcacaaaatggaagtaagttgttacaacattagaagtaaatccgttgtatggataaaaacataagtttatcaagaaattaaacttacttagcacaaattatgaaattgactaaaaacaataataaaagtaagcaacttagagcattatgaatgtataagaagtaatttattcaaatatgaaagtaatatatatatatatatatatgagaaaattttctcataaatcggataagtaatttatgagaaaatttaataagaaggaataaaaaaggacatgcatgtgtagatgtagcagttttttttccctcagcggctcttgctttgtgtatgtgcgtggtcgaatggctttgaggtgcgtcgtgcgataagattaaaacgagaggcttcttgatttagatgttacgctaatttttctatcatatcgccaactataaaatcataagcgagaggcaatcgatattaggcgttggaagatgttcgtattggtaaactccaccctccatggcaaatctataagcgaaagaagaagtgaaatccggctacatggcatctcaaaacagtcagtattatatcaaattccacataagcaagaaggtgatcgtgttaggctaagatcaattatgaaattggagacaacaagaacatatataacaaaacgcaagcagtaattaattgcccagcaaattgaatcacaggacggaccgacagggccggttagagtatagctaactagctaggagttgagttttgcacttggcctgtaggacatcaccgcgaacaccgtctgcacgagcgtgcagaggaggaggacggcggcggcgagccaggccaatatgagccacgggttgtcgaagtggcggcgcgccacccacgcgagccagcggttgaggcggcgtccgtggtgcctgttgagctccagccccacccctcgcaggtagtgatcgccgtcggtgtcgaaggcgaggcccctcgcgagcccccggaacagggcgcacgcgtcgccgtcgttcccgagcgagtgctccatgacgcccgaccgggacagcaccgccacgtccccagcgctccccagcagctgcgacatgaacaccacgtacgccgtcacgtacgcgtcgcgctccacgccggcgccgctgtcctgctcgaacgccagcacgttgcggaacacgcagctcatcttctcgtcgatcacgtggcgcgacatggtcaccacgccccacgagaagtccacgtcgaggagcccgaaacgaggggcaggctctgaatctgacctgaccctgaaccggacgcccgattcactgtactccgtcgccgtcctgaaccgctggatgtgaccaccacccgccgccgctgcctgctgccacccggctggcctcaggtaggtgtggcacaggtcgaccagatgcttgcagtcctccttgacgtcgtcggcgttggaagccgttgggatgtgttgcatgaagttcctcaccgcattccaggccgttttggctagagttgtaccagcatgatcgacgagcaagccgaagatgctgtgcacaacgaagaacgggatctgattctccagcagcaccaagtcgagaaacccgtcgacgagcaccctcttctgcgtcctgctgccagtgcccggtccagaatcctcttcttcttctttattagcaggcgcgtcatcctgttcctggatgccaaacgcggtgagcatcgcgatcaggaaggccccgtccaccagcagcatcatgcagaattcccccgaatccatggcgacatcgccgtcgtagcagcgcctcgcctcctgctccagcgacgccatggacagcaggcactctctctgcagcgacgccgcctgatcggcgtcggcgccgagttggagcttcatcaaccgaaccttggtgagctcgttcctgcccatctcctccgtgccgtggcggtggtaaggcccaaccgagaacaagctcggctggtaagcgtcctcgtcggccagccgatgcctccccgggacgcggaagatctcgcgccttgcctccacgacttgtgcttgtgcttctttctccgcggcgtcgagacgtcggatgatttcgtcgatgcgaatgtgcgccgcctcactgccacccatctgctccccgccgttcgtcctcatcatcggcggttcagttccatctggatcaaacaattactagttaaattaatcacaaatggaaataataagaaactaaatctcgaggggaaaataaaattaactataaccaaatatggatgagtttctcgaacaacgtgaatctgagaaacgtacgtactgttgggtgaagccggagcagagtccgcggaattcgacaaacccgtcatttccacgctcaaccgcagaatttccggacgaaacatggtgtctgatgaactcaatcggtcccggacgacaagagtagtaatcaatatctcagggaagtccagatctggtaacaggtctgacgacggatgaacaccacggcttgcactgcggcagatgagctagcgatcgagtatcgaggcagccatatatggcatgcggtcatgactcatataagatgagatgatgactcatgaacatatcattctagagcttaaattaggagggaagaaattacttactaacttatccgtttcacaatgtaagaaattttatcatttctcacatgttaatgaatcttacatcaatataaatgtaaaaaatgttataataatttatattgtacaacggacggagggagtatggagtaacaaatagagtgtgatttggttctagtacgactgagcacgcgcggtcgaaaaaaaaaaagaagtggccctccaatcatcaacagctatagcagatcgttatgatattgcgaaccacatggcctgtactaccaaaagtaccgagtagctccccttcaagaaaaaagcaccaactagctagttttaaaaaaaacaaaataaaagtgtaccaattagcaacactatattaccttgttttaaaatatgtgacgtcattgactttcacataacatttaatcatttatcttattaagaaaatttgtataaatattattctttttttgacttgttttttataaaataaaatataatcttagcaaataattttacatatacacattaaatttttaaataataagaaattaagaatggtccaatgttctctgaaaacttagcgacgccgtacattgcatgcagtatttgcaaaggccaacccgatggcttgagttgaaccaaaacagcacattgcactattggagaccgggaaagctcccgtgtgcttcctactgctacatttgcatatggatacgacaagtttatgacatgccaaacagtacacatgcatcttttccaattgcacccaaaactatttgaacgtgacctttttttcatgtttatcagctaaaatttaaattttccaccttaattttgaaactgattttaaggtttttctcatcaaaatttatttttcagtttttacttttaaaacgctaaaaacacatatataaaaatttattcacagatactttttatttgtaaatatatactccctccatccaataaaaaaccaatctaatacactggatggatgtatgtactatgaatttgactactattttttttacggagggagcatatcgtttcgattgggccgttgcatggcccgacgcgacgacttgacgactcttgtcttggcattccatgcgcgacagaccacgtgcggccttagctgtgtgtccatgctactctggacgcattatcaaatgctccggatccacgattccacgccattgagcatatatatccaacataccctgtttagttcacactaaattttatccaaactctcaactttttatcacatcatatcacatccaaaacttttctactaacattaactttcaacttttttttttaaactaccaaatttctccaaatttctccccatttcagacactaaacacagccaaaaagtatgatttggacagttttgttaattataagcggtgctggtaatttggatgtggacacgataaaatctgataccacaatagagttttgttaatcataaggtgtgctggtaatttggtgcaaggagttgctgtcccactctccgagcaaggaaaaaaaaacccaaaa

SEQ ID NO: 2331 - DNA, 18354 bp, Oryza sativa
tttttacaaggcattccaagacctttttattttctacaagttgggcaagaaaacaccttatcttgtttaacaatttcttccatgtgtttaacacgccctaaagcatctttcaacttcatctcattcaaaacacactttgagcaatcttgagaaatcaaaacaccattgttttgttttgccttatttgcacatgaagcattgaccaaagaacttgcacaaaaagcaactttgtattttttttcaacacattctttgtcaaaatcaactcatcaacaacacgagcgacagcgcggcgtgcgagaccgcacgataccgtctgcgacgtctttcccacgttattttcgcacaatggctgtgcgataccgacgcgacgtctttcccacgttattttcgcgcaatggctgtgcgataccgacggtatatttgtcgtaggctctccggacctctcattatatttgagggataaagtgaataattcaagccatcaaacaaacgtaataaaacatccgacgcctcgagagaaggatattagagacattaatgggcctttagcttgccagtcaacttcagcctgagatgtgcccatcaaaccacacgaaggagacgatcagatgtgttacacattcaggagacttgtcaaatgggctaaagatctacgatacctcaaatatccttaactcatactcatatgaatcttgttcctaggatatgtactagattcacactttcttcttaagcatggttatgcatagcaaatacaaataagacgaaagcgattcaaatttacaactactttatagttacataggccgaccgaccagatatagatagataacagagaacagcggaagcttgactacccaaccacaagcacaccgattaagggtttaccccattaagttcaagtcctagaaaaagcaatcgaaacccgcaccactcaagaagactaagtctaacctgcaagcaaaagattattccagtagcaagagtcagtaccttaatgtactggcaagccaaaaatcaatcctaacatactacatgtaaggcatatattcaaaggacaatatgtagtttaatttcagcataaagcaagttttggttcacaaatattttgtaaaggagttgattcaattaaattaacaaatttgtaagttcatcataattaacataatatatcatcatatataacaacatatcatcataagcatactcttgttgccttcaatggcacaactcttataatcatcatcactcacacaactcaacacaatttttccatttcaatcccaagtttcatcaacacaaggctatactcatgacacatcaccaaagcgctcatgaccgtgagcatggctaatcgattagttttaaagaactctacagagtttgtacagctttacccacatgatatgaacactatagtttgtttcgagtttgcaagactctaccacattcttcacgttgaatgtggtctaaaggtcataacgaagcctttacattgtctaatgcctaaccttgcacgagcacggcaagtgtttattcacacgaggagcaacccaagtgccgctaggtcggggggccctcgccatccctagcgccatggcagcgaacacatccattcctccacgaggtacttaaccgttatattaaccgttatattggacacgcttagacgcctaggcacaaccgcactaggtagctcctataaaccatcattccgactagttcatactactactgcctcccaatgcaaggttagacattaaacaacttaataagctaaggccgtcccattcctagcacatgtggttgcacggtatacttagatggtgacacaaagttcggtccttaattgactagggcgagcacttcccctataggtatgcaactaacaccatatgcataccacttgccgcccaggtctaaaatcacacttttacaccttttaattcacaaatatcagagatattcacctctgtccagcagtgaaaattttcccctaaattctcattttaaaagtgatcatgaaattatttagaaactactaggcatggctaagcgtaaggcttttatgtaagcatgtataaacccaattgagcactttgaaagtactctaaccatttctaagtaaccatttctaaggttacaatcagtgaggatcacaattattcaaagaagtaaatgcagcaattaggtcatagctaccataaccaagtttcaaataccgttatagtctaaattcatatgcaactttgcaaacaaatatattttcattcctcaaaacatgggattcaatgtgatcaaagattgggaggagaaaacttgccttgttcctgggaaatgttagcacctaattcacttcttcatcatttacgcaattatctatataaaatacacgttatgcaattaaacaccaaaataggtaaaaattcaaaatgctctaaaatgcatgctttgtgcacagtgggtaggtactgatctaagatgaatttaggtgaaagaatttatattttatctctttttatttgtgagttatgagttttagaagtttactcggtacagggtggtatttacttaggtagtgttatgaaatatttttgcaaagtgatttttattaggtttgatttctcaggggtgtagagatgtgttttctaagactaacacatttggtttcataacttttagagttattatgaatttcttatgtattttacaagttttaacgtgttgtaggtaggtagcttctatgtgtacatggttttggagttttatgtccagtacatgtttcatattgtttgtgatgtataaaatgactaattttattaaccaatataatcttagttcacaattttagagattatattacgctactacacattttatacgctaggggagtgttctatgttagttacttaacataccaatctagaaattgatatatgagctaagtgtgctaagtttttggtggttggggatagaactatgacctctctggtctatcaagttttattttggttacttagagctagagtgcatttatatatacatttatacatatgtattgcctaacctataccatgtgactagcactgaagttatctatttaaagtttagtgacatatttagtatagaaggtgccacattttattttacctaattaaagttcattacttgctagttctaaagaaatttggttcattccatttggactaaagatgaattctctacaaattttagaagttgaagggtgctctaagttgtttattccttatataaatatttaggggcttttattgcactgtaagtatatatttttattttatatatctaaagtgctaaacttgatgattctacagaacttgagtttactcaaaaaggaagtaagatgaattttatataaatttttaaagttcagcttgtctaaaattagttattttgtataacatacatttagaggtatttggtgtaaagcaagtgcatctttttattttattttaccttagagagtaagttgatgaatctgtggaagttgagtttgcttcaatttaagttgaaatgaattctctatacattttgtaaatttgtgcatgctttatgtatagtttttcttagacaaattttagaggtgaaatttatactgcaagtgccaagttttatgtttccatattaaatttcatccttctatgagttcacagaaacttgaatcatctcaaaatgagctatatttcactttgtatgaattttacaagtttgcatgtttttctgttgaaaatataaagctctagaggattttccttagattttcagattttaagctcatggggtccacctgtcagtgagagaccaatatgcaaaaggtccctggcttttcaggaaatcaatccgcagtcctatgactgttccatgtgtgtggtagtttttacaaagtagtatctacagttttgtttcttctccacagaggtccctggttcgagctgaaacagagctagccatggctgagctcgttctcgagctttctggcggcgaacggtggcagatctcggcatgaaaccaaaatataaaaggaataggggttcttttcgaagccaatggtggtcttatcgtgatctgtggttaccggaatcaatggcgacggcagcacgagtggctttgggtctcggggtagtgatgcatgtcacgttagaggccggatctaggtggataaaatgcatgcatgcaactctagaagctccagggtgctcacagtagtattggatgaggttggcgaagcttggtcgtcgacgacggcgttcggaacggctcggcgacggcgctccttctcgatgaacggcgtcggcttgactcactacaagaagtgccatgcatgtatgtctctggtgttaaagaggtcctaggaaatgcatggaatcgacttggagctcaccggagaaagaagaatcaaagatggagctcggcggccggagttggagaagaatagctcgatctctctcctcagtgctcagatcttggggattcttgagggcatttggagaggacctcgaggggaagatgttagcgcgacggctcgaccggattcgctccacagaagccgggacagcgacgaggtcgtggcggcggcgctccgggcgcgctctggagctcccgtgggcacgatggcgttcccgtcgctgcagtggatgaaatgagatggtgtcaaaaggaaacttgttcggcatgaagattagaatacggaacgggaaatatttggtgttggcgatgtctcgacgatgggttgcggcgtccttcttcctggcggccggcaacgaagaggagagggaagaggagagctggagctctccctctcggtttctttggctcacgggtggtgagtgatgtgtggcgatgcaactgggaggaggagaaagctagagatgcagaactgggcgtccacgcgtctcggccacgcgtcgaccggcgcccagggcgtgtcccctcttctctctcgtgttcttggtcggttggagaggagagacagaggaagggcaagccaaggaggctgccaagtgggtccagggcgaagggaacaagtctggagtgagagaggtgggtaggagattgggtgttaatccattttggatgattttcaggatttgaatctctcttctctctttgttaatctatagtttaatttgtgggcacgataaattcatgtggatttttctggaggtagctgaagatacctagtttccattttattttgtttctcttaaaaattttatgtggtttgcactcagaaaattggagaatatgggctcggtagaactttgtttgaatttttaggagatttgaacagagtagataaattctgtaaaaattctatttattcatgataaataacctagtattttaataaattatttaccctatacacttttatgcagtttaatgcacattatggtgaggcaggttttagccgattaaggattataattggtctatcatttaactggtttgactgatttattcgaggtatcattctaagtgttaaaattttaataaaattatagtgaattgtatgtgttgagtagagactacatgaattttcccatgattttaccttgcataaattattttcaataattagcaaggcgtttatttatataagtgttctcattatataaatgcatctaaatgtttgtaaagacttgtattaggacttgacttgaactgagttgttattatttgaattcactttcatgtccttataattacgtcacaagaatgaccatgggtttgtctagtgaagttgtccttttattcatgttcatgaacctaacatgatatgcaaaccaaaatccaaatgcacataaaagactgaaatcaaactaatgctagatgcatatgcatgtacactttttttttttgcatttttgtgctaggctgaaaatggaaaggttttaatttgttctcaaatttttatttaagtacaagttaagttgacctcacctaggttaaagtagcaatttttggctctcaaaattagaaaagttagtttctaactattttaacaagaaatttttaagacctaaaattcgggtatgttacaatatttctccacaagtttttgcatcccgaatattcctgacaaaaaattggatgaacagtatatttttaaatttaattccatttgttccatgtccaatgagaaaaaactgatacatttgttaaaatacacacatacattccctaatgatatgtattgtggataataaatcttgaagatgcaggtattcatgatggacataaaacaaaattgagctacagtgggccacaaccatgatgtctaagaggtcttccgttcgagaaaaaagtgatttttgaggtgtatgtatggaccagcgaaatccaaacttgccgttatgcccaaaggcaggggatgcgaaccctcgatgaggacatgtactaaatgtgctgagaagatgccaacaaatataagcatattgtcctggcatccaatatgtattcgctgatttcacgatcgatacaactaccagaaataaccacagcataataatccatggtcatgaatagatttagaagagtaacatagttatagttttaagttagtattgtttgtacaaatatataaataattacattgcagttttaattaactcactattccttctttactaaaataaaacgccaatgatatttcaagattgtaaaacaccaaaaagtaatttacaattaaaaaatatactttcttaattagttcttcaaggatgacaatgccaacttattcatccatgcatatggttaaatttataattttatatttattcttcaaaacaacaaatatgaagttttactttacatgctcgaaagtcaatgtgttattttattaaaatctaagcaataccaatcaagaagttgcgactgtttgttagttggttatcaatgccgtactaaatactaagtgaaaccccgtgcgttgctgcgggagtctagtacgataataataagtaaaaataacgtgtaagataactagacaatataatattatataagttaacgtggtttatgataatttaaatttaaatagtatatacaataatgattcaaatgtaaaagtaaggtgatatgactttatgaaagaagaaaaatattgagatagtttggaccgtagattaatcttctaaaggctaaaaataattgaggtgataatttagaccatagattaatcatttaagcactaaaaacaattgatgtgatatgactcaatgagagaagagagaaataacattaactaagtgaggataaactatatagctacatagcatattgtaaaaataatgaagatatatattgaaatattatgtgaattatacgggatgatgatttaacatgtttatattttaaaagctctaaaatttaacaaattataaatttatagataatataatatgtttgtatgatgtttaaatttaatgattgttagtggatgaggatgtggcatattgttagtggacaatgatgtggcatctttgcatattaaactttaggagttagtgggttataactttataataagagaggattcgtgttaaatgtagtgtgttattgattaattataatatcatggactcttcaaattttactaccatggactatttagttatagacatacctaaaattttaatatatcctaaattcggaaataataacaagaaaattgaaaatggaatggattcttcttttcagcaaagccagaataatgaaagaaaccaagacatataagatatgaaagcaatcttaatatttttaatatcaacaatattagcttgagccatgcatggggttgcgagtctgtgtaaaataaatcatgcattataatagtgtgggctctaaatttataattttgaaatccacaagtaatcaatattactccctccgtccaaaactgtagcaattttttggtggatgtgatatatcctagtgacctgtccagattcgtagtactaggatatgtgacatcgaactaaaagttgttatattttgagacgaaggtagtaatatattttacacccatcttagactctcaattttgcgctctattaattcagttctactattctaaattaataattagcaaagttgtaacttatatggactcctcttttaatataatcacacgaaagataaccaatatgtttaacataatattacaacattaatggtagcactattccacgcgctacagtgcggaatattagttcgagcgccgcagaataccctgtccttccgatttttcccttttttaccactccacctttcctccgcatcccacattttctcggttcgtcttttttgttttttaccaccccaccttctatgttttttcacttttccatctcatccatgcttcatcaatgggcctggtaaaatattaaccatccagatttttttgtttttcattccttctctatagtttttctattttcacgtttttgtaaaatatttaccatctaatttttctttccgatttttcctttttttatatctccgcacgtttcaaaagtaacgaatttactccgtggagtttttcatttactcccagcctcccacatttactcatccaaaagtaacaaatttactctcattaatgcctccacatcgtataacgcaatacctagatggtcataaaagaaatattaccagcttacaatgctagtaattctttaaccaatattataaatattgtttaaatttcgtggtctatgagtaaaataattactaccttcctctcaatatagcccatgatctcgtagccaccgtgtagtaatatgtttactgatgtgttcaatacacagtataagagactgagatttcgtggtctgcgagtaaaacaattaccaccttcctctcgatacaaccatgatctcgtagccaccgtgtagactgatactaagagtattgttaatctgtatcccaaaatagtcgtatgaatgaaaaaatttacatgctcaatcacacacaagcgataaaattactcacatatgaatcaaactagaaaagaaaaaaaatgattcagccaaaaattcatctggtggctttgctggatcttgctataaggatgaagagcatggtctgtgtcttgtgactggtagtggagagggcaaccgggtggcgagcagtagtcgatgatggaatcatggaaggatgtagcggtgtggtatagagatgagctcgacgttgggcagtagcagccatccatcatctagcaagtacgaaaaaaataaaaaaccatttttgttcatgtcaatagagacgacgagcaaaagaaaaatagcaaacaacctctgtcactggcggattccaccctatcctctgcggccagccccatggagcacgatgtgcaaatgtaaggcctgtgcagcccatcaattgagatcaggtaatattagagattgcacgttaatttgatttgcaaaaaaaattagggcttcatgtgtgaagttgaaggagagtatgcaaatataaatcagagtgtcatttccttacttgcttgttctatcaaagtcgccgacatggagcagccactggttgttgctataggcccaggtgaacatctccatgctcgttaaggtgttgcctagcgtccggcagcgaggcccgaagcagtgccttcgcctcaactaccgccggccaccgctcgccggtcaccgccatcaaccgccacggtgtcgtcgtcctcctccatggtgtatcgccgatctgtgggctgggatggtggatcaattcagatccgaaaaaaaggaaaaaaaataaagtgggttctgaaaaaaaggaaaaaaaataaagtgggcgcgagagtggttggttgggtacagaaaaaatagaatatataccggaagcagagaagttgtttttatcgaagtaaatcattgactccgataatggtaggagcacgatgcgggacgtggggtggaatcggaagcaggggagttgtttttattattgaattaaatcgtttactcgaataaatgtgggtggttgaggcgcgcgataggagtaaatcgtttactccgacaacagtagaagtgggatgacgggacgtggggtggggtgggcctaggctgatgcatgtttgacgcttggaatattagaagtagttctaacaacatttatagtatttgtaataaataataacctgtgaaatggatgggtagacaactagaataaataaggcatgatgtgcacaattttagtaagatgattgtgcacaattttatttcattcatgagtttaaactgtagtaagatgattgtgcacaattttatttcattcatctttttgcctgtggcatgatgtggccatttagcttcctatttattgtttctattctttggataactattttttatttttctaccacctaaaccctaacatatactacctatcagctcatcccatgcacgaggccacaccatcaagaagagctaattaacccgatcaatctggtcgcatgttctgcgtttatatattcgtgcctaccatacagagtcatttgttcaatcttgcttattttacattataacttcccctagctagaaacctgtgaggtgtcatctagtacagtgtgcttaagcttgtcctccatttatactgacagattgacaacaattgcataaatcaaatcgtaatccaagcttcatcctagcagctagcagcttagcttctgtcttcctactactacgactaacccagaatattgagctccaaacagaggcccacagggcataaagtgaaatgtaccactgtgaaatatggtggacaaagttttatacagcaagtgttatgccaatattaattcttccttgtgctgtttaggagtgggtggcaccagaaaagaagaaaacatggcagccgtgatactgttcatggataaatagtaggcttcagaatcatcatcgcccacaggtgctgcatagcattattgtttgatttaacttttgtagctggggtagtttcttttctccactgtgcatgccttaccgaattccccagataagctagcccaagatgcagattaagtacatacatgtaaaatgagagttattatatcatgattaattaagttttagttgttttaaacttgaaaaatgaatttatttggtattttaaagcaacatttacctataaaactttcgcatgaaaaaagccgtttagcaatttaaaaaacatgctaacagaaatcgaggtaaaatctgtatcttaatcaggttcaaatggagccaatgtgtagtgcttttagatggtgctagcagctactaccttcatcccataataagttaatctaattggccagatttatagtactggttaggatatgccacatctcgtactatattaacttgtatatggggcggacggaatagctactctattgatgtcagcaccggctttagcacattggtggacaatagaaattagtttaattagttggagattagatatcaagttgggaaaaattgtagaaaccaatatttggaactatacagtgcacttatcaaatggtaggaaataaatgcattgttgtcggataatgcacctactgtgtttagcctagtcggaaacacacagtaggaaatcgaaaacattgaagcattcaaaatctggccttgatgtgctgatgtgcatataaatcgaagaagctaaattctttttggaatgcttcaattctgatctcattgtgccgtaatactatttggaatgggaagcatccagagtgacgcaaatagaaaggatgaggatggatgtgcagtgattctgtgactgacctcgttgatcttatgattaattaggtacatcccgtttgtctaattaattgtcttcttccattattcgtatagaaccagtagttcagctactggaatttattttctctaccaagcactcacttgcactgtccattctcatctctttgtatactggaaagctttgtatactagaaagtttagataggtggaagacctgtagtaaaagggaaacaatggtcggctctaccgattcaactgggaatgagtgggattgggaaaagatagcacacgtaaatcttgagtccatcttattgtgagaaattttatgccgtggaaagaaatcgatgttcaataggaggagttaatccatcatcttaagaaaaaaaaactatttagttcgagtttttgaatcaagagatggaagaaacattttttttaacgaaccggtgagccgccaatttcatttttgcaagtctaccaagttgtaacccaaacctggattgcaaactatctacagactgatggcgaccataagttgcacacctgtactgttgatgaaaactgaatattgcaaatgctgcatcattaaacttgtggttttatattgtttcactttcgaaatatttgagtctaagtctgaagaattaacactattgactttctggcacatggatgattcacacattccctttaacttggtcttttacaccgtgggttccaatgcatgagtacatgatattttttaagctgattaattgcacgcatggtagtaaagagtaccaatcttctattatatactaaaagtccattaaacttcctacaaacgctcttaagccgccacgtggcactcctacaaacgctcctaagtcgccacatggtactatctaatctcaccgttcattttcacttaaattgatagacctgttattttacactattagattagatctattattaaaaaataatatcctcatgaatgtatgagtttgagtttatacgttacaaatgccactgctttctttccatacgtacaaacgttgtacatgattgaaaacaaaactttcctaatcttcgctggaaaaaaaacatatacatgtacataaaaatgacagaaaaaacatacattcataaaaatcaacagtatttaaaatatgattttctactatataaagataaaatatattacttcacacatataaatatatttagttaaattaagatctataataaatatcctatcaatgttcttttaaaccatcttctaaatctatctattatataaaaaaagtacattaaactttctctcaaataaattagagaaacactaaaaatctattatacactaaaagtctattaaacactccaacattgtcacgtgatgctctaataaaattagagaaatcctaaaaatttagagtagaaaaagaaaaccatccaacctttaattttcacttaaattagtggacccactattttaaacattggattagagctcttaaaatttccgtgctgctaatctctatcccggaaaaaaacataacttgcttacgtcgtacgatcgtctcctactcggggaaaaaaaacttaaatacctacaccatatatgatcgaaaaaagataaagccaaaaaaataaaaagaaaacatgcacacgtacatagtagtatcggaaagaaattctaatcatgaaaaatcatcagcgtcagcactgatttgttgtcaacatcctttaatctacgattttattataaataatactacacaaatatgcacagctaaacttaatcgtaaacttattgtagtgataaatatatcatgacaaatgacgccaacatgtaatagttaatgcgataataatgttccaaataatttcatatcgtattttatggtgtcaaatatcacgtgacaaatatacaacgttaatttgaatctacatatgtaaaaaattaaaataacaaaacctatagcattgttttttgagtacatctatttaggtttatttaattttggaagagattgagattctcaaagtattaggaatttttcaaaacttttcttatttgaggtatgagaagcacaattaatagattgatgagaaaacataaattaaattttagccagtgataataaaacaatagaatttagctttggtttttaagtggatctttttaggtttattttgggtgatattgagattctaaaggtatctgaaatttttcaaaactttttgattgttatttgaggagtgagaagcatacatgatagatagatgtgaaaaaaaaataaataagattttagacagttattttgctagaatacaactcttaattcatcacgagaagtatgtattatctttgccaagtagtattggcaaaacatgaataatccaataaaatacgcataaaactacttatattatattttttgtagttgatagaaattctaatatactgggtatataattgacgaatgttatacaccacagaacccaactataaatgcactctagcgaattggttagtgtaaataagtttgtgaaaataagtacattcttagaattattaaatgagtctcatataattataaataacatatggtggaaacaaatttggcgctaaagtataaatctttatcaaaatataaataatgatacggtgttttacagattttcgtggtagtacatctctttagctatatttttttaagtagtgtcgaatgattaaccccactcatttgaaaaatatgatattgtatgtattccattaaaatttgataagtacttattactaacttcatatacacattttgtctattctctaccaaaaatcgactcaaatttttttgaaaaaaattgttttcatcacctcctccttctttctatccctctttgacatttaatgcagggtgcagtacttgctacgctgtcatatatattgtatgggcatctacatggttgagttaaggtggtgtctgtgaaagaccatcataggcaatgtaactaaagtgacatagttatcaatataatcatttgtaagtgtaccaatagtgtactaagtgttgaaattgtattgtatgatggtttttaggggcatggctacatcgaaatgcgggacctatatgttttaagccattacatacttcatccattagagaggcattcatgtttatttttaatggtgttatcatattattcggtagatatgatatatttatactaattgtacatatgattgaaaaaagtgatgaacaccgggttatgttgtgtagatgaattttttagtgtattaataatgtatcatttgtttaagtggtgctaatacagattcatttattaaaagtcatctaactcttaaaacaattatagtaagtagtgatgacaaacaaccagtttatatacgaccaggataaagggatttttatttaaatctaagagacattcttatcacattagtagtatattaaaatctaccatctattttatggtaaatatattcctttttttattgtaggatgatctaaattctcttacactatatatatagtgattatatatatagtgatgtatgattccttttagcattctttttttaataacaaataagatgcctgtgcatctatgcaaaattcttttctgatttatattccggaaatgttctacaacttatattccgtcgttatagagtttgaaacacaaactataatacatgcccacgcgaatgcgcgggctacctttctcgttgaaaataaaaagcacttccaaagcatcttcttctaaagggctaatagcgttattccaacggatgtcacttatgacaagtatctaaggtatattggtaccgcagcacctatggtctattagaacttcactatgtcccttaggacaaagatgttaaactagataagacctaatgccaattgtaaaatcttaaaatatcttttctaccttaaaagctaaccaataaggtaagggctttctctcttatacattgtttttttatccttcaacaacaaatgtgggaccgttcaacataatccatcatcaaaattacaacctcaagattgctaatcggattttgggttgggaatagattcctctttatttttcagaaaaaaaatctaaaaattgactgacagtaataaaaagtgtgtccaccctactaccaacaattcaaaaaactagaaacaaatatctcatcctccgtttaaaaaaaaactaatttgcaaagatcaatttggacaaacaaataattatctggactcatattcctacaatttttttaatcgaaaggatatatatctgttgtgctctctctctcctcaattatagattctctctaggaacgtgatgatatagcagaaattgttttttagcctgctggcttgtacttcctgctttaccgacgttgcttctcggaagcacacacccagtcgacgacgacttgacttcatccttatcactaaaaacgccgcctgagtaatacaaagaggcgtaggcctgcctgactataattggctcgatgatcgactgcaactgcatcaaaacattcagcatatctcttgctatcttgcaattgcaaattagttatactcgtagctactgcgcgcgcactaattgactacacaagcaaatatgggttctccttctgccaagtacttgctgtttagccttgcaatcctgctggtcctgagtagccagcagcaagctctgctgccttcggcattcgcccgccagttggttccgatgcccacgaacactgccgccggtaagaataacatcagtgttaattaccagttccatctgtatatgttttgtgaaatatcatgtggagaaactaaccactacatctctttgaacatttggagttgcggttctttcttctagcgtgtgtttggccctcccctttttaacctctactctcttatttctacttgcatgtttctcgaactattaaacgataatttttttaaaaagttatgtatataaaaaaactatttttaaaaaatattaattttttcttctaattttgataagctaatacttaattaatcatatggttacgagtccctccatttttgcatgtgcccaagaccttcattgcgaaacaaagccttaattaagtatagctagctatgtctacatactttctctatttaaaatataataattgcctcagatttaaatttatcgaggaggaattactttgaacgttttctggtttagtatatatttttttatatatattggatttttttttgaagtaacacatactcctacgtacattaattaactgtttccattcgcatgcgtgatggagcaatcgacaggccacgcagatgtcacggaggaaaagcctagcgtcccgccgtcgagcgtaacaaagatctgccgagttttacgtatctgcaaacgatcatcgtcggccgcaacatcggccaagccgtgatgtgtcaacgacggcaaatgcatgcacgcgggaataaataatggaggcaccgattaggatcaacaatatggttagtccattaaatatgtgtgtaagctcgatcgatatggaataatgagaaacaaataaacaatgagaaacaaatattcaccatgtttattactacctctgttttcaaataaatagtattgattagtgtaattttgaactaaccggcatcaaacaaaaagaaacagagagatacttgtttacgttacttcttttgtatacgtatccagccgcgatgttcggaaactgtgtaggatcgagattggcatcgatcagtaagggcatcaacaatgttactttttagctgccggtaagaagcattaaatgctcttttcctatccggtagcaagctctgtgagagtggcgaagaattaaaatctggtgataatatctattaccggtatattactaccggtgaagaagagataaataatattatttatatagtgttttaatagaactttaaaaaaatgaaagtggctgttgctgtggggtgatgctcggatcgagatgacatcgatcagatggtgaaagaattgtttaggctgtgttcagatgcagttcctaacttcaaacagtgcgcacgaaaaacgaagtgatcaattagcgcgtgattaattaattattagctatttttttaaagaaaatgataatatgattttttaaagcaatttttgtatataaattttttttgcaaaaatcacactgtttagcagtttaaaaagcgtgcgcgtggaaaaggagaggtgagtgttgagaacttggagtacccaacacagcatctaaacaatagtttcaattatccctataaactgtggcaacaaaataaattcactaaatatatatgtttgtaccgaacaaccttagaaaagactgaccagaaaagtgcatgatctgcaaggtagccaggtgcatttttagtgataataagtgtgtacttcgaggtaaattttgctacaggacgcttcgacttcgtggagttagccgtgggataccgcctgaactcatttttagaggaaaacactccataaatatggtatttggtcaatggacaccgcacct

SEQ ID NO: 2332 - DNA, 13930 bp, Oryza sativa
  unsure (1)..(13930): unsure at all n locations
ggctggctgcggttcgcccgcgcccacgacctgcgcgacggggacctcctcgtcttccgctaggacggcgccaccgtgttcaccgtcactgtcttcgacgacgggaccatgtgctgccgtgcctaccatgacgccgccagtaatataacctcgccgcgcgtcctccgtcccggcgatcgactccccctatgggagagaagatagagagagattagaagagagagaggaaaactgacatgtgggcccaagggatatatttgatatttcatacgatttctcactcctcttcaacccgaaagaattgattattttaatcaatgcaacagcggtgtctattggcaaatcctcttcaaccgaaaattattattttaatcaacacggtgtctattggcaaatcaccttatgtttatgtagtgtttttcctcaaaagtgagttcgggcagtgccccacgactaaagccacgaagtcgaagtgtcctgttgcaaaatttatcttacttcaaactcaggtagacgcaagaaaatatgattcagtgaggacaatacatatcaccgcaggtcaattgcaatagagctataacagctcaaatttcaagcacaaggactgaagcattactaaggacagtatgagcccagtactacccaagtactaccacgaaattcagattaaataaatacaagtaagatgcccgtgcgttgcaacgggaaattttattaagtttaaagaaattgagtgaaaatttgttaaactaccagaagcaagcagtcaacacgtacatttgtaatatctccaagcggggctgctcatatccaaatagattagaacgtatttggtacaaaacacctaacaaatttctacatgtgaaatattacacatcaacctgaaacagatgaggatgtaggagtagccattttggtcgtggaatcttgagatccatgatatgaaagagttgaattaattcaataataataaggtgttgtgttcaaaaagtccaaattttgataacaatagatgtgttaatttataaaaaccaattgattcatccttcctccgctttctggaatcacgtctcttcttgtttctatcttcctttagctcttttgtcaataatgggtacctctctctagcacacttcctttttagttcagccgtactgggattagtaacatcttcatgcatgttgggtgtaccgtacgacagttcagctttgtctgtgcatggtagccgcacatgcctaatgacagaagcgttattttcatagcctgcaccgcaaaatcagaatgctgatgttagcctaaaacaaatatctcatatattaaaaaaataaagccaatataagtatgataccaaatccaatagttgaggttctctgaatcttatatgtagagttcttgttgatctgttgacagttctcacggtcttttggaacattgatttcacttgggataaccgcgcggcacgcttgtttgtcaacttggcattaatcacattagttatattcacaaaaggacctaaaggaagagtgtatgtaaaattaggaagcaaaaatatatcaattgagtaatggatatgaccatggctggatggatgaaacaattacatgatcttttggacgatgttggtgctgaaccgccaccattgttatccattgcagaactaacttgattagaagttaaccgcaactctagaaaatcattgttcggtttcaatttagttcttcacaccaaaactggcacctaaaactgaaaatcgtacatcatgatgtggggataatgacatgcaaaagctaccagcaaagtagatgagtagactgtactgcagaaaatgaaaaaaaaaacatggtgcatgtactgaaataggtaagatacattgcaagaatgcggatttctgaacttgaactaatgttcagaatgtggttttcaatactacaaaatattcaagataccattcttataatagtattcagttttaatgtccatggtgttgtgcaacaaattataatgttgtttgagtgtccttaggcaaattagtgcaagatttgcagatccaagaatgtacaggttaagaagtgcaggccttcaagttagtagtagtagactgcattctgtatctttgctacctaattaaattgtacagataaatcctattcagggtaataggttatttcagaaatacttgccgcaaccaaaattgtagttactcaatccatgatgctaggatgcctagtgatgcaagcaacacaacatgcatggattggggatataacatcagaacttcaaacttattacatttttttaaaaaaagaagaagagcagagtccagatttgacctgttatctgaacaactccacaaaccataccaaatgtcaagaatggattcaaaaaattaaaaaaaccagagttattcagataaagggatgatggtctggataaaggaaatgcccttcattttctcatcattttatcaattttaggtcatgttctccaggcaactacacaacattgtagtgcttctatcccgttagaatggctaacggattaatagtctgaaacccctctaacaaccaaaccatgataaattctgaagcatgatatcttaatagataaagatttgtgatgaacgagagcaattgtttttattctaaattccagcatatgcaaaaaacagaaaaaataatatcttctcatatcaatcactcaaggaaaacagggaaaaaaagagagaatagtcccgcagtagttcatcattaataatttactgcccctttttgagatcatgcataatcacagttgttatgcatgccaatgatcctgaagacgcagatgaagttattactatgctttgcctgagagcctgacagctaatctctaggtacgctgttgaaaaatcatcacaatgcccagatatgcatggtgaaaaatcatcacaatccaatcagctcacatccctccccaattcatctatacgcacgctgttaaaaaatcatcacaatccaatctgctcacatccctccccctttcatcacacatggaattcagcggtttgatgcactcaccgatgcacacgaccttactcaaccgccaaaaacgcaaggatttttcattcagttaaagaagaggaagggggaagcaatggatgagtacctgcttggccgccattgccggtgaagcatagaacatgtagcacggcctgcccgctgacccgaacatgatggaggagcgggaggcctcggcggcggccgtccaggcgacctcgttctgcggcggcggggtgaccggttgctgctcttcccgcggccacgtgctcccgcctcgccgatccggcgccggcgcggtggagaagccgtccgcagggggaggtggaatgcgggcgctgggggatgggggatggggaggaaggaggatgaaggcggcggcgtctggacgatggatcggtgaccgctgttgatacggagggtatcgaggaggaagaaggatcaaaggcaccgctcgggagagaggggaacgcgtgcgcgtctgcactcggcaggatcagagcattgcggaagcgatctgagccattggatttcacgatcctacgtttagtattacgcgtgtctatcaggattggagtcaccgctaccactacggaatttttaagtagcagagattacgaatctcaactctaattgcgattgccactaaatattaggggtataaacggagcggatattatccgatccgctccgaatccgtccgatgtaaggatatggtaagggtttttagtatccggccggatacggatgcggattttgtcatgcggatatggtatcaatgatatccgatggatgcggattatccgatattttaatcggattatccgatgtactgtttggcggataattcacaactttcaggccacacaacaactttcagacccatctagcccatctattataaccctaacctaattcactcctcccccagatccctctctctctctgccgtcagccctcagccgtcacgaggtcgaggagtctgagagtggcggcgcgacggtgacccagcatggcggccgctcctcctcagtcttttgctctccccaacacgcgtcggccgctcctgtatgcctatggaactaccgaactattgtaatgtgtcctgtgtggcagtgtgcctatatgcctgtgtgcagtgtgtgctgtatgcctgtgtggcagtgatgacttatatttttaaattttaagcaacgcagtgaccattgaactactgaactgaacacttatattattgataatttattggatgtgttatattaagcaaaattatattattgatgggttttggttggtttttcctaaagagctgagatcatgttcagatgttgttttgctatcgtattgcggctaattgtaatgctgccctcttattatatggactgaatacaaacttgacatccgataactttttatcctttttcgaattgagtccgcaccgattccgcaccgaatccaacgtccgaaataatccactccacatccgcacgtcatccgtacccgctccgtatccacttaagaaatagtttaggatatgatagagctattatccgtctaaatccgctccattttcatcctctccttccctcccattctctgatctagtcacaacttgctgagttgcttcttttcatatgtgcgacgggagagattggatcgattttttcttcttttctttttcatgccacagaattggatgattttttttcttcttttctttttattttttgggacaaaaaccgtgatgacgtgcatgcttggtgagcacatttttaccattatttcttaattatgtgcacgtgaaattttttgtcctttccaaaaaaaaatattatcaacattgttttgcaagataaaaagataatatttcttgcataaaaaatacaacatttcagaggtttttaggtgacaaaggaaaacaaccttcacaaacaaaatgactaaaccatcagtgcttctcaaattgtcacaaagtcattaaagatgcgaaagggcctgtagcctagtggttacaagagtctaagtatcacttgaggttctgggcaagacgcctgtgatgactttgtcaatctgaaggatagcggctattgtaagtgtttgtattgtactgtttaattctaaaaaaagtcatctatctatctatctatctatctatctatctatctatctatctatctatctatctatcttctatctattttatactaaaagtccatgaaacttcctacaaacgcttctaaatcgtcatgtggcactcatataaacgcttctaaaccgccacgtggcactatctaatcttaacatcgattttcacttatattggtggacccgttattttagatcgttagattagatctacacagttaattttcacttataatttagttgctagaccattattttagattacatatatatgagaatatatagatgccaacagttggccgaaaaaaaaggcaaaagtatttactgttcgtactatggaaaaggaaaatccatacacgttgatttccagaccgttgttttagattagatatgtaagtgtaataccttcctccgatatatacatacacgagaggaaatttagatgtaacagttggctgaaaaaaaaaaagcaaaagtacgtaaagtaggtactactttgtggaaaacagaaaagcttgcgtatgtacggttcgccaaaagaaaaaaaaaacgtaagcaccataaaaaaatatgccgtcgcaaaaaaaaattaaaattatatatttaattggatcttgttgtattccttttatctaaatcaactattgacatattataaaagttatattatagtcctactaaatacatcacgacacatagagccgataaatagtaattaatgttatgataattttttaaatgattttgcatcatattttagggtgtcaaatatcacttgaaaagttttttaagtagatatgatttaattttaatttttttaatctcaaagtgtttttttgaaattttccagaactacttaattgttattagagaagtgagcagcacagatggtacatggatgtgaaaaatattataaaaaatatttcaaccaatgatcctgctataacacaatcctttaatctatcatgagatatatggttatatatgtatattttgtttatctggtcaaatagtttgataacaataaaataatatgtaaaataaactactcatgatatatttttcttataattgaggaattccaacatatcaaacataattaatagatttatatcatacaccccaccgacatgactaaagtatgctcctacgaattagttattatacaagtttgaaaaagaaattcttaaaggtgtctcatatgattatcaaaaataggtgttgaaaataaaccaattgctacgctatagatatttgtcaaaatataaaaataatatagtgctacgaagattatcctggtggtatgtctctttagttataatttttttattctatcgaatgattaaaatcgcttattttcaaaagtgagtactctatctatagcataaaaaaataaaaaaaaatattttgatcatctccatttcatctttgtccttccttgaagggcaccaagcatcgataacagagtttgctacgatatcgtaattagtacgggcatacatatagctgaattgagacggccctagtggaggccaccgtcgccaatagtgcccaacttactacttagtgatgcaatactatatgagggtatgatagtgaattagacattaaaattatactccagactggtctagatgggcacagctacatcaatgcaggacccatgtttcaaggcacaaagaaataaagtcttgctggctacaatgagcttcacactttataggggcatttatgtttaattttaagatgtatcctattaattggtacaagtggtatttttagaatgtttttatatggaattggaaataagtgagacaaaaacacttaggtatagtggatatttttagtgtattaataatatattagacttattttattcgtacatatgcagtttcatttattaataggtactcaactttagaagtgataataaattgtagtgacaatagggaagtttatatgaaaccggaacaagtgttttttttaatttagaagacatccttatcatttaaatatattaatatatatatggtagaaacagtgaaatgtgactttttttaatcattattttcataaaacaacaaataaaatgcccgcgcatctgcgcgggcttcctttctagttaaatataacaatctagtaagccatttacaacttagttgccgaggatatagaatatattttcgctatcaatcactcacttcctttaaagtgtcctcggtacggtgtaattcttaaaaaaaagtcattaatgataacaatctaataagccatttacaacttagttgccgaggatacggaatatatttttgctatcaatcactcacttcctttaaagtgtcatcgccgtgtctttacatattgcaaagcctatgactcaagtgtagactttgtcaatctcgaggataaggatttgctggctattgtaagtgtctgcgttgtactgtttaattctaaaaaaaaagttattgaagataacaatctaataagccatttacaacttagttgccaaggatacggaatatattttctctaccaatcactcacttcttttaaagtgtcctcgccatgtctttatatattgcaaagcctgtgactatattttcgctaccaatcactcacttcctttaaagtgtcctcgctttgtctttatatattgcaaagcctgtgactcaagcgtagatagatgaaaggcccttttgtaaaaagggttgaggctacccaaacttaactgggaatgagtgatacccaaacttaactgggaatgagtggaattatgaaaagattaaacacgtatagagcctgcacaagtcgtcaaaagtacttgaccagtggaaagaaggtaacattcagcggaagaacatggaaatatagatgaaaacaacaggcaacaaccgatcgtgctaggataaatgtagttcatcaatcaagatcaggaagatgaaaatgacattgcagcctcgtgagatttgggaattatatcatggtcgatagtgttgacccaatctacacatttcctctgtttgccccactacctcatctaaagttagatatcacgatatctatatggtcagagataggatcatgcctgcttacaacagtccaaacgttccttttcccttcaattacctagacaagatgctccctctaatttaacagttctacagcattatagtactccgtatgaagtatagtagttagagtaaaaaaatggtgatcaaattggagcacacatcaattcgagttaacatgattcacatcaattgcaccctctgacaatttaagccgtagcacttattatgatctcacaatcagtggctttgtaatcttcacaaatcatgtgtaaaaaatcaaaatgaaataacatgaagaaaagtacatcgcatctttgtattcagcatataatcatctccagtcagctcatatcaataatatgtgcaaacagaaattttttatactccccagtagatgaaagataaagcaccacagagacaaaaggattaaaaactagatagttagagaatgctattctaagaagttttctccataagctggattggtgctaagatgttctgtttacttgtctctactatgcagccattcatcaccatctcttccagcatgaagtgcaccttctctagatggaacatgatgtcgagttcacactggccaaaaggataattaccatcagcttgtcccatgtgatatatgtgagcgtatttacagtcacaagaaaaataattgttgggattactgaaaaataccacatttccgaagtggcggtccatagtttccacaaaaagatgaatgaattcgagaatagctagctcattctgccaaacaaaagaaaattgaggcattttaatatgaatcaaggaaaacatggtgcaggctgtagttatgattgacatcccagaggaaaactacaatgcaaattgcaaccaaaacaagttgaaggaagatttgacttcggcaattgctacaaaattcattgagaaaccaggcagcaaacaatgaactgcagtcaacaggcataagatggagatactgagattcgtatgcagagatgtaagtatgaaatagtgttaccacacagaatcaccaatataacaaattttcttactaaagagttctatctaatgataaataaatagtaatagcgtatatcttatagttccatcaaagacaatgataatgcattttcacattactatcaattagcaaatccgacttgtgcatatattcatcgaaagaagaaaacagatgaacaagatgtaagcctctgttgcgatgcgggatacttcatgattattgagtaaattaaacttctcatgtgaaatttctagttcctaatagaaaccattaaaccgtatatcttcagaactgataacaaccccaaaccctcaactactaagtagtaatatcatttttagtagcaaggacatgttcagaaactatgagctaactgcaactgcaggagcatttcggtgccataaaatggaatttaatggcaaaatttggtaaatcatccgaattgttcaacaaagggaggcagggtgccttttgtctaatgaaaattggaaggcggaggaatcaatacctcgtcgttgtcgacgccgacgaggaagaagagggaagcgtaccgccggtacaccaccttgtagttccggtgctccacgaacgaacactgcaatcgcacggatcatacaaatcacatcatcacgaggaagagaacgaacacccaagaacctgcacagatccagatccaagaacaggaggcttcctttccccgctcccccacccaccaatccggagcccaagtttccgcgctgggcaatattggatccaagaaaacgaggaggaatcggaggggggatcgggaattggggggttaaccaaaacctgctggtcggtgcgggcgaggcacttgcggacgatctcgccctcgagggcgcggcgctcgtcgatggagaggtgctcgtagtactgggccagccgcgtctgcccctgcttgttcacgaacagcacgaaccggatccccatcgcctcgcctctcctcgcttcttccttcgctctgttccaaggctgcttcgtcttcaacctctcgacactctgctctttctttctttctctctcccgtcttctgtttgactcttcttgcccatactcgtcttcaacacaaggcaaccctcttttcgtttgccctttttactatttctaacggtggaattattttaggtacggtgttcgtaatacaattcgtatattcagatattttattaatttaaaagtaatttacttaaatttaaaagttatttttttgacgggaaaccgcaggagaggctcctactgcgataatatattaaataagggatcgacatatacaaagaaaaagaaagaaagaaagaaaaagaaaatagattacaggaaaatatattaaatttaaaagtaacttagaattaactctttgtactattagaagtaattacattaggaccgaattcaaataaaaaatatgtggagtaaattttcaagtaaagtttacacaagattttcaagtaaatacatgtattatattttcaaagtaatcactatattatttttgaaaacaaaaattttgcatcatatagaaattaactcttcacgatattagaaataacttcattattagagaaaagtaatttttataagtaactcttcataataaatacactcctaaagggaagtgactataaaaagataatatataaataactaactctactactagatagaattaagttttcacggcaactacactgctataaggaaagtaactgttatacaaaagtaactcttcacgttattgaaaatagctacactgctagtgaagtttatcggtgatatggacctggggatatcatctttacagggaggaggctacccccgaacccacatgccccccctccagggagatcgggcctggggtggagcggcggctgcccctctccagcttggggtaccgagattggagggaggaggctgcccttagacccacgttgcacttccccgagtagggtcgagcctagggtggagtggcggccgacccgttggggtggccgtcccgaccctcggcgcatcagcctactcctgcgagttgggtgggcagcagncccaccggcccacctaaccgcatttaaatcagaccgaacgggcgtgtcacgccgcatttaatgcggcgtgctgcgcgcctaaccagtctatgaacggtcgaatgactgatgggactggggtagtgcgcctacgcattgaccatgtgtcaggcggtgtgcagcctgccatgccccgtcacgtcatgatgatgagaggctttcccagccggagttggtntcatccgctctanngtcaagnncagggtnntncccattnntncccggtnnngcacaacacgggtgcaaacaggaacccagaagtcttcacccattaaatgatgaatgaaacgggcgtcccctatgtcagccggttcgatttgaccggtcccacgaccgagatgacgtgcacgtgacttccaagtcaaggaacaagacatgcattcaatgcaaagattgtactccttcacccatagacaggttcttgggcccatgtggtaaccccttgaggtataaaaggaggtccatgcctactaagggagaggatgagcccattttctaacacacacttcagattcactatctcaagcatctacaatcttcacagattcagccaagcacaggagtagggtattacgcttctcagcagcccgaacttgcataaaccttttttgtctctatgtcttcgaggggcctgacccctctctttctctcatccatcacagggatcctcgaatctcaaccgctgcccccggccgaactcacaaagagagggggggtctcacggtcccccgctagaggagttcatcctctgacatagttaagaagaaaggttaaataatttaaatatattcaatattagacttgttttgtcatatattttgagtagagtatgatggttcaaacggatttaaaaaaaatatacagtttaagagatatacatcatcaaagattctattaaaaaagaatatatattagtgtaactatatgttagactcagtagcatgcacgtgaatctatgtaacaaccagcagataccatgtggtcctctttttctggcaagtgatctcatttctctatcacttgatcagtacaacatccacgtgttcatatcttagccattacaactgatcggacggcttacgaaagatgtttggataaggtcaaatagtgtgtgtgcactgaatacattttaccataaagatatgggttaattagattcatgccattataacctttatagttttgaaatatgccattactatttaactatttgaagtcgtgccatttagtagatatttaagaaatgccaccacatacccctccaacacactgaaatttatttttggaccaaattacctgagtcttttttcctccatcccctcctcccattctctttctggatctgagttcccggtgtaagcgtggtggagaggcccggcgagcagccccgaaggagtcaaagtgatgttgccggcgctgtgagatcgtactgccgcagtgtcgtgttatcgtgtgagccgcgaaacgccacgcccaaatcaattttgagaaaaaaaagataaagaagtaaaaaagagaaaacaatgcacggatgaaagaacacatatctgttgctgatagtcctatgcacaatcaatgtaaaacgagctttaagaagacaagaacatatcggcggaaggtgatcttggagcagccgaggtcgtcacgctcctcgcctcgcctgcgcggtgcttcgctgcagccggaggaggggaggaggatgctagttgcagctgctgctttcagtctggtcgccggtagttctaaggccgccggccaccactgaatcaagccaaccgggtgtagctccaaatccgaagagggatgggaagaagaggagtagagagagaaggagattgaggaagatgacatggaaaatttggtccaaaaagaaattttattatattaaaagggtagacagtgacatatttcaaagagtagttattccaaatagatgaatagtagtggcattttttaaaactgtaaaatttataatgacatgaatccaattaaccctaaaaatagatgctgcaagcaaaactcaacaaaataaccacaaattaagacaagtaagcacgtgtatgaagatgttcagactccatgtagacacgttctctgatcgatctgaagcccaagcagtcgagcttgtgcccaggggtcaataccggtgaaggtcaggagcaggtaaccgaggtttgagaggaagaaaatacatagtaactgcggtggagatatacaggtggtccaaactatgctactagaatgtaatgtttttattttgcatgaagttgctccagttctttcataatgttcgtattcgattaaaggtatatttttgtggaggctccaacttcttgttgtaaaaaatgattatttgccgagataaaatggtttactatttcaattataatattattaattgtaaagaagatgttttgcccttaaaaccatagagtgttctcagctccaaggctccaacttctagagttacgtttcttctaccaaccttataacaatcctaaatgacagccctaaactatgcgttcagtcttgtctaaatttaatggaaaaaatgcagca

SEQ ID NO: 2333 - DNA, 1488 bp, Oryza sativa
gccttcattcattgtttaccctcagttttggaaactgctcagcatttgtaggactctcctgtgtgggccaagattgcttgggcctcagcccatgtcatctgatgtagtcccataccagctgcctgtccatcatgtttttcaatttgccatgctagcttctgcattgatatgggccaaagaaaactgggtcagccaacaagttatttcagtccaaccgattcaagctatccatcctcaacacacagtttcagtgttgaatcttctcctggacccattccaacaagatgtctctcctgctctacccccaaggcccaaaaggaggactgggaagttgattttgttggattcagaaatacggagaagtgaaagaattaacaagctttctgatggatttatgtcccctgacccaaatttgggtgtgggaaagccaaggggaaaggctagggcaaagagctccaagaagcttaaaatgctggctcaagaaagtggtatcttgctctctctcaaccctttgcctttggaacttaatgatcgtattgcttaagatgatgagattgatgcccccctgctgattgttctatacagcttcaacagattggcactgatgtctgtgggatgagcagggagatggtatctgctgaagctttgactgcccatgctggaaatgggagtcactgtgctgctgctccctaaattctgccccaatgaacagtcctattttgttattttgttgccctatgttgggtctctccaagatttgtaataatgaatttgcctttaaaagctgtgctattatgatgaatgggacttctgcctggatcgtttcatctgttactcttcgctcctatgttatgcataggactctatcttattgctctttgtttgacaatgaattcacacaatagaaactggaatattttgtgttggaatgtcaggggtctcaactcttcctctcgttgtcaggctgtaaagcaaaagatagatgaaagttcttgctcgattttttgtttgcaagaaacaaaaaaggatcatttggcgccaagttcgttaagacgctagcccctaaaagatttgataatttccttttttctccttctgttggagcctcggggggtgttttcattggctagtgaagctctatgttttttggtgtgctcctgcaacaaacccaacatgttttagtggtcagtttcacttcaaagtcaaatggtcagaattgggttttgatcaatgtttatggtccctcctgtggtccccagagagatgagtttgtacagtggttacacgatcttgatattgccaatgattattggacgatcctaggagatttcaactcctacgggtctattgacaatagaaataaaccgggggacaacatgaatgatatttttatattcaatgatgtaatcagttccttgggcctgctagaaatccctctaagtggaagatcttacacattgagtaatatgcaagcagacccccttcttg

SEQ ID NO: 2334 - DNA, 4862 bp, Oryza sativa
ctgatttctgctaaatttaagaggttgcgttgctctcttaagaaatggagccaagctatctctaagttgtctagaacaattgagaatattctttgtgccctaatacactctctggatttttccatgaattttcggagctcaagaaataattttaaagtcacaaagttcattaaactaatttaaataaaaaagaaaactaattaaaatcatccttcctctctttgggcccctttcggcccaatccccctttccctcatgcggcccgcgcgccctctctcggctggccttccccctcgtttcttgggccgtcggcccgtttttcctccctcgcaagtccagctcgcctctcccttcgcaagtccgttttgcctccctctcccatccctctctcactctctccccgacaggtgggacctgtggaacccacctgtcatctcctacctccggctccccactcccaaccaccatggccacccgagccgccccacgtcgccgcttcccccgcccacctcctccaccccgcgtgctccagcctggccgtgggacctcgccgcccatgtcctcactctcctaccccactccttcccacgcaaaactggcgccggatcggcccccacgaccccacgcatctcccccactccggccggcgattccgcccctcccggcctcgatctcgagctccccgcgctataaaaatgctccgcgagtcctcttccatttctccatttttcctgagcttctcgcgccccgtactgctctccccacgctgctccccatcaccgcccacctccagcgagctccggccgccatttcccgtcgctagggccgccgccacactgccccgccgccacgttcggcatcaccgagccaagccctatctcggcatcccctcttttccccaatctcccaccaaaacactaccccactgtcaacccgagccgccatcgcctttgcgagctccggccgtcgttccccgtggctggaacctccgccgcactgtgtcaccgccaccactggcttcgccgcagcaatcccaagcccggccaccgcttcttttctcctcgccaccaccgaaaccaccccttcaccgcgtacccgagccacctcccccattgctgcctctggctgcaatttcccttggtaccgcgcctcctcctcccttcctaacccctctactctctctcccaggctgtgttgtgccccggccgctcctccttcgccggacgtcgccggagtcccaccgttgccgtgcctccccgtggagcccgtcgccgccgcgttcccgttgtctcctctccgttgcgcgagctcggtgagcatccctccctctccctctatctccccttcgccggccgcccgcgttgcaccgccgccgccggtggccatccggctaggccgctgtcgccgccgttcgccgccgcttggccggccggtctcggctgcgcccgccctgcactgtggccgcccgtggaccggcgtggtcctggtccacggcgcgcctgaggccgcggtggaccgtgtccaccgtgggccgcccccttgagccgctgatgcctggggcccacctgtcggtgccggccccctctttgatgacgtcagcatgtctttttttctttggaaaaacaatcaataattgcgcaataaatcaataataattctagaaatctattaaaatggctcaaaacttctaaaattcatatctaattcattcgaactccgaattgagccattcaacttgcaaaattcatctaaaattgagatctacatgttcgtctcactttttatgtactggttgcttggtttttattagagtttttcctcgttctgcgtgccagcgtgtagaatccgtcgtttcggaagtccgcggtcgcaaggataagagttcagaaggttgttgtgaagaagcaaggcaagtcacatattccccttgagcatattgagcctactttacaaatgttttactgtttgcaaataaatatgcatgttttgctaattacatgggatcagggtttcacctatctgctcgcttgtgccatgtttacttgatgtctgtcctttgtcaacattgggtaataaatcgactagctcatgttacttatgtgacctagctagaactatatgcttagctatgcttaattaccactagctcagttgatgggataattacagtattagacctttttagtattagaatgagctgcgtgctcgagacatctggccatgcttcatggtcataattatccaactaaaatgcgactaaatggtgggctgtgggtgcatggttttgctagtcacacccatggcaattaaggactggttcgcgggatgccctagaagaacttattgtacttaccacaaaccagcgtgggcaacggctgggcttgtagtgtagctttcctctagctgatgtacccaggtaagggtgggcgttatggagttgggtcggccggggtgttcggttgatcggcttttagattcaccgtggcacgagagaggggctgcccgttgcctgctggggacgggggcgaaccctgaggtgtggtgcgatcggttagagggggttatgcgaagggtcatgtcacggcctctttccggtatgttgtggtggcatgtcggcacacggaaatgtgtcgtggggctgtgtcttgtgggtacagttgtacacctctaatcagagtaaaactattcgaatagccgtgcccgcggttatgggcggtcgactagattcaccgtgattagtcccaccttaataaatcaactcaatgcaccgtagttcaggtgggttagttgggcctgttcaatgtggtatagcgttgatcagtggagatttaatattaccttaattactctattgttttactgtttgctcaataaaatgttttacaaccgcctttatgcaaatagccacaaaccgtccttgtattcccatgcacgtctgcatcattggtgtggcttgctgagtacggtggttgtactcagccttgctattattcccccttttcagaagtgtagtgcttctgagctgaagacgaagttagaggaccaaggctcagaccccagttgagttttgcctgtggagtggagctgaagccccgctaggatcgcctttttccactgctgctgctttcgtttcggtgtgtggactaagcgcctcttctgtaagtattttacgctttatttacgtttggaactgtatattacttatcgttttgtgtaccctggctggtcctggacagagatttagtctggaaatttgggctaaatttctgggtgtgacatggctccttttggtggaaggatgttttctaatatgatgtcttattcagaggaattgccaaacctgtcttggattcgggaaatgacgtgctttattgggatgatttatgggaaggagtgattcggtcctctaaatatcaagattattttcctatgctaagcacaaagatgactccgtagcccagcatctggctcgagatccacaagatcagttcttcctccctctctcccaacaagcctttgatgagtacaatgatatgaagagagaactctaggacttttctcttcaggatacaactgactcttggacttatatatggggatcggcaaagtacacttcaagactctgctataaactcagtttctggtctttatcccctcccatcaattttaaatggatctagcagagtaaggttaatatgaaaataaaggttttcggctggctgttgtttttggacagagtgaatactagggatctgctggagaggaaacactgtgctcctttgaatgcctcagacatctgcccttcttgctcaaccaatgctagagaaaacagggagcacctgttttttctttgccctttcagctcagcctgttggaataagttgggttggtgctgtgatactactctgcagtttcatcaaatgattcaagcccaactggcagtggtatcgcaccaatgcttcatggaattgttcttaattgcagcttggaatatttggaaggagaggaatgggcttatctttcagggtatccaaccttcagtgcgtaactggttaagaaacttgaaggatgacttgagtatacatttaggtatccatccttcagtgcgtaactggttaagaaacttgaaggatgacttgagtatacatttaattaggctcatggatagagcaactgtaatttttgtttagttttccgttttcttcttctcgtttgtcttctatacatatactctatggaaattaatataccgtgggggcatccctcactgttttctggtaaagaaaaatataatggattttgactttttcttgcactgttagaccactcgtcttattaaaaaaatttggaattattatttattttatttgtgacttactttattatccaaagtactttaagcacaacttttcattttttaatatttggacaattttttttaaataagacgagtggttaaacagtgcaaagcaaaaaatcaaaatcccttatattacgggatggagggagcatgtaggatggccatgccatgtgcacaatgttccctaatatcccaattcctagggaacctttctatccctaggattttacaggagaaaacgtagggcactttcaatttcccccacattgttttcccttggaattgtgttctctatgaatctctttaggactgtgtgccttttttccgacgccacccattctcagataaatcaactttggtagcaagtgatgctgcaggccctgcagcatgtgtatgaatttaccatctatcgttgcatttggtaaaacctacaatgggaggcacgatggttgcatgatttttgtgcagtggatgaaccagatgagcgatcatggattgcaaa

SEQ ID NO: 2335 - DNA, 17254 bp, Oryza sativa
cgatgtgttcttggagcctgttattgatgaccttgagattttgtagaaagagggtgtggaaacttgggatgcatatggtcaggagaacttcacgctacgagttctattgttctgcaccattaatgattatcccgcgctgggtaatctttctggacaaaccgtgaaaggaaagaaggcatgctctgactgtatggaacatacacgcagtaggtggctgaagaaatcaagaaagatggtttacatgggtcataggagatggctccccctacggcacgcctttagaagaacgaagaaaattttcaatggtaagaaagaactagggtctgcccctgcggatttgtccggagatcaggtacacaacatggtgaaggacattactaatgagtttgggaagaaaagaaaacgtagcaaggaggacaagaagaggatgtggaagaaaaaatccatattttggcggctacctcactaggaagttcttaaggtccgtcattgcattgatctgatccacgtagagaagaatgtgtgcgatagcttgctggggctattactgaatatgcctggcaagacaaaggacgggttgaatgcgcgtctcgatctacaggagatgaacattcgcagtgaacttcagcctgttacagatgagaagacaggaagagtgtacctcccaccagctagccatacattgtcgaaggatgagaagatcgcaatgctatcatgtctggtagatattaaagttccttcgggctattgcgcgagaataagtaagtacgttaaattggaggatctaaagctggttggaatgaagtctcacgattgccacgtgctaatcacacagatcttgccagttgctatcagaggcattctaccaccacaagtccatcacatgatccaacggctttgtgccttcttcaatacaattggtcagaagattatagatccagaagacctagatggtttgcaggccgatattgtcagtaccctgtgtcacttggagatgtattttccactggctttcttcgatatcatggttcatctcactgttcacctagtgaagcaaacaaaaatatgtgggccagcttttatgagagaaatgtggccattcgagaggtacattggaattctgaagtcctacgttcggaacagagcaaaaccagaggggagcatcattgaaggttacatgaccgaggaagccattgagttctgtatcgattacatggccgagactgatcctattggagttccttcgtctcgccacaaaggaaggttggcaggtgtcggcacaactggcagaaaaagaattgttctagatcaagcttcctacgcgcaggctcatttcgcagtgctgcaacatatggctgaagtaaccccatactttgaggagcatttagcgaaggtccgacaggacaatattggtcgatcagatatttggatcaacagagaacatggtgctcgtttcaacgaatggttcaaggatcgtgtagtacggtcgaccgatggcccaagtgagatattacaaaggttggcaaggggtccatcttgggatgttgacacatggcatgggtacgatatcaatggatacacattttacaccgtcacataagatgagaaaagcacagtgcaaaacagtggagtccgtatagatgcatatcaggatcaggctggatcgagcacatactacggccgcatagagcagatatgggagctgaactatctaaacttcaaagtccctttgtttcattgcagttgggtgaatatccgcacaggtgtcaaggtcgacaaggaaggcttcacattagtggacctggccaaggttggatacgcagacgaaccattcgtactaacgaagcaggttgaacaaattttctacataaaagaccccgcaaacaagaagatgcacatcgttagggatggcaagagaagaattgtgggggtggacaacatcgtcgatgaagaagaatacaacaagaatcttcatgtcagacctcaaatcgaccttgacgatgatcccaaagacgaagtggcttacgttcgttcagaccattcggaaggcatatcactgtgaatgatgtatttaatttgtattggagccttaatgaatgaattgcatatgtttcatgccattctagttaaaactctttgaagaaatggatttgttaattatatggttttaaaaaattatacttgttattttaaactatatgtgagaaagccaattgttaattgtatgaatttaaaaaagtaatatgaattttaaactatatgtgagaaaggcatttgtcaattagatgattttaaaaaattaataggaattttaaactatatgtgagaaaggcaattgtagattatatgattttaaaaaattaataggaattttaaactatgtaaataagacatttgttaattatatgtgataaataaaatgtaatagaaattttaaatcgggtagaagttaattataaatgatttttataacttaaaaatattttaataagtcatctgtgatgggctttagtactatgcccgatagagattattccatctctatcgggcttagtgctaatgcccgtcacagatgactttcatccttatcgggcagagtactaacgcccgtcacggatgagtgtcatccgcatcgggcatagtagtctgcccgatagagatgaggattgactagggtttatttagtcaatcctcatcccgacgccgcctctcactctctcacactctcactctctcagatccaccgccgtcggcgcctccctccacgcctcccggttcaagatccaccgccgcctcctcctcctcgacgccgccacctcctcccggttcaacatccaccgctgcctcctccctcgtcgtggataccgcctccccgactgccgccgccgtctcccggttcaagatctggcctccccgaccgccagcgcctcctccgcacccaagaccgccgccgccgccggcctcttctccaagtccgtgtcctccatgcccaagatcccgccgccggcttcctctccgcctagtcctcaagaccgacgccgtggccgtttcaccgaccgccgccgcctcctcgtcctcaacgctgccgcctcctcctccctcgaagatccggcctcactgaccacggccgcctcatatcctcctctctagatctacgcccagcggccgtcgacctcgtcctagccgccgcgtcgacctccttcacgccgctgcctccctctactgattgccgaccgccgccgttgcgcaagaccgccgttcccgaggccggggccgctcaagatccggcctccccgacggccaccgcctccctccacgccgtccccgagcccggcaccgcccaagaccagcgtccccgagcccgacgcctccctccacggcgtccctgagcccggcgccgcccaagaccgccgtccccaagcgaggtaggtactcctcaccgatgatgatgcataatgtgatgatttgctgtgtacatgttatatgtgatgatttgatgattcgatgataatgtttaaattcgataatgtgatagtgcgattatttgttgattcaatgtttagatgctaatgtctacatatgaattgtgctagtgatgaatttttgtatggctgtgatgacttgtgcatttttatatgtgttagctaatgatgaatttttatatggctgtgatgacttgtgcatttttatatgtgttagctagtggtgaatttttatatggctgtgatgacttgtgcatttttatatgtgttagctagtgatgaatttttatatggctgtgatggatgaatttgggggagaatgggatgttgggaaaaatgtttagatgtgggctgtgatgatgaaatattgtgggctatgatggatgaatggccagtgatgattgctcaagaacataccatttttgggatgaattgttgtgggctgtttttctatgtctatttttttactgcataaggacagacttgttcttatatagttgtttgcaaaatatttagggtattttgggtccaatgggatggatgaattgatgtgggctatgatggttgaattattttgggggaaatgtgagttttggtatgtgacctgtgttttttatggctgtttttatatggctgtttttttttgcatgacagaccctctacacttgttcttatatggttgtttgcaaaatttttgggatattttgggtctaatgggatggatgaattggtgtgggctgtgatggttgacttattttgggggaaatgtgaattttggtatgtgacctgtgttttttatggctatttttatatgactgttttttttttcataagaacagaccctctagacttgttcttatatagttctttgcaaaatttttgggatattttgggtccaatgggatggatgaattgatgtcggctgtgatggttgaattattatggctgtttttatatggatgtttcttttttgcatgaggatagaccatctacaattgttcttaatttcttttgggggtgggggcagttgcaaatgatggtaattgatgcataatttcttagcaaaactgaggccaaacttattatatgtcatgacttttgtttttttaggtacaaaaaataatatatatgtgacttgtgtagtatgggctgttttgggtgattttgagggaaatgggatggatatgcatagaaatctgttatcaaatgaagttactgaaattatggcatttaggagaatacgaagtgtcccagttgccaaatctggtttggtcgggttactgcctgcacggtactgaccaagacaaattggtaaacagaacatttcattcaaatacaacatttctagaaatctgttatcgttaccaatatcctagattgctttcaaggtcatttctttaggaaaccccattcccataaattcagtatccaaagatggttgttgtatctatgggaataagggttccctaacgaaatgatcttggacgcaatctaggagtttgctgataataacgttagggatcttggataggaaaggttttggttgcctgtgtattctatctgcgtccgcctcgtcagcagatatgtagcatccatgttccttagggccggaccagacgggatctcgacctggacatccatatcccactagaacttgctaccgttgccactatcttatggtagtgacattgatagcaagttcgagtgggatactgatgtcgaggtcgagttttcggctgctccggccttattgagcatggatgctatggttccgtcgacgaggcgaacacaggtaggagatagaggtatatcaaaccatcagagaatgtgtgtagatgcaattttgtgtttaaaaagtactttctccccgtacaacagtgacataggacatgttgtagcaaggcgaaccaatgtcgacgaccactactgggactacttcgagccggaatcctaggacccagaataagattcctaaggaagtctacaccataacagaggtggatgatgtttgatatccgacggctccgacgaaagctgtcaaaaagttccctacgatatgcggagtcctagggaggcgaaacttcactattctgaaggaccacatcgatctggtccctcaagaagaagaagaagaggcctggaggcagttcaaggaaagcttccgataccctacagaggccgaggcaggactcaagcggcagactatccgcaagatggggaattgttggaaaaatttcaagacaacgttggtcatggagtacgtcctcaaccccgcccagccaaaaccatttgggaaatacccattcatcacccgacccatgtgggatgagttccatgcctccaaatcaacgaaagagtctcgggcaaaaagccaggcctaccgtgatctgcaggcaaggaaccttcacccgcaccggcttggcaccggaggctacgcggggaaacagtctgaataggacaaggaggatgaagctgcagcggaatctaacaccccgcaagtgcttgctgatatcccggtccagcgggcaaggaactgggcaagggcatgggtgaagaagaatagtgacgaaactctttcgttcccaaatcccgaagatcaagcggtgtaccagaaaattgtaagttgaacacatagaataagtttcattatgttgtatcgtattcttcgtttaacgcgtcctaactgtaccgcaggtcgaactgaatgctgagagacaggcctcccaagaggtctgctcacaaaaacgcgaggatgacatcttcacgaaagcgttgggaaacgaagaacaccgtggacgaacaaggggcattggctccaatgttccatgaaagtttgggtttccccaatacgtgtggcagtacaagaagcacaagctttccaaggcgtagaaagctgcacgcattaaggcccaacttcgggaggagcttaaagaagagcttagagaagagctcactgccgagctgttaggtatggaggctcggatggaggcacgcatcagggataggtcgaccgatgccactcccggtcccatagtacaagtgagccccacgcagaggcgtagcagctgcacatcaactgaggctcctgcagaacagcttgaaggccctgccgcggtggtccacataatggtaaaaacaacttaataacgcatatactgtattagcaccacaatacattgcaacatatactaaggacactaatgaatctatcgcaggaacccacatcgtgtaccctagtcattaggatgacaccaggatttgcaattcctgccgcagagggtcaagcattcaagcctaccccggagacctgagtgcatggggcgcagctgctagccagcaatgccgaagttcaggtggacttagtgaagcccaattgggttggctacactatcccacacccacctaatgatgagattctgacccttggggctgcacgtgggacctttattcaatggcccaagcacaacattgagatcaatataactccaagcaagagggcgaaatcttctccacccaagcttgacacacgcagaaaagctgctggaacggggagaggaaaagtaaaggtgccattagccccaaataagcttgatcttggcaaggcgtcaggagctcctccaaagcctccagccgaattcacattgggcatgccattggtcggagacgatgccttattctagatgggcctttcatgcaaggagttgcatgggtactacatggagaagtccaacgcaaggaggaataatagagagacctccatggtaggccagcacggtggtcagccgttcctcaggcctactgccttcatcgccgtagacttcaaagatctatgagacctctatagggtgcgagcgatcgataccaacctccttaagtgctactccttgtaagtatttcttggtacgcgatatggtagtgactgtccataaattacacttaccgtgactcttgtcttgctcgtaggttaacctggaagcatgtccatcgtaaagcaccccatgttgccttactcgatccagctgtcatcaatgagacaacgctgaaaaacgatcgagcaaacatagtgggctatatcaaggactgcttatttgcccatcaagacaaggacttcactatgtgtgcctacaatcaacagtaagcgtgtaccgtacttatactcaaatactcgacgcgtacaactgtagtatgtaactggcaatttaataatttcgcaggcaatattggattcttctggtaataacgccgaagtggagtttgatacactagcttaactccaatatcaagccagaaatatacgattggtcggccatcgaatctaccttgaatgaggcatgggaccaatacgtggcaagaggcgggaggcataaggatgggcatcccaaactcggtcacaagaaagacttcccaatacgccaacaagttggcgaccagtgcgggtttcatgtctgccataacatgaggagctttgcagacaaagtgacattgctcgaccctgaggtgtgtaattcaattgtttatacacacataggatgacaaatttacaagtatgtagactaacttggcgctgaacattcaggaatttatttcaaggatttcggaaatcaacatcgaaatcattagagaggagatagcacaattcatactagatgatatcttgtcaccgaaagggatgtttagagtgaagtcctaggtagctcgtctcggaatggcagaacatttgcaatgcatatgcgacaaacatttgatttttgtaaatattctttgtaatacgattatattctttagagtaatgtcctaggtagctcgtctctgtatatacttgcatttctacttacatataaaattgttccaatttataacttagttttgcaggttttgatgcatgtcggcggtttggagagaaaaatggatgtgaatgacatatatatgtgaatgggttgtggatgtgaatgtatatgtgtttgattttgtgaattggctatgctgtgatggaatatgaatgtgaattggctgatgtgatgctgggaatggatctatatgaattggctgtgaattggctgtgatggtatatgtgaattgatgctgggaatggggttgctgggaatgggactatgtatatatatgcttctgtcatttttgcagcgggcatggctagcaaaggcctgaggctagccaaaaagacaaattttatttattttttggttctaaactcatccctgacgggcatttagctaatgcccgaaagagataactcatccgtgacgggctatagagtcaagcctgttagagattagtcatccgtgacgggcttttagaatacacccgatagagataagtcatccgaaccgggactagtttgactcaacacgtagggtcaaacctatcggtgacgagctctggctaaatgcccgatggagatgactacttatccgtgacgggcttagtggtgtgcccgattgagattagttatccatgacgggttcctaactatggtggtttgactggtcatactcatctatgacgggcttggttgtcagcccgattgagatagcatccatccgtgacgggctttagcccgattgagatattttctcacatcagtgacctgtgcccactgacgggggccttacccgatagtgatgaggctttcagcccgttagagataagcgatcccgttctagtgaggttggatttccttacgtttccctcgtttgaacttacaaatgtacaacccaactcgtatgcaatatataaacttgaaatacaaaagttgtctcgttcagttttttgttccatttataatttgctgtctttgtgagttcacacatatatgtttatacttaaacattgttatccttttatgcttataatacttggggtttccgttagcccgtagtaccaaatgcctagtggcactactacaaaaaaagctcatagagatcggcactgtaggtgccggaccagctaaaaccggcacctataatgcttttccctcctctatagactgaaaatacataaaaccgacacctttaaacaacaataggtgcccgttctaaagaagaacctacacctataatataagtgccagttttctttaatataatataggtgccggttttttaaagaaaaccgacacctataccataggtatcggttcttctttagaaccaacacctataataagttataggtttcgacttatttaaaaaaaaggcacctttctaaaccaagccgagccgagccgagccaatccatgccgacgccctatatgagtcaaacttatcggcctcatctctatctccctctctctcgccttctctcgcctcctctcttggttctcgtctctctctcgtcttctctctgcggcgggcgacgggcttcggcggcggcgtgatggaaggcggcgggcaacggccggcggcgtgatgggaggcggcgggcggtggcagcgccctcccctccacaggatctagccagaggggaggcggcgggcggcggcgtgatgggaggcaccgggcgatggccggcagcggcgccctcccctccgccggatctggcgggagggaggcggcgggcagcggcagcgcccttccctccaccggatctggccggaggggaggcggcgggcggcggcacaagaggggcccaccggcggccagcccctcttcctccctcatctcttctttgtagatttttgattagatgttttgatcaattttggtgacggtttgtgaatgattatatgtgatgtcaatcaattttggtgacgatttgtggataatttggggatttgggtttgggcacatggctacggtgctcagtgagttcggctcgattcgagccggctcttttttttttctcgagcaaagctaaaggtgccggtttatattattggtgccgaccaataggtgccggttggaaaaccggtacttatagtcgattcccaaccggccccaataaccctttttgtagtagtgtggacaacactttaaattgccggggagcaatgaactacctccggcgaaaactcacacgagagcatgcacacaagaaataaattttgaggattattaacacacaacgggatatgatgacaaacaccagccacgcacactttttcttattgcaattcacacacttggtgacaaccaagtgatacacggcggcttaaggttgcgttcgtttgtgccggttgagagtttatccctccggcataaaaaacggaacagcttattagcacataattaattaaggattagctaaaattaacttaaaaaatggattaatatgattttttaaacaactttcctatataatgttttttttacaaaaagcaaaacgtttattagtttgaaaagcgtgtacgtggaaaacgaaggagaggggttggaaacaaagggtgccgaacaaagcctaagtagcctcgtgtacatgcattctgcagcttcaacgacttggctaactcatacgaatgcatcagccatcctcgcaagtcatgctacgtgctccactcatatatatgcatgcagctacggattctactgcaccacttgctgatcctatatataatctagctataacagcctgagacttactcctactaacacatacagcacacgcacgtgcagttactaattgagccatctacacttgcacgctagtccagtacatgacatacatgaatcctattagatgtctaatacgtgaacacccataacatatatctagctaacataaaccttgtcaagattagtgctaacagatcatggacactatggactggggcatggtgtatatgtggtgtactcgaatcttagacgatggtcctatcttgttcaaccttggcttctagttttctcctttacaagtttgaattcatgtgagcttagtagtgatgctgctcacgcctgtttgtgttggaaacacgctcgcaggcctgtgtttttcctgcttcgtcgtgccgtgctcgtcgatcgtgacctgaacgtctgtgggacggcacggatagtgatgaccatgacacgtgtttagggtggcttgaccacatcatgataatgtgtttcggatttgtaagcatgcagcgagagaatctcggagaagagcgctgcgatgtttttggcagcacaccaacttgatgtgtcgtccattttggagtttcacgtgtgtgttgaattcgaccaggagagctgatttaatacaacttggaagagatcgagctttccgcggttcaagttgcgccgatatgttagcgttggagaaggatgcatagaatgcatacaaaatcttgtaaaatcgagaaacttggaggaatggatgctatttttttcaattgagaatgttccattggaatcaaatccatgtctaatttcctgcaaaacacactaccaattttcatccaagtgcacaaactgggatcgctggggtagaaaatgtttaagcagactatccgtatccctgtctccatggctgtatgcttgagctttggaagccctactaaacccatgatgcatccacatggaaaaaccagcccttatatatctgaataagaatcatgtctgaactctgacgagaggatcgatgatgaaaaaagaagtacataagtaaccacgtacgcgaaaatttaattcatgattcagccatgtctctgtggaaggcaacaactagctagctagctgcactctcagtccaagggcttgggcccaaccacctccatcgtcgcacaaataatccatggctgcctgacacagtgagcccagggccctagcccgaagcccagggtcgtcagacattggctccgacgcttgctagagtaacgtaagaggtaggcagatcatgcagtatgtttcttttccaatgccatccattctcaagtaaactgatgtaacagtgttgctgtagtacgtgtatatgttacaaacacgaacagtgctaaatagaaagcattacctatcacttgccagggatagatctagagtctggacagacgtacgacaggaggaaaatcacttacttggatgggatgatagtttgcttcctgcaaaggatgaagtagatggatagaaaggatgaagtagatggatagaaaaagcttatgaatacgagagtggaagtagccacgggacatataagaagaatcaatactcggttggtggttgtagtaagtatactcccttcagactgataatacttgtcattttagataagggtgaggtcaaactttacaatctttgattatgaatcatttttaaaatatttatctttcatatatggtgattacatgtatagattagtcttaaaaagtactttaataaaatcatatattttttaacattcttatacatattataatgaaaaataatggtcaaagttgtttttttgagaccatgctcttgtccaaaatgacaagaattatcaacccggagggagtactttcttaactttgaagaaagcacggctagaaaagcaaatttccagacgatgacatttttttcaggtaggtaggcctctccgagctaaatgaccacctgcgaaaatgacaaccgtgaggtgaaatcgttgtccacctgcaaaaatacacttaagttgatcagaagttgataactatatataccatgtaggccatataaaggaaactgaacgagatggtctttgtttttttttaacgaatcgcactagagagtgtaaagttctactgatagagtaggaaaaaataacaaaattacaacccttgaagatggtaaccaggaaaaagaaaaaaaaagtatactaccactcacacacccacaacgccaacacatagactcaggagaaggctagcatcagaccagccaccgctaagtgtaaccgacagccactaagccgtacaacggaacacagccgacatcgcccaaaacccgaccattacaactgacacaaaacacagctctatctaaatctttgggattgagggtgagagggtgagagagaagaatgcagccattctccccctaagccctccaacgtggccaacttgcggaagctaggatgccgacataagagaatatgaattagagagagcttgcaccaattgcttgggagattttggcaagggggtgcctacacggcatctctaacgagaggagcgatggatacaccgccgccgttgtccgtcaaggcctcaagagggccaagactgggttttcacccgatagccccactggaggtgaaggggcggcacgacaacgccctcaagaagggtaaagacgttcgaaaatgccgtcgttgctagcccggccaaggccaaggccgggctaggtttttacccgtcgcctaccgcctgcgagtctacaaatgatgccccgttgctccaccaccgtcaagcctccacaggcgcgtgggcttcactgcaccggctctccccaccggttagcctttgcgtgccgcgccagcctccaccacctgccgaccgcgcctcgacgtgctgcgccggcctccgttgccaccggtggcatctcctcgcgccgtgtcggcctccatcgccatcgtccgcgcctcctcgcgccgtgtcagcctccggccttgctccgcagccatcaaactgctcacgccgtcgctgtcgcccacaacccaccatgcccgcatgcggccgtcgctctccttcttccccattgccggtcacctccttcctcgcctcctctctggctatcgccgtcgtcgacacgccagtccaccgcatcctcctcccgtgcgccggccgtgtcccatctccctgcatgccagcgcagctccagccggcttcgcgcccgccgctgctagcagccaccgtcgctgccgccagcaccactggtcgccgccaccaaaaccactcaagcccggctgccatcgccagccgccatccccgccagatccgaccggcgcagcgcggatctggtcggggtgctctgccgccgccgctgccaccactcagcccaaccgccagcctccaccccacgagatccggccagaatggcgcggatctggacggttgccaccaccgccgccccgagcaattgccccgaccaccggacgcacgctgggcgcagccccgccgccgccgtccttgcggccacgcggctttgcctacgcccgctcaggcggcggcgaggcagagaaggaagaagggggaggagggagttggcggtggcgtcacctctcgtgttgcccatgtggagagcgacacgagatcttatggtctttctattacatccacaaatgttttcttttcaagtaatgttaattactgatctttcctccaatttttttttcactcactaacatatatatgcacgtagaatatgtagtttatacttgtagcacatattattagtgattttctcttaccactttgtttcttttttgtcaccaagagatcatctctaaagctttgtggtctgtatggagtcgtcaagtaccttcattttgagaagatactaatcatttctcatgtttactagtcccaaaaaaaaaagtacgatcgttacggcagatcggaattgtatcactgtttgcatgcacagttgcccttcactcgcaagctcgtaagagaatcccagcgcattcttgtcatcaacgcatgcccaagttagggacttggctatctaccagcttcggggacaaaattgtactgccagctacacactgagccaaattcagtcactgagatcaagagagaggtccacgatatttcatccttttgccttaattccaactcaatgagctcagtgtcccgactcccgagccaccgcccgggatcgccagctggtggttctgctggtgcatgaactgtcatgcatcctaaagtgaacatccagtcctcttcttctccaatgctacccgttcttaaaatgaaatcttttagcaagctctttacaaggtacatgtttcagaactaaaaaattacatgtaaatagcatgagttgttttatatggcagactgatatatatgagttgatttttttttttttgcacgcgagagcatgtacccacagttacaccatgtatatatacaccttgcacgaatcctagggcagttacattaaggtgctaacaaaatatacctcgcatgatgtttcctttatactatattttttcaaatgtaaaacatcttgtttatgtgttttttttatttcttgtattttatatggttgccctattaattttatatgtttaattgcttgagatgtttttccttaatatgtttgatgaactgtaaaacatggtagcatatatatatcatttcgggagtatcatttttgtaagatgttaacctggtgaaaaatatattatgcaatttttcatgcgacgcttctgttgtatatatatgattcgtacctgggacccatctgtcgacgtgtaacatcctttctgtatgaaaataatattattctgatgtctcactataaaaaacaggtaattcatatttggcattgtagatataacttcaaatgaaaaaaaaagcattaactataatgttgtagatattgccgggcagtccaaatttcatatatagcttttccccatacgacgtcatttgaaaattttaaacattcttccgtggaaatagatcccaacactttgaacatctaaataaaaaaaatacatggttcaatctttcgttttcggtatttgtattaggggtgccgatatggtgatatttccgaaattttggtccgaaatttcaaacaaaatttagttaaatttaaacaaatattgctaaaattcatgagaattttttttaaaaaataaaatcgtatcggtgggggtggggtccgatatgaccaaatcttttgaaatttcgttcggaaattttgaaccctgacacaaatggatccaaggaagttgtagaactcgtcgaactctacgattttgccataaagtttttcataaaaggaaaaaactatcatttgaatatgtcggccttttccaatattcaatggataggtccgaactgtccggtcaattgagtataaatgctggttcatgttatgaagaaccagtgatgcttgtttcctatcactgccgatttataacaagaacaactagcagtgatacaatagtaatggttcataacaagaaccaagagtgatattcaagtatcactgctggttcagagtagtatcagtgactgttctaaggaaccaacatcatgggccggtttgatttatttgaaatgataaagtatgtcctagaaagaaaactaaactggaagatggaatctgtcaacaaatttattttctcgatatacaggagaactacatagatgcattaagaattgtcagtaaaatacaatagctgcttttacttcctgcctactatacttttatggtggtgtttactagtagtagaaatgattgacaattgatctctcttttatttagtaaaccatatcaatttaataacaaatattatagtgaacaggatatagttgtgcaataaagcaagagcctcataaccaatgccacgaatcgtttctacttgcggtaaagaccattataaaagtggccataatggaatacatatggattcaaaatagaaatcaacatatttttcttttatagtcatactgacaacctacttaaagtcgagctattgacgaacccgtattcttcatggagagctcatgtgaataattaaccaaaatgtatatatggggtgtgtctgcaaattttcaactgccgatcgttactgcgtggctcttgtggcagccatcacatacagagcacaattcaaaaaagcacacccttaaacaaagttat

SEQ ID NO: 2336 - DNA, 2116 bp, Oryza sativa
ccccttgacatagcagctgcactgtgaatctctgctactttaaaagccagcggtgatggtagtgtctgcctccaccacttatagtttaatataaatatatgttagacacaattagaatgaaagaaatgagagaataggatagtagtataatatggataattttgatccttcttcgtgtatattataataacgctttacaatatataattaagttatcttcttaacttacgtacgattgcaaggtatggacatttaattagctagtttgaataaatgtcaatatctacagttttttcactggcttattgctaagtgctaagtttcttttagataatggataatatctgagctttactttaacggaagctacaaccacatatatagttcttagctgaaaaccaagtataataatttttaataaaggataaagaaacgatacaataataaatgccacggtaaaaaaagagagacacttattcaagaacaatcctattgttaaatctccatccaaagttaacaaaaatttgcatagcggttgtctccaattttcgacatacagcgtgaataaccaccaatgtcctcttcacacctttgtagttgggtcaaaaccgaaccagtatattgctctgatgagtacatgcatataaactttagttggtattttattaaaaaccatatcattcctatttaaccatatagccaacataaaaggcagatgctctaattgaaatatgttttttggtctttgagtaaatcccaatcagccaattataaaacatatgagtattgtaaaccaaattaaaagacataaaaatggttctaaaaaaattagccatttgacaatcaaagaatagatgttggacataaaaaacaacatctagtactaccattctaatttcttcttactaaattatcattgattaattagaactaccctttagctagataacacatgaaaatcttaagtttgataggaatcttcaatttccgtaacactttattcctatcaatatacccactgttgatcatagcaagatacatggatcaaacagaaaagataccattttgatgaaggttccacctaaacatatatttattatcattaaggttaatacgtacaattcgagcaacaaaattttgccaattaactatattctggcccactagttccctatggaaagaaacattcaaaggaactgtattcatgatagttgcaactgacgcacttttccgacgcacaatattatataaagatagataccaccctttaaaagaagagtttccaatccacttgtcctcccaaaatctacattgaggacaaaagattcaaaacctagaaatttatttttaacttttattagacccggctagaaatgagagtcacctgtttttttaaccacttgagtaattgtctaattatgtagttatttccttcagagcatttactgccaaacaccatcctcattaatcaatttagacaagcatttactaagaaaatattgtaccttttgctcttgttttgtgggtgcagaactgcatagtatttgaagaccaaatttagccatggtccagtggtagatagtgatattttttgaatgcttgcttcttcttatgcatgtttacaaatgggttgttaaatattgacttgttgagtctaattactaaactataatatcaatatcaatgccattaaagataactcattttaaatttgcaagcatggccatgggccatttggccacacctcattatcttttcgtcatctgtctctggtttcatgtgatggatgaactagatgacctatcatagaagacctatctacgaagtatataaatagggtgaggttatgcgagattgaaaaatattatggcaatctaggtcttcggagaattaaagctaaaaggaagagatggcatttgtgtcctaagatacaatgaatgtttttttaataccttgcctctaaaaactgtgttgcaatgtatgaaataagtaaatagatcgtggatcaatatttatggatgagaatcttacatttaggagaggtaaagggatcttcttaaacaaagggaagacgcggggcggggagcggacatagtaggtgcactagtattattat

SEQ ID NO: 2337 - DNA, 9005 bp, Oryza sativa
tgccacgatcaacaaattcgttgcaataaaaaaattatcgtctcataatttaacttatttttttcatatggacacaaattgagacaaattttatatgggaattatagctgtcgatgagatctacaattttataggtgacaacattttcatttgaaatcttttagatatttaaatctatgattcaaatctcagttaggtaaggttcaaatggaacgatatgtattttccaaaagaattgatgcgtgtgtgagttggtaaaggaaagcacgcgtgaagaatagatcttgggttcgaatcctagccaagacacaatatcaaaaaaataaatagataggatgataaattaatatttgaacctttaatttggtacgtagaactaatgccaaatatggagtggtggcaatagcttttattataacgatgtgaagtgttgcaatatgattttttgttacatccattccgtggcaacatcgaaatttattaccactaaataaaaatcgttgcaataacctattaccacgctatttattacaacggctagcaacaattttaaaattgtggtaacatatatctattgccataattttagtattgataccatgatttttttcgtggtaacaaataatttttctagtagtgcatgtaacctgttctagtctacgatgagtgacaccagtgcaccttaccaattaacgccatactcacacgaaaacagcagtaaccactaattgagcaccatttgttctgcccataaattacccttactaatttagttggccacatgcccacatcggcaggcggccgcagctagcagttctactgtttgcaactgccagccaaggccctgagcttctaattttcttccatgcatcaggttcagtaaaacaaattagtggcggtgctattatttacatgtgtatctaataaatttagttcatagtagtataatttaatttcaccaattggacatgcggtatatatagaaactgttgttgaaaatatttttttaaacatggtatttagatataaattgatataaaatattcatttatctatttttaggctactacttctcatgtttgacgtcaactttgaattgcatgtagacatatgattgctaaattatctctctattgcttgatttctagattaataggtgggttcatctcatttctctattgtttaccattaattttaaacttttcatatgtattattgactgtacttagaaaccaagcttcttagtagagttgatgatgacacaccatcgatcaaaaatcctggatccccccctgttctccgcctcacataatctagcttgtgtgacatcactactagagaaatcattattaacgacagaaaatatggtcgttgaaagtccaaatgtggtcgttaaaggtcattaacgaccatattttttgtgatcgtcagtggtcgttaaaggctccgtcgttaataatattaacgagcacgctaactttttttctgtcgttattgtactaacgacggagtttctctgccatcgtcatttctttaacgactgtgacattgtgacatcgttatattcattaacgaccatgatttgtgtcgttatttttttttaacgatgacaacactgtgtggtctttattttattaatgacgatatcacattttttactagtaatggtaatgtatttagattaacgagatgttaatagaccaataaacgaaattattgaccactctttattaatcaaatgcaaataatttaattcgttcattacatataatttggaaatgtacgtccataatgtactatacatctacaactacatgaaaggtcttcaacccagtcgtagaactcttggcttgtttcatccatgttgtgaacactgcaaaatccaaggtttaaaccaatcaatacacaaatgaattgtaatagcgatatgtggagttataggagaacatataattcagcctgtataatagagcagtctgaatgcttatgttatgaactagatactacttttacaccaagctatggtaagtgtaaacctaacaatatctaagttagggtcaacattaatagtccattagtctgttgattattcttattgatttctccaaagcattacaagttggggatgtatgctatcttattgaacttggaaaaaaaaaggaagtggcaagccatataccagactatcagtgcatatcatattgatgttgatcaaatccaagaatgttgatcaacatatataaatcatcctgcaggaaccattggaaataataacatctgggcacacaaaataagtttctttgcactttagctatgtcacactggaatctgtccatgaagagaagggagctgtaatatgagaaactaaacacattttaataaatccaaatggaagcaagtgtgctctgctactgataacatagagcagggcaaattcataccaataagtagaatatgttaaataaactatcaactgcctgcaagaagccatgaattgcagtacgggaagataaatgattgattgaaaatgaaattatcgttttgtcagcggtatcagggccatgctatatcttgttactgaactgtaaacattaaacaatatgccaagatgcctccacaaatttgcgtgttcacagaagaagaatcccgtaattttagataaataaaccaatcattgtatattgactagattatcctgcaagaaaaattgactttcctctcaagtattatgatcaaactcaaaatcattcagaaagaaaaaagaagttatgcgccatgttgaaaaaaaatataccttgttgagacttcatggatgaatggacatgagagcatgaatggaggtcacactgccatctataacaaattctaagttcaaatctacaagagtagtacaaatcacaagctcactcagtataactggtaaattaaactgcaatgggcaattgggcatagttacaaattgttcctttgaaaaactagcctgacagatcagcaagaaaaaatggctatgtactacaggtcttatatattccttcatctcatggaaggaacatatcataatcctcaagttaaacaattaaacccagccgtaatttggaaaatagaattacaggacgacaagggatatcatggaacgaacatatcataatcctcaagccacaacgctaaaacaaggcagagaaaaagttacaagggatatcatctgacctagttctgccgttcacgcctcgccgctgttccatgcccaactgctaagccgccgttttcggcgagtcagagctgccccaactgggcaggcgctagggcttggggcttattggcggccaaatcttgtcctcgggaaaagcctggagcgggagcaggcgcgcagggatggccggcgaccgctgggtgcagcggcagtggtgaccatgtagggggcgtcggtgctggtgcaccagtgcagcggatctaagccggcggggaaggggatcggtccaccaatttcgttatctatagaaaattctgaactgacgccttattagcgaccacatacacgcacgtagtaacgaccagcgattacatggccgtcggagggcctaccgcggcttctttgactatcaacgatcagatgtttgttaaggttggtcgtgaataatctaagttctagcagtgcatctgggcgtgaccgatgtatatttagctaactatgacccatggagcaaacaaaaaaaagagaggaaggattgtcgaatcgaagcagtatgttccttcacgtacgaatagccagatttgttccaaggcatgcaacggcatcattgtccgcacaattgcccttgcactcaggcaagctagcgaaattctgcgggcattcgtgtcatccgcacatgcccaagtttgggattatgctttcgactgatcatggtcaaggatcattccgtagatcgctttctccacacaccagcttcaggcacaaaatgctagtggctgcacactgggccaaatttggtgctagaccatgcgaaatgtcagtgtcaaagacatgccctagcccctttccatcccttgacctcaattgcaactcaatcattccatggctgcattctgatgagctcattgtctcgagccactgatcgggttcacagatagtgggtcagttgttccgtggattggtgaattgatgtgcatgatagtgtgtatatctgctgtgctacttttccgacgccacccattcttaaaataaaaatcttctaacatgctctgtgtagcgtacatgcagacatgctacataactgtaagaatcgtagagatagttgtattgttttatatggtagagagatataggaatcaacccctgcttattgatcaacataaatatatataagatgagaagagaggtgaagtatatgaaaacaaggtttggtggttgtagtaaagtatatacagaggtataaaatggacacagataactagaccagacaaagtagatcctagaaagaaaacaaaattaactagaagatgaaatttgtcaagtaaaatgcaaccgctcctacgtcttgcgtactaacaccgatatggaataatagcttttatggtggtatttagtaatagtaaatgtagagttcctattttttaattaaccatatctatttacactaccaaatcaattacttataatagaacgaagggagtacagttgtctaataaggtagaaagtgttagatcaaggtgttttgattcttattctgtgatgaacaattagcatcggtgattattagttttgatatttggaattaatcttcgaagtggttttggagatgtttggatttacaagtgttgctggatatgtggtccggtcagaccggcggtatccgtgcagtcagaccggccgacgctgtgtcggtttcggtttcggtttcgggttgtttctttggatatccgagtttgtttcatatttatgacttctagatggatactatacgtatgtgatactgttgtttgctaacaatgagtcaagttggtgatagcttggtctcggaatatgatttcttttttggttcatgtgtaggtgactcgacgcctcgggatagtattttgcggtgatggaccgggagtcggcttggtggtaagacgatgtccgtggtggttagagatcatgcgggatactcaggctagagttgatgcatgtggttggtgaagattccatatggcatacgatggaggtattgtgtgcgtatgggatgcggagtcgaatttggatggagtccaaatttggtatgattggttatgttaagtttgttttttgtactagaaggtttcctaggtggattaggacatctagtatgagtttggttcgtggctttgggctgcttacctcatgtataaatagagggggagcgtgaggcttcctggtatctcttttgtgttgcttttcatagcgctgtgttttagggtttcgagtttagtcgagattttgtaaggagtgctgttgttgcactttgtaaacaaagagagaagtaataaagttgtcatctacttcgagagttcttcgatttgtgtttcatcggcaaggcggcggtcagaccggcggagcgacaacggtcagactggcggcgtcaggcaggcgcggcaggcaatctcggcggttcgactggagcttctacctcggtcagaccggaggcatctcgacggtcagaccggtacaacatcttcggtcaaaccgcgatccatcgattcgagggtaacttttattttccgctaaaagtttttgggtctttgggtataccaaccattcaccccccctctggttagcttagttcttgtgattcggtcctacaaaaagttgttacaaaatcattcttaccggtagtgtatataagaccatattataaagtagtgataataaaatatgtatgtcatataatgaggatcagcgttattcttatgataagaaatggttcattacttcaataaactgagaattatgtcacatttcaaaatctatgaagttcatgtaacggaaattcgtttatcacctaaaatgcgtccctaatcatgttttgtaccgaaaatgtatttttctcatcattaatttagtgatgatccttctttcgttattaactttatgatgctcatcttttcttccaatataattggtatccattaaagatcatttagtgctataaagctcaaattctgtgaagctacgtcatccactaaaaatcaaccgttagatcattcgagggagttattctcaaccatctgatcatctccaatatgctcctttccgtggcccattcacttgattaggagcattggaaattcttctcagcccaccaggcaatgaggcatggagaccttcaaccttcccctgcagacgtcaccaagtcatgcggaacccttccaatcgtctgctgcgtcatctccgtattagaggaacggctgccatctaacacggcatacgaatcgacggcaatagctatttgtatgctgagtaaatcgctcattctttttcacgctaattaactttccatctgttacatcaccttttgctaaacaccacgatgggagctgaagcagcccgcggcggatgcatacacaccgctggctatggcgaaacctcagcgaacatgtcttggcttcaggaactgacggagctgctgttgcagcaacacagtaagtaatagagagattgatcaatcttttttctttatgacttttgcctaattggtcgcagctgtggcggttctagggactgaatgcaagctttatagattgtagactcattctattcaatccacggtacatcgctgaaatatgaatttctgtcttggaattaatgtttggcttatttttgtttttgatggcgaaatatatggttgatttaaccttacagcacgcaggaaaatattattggtagaaatgattttgttttttcaattcatattcagggtatcacataactctggcttcttgacatatacaagtctctagcggagtgtgttctcgatatatcagcacagttagtctatccttacttctttttagaaaaatcttattgctttaattgtttgatttgatattcgtgcttccaaataactgtctacgaaacatgtctatagaaatcgaatggactgcaaaaattaagttcctccgctctctttttttttttgctgtttagtttatcttttacaatgtcagaggaattttattattaaagaatgtaagaccaggcatggaaatatgcgtgtattcggtaaaagaacaatgatcactagcatcattttccattacattacaagatattgtgcctaaggttcagcgctgtgggtcttgctacctgagtggcagtgcactggacatctgaccaaccctacttgagtcttttttttcctttctatttacttagttatttttttactaagacttacaactgctatatattaaaataatagtaatatgtacatgaatatcccgcagcaacgcgcggggtgtcatctagtttcatcattatctaagacaaagaatatcccaaaatggcttatggcctatcaaggtccctatagtgagcaacttgtttatgggctaagcccaattatatgcaggcctggctcatttaaggagtagcactttactcatgattttcagctcaattgtattatatctatttgtattagtatgaaataacaaaagggccaagcccctcgcgcaggctccatcatgctaaaatatgcttaataaacattgatgtgcttatttattaagatcttgtataggatcgcatctattccccttgaaacctgtttggcatgtttatgcaacttctgatttcttatagtaaataaataagtttataggcaaaaataaaatgatttataatcatctagttttagacttgtgttaacagtatcgcacgcttatacaaccatagaatatgatatatcctcaggtccaacttctcgattttaacgtatcccaaccccaaattatgcaaaaatgggcactatatggataagaaccatcttcatacagaatagtgcacaagtcctccgcttcggtcaagtatttactatgtttcgagttaatatgccaagggggcaatgcatgccatatgttacagatttaggccccattaattgcaaactagactgtatgaattttagaacacttttttttaggaattagtttagtttgcacaaaatttaccaagaattctctccattgaaataaggcctcgcatgttgggaaaacaatttgcagttaagtctatggaatgtcctatattgcatcggctatatgtcaacaactccagtcaggcccaatactatgctcgtaccctgctagagctacctaatttcatgcaggtcatggcagcctgacagcctatcgatctgcagtgatgtagtgagtacgcgctgcttggcggcaccccagggtcgtcggtccatgcctctacctttgggttgcctggaattctcgcgtaatccgctggatagcatggaggtgaaccacgtttcttttccggtattgcctattctcatttctcaaatgaatgaactctagtaacatgtgatgctacatcctccctttataaaaaaaacgacgaatcttgtgtcatccaatcctagattagcttttttttttttaagaacggagagagtacctgtagaagttaataaacatgaaaatgcaagaggggaagagatagaaagaagatattgttttatattttatttggcaagcagatggacgctgacagattgcttggatagggaggacagttacatggtttcatgcaattgacgaatgactgatcatggccttggtagacaaaaatgaaagaacacagcatataaataagggaggctggaggaaaagggtacgaagaatccttgtaagttttttcattttctaacttatacttataagttaaaggcatgcaacataaataaaaaaaaaagctacgattactatatgtctgttctcagcggttcaaaactaatactaaaaatataaaagccatctgt

SEQ ID NO: 2338 - DNA, 10499 bp, Oryza sativa
  unsure (1)..(10499): unsure at all n locations
gcagttgaaaagataatcttctctcgaactagattactccaaagccgagtgcttcaatcatcttcttcatggtcccccgagtacttttaccaaatctgaagactacggagggctgaacaaaaattgaatgtagacttaggtgcatcgactagatgcacctaataggtgtagctcccgactatgtggttagttgaacaaaccaagcatatagtcaaggaataaataatccaaccaacagagtggttttcgataattatagtcaaccaagtgacttgatatcaatatacagcatatgcggtgtgaatctccaaataacatgatccgagtgatataccgacagctttgtaaaatataatgcgtgcaacctaaagctgacaacatcattgaaaagtcatatagcaaaacagctataaaaaagcttgaatgctgtgaataaagaaatttccaaagtattggacatacgccatgtgcacactgctttaacagatgtgcttaagtccctaaaagacacatggtttcaccacacccagaaatatacggcatacgtggtgtaaaatccgagtaaataaactcataaagaatttaccaaccgcctgaaaaatgaccaagatatataatcagcctaagccataatattggtcaataaaaatgcacagttacgtggcaaaaagcaatgatattgtatccaataaattgcttgataaacccaaacagtgccttgactatatataaaaaagtcagcggagcagctatataaagctttactgtttgacaccttttaagatgcattgtaccaactcctaaaaagttgagtaactgcggtataaaaggattttgaggtattgggcacttgatcacgcgcactttggcctaagcaaaaagtgcctaagtccctaaaagaacgtgacaggccacacctgataatatgggctgcagacatattaggcctagggcaaaaaatatgccttcgacaccctttaaagggtgacgcatgtaacatgctcccgagtaataaatcttccgggtgatatagaccaagtgtagctcatatgaatagcttctgatctgagtgattatcctttatgggatactccaaaatagatataacaattaaatcctgattggtgcaagtattcagttgatagcccttacggggaataatgagtggtccagtagttgagcaggataaatcaactcatgaccatgaatccatgttgaatgtatccggaacaagtccaaattgaaggtatgatacttgtgtttgagctagtaggcccctgagcatatagcgtgtccttttgtcgtagtcacaattgtccattgatggtagctgacgcagttggcatagagacaagacaaccaatatagagagaatattgcccactagaggtggcaaaaatattggtggtagtgaaaatagtgataccaatcaaaagtgatgaagttgcacaaccgtgaaggcaaagaaaccagtcggcagcagtcaggtcagccagcaatgaagatgaaggcgcccagcaataaagttgtgtagccatggcagcgaaataattagtcggtgacagacaaggcagctggtgaagaagatgaagatgcctactagtggcgacataataagccatccgtgaaggcgacgataccagtcggtggtgacgaaagcaagccgacggtgaagatatagacacgcatcaaagacgatgacgaagtccaccaatcatgaagatgaagaaaatagtcggcgacgacaaatgcaaccgatggtaatgacgattggcagcaatagagatgatcaaatatgataacgaagttgcgcatcaaacaacagtagaataggctatgttgaagaggtttgacaggatgttgatgaagatgacgatgtcggtgatccagtcaatagcgttgtagcagccgacgataatgatgagatcctctatcggtagttgcgtagtaggccaaccatgaaggcgaaataacaagtcggcaatgacgaaagcaaccagaggcgaagacgtagtcacccattagcaacaacggagacatcaaggctgatgaaatataggtgctggtgatgatgtcagtgacaataatccatcaaactgttgagaagatattgaagctcgagtagtttccttgatgcgagcgtgtgcataacgaagactgatgcaatgccccttgatttataaagacgtcagtagaacttggtgttatagttgttgcagatgctccacttagaggaaagtatatgctattgttcaactcattgaatctgatctgagttgattggttgatgactccaaactcccagacatgtaaattaaatctcaaacttgagaaatttggaatagattgtggcggcgtgaagaagccaaaattgctggtgtaataatcggagtcgctgaaattagatgtcggctctgaagcgaagacgaagataataactccccgagttgactcgttgattgattgattgcttcatcttgacataaagcttgtcgaattttgagagtcttgtatttgtgtagcccccgactctttggttagttgagaaacaactgaacatagagtcaagaactgtagcttcttgtcgtcgagtagtcattgcttcagtgaagatatatgttgaagatgtccgagtagaaatattgaagattggaacaccacttgctgtaataatataacacggcatcatatttggtgacgcatgccgagatgtcgaagctcctgtagacgtcgtggttggtgaagtaggaaagcttgcaaagtaaaggcaatagagtttgctggtgctgaagacaatgaagatgaagccgctccaccatggcgacaaagttgcatagccgtgatgaagcgaacacaagtcggcggcaacagaaacaaaccggtaccgaagacgcgcagccgtggaggcgaacaagccagtcagcgtcagataaggtgaccagcaatgaaggagatgacgtccatcagtagtggtagcggtataaattagccgtagaggcgagggcactagtcagcagcagaagagacgactagcgatgaagacgataaggccaatcaacactggcaaaatcatgcagccatggtagtgaagaaaccagtcggtagaacacgtagacagcttgcattgaaggtgatgatgcctatttgcggtggcggcgacatagccagccgtgaagacgatagcaccagttggcgtcatacgaggtggccggtcggagaagatgcagacgtcctacaatggcggcataataagccagccgtgcaggcggaaacaccagtcgacggcggacgaggcggccggtcggtgaacacatagatgcccaacaacagcggcataataggccagccgtgcaggcggaaacactagtcggcggcggtcaaggcggccagtcggtgaagacgtagacgcccaacaacgtcggcataaaggccagccgtgcaggcggaaacaccagtctgcggcggacgaggcggccggtcggagaagacgtagacgcccaacaacaacggcataataggcgacccgtgcaggaggaaacaccagtcggcggcggacgtggcggccggtcggtgaagatgtagacgcccaacaacggcggcataataggccaaccgtgcaggtggaaacaccagtcggcggcggacgagacggccggtcggtgaagatgtagacgcccaacaacggcggcataatacgccaaccgtgcaggcggaaacaccagtcggcggcggacgagacggccggtgaagaggtagacgcccaacaacggcggcataataggccagccgtgcaggcggaaacaccagtcggcggcggtcgaggcggccagtcggtgaagacgtagacgcccaacaacggcggcataaaggccagccgtgcaggcggaaacaccagtcggcggcggacgaggcggccggtcggagaagacgtagacgcccaacaactgcggcataataggccacccgtgcaggcggaaacaccagtcggtggcggacgaggcagccggtcggtgaagatgtagacgctcaacaacggcggcataataggccaaccgtgcaggcggaaacaccagtcggcggcggatgaggcggccggtcggagaagacgtagactcccaacaatagcagcataataggccaaccgtgtaggcggaaacaccagtcggcggcggacgaggcggccagtcggtgaacacgtagacgcccaacaacggcggcataataggccaaccgtgcaggcggaaacacctgtcggcggcggacgaggcggccggtcggtgaagacgtagacgcccaacaacggcggcataataggccaactgtgcaggcggaaataccagtcggtggcggacgagacggccggtcgatgaagatgtagacgcccaacaacggcggcataataggccaaccatacaggcggaaacaccagttggcggcggacgagacggccggtgaagaggtagacgcccaacaacggcggcataataggccagccgtgcaggcggaaacaccagtcggcggcggacgaggcggccggtcggtgaagacatagacgcccaacaacaacggcataataggccaatcgtgcaggcggaaacaccaggcggcagcggacgaggcggtcggtcagtgaagacgtagacgcccaacaacggcggcataataggccaacagtgcaggcggaaataccagccggcagcggacgaggcggtcagtcagtgaagaggtagacgcccaacaacggcttcataataggccaaccgtataggcggaaacaccagtcggcggcggacgaggcggccagtcggtgaagaggtagacgcccaacaatagctgcataataggccagccgtgcaggcggaaacaccagtcggcggcggacgaggcagccagtcggtgaagaggtagacgcccaacaacagcggcataataggccagccgtgcaggcggaaacaccagtcggcggcggacgaggcggccagtaagtgaagatgtagacgcccaacaacagcggcataataggccagctgtgcaggcggtgacaccagtcggcggcggcgaaagcaaaccggcggtgaagatgtagacgcctaacaacggtgttgtgaccaaccaactgtataggcgaagacaccagtcggcggcgacgacggcgagccagtggtgatgttctgactgatccattcgtggagcgtaagagataagcttaaagccatgaatcccttttatgcatatctggatttggatcctgcagaacaaacatataggatgagtagtatctgatgtaaatataatactcgagaaaaattcaagcattttaaaatgtttataaatatgtatttcttctcttgttaattttgatttccacgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaaataaattatcttatctctatgcttttgatttattccgaataatacttagcaccttgcgttactcggtctatccaacgagcccccgggtgctaggaatcggcccaaaggcaactatccatgacaaaccaaacggaaagcataggaagatagaactccataactcgatagacacttttgtactcagattatgtcacaagcaatcaagataaatattatgaaaattattgaaaaatatgttataacatctgtagcccccgactcactactcaatggagaaccaattgatgtagtgaggcagaggaaaaggaaaatatcatataaggaataaatgatgacttagctttgtaatattccccttggtgatagcagaggtggccaatgtgggaataaagtcgtccatcaataacaatgaagacaccagtcggcggcgacgaaggcggtcgacggtgaaagcgaagatgcccaccaacagcggcataataggccagccgtgtaggcagagacaccagtaggcggcggcaaaggcagaccggtcggtgaagacgtggacgcccatgaacggtagtgtgaccaaccaactgtatagacgaggacactagtcggcggcgacagaggcaggccggcggtgaagatgacgattcccatcagcaacggccaatggagaggcgcagccgggtcagcgtgagctatgagaggcgcagccgggtcagcgtgagccatgcaggggcgatagtcgggctcggcagcgtggaagcagccaatcgcgaacttgttgagacggtcgacagtgtcagcggatgtagccaaccatgtaggcgaagatgcccggcaatagtgagtgcgggctaacacgccgacaaatcaagtcgatactccgcggcacggcgacggcctgaccaccacggcgtctcagtagcacatgcaatcaaacaaataattaaattgatcagcagcagcaaggaattaattaaagataaatgcacaaatatcacgtgaggtgtgattggttgctggcttgatgggcatgcatgttgccgatgcatggtcctgtgcatgctggtgacgtgtcatcatatcatttgttggccatgttgccattcacagccttgttgaatttggttgttgatgatgtcgccggtggcgaagacgaggagcttgaggatggcgagagcgatgtcgcggtcgtagcagggatctgtcgacgtctcggactccttcgcgtgatgcaacctgcccgactagttgacgatgacggcgcggcagcagccgggcagtcctcgccgactttgaagcggcggaggaacagatccgcgactccaggaggacggcggggagggaggcgacgtagtcgtcggagcggaggaggcggaggtcgcagccgcgcgcaggcggcgtagctgcgtgcgcggccccggcgtcgtcggtgtccatcagctgcaaccgtctcctatgcatgccgattagatcggtttcgtcatgcctcgtgtctgtagatccatcttgcagcatcatagcatcttcgttggggtagattgattggttcagtaggcttggtagtggatgaccatctgatccatcggatcgtcgctgccctcgtgccgatacgaacaggatcaggcggaggactgcaacggcgattggtctcagggtttagccatctccttcttacttagattgaatctctcctgactggtttggatccaagtcagagagtgaaaacttgttaaagttgtcagcggcgatgacaaagcaaaaatcccgaagcgaagtgaagacgaagccgacgactctttgagatcgatctcagcacatctccagaaattgattccatcgcacttctcgatggaaagctcgacgcagcccctacctggcgcgccaactgtcgaaacatgaattcggcaataataaaaggggatagcgcacaagatctaaaagtggatggatacggagacaaaggatttagacaggttcaggccctctcaatgagaggtaataccctactcctgtttggggatttgaatccgccgggtgtattatagatattatgatctgattgtatctcatgccccctagagggcctcctgcccaccttatataggatgggggccaggattacaagatagaaatcttaatcaatacggtatcggtttcctaaatctactttacaattttatcaaaccaggactttaggccgttccataatatacatggaaacgtaatacccaagttatgatctgttacaaattccatagatataagctatcccttataacagtcggataaccatgccgtgtgggtatggggtacccataatctccacaccatccacacttttgccggtagcatattaatccatccacataaaagtcatcccactaaaaaatatctttcataaaccaaacggcctctatgtgaaaattgtgtatgtgaccaggctaaagagagaaaaaaaaccactcgtctccgacccctcccctacatcactctccaaattagctcaccaaattagctccatccctgcatcactctctaggttcataacggaaaaaggcaatagggacggaagtagtaacatttcactttactctgttgtagaaatgtaggggtagaatttatgggctattatttgttttgtgctcgggtggacgatggaagtcaataatcgatcgggcgtgttcggttatgtttgtctgtccagcctgaactgaaagcatgcaatgttgttttcctgaaggatgcttgcggccttgccccttgaattcgcgtgagcgtcgtgcgggctcatctgtttgtgctcgacacatatgctctgttgatgcggggttctgtgtttttctgcttctggcgcgttgttacatgcgttgtaacctggtccataggatatatggtcgatgttaatggactaatggtcgtcatggcgtgcgtttagggcggcttataaccaccacgatattgtgtttcagtttattttttttaagcaatgaaagaaccacacaaaagctaccaagttttggcagcaccaactcgatcggtttctgtttcttgcactgttttctcgcctataggtgttcgtccattcagtgttggtgtgtgttggacgttactagctaggagagctcatgttgaaccaacttatgctgtgcccatgaaccacacgttgagcggtgctatattttgtatttctttaaaaataattgaacgcgtgccggtgcaagcaaagattcaaagcaattcgtaacttaggggtgtaagtgggctgtctcacaaagccaattatgggctaaataagcaggtaattcgttggtcagcctataaattagtataggaataagtacatctgagtccccttaactttacaccgaatccgattttcatccttcaacaccaaaaccagatataaccggtccctgaactatcaaaaccggtgcaaacaaggtccctctacggtttagaaggcggttttggctgacgtggcgcctactgttggtatttcttaacgacattactagaaatataattcccagtaatagcgcagaaatacttctggtatattatggttatagagttcatccgcaagcgcacggatatactatcgtagcatgtcacccgagagtattccaagggtatcgtatttattttatcccgtgggaagatcatgtagagagaactcaactaataatttatatattacttgtgataattatattgtaagcaggggttaagataatccaagggtagagtgacacacaagcattactactcattctcataataaattatctaaactaaatggaaagaaaagagaaagaatatattcctatacttctaatatacatagtatacatatattctagttaactgatatactagctaatactctctatccaacgccctcctggtacttcgagaagccacccctgaatgccgagttccttatgacagtccgtcatgaccatacaaccggggctaaatacggaggaataccctccccaggaaattaacttaggattatatataggcgcgaaggaatacccgtactgagctgttaccatcagcggcccacctctcatccgcaatatataaccccaaataatgatatcccgtaatctagacatcacgcctaaactatcagatactactgtaatatcatcgtcatgacatagagtaattgcataagcaaacattatacccgcaccaaagtatctcccagataagctagctgtatattcagtataacatgaacataatgtaaagtaggtactcatatactcggaaagtatttcaataccataaatatatatagaagagtattctaataaaagtacaaagcttacaaaagaggaaaggaaagttgctagagccatacctgaactcttccgaagacttccggactcctattctatttctattccaccagctagatactactaaactaaacttgagagaaatgagagagctattgcttgaggtgtgtgttgaagtgaagagagtgagctccttatatagaggtagttatgacggttgtggaaggggaattgtccgaagtgccctccaaccgtcattgggatgcaatcctggacgtccacgccaaaacctggtggcctcctctattgctccactccgcagacttgagaattttggcctaattcatcatgttagttctgagttcttggcctattcacacacaagtctggttcttgacatcgttcgattgatgtatcgtctgagttgatgtcgattctcctccactttagtgtcattccccgcaagaggttagtatacctaatactagtggagttttattattctaacagatatatgcattgcaagcatcactagttctcctctattttggtaatattgatggtcgaaactgatcgataacgaccgtcagcaaaacccccnnnnnnnnnnnnnnnnnnnnnnnnnnnnnnnnnnnnnnnnnnnn

SEQ ID NO: 2339 - DNA, 7044 bp, Oryza sativa
ttggtgttaagacaatgtccgtggtagtcagatatcatgcgggatactaaggctagagttgatgcacgtggttgatggagattccatatggcatacgatggaggtattgtgtgcgtatgggatgcggagtcgaatttggaagtagtccaaatttggtatgattggttatgtagagtttgtttcttgtactaggaggtttcctatggggattaggactcttagtatgggtttggttcgtggctttaggctgctgtcttacaatgcatcgggagaatatttgcggtgatggaccgggagtcggcttggtggtaagacgatgtccgtggtggtcagatatcatgcgggatactaaggctagagttgatgcacgtggttggtgaagattccatatggcatacgatggaggtattgtgtgcgtatgggatgctgagtcgaatttggaaggagtccaaatttggtacgaatggttatgtaaagtttctttcttgtactagagggttttctatggtgtttaggactctttgtatgagtttgattcgtggctttaggctacctacctcatgtataaatagagggggagcgtgaggcttcccggtatcacttttgtatagcttttgagatctagtttagttagggtttcgagtttagtcgagatttttgtaaggagtgctgttggtgcactttgtaaacacagagagaagcaataaagttgtcatctactttgagagttcttcgatttgtgtttcactgggtttcggcggtctaaccggcgatatactggtggtcagaccggcggcgctagggcggtcagaccggcggcgctagggcggtcagcgacaggtgatctcggcggttcgaatggactttgatctcggtcagaccggcgtgttccaggtggttagactggtacaactactttggtcagaccgcgagccatcgatttcgagggtaacttttattgccgctaaaagtttttggtttttgggtataccaatcattcacccccctctggttggcttagttcttgtgattcgatcctacaagtggtatcagagccacgtttgctctttttgatctttaccgatcttgagtttttgccatggctatttctaataagtttacaactaagcctcatattttcgatggaacggatttttctcattggtgtagtaggatgcaatcttacattatggctgagaattatgatctttggagaaaagtttctcatccttatgtgattcctgaagctattaatactgctgctaaaaaattgtttttgaacaaaattgcaaagctcgcaacattcttttgagtggtatttctcgttcggattatgatcgtgttgcttatcttcaaactgctcataagatttggattgctttgagtaattttcatcaaggtacaaataacattaaaaaacttcgtcgtgatcttttcagaaaggaatacattaaatttgagatgaaacctggagaagctttggatgactatctttctaggtttaataaaattttgagtaagcggtcagaccggccggcgctgtgtcagtttcggtttcgggttgtttgtttggatattcgtgattgtttcatggttatggcttctagatggatactacacgtatgtaatactgttgtttgctaacaatgagtcaagttggagatagcttggtctcagaatatggtttctttgtttgtttcatgtctaggtgactcgatgcctcgggagagtatttgcggtgatggaccgggagtcggcttggtggtaagacgatgtccgtggtggtcagatatcaagcgggatactaaggctagagttgatacacgtggttggtgaagattccatatggcatacgatggaggtattgtgtacgtatgggatgcggagtcgaatttgaaaggagtccaaatttggtacgattggttatgtaaagtttctttcttgtactagagggtttcctaaggtgtttaggactcttagtatgagtttggttcatggctttaggctgcctacctcatgtataaatagagggggagcgtgaggcttcccggattcgcttttgagagcaattgagttgagttttaagttagggtttcgagtttagtcaaaatttttgtaaggagtgctgttggtgcactttgtaaacacagagagaagtaataaagtcgtcatccactttaagagttcttcgatttgtgtttcaccaggtttcggtggtctaaccgacgactcatcggcggtcggaccggcggcaaggcggcggtcagaccggcggaagcgaggcggtcagaccggcgatagcagcaggcacggtaggcgatctcggcggttcgaccggagttcgatctcggtcagaccggcgtgttccaggcggttagaccggtgcaactacttcggtcagaccgcgatccatcgatttcgaaggtaacttttatttccgctaaaagtttttggtttttgggtatctcaaccattcaccccccctttggttggcttagttcttgtgattcaatcctacaagtggtatcagagccacgtttgctctttttgatctttgccgatcttgagtttttgccatggttacttctaataaatttacaactaagcctcatattttcgatggaacggatttttctcattggtgtagtaggatgcaatcttacattatggctgagaattatgatctttggagaaaagtttctcatccttatgtgattcctgaagctattaatactgctgctgaaaaaattgcttttgaacaaaattgcaaagctcgcaacattcttttgagtgatatttctcgttcagattatgatcgtgttgctcatcttcaaactgctcatgagatttggattgctttgagtaattttcatcacggtacaaataacattaaagaactttgtcgtgatcttttcaaaaaggaatacattaaatttgagatgaaacctggagaagctttggatgactatctttctaggtttaataaaattttgagtgatcttagatctgttgattcttcttatggtgctaattatccacaatctgagatttctcgtcactttttgaatggtcttgacatgtctatttgggagatgaaagttacatctattcaggagtctgttaacatgtctactttgactttggattcgctttacactaaactgaaaactcatgagatgaatattccttctcgtaaaggtgattctaagtctagtgctttggtttcgtcttcaacttctttggatcttggtgcttcttcatcaatttatttaatgccatgtccgatgatcaacttgaacagttcgaggaggaggacttggttttgctatctaacaaattttctcgagctatgaaaaatgttaggaacaggaaaagaggagaaccgaatcgttgttttgagtatggagcacttgatcatattcgctcgcattgtcctaagcttgggagaggcaagaaggaagatgatgggagagtcaaagatgatgacgtgaacaagaagaagaacatgaaggagaaggagaagaagaagcattgcatgcagtggttaattcaagaactcataaaagtttttgatggatctgaagatgaagatgagggcaaaggtaagcaagttgttgatctaggttttatttctcgtaatgctagttctgatgttgataaatctgatgatgataatgaagaaaagcttagttatgataaattagaacttgctacttaaaaatttgctaaaaaacttcaaacatgttctattgagcttgatgagaaggatcacactgttgagattttaaatgatgaaattgctagattaaaatctttgattcctgatgatgataattgtcaatcttgtgaagttttattttctgaaattaatgctttgcgagatgtcaattctgttaattgcaaaaaattggaatttgagattgaaaaatctaaaaagttggaatcttcttttgctcttggatttgctttacatgctcgtgttgttgatgagttgattttgacaaagaatgtgttgaaaaaatacaaagttgctttttgtgcaagttctttggtcaatgcttcatgtgcaaataaggcaaaacaaaacaatggtgttttgatttctcaagattgctcaaagtgtgttttgaatgagatgaagttgaaagatgctttagggcatgttaaacccatggaagaaattgttaaacaagatgaggtgttttcttgctcaacttgtagaaaacaaaaaggtcttttggatgcttgcaaaaattgttttggttggtttttgttttagacttggccataaaaagaaaaaggaaagagaaattgctgttgcaaaatgacgttggcaaaaatcgggttttaattcgaggaacacggttagaccgacactgaccagtcggtcagatcggccagcggtcagaccgaccggcggtcagaccggttgccaggcccggtcagaccacagggacagtggcggtcagaccggcctcagggtaattttgcgcgaaattcaaatcggacttttgtgaagcaaaaaggtaagtttttttggtaagtctgattctaattttattagtgcatatgtacctactggttctactggtcgtgtgactcagtgttggattccaaaatttcttatttctaaccctaacacggaggcctcgacatcttctcgttcgtaggtattttggcggcatactccccatgtgcgtttaactttgagatgacaattgtatagcaaggtaacatcacttacttttggattgacataattttggtctactctcttgtttattagcttttttatatgctactatttgaggttgtagttttggtttatactattggatatatgtcaattcttgagaattttggtgatatcgttggcaattggatgtctttttcaaaatctttgatttcttcttgattctttgttcggggagaattggaggttattttgagggggagttagtgctttttatgactttcttttagcatgattttagggggagtttgtacctcatggttttatcaagcaaaaatatgacaatggaaaaaattgataaaagagagctttgtttatgcatatggtattttcctgtgcatgctagcaatattttgaaggtttatttgtctctagcatagcttgtatgtattctagtcttttcatgatatttagattttgcttttaagggagatgatacatgacacttaaattctatttgaattaagtaaatatgcaatgttgatgctagcatatggtttgattcataaatgctttatatatatgctttattgacttgttattcctcaaatagctttaattgttcattgtgaaaaagagaatagaaatatgaaaaaaaaatgaataccgaatccttcgaaacagtcttgacgacaaggacgtattcgatgtgagcaaaataatgggtgctgaatctctgcaaacagtcttgacgacagcgacgtacccggaataaaagagaaaaatatgagaaaaaggctcaagaaaaagaaaaagtcaaattctctttgttattttgtgctaaaggttatttgagaaagaatgataaatgcaataggtatatgtgttagtgtttattcttcaacctatgtgcttgttaagatgttgcattataaatcgtatgaaatcatgatttttgattgttgattcaagcttaattgtaaaatctttggttcatggttatactttaataaatgcttgttatattatagatggattcatcttctttttattgcaacacatgacatgatatgctatatgtatgttaagctcttatactttaataaacataatttctatgcttgatgaaatcattggcaaaagggggagaagagatgagttttggggagaagagatgtgttttgggagaagagaagagtttctaagaagtgcatgtttttggttcaattgggaatttctttctttgtttttggttcaattgggaatttctttcttttaaggaagcaataaagttgtcatctactttaagagttcttcgatttgtgtttcaccgggtttcggcggtctaaccggcgactcaacggccgtccgaccggcgacaagcggcggtcagaccggcggcatacgggcggtcagaccggcggtggcgacagcaagtggcagttgatctcggtggttagaccggagattgaatctcggtcagaccgacgacaaccaggcggtcagaccggcagtgtaacttcggtcagaccgtgatccgtcgaattcgaggataacttttatttccgctaaaagtttttggtttttgggtatatcaaccattcacccccctctggttggcctagttcttgtgattcgatcctacatgtggaaccatcagaggcccacttgtgaaaatcgatttttgcgtgtggtgcttttaaggagccgtatgcaaaaacggaagttgatttttgcagaggtaaccagtcatgatttgtatgtaacctaaagaatgtcttattcagaataatcattactgtagtagtgtaacttatattcacggtcaaatttgtttttttcgttgtgacgtgtaaaagttgaattttaacttgtatctttacgaagtgatatatcacatgttaatacatcttctcaattttttataactatttgaataacttacaaacaacgaggggatatcccctcgagagttaaaatccactcctagttgatcagccactcaacaaagagtgagcatcatagtgagagagataagagacggagacgaagcgtcgtgcttgcgagtatggggtagcaagaagagaaggcgaaccggtgattccgtgatttcctcaaaattctagattggacacttgggctttcctcttatgcggtggtagacgtcccaagggaggtagggtgacgtgggccgtagctgtgccggttgtaagatcaacgtgtgttttgattcttattctgtgatgaacaattggcatatgtgattattggttttgttatttggagattatcgtcgaagtggttttggatgattggatttacaggtgctattattttatgtggtccggtcc

SEQ ID NO: 2340 - DNA, 24355 bp, Oryza sativa
tgttgtgctaaaggttatttaagaaagagtgataaatgcaataggtatatgtgtttagcgtttatttttcaacctatgtgcttgttaagatgttgcattataaattgtatgaaatcatgaatttttattgttgattcaagcttaattgtaaaatctttgattcatggttatactttaatgcatgcttattatattatagatgggttcatcttctttttattgcaacacatgacatgatatgctatatgtatgttaagcttttatacattaatgaaataattcctatgctttatgaaatcattgtcaaaagggggagaaataatgtgaaaatttttagatcttttggagttgtcaaaagggggagaaataatgtgaaaatttttggatcttttggagaagagttaagttttagaagagaagagtttttaagaagagcatgtttttggttcaattgggaatttctttcttttaaaaaggggagaaggtttcttgtttttggttcaattgggaatttctttcttttaaaaagggggagtagttttcttttggatttttgagcacgatgtgtacgtttgtacgaagtgtgctttttaccgcttttgtttttaatgttccaaactccaaaacatttttaatgggtttgccaatgtgttcatcaagggggaaattgtaagatcaacgtgtgttttgatttttattctgtgatgaacaattggcatctgtgattattggttttgatactggagtttattcacgaagtggttttggagatgattggagttcacaggtgaatctacaggaaatcgctgttatttcatgtgaccggtcagaccgggaaggtgttgccggtcagaccggcggagatcgagcggtcggaccggccggcccgcggtctgaccggccgacgctgtgtcggtttcggtttcgggttgtttctttggatatctgtgattgtttcatggttatggcttctagatagatactatacgtatgtaatactgtttatttgctaacaatgagtcaagttggagatagcttggtctcggaatatggtttctttgtttgtttcatgtgtaggtgactcgatgcctcgggagagtatttacggtgatggaccgggagtcggcttggtggtaagacgatgtccgtggtggtcagatatcatgcgggatactaaggctagagttgatgcacgtggttggtgaagattccatatgacatacgatggaggtattgagtgcgtatgggatgcggagttaaatttggaaggagtctaaatttggtacgattggttatataaagtttctttcttgtactagagggttttctaaggtgtttaggactcttagtatgagtttggttcgtggctttaggctgcctacctcatgtataaatagagggggagcgtgaggcttcccggtatcgcttttgtatagcttttgagagctagtttagttagggtttcgagtttagtcaagatttttgtaaggagtgctgttggtgcactttgtaaacacagagagaagcaataaagttgtcatctactttgattgttcttcgatttgtgtttcacagggttttggcggtctaaccggcgatatactggcggtcagaccggcggcgctagggcggtcagaccggcggcgcaggcaggcagcggcaggtgatctcggcggttcgactggagttcgatctcggtcagaccggcgtgttccaggcgcttagaccggtacaactacttcggtcataccgcgatccatcgatttcgagggtaacttttatttccgctaaaagtttttggtttttgggtataccaaccattcacccccctttggttggcttagttcttgttattcgatcatacacgggtcgccccatgccacccaatggtaacgtccgcccctgataagagctgagccgaacctatagccaacgagcagagacggccatcccttgagctgtggttgtggtggagcgaggcggccggggccaatcctatttgatacctcgggctgccttcccctcttctttttcttgtttatccctgaacaagatgcaaatgaagcaacacattcaagctatttctttggcattcttttcgagttctgtaacattaatggatattgtaagcaagaagattttatgttgagaatggaaggtattggaaaagaagctattgagaataggctagttgaaagtgatcaggatagcgagccataagttactacaacacagagtatcacgtcgtggcctgagttgacgtcttaagagagtggttgacccaacgagacatactatcgccgtccgaaaatactcatcgtattaagtttttattgcaatgtttgaccattcgactcattcaaaagattatgaaattattatttatttttttttcacttgctttattatcaaaagtattttaagcatgacttatctttttttatatttgcactaattttttaaattagacgaatggttaaacattataagcaacaagttaaaacgacatctaatttaggagggatggatgtagtaaattcaagcaagtagaatcctgaacatgcatgggcatgagtggatgacatggagactgagaagtgtccaatttcctgagttcaaggacaactatgtagacagggataccctactagttgtttgctaaggctgtgtttagatctggggggtgtaaagttttgatgcatcacatcggatatatggacacacatttgaagtattaaatatagtctataacaacacaaattacagaatccgtctgtaaaccatgagatgaatttattaataagcctaaaaatctatcattagcaaatatttactgtagcatcacgttgtcaaatcattgcacaattaggcttaaaagattcatctcacaatttaaacgtaatctgtgcagtcagttattttttcgtctatatttaatactccatacatgtgtcgaaatattcgatgtgacagggcgtaaaattttacaggggatctgaacagggccttaaacaattgttttttagataagtatattttttacacggcctctttatcgaaccggatatttgcagccatttaagttaggaacttagtctctcaaacaacctaatttgaaattcgctcatatggagatttaaacttatgaccttgaggtgctatacaaatcactgaaatcactaggctacatggggtgcttaaacaattgttgctcatgatatcttactttgtgaattttgatgactacaagcagcttgtgcaagaattggattgatttggttacaccacacattactcgaccagccaaaggtcaatccagccgaagctgcgcatgctttaatatcaattcaactagtcaaattcaacgcacaaaaaaactgaatggataaaggtggaacgaccaaagttgaaagaaagcttcattaaagagtatttgcaggtttatgttacaaattgtatgagttgagctgtacacatccataagtttcagtgagtgaaattgatttttttataaaaactaacaagtagtactacttaaaaagaaaacattattcatcgaggcatgaaaaacaatgccatcgatctcatgtttattttttctttccatgtcttatgctaaggctgagttagaggagaggaaaagagggaattgagaagatacgtaaaacgagatatgcaattagcgtatgattaattgagtattaactactttaaattttaaaacagattaatatgatttttttaagtagttcaggaaacatacatgcggaaaacaaggtgttttctctctcaaatctcccagtaacgaaagcagccgtgtagttatcgacatctgtaggccatctaccctatatgttggatacgtccaaccaagtcttccgtgaaagattatgtcatctttgatgacactgaagctcagtcttccggtagcttttcttttttttttcctcttctgtgcaggggggttcagggcctaacaattcgtgtgtgttttggctctgtatattctccatgaatatagaggctggatttgatggcgatataaatatagcaaatctgttgattttttctcattaaatcatgagatgcaaggtagcgggctgctacagattgtcgtctcgacagtgacataatattgattatcagatggatgcgtggtatgagaggcgatgggatggtcgtaccaagcattgcagctcaataagaggtggaggtaacacggggttgttctccggatatctattcgtagcagcacaagtcaacacgaattactagatttgtctaactcttctcccccagagactttggtactcatgtcttgttgcagccgcggcttgagagccatctctaccatcaagcgtctaagcttgatccgagtaatatcatcggtatataggagtaccttccatgacaccaccgattcccatacataaatttaaaatctgtaccatacaaactagtgggagaagagtggttatgtactccagtcaaccaacaagtgtatgctatatatcgttatttgtccttatatagactgaagagggtgggacaggaaaaccacccaaaacatgtttaactgaaagtatagaggacaataatgcatggtgtctgagacttattggcttcagtcggattagagagagttctttattttgtcatgtcaaggaataactaaaacagagtacaatggattggtggaatataaatgtagttctatttcctttcatattggtttttactcccaagtagtttcccctctctactccaaatcttcgagtcatccacagacacaaagtcacaaacaatgtgcaataaccagtccttgatcaaatcctctgatttatgccttcctaaatcttaagcagattaccttgtgcatgtaagtcccgaaattagatgatttttcaagcacattcttatcaataatttcgtaaaaggtgttgatgactcatttgaccttgtttcgtatgctaagtatcaatctgaccctactttttttaatttacttatttgactccactttttgaaattaaagatgaaagctgaccttattccgttaaaacgagttaacattgttaaccaaggggcaagtagtccttttgcccttgcttatttaaccatattatataaaaacatccatatattccaaccttttgacataattgtaacgaatttgacatatctttcacatttgacacaagtttgatagatttggcttcaatttgataaatttgaatcatattgaaaaatttggcggagtgcaccaattttgacacaagtttggtacactgattttgctcttgtggtggtgagaaagcatagccaacaaattagaagaggaagccgagaacaacaccaccataatcttctccccacgctcgtcctactcgtccctccgtgccaccgccgctctctccctctgtgtgcctgcggagccgctgcctccatccatccacccgcctgcgctagcaccaccgccccctcctccctcagcatgtcggagccaacgccaccccctccctctacgcaccggcgctggctctaccgttcatgccgagagagacgagagagcgataagggtcaggcagggtggtacgagatggataagattgaaggagggtattttggttagtttgaataataaatagatttattttctttttcctaaatgaaaccctatcagtatattgcaaatatagtcaaacggtaggttcaattgtgaaaagcagggttaaatcagcaacctagaaaaaaataagatccgattggtagttagccttcgaaatagggtcaaataagtaattattcgtttcctaaaagtgatgaactactcgtagtagaatatttcttctactggtaatataactcacaaatgaacggttaccatagtagtgataatatgggtagaacgataactaccggcagatacccatgtaaaagtactccaattggaattatttgtagcaaatattacgaccatttttctgtagcactaaatattgaactagtctgaaaatggttgtgactttttaattaatttccaaacaatcctaccacaattggactccattgaagctacaattaagttttttgttcttcacatttccgaaagaatgatcaggttatctgatttgaccattaattccctatggagatatacattccaatatcaatatgcttttgttctagagtttgacaatcactacacaatgggggtcttggttctattaacatatatactcctacatctatgtgccagttacataccttgtgatgtataataagcccattaattgatgcaaaatgcatgcaattcggccgtggtaagagaagtcgtattatttctacagaaaagcaagcagagggcaggagtgattctttattaagacgactgaatttttccttctgccacgtggtaatgcaattcatttcattttattgtatttgttaacattattggtgacttcaataatatcgatctccagtatgtattaattaagaccaataatatatatatagtaagtggagttcaattctaaaaactctgaaaaaacaataacaaaataagtatgtgctcttgtgtacctctcgttgctcaatacaatgaaataattatataaaactatggaaaataatgacaaaagttgggctgtgtttagatccaaaatttggatccaaacttcagtcattttccatcacatcaacctgtcatacacacacaatttttcagtcacatcatctctaattttaaccaaaatccaaactttacactgaactaaacacagcctcgaagagagaaggttacgatggttgcagtgaatctccaattccactacctacctaatggtaaattttgcaggttagcccttcaattttatcatattaaaaaacagtgaaatctaaatgaaggtgataatataccctatagaaaaatatggataacacatttaatgaaaatttggtactaccaacactttggtagatatttctattgatttaggaagttctggaatcaatccaaacaacacataagtagtatttagactaccaacaatttggtagtgtaagatttggcactaaattaaaagagcccataatgtattttaattctgagatctatggattgaattgagaaatgcatgtccgtagaggggaatgacattataatccatgctactactttttttctctagatttacaaagtgaacttcccatattgtttcctcatttagtgtacagagtaacaagatttactaaaactgtttgtgttccatacaatttgatctactgttcagaataagaaccaacaacatacccatgtaaaaaaaagagtcataacacaatataaatatttcaatagaaaacataagtaatcgaatttgatacatcattagcaggacataaatatgttattagttttgctgaacgtgcctatgcaaccagcttgccagctactagctagttgagcatacagtatactcccatgcctgatgatcaccgtgatactctttagtgcagcaattcgcatagtctcacctcagcatacatgcccagataacgccattaatatatatagatctgtcaaacttgctgctaacccaagtaattggcagcaaaagcattagtcccggttacccttaaccatcatcgcttcaaccttttgcttgagggaataagtgaataacaaccccactgcaaatggtgcaagcgttgtacgttcttcccatgacaccacccatttccatgtaaaactaaactcgcaagacaaacctaggtttaacaaggtcaggcatgagaagagtgtacaacgatcactgtttgtattactcagctgatcttcccctttgaactgtgcgtgtcaaatctctctctctatatatgtaacaatgacaaaacatatagatacattgtgttataaatagttacagagacttaatagcagagtgaaaagctaatagcagggtgataagcaagctggctgtcagtggggacagctatgtgtatctattgttcaagacaattaaggggatgtttaaatcagggtctaaagttttagcgtgtcacatcgggtattatatagggtgtcatatggggtgtttggatactaataaaaaacttaattacagaatccgttagtaaaccgcgagacgaattattaagtctaattaatccgtcattagcaaatgtttactgtagcaccatattgtcaaatcatagagcaattaggcttaaaagattcgtctcgcaaattagttgtaatctgtgtaattagttattgtgttagcctatatttaatactttatgcatgtgtttaaacgttcgatatgacatggtgaaaaatttttgggtgggatcttaacagggcgcgcgtaagttagattggttcatgattggctgtaacttttaggacgctataatcttgttcgtattggtttattacaccagattaaatcactctgctcgtatcaaccactgaagtagaacttcgtactgtgctatctgttctcatatcactactgatctttgctgggtggtgcaaatagtcccggttcgaatagaaaaatagactaaacatcatttttagctctggttaaaaagccaacgaaactttttgatctttagtcttagttggtgttaacaaccggaactaaacatcatttttagtctcggtttgaaaatttgtcaggccgtgtcaggtcccattatttttagtcctggttagtcaacactttagtcccagttgtttataccaaccgagaagaaagattgaaaagaaaactaaagatcaatactttagtcccggttgtttgtaccaaatgggacaaaagattgaaaagaaaactgacagccgcacgccaccccctccctcgtccttatctccttgcacgcacaagcgaaactccctccctctctctcgctcccgccctccccctccctccttatctcctctccctgtgtgctccctccacctccctcgcaggtgactccctcgatccgccccctccacctctccctcaatcccccctcctcctctccctctcacctcccccgccccctcttcctctccctccaatccctccgcctcccttgctgacggcgctcgccccctcctgtccgactcacctccctcttgcggtggatttggcggcggtgacagcgtctccggtggcggtcgcaggtggatccggctggatccgggccacggcaggtactagcagccacatcaagcagatggtggctcgcggtggggagaagaagaagaagaagaagaagaagaggaggagtggcggagagcgtggagaggatgaggcaaagggggcggccggctgtagtggtggcggagcagatgctgctgctcatggatttgtgattgtattcatgaggcgattgtgttcacgaggcaattgtgttcatggattttgattttttttttcatgattgcgttcatgagatctcatgggtgatgtttatgattaatatgttcttggattggatgaattgatgatggtatgtgaatctgtgatctgtaatgtatttgttttttgagaatttgtgatgtgaatccatgattttatatgtgaatattttatttggggaaatcaatatgcaagccagcaaaaaaaacaaaaaaaaaaccctttagtcccggttgataatactaaccggaattaaatatggtagcgtcagtcacgtggcgctaccatctttagtcccagattcggggtctcagaatttctccagtagtgtgtcgatatcaaccgaatcaaatttttattagttggaaatgtgaagaagctggtaaatctcgtatatattaaatcacattaatgtgggtagcgtctaagcgatgtcaatattaacaacaaaaatagtacggaagacaggtactgcctttgtttcctgaattggccattccaaatttggacctgtacactatgatttgtatttttttcttatggaacaaacaaatatattcaaataccgattctagaaaagatcattatgaaatctaattccaaggcacaagtctgaagattgatggcatcgttcaatggtaaacttatattctcattttgttattcccaggcacaaatcccagagaataatacctttgagaaaacatgtatatgtactaaatccagccaacaaaatggaaatggacgctctggggtgaaccagtgaagcctgtgcttatcttgtccttgatggcacccatttctattaaatagccccacattggttgtggaagggtaaggaatattatatgtaagtgggagacctcttcacctaattggttagcttttgagatgtgaaaggccctttacgcgcaattcgtactattctataattgctacacagtgcttgcacaggaagcacgttagacactaatagaaaaaatgtttttgcacagtcaaaaatagtttttccaggcgggtgtaaggaccgccggcctgcttgcgaaaataatttttgcaggcgacatctccattttcacagctggtagattcactcgcctgtgaaaaaatcacagcgaataaaaaaaaagggtgccgccgccggcctcccctccggtcgacggctctccaccttcatccgctggccactgccacagccgctggtatcatcatcgcgcatcgccgcctctgctccgtccgccggcttccccgcaggcgtcgtcatcatcgtgtcggcgccgtcgtcgcgcgtcgccgcctctcctcctccatccgctggcttcccacaggtggagctgtcgtcgtcacgcatcgccgggagagggaggagtcgagccgccgcctctcctcctcgttggcacaaagaaaagcataagaaattgttcttttatccatgaatcatgtgatccatgccgacaaggctgccacatatctctactattataaaaattgaagatgtttttaccgattactttgatacgttatccatgtatgaatcgatttttaagtttgttcgctttcggatatacaaaaggagttgtacaagaaatccctttaaaaaaactcgcatgctaacttgacactatcggacttctaattgaagttcatgattttctaaaaaatatatatatccaagtgaattcccacaatgaatttcaccttagctaaatcgtataataacaataataagattaaaataacattcacccattgcaacacacggttatttttatagtttgtaaaaaataaaataaatccagtactgttcaacacggacagacaggtgtctcggcagtggttaattgcttctagcaatctagcttgatgatcaaatgaatgtttgctactccatcaagaaatcaatgcagttgtagtgcagcgatagcgcgtggaggcggctactaagtgagatcacagaggcagcacaaggtgattttccagatttaattaggaaataacaccggtataccacccagtagaggtttcaagcatccctgctcacttagtgcaatatccccatgatattctttccatgacaccacccaatcccaacttagggtgtatgcttccattaagggatgtgcgtggaattggactgtgataagagaagtcgtattccaagagaaagcacgcatggggtgttgaattgtggcagagggcaggagtgtttctttattatgactgaattttctcttctcctatggtgtaatgcaattcattccactttattgcgccttcgaatacaactatatacctccagtgtgtattaattaatgttaacattggtatgtggagttccgtccttacaactcaagcatatgtgctctcatacctcaaaatataattaaatagaaaatattgtcaaccaattaataggttgtagaatcgaatacaataaccaaacgtacaagagggggtgaatagtagcaacacgaaaaacaaaaactttttacagagctaaaaatttaccctccaacctaatgaagcccttggcgtagctggtctgactgtcgtgtacacaccagcctgaccgcaacttcaccgcctgcccgaccggtgtctggatggttgaaccactgcctccctgtactgccttctagctgtcgctggttagaccgcccaatgaactccggtcaaaccgttgggatccctaaaaacgcgtatcgacaaaactcttgaaagtacatcaactttattttatcaatatgtatttacaaagtgcacctaaagtactccactcaagtggttgtcacatgatctaggatgggatgctcccacctggcaatggtacacctattatacggtcaagcaagacagcaaatgcacagtgtagaacagtgcagtacgcatagacgcaagtagcgacgtacgtgggtgtcgcgataagtactacggccaaatggagcaaatactggagctataactagcatatccacagtgtgggtctagaaatacctctacaagaggagtaggaagaagatgcggtctaacatgcatgtgtcgaccatgaggaaggactatttttgaaacataggcccaatttgatcatatgcctaattttgtgtagtatatgtgttatcttggaaatggactggagagctataatattttgagataagtttgaaaatttttgaaatacttaagagaaatgaaatattgcctttgaaataaataaaaaaatattatattactggttacaataaataaataaataaataaatagttaaaaaaaatgttagagcaattatgttgaaataggtaaacaaaaatcaaaataacttgaaaataagactggtcaaagttacctgtgacgggtgagagtaatggcgccgtcacaggtgacctcacctgtgacatgccctactttccggctgatcacatatgacaatacctatgacaggccggtgagcagggcccatcataggtgatgtcacttgtgatggcgccaacactcccgtccgtcacaggtgactttgaccgggataagtagggttggaccgtttcccatccctctcagatccagatctctcactcactcactcactcaacactcgtcaatagccacctactccatgccaagcacctcccttgctttctcgacgtcaaccgttgtcctcccgccatcatcaaattccaccgagcagcacctccctgccctcgacctctccatatccatgacaccgggctccacctccccgcccttgactgccggcttccattgacagcctccaccgcactgtcttcctacaccgccaagtgatgcctccctgacgtcgatcatcaaccgcctccggcctcccactctcctcgaagaccacctgcctccacctcctctgcctccacaacagccgccgccttcacgctgccctcgacaccggctgccttcacgcccacctggaagacagccaaccactgcctcctctgtttccacaacggctgccgcctcccccacaccagtcgccacctcctcagctcccccacccctcgcatgtttctctttcttttaaatttagattgttcccattttttgtgatttaggttgtctataaataatttgcattgtttagaatgattttgagtcacaaatgtttagaaatagtttgatttaggttgtttagaagttttatgacttaggttgtttagaaagtttgtgacttaagttgtttattataaattatttaggttgtttagaattattttgatttaggaagtttagaaatattttgatttaggttgtttagagatttgtagacgtaggttgtttagaaatgacttaggttcaattgtcattaaactttgaacaacttaccatcaaaattgattactacgtcttacatgtacttattatttactacattgtattgttcaattgttttctaacttttttgaaatggttggttgtcgttatttttcaaaaggcaaaggctataagtaacttgggtaagtttgcggcaagaaattgggcaagtttgtgtcttcacaggttcaaaagaaatgtgaggtgggaatatgtgactgtctatgtaatttatgtaaaaatttggaatgcatgtgtgcatgatgttaattttgggatgcatctgtgctaaaatggagaatatgtgatattgggtatggctaggatatatgtgatgtttcttttttcagagagtgtggctagcaaatcatgagtctagtcaatatttagaaattgttgtttttcgaaaatacctcataactgaagggtcgtaaacaaagaccgtcacatgtgagctcatctgtgacggccttgttacttcaatccatcaaaggtgagtcatccgacaggtacaaactttgcacccgtcttaggtatctcactgtgacgggttgcaaccaaacatgggcatgtggagacgctcacctgtgacgggaaattaaaatactggcccgtcaaaagtgactagagtcaccagtgacccctaatccttgaccgggggaaatccatcgaaggtgagggttagtgtccatctgagatgacctgatacggcatagtgatgtggaaatatgctttttttatttattttatttagattagggatatgccactgacctccgtcattaatatatgttcagagcatgttaataccagagcttgctgatggagttcagtacaaattacctgctcttactgacttaggctccgttcaaccgggaatagtacgcacagaaaacagagcgatctattagcacgtgattaattaagtattagcttttttttttcaaaaatggatcaatttgaattttttaagcaacttttgtatagaaactttttacaaaaaatgcgccgtttaacagtttgaaaaatatgtacgtggaaaacgagggagagggattgggaaaagggtgtaccgaacacaaccttagtgtgtaatctttgtattgtgcttgcaacttccctgcacacatactgtagtgccttgccaagttgcttcggcaccccttgttcccaactcgtctccttgttttccgcttgcacacttttcaaactgctaaacggtatgtttttgcaaaaagtttctatacgaaagttgcttaaagaatcaaaataatttatttttgaaaaataaattagctaatacttaattaatcatgaactaatggatcgctccgtttttgcgtgcggagggaatgagttcccatcaagaacatgcgaacacagccttagtatggcacttctatgcaaaacatcctcatacacaatatttggctgtatttctaccctcaatccctaaacgaagtatgatccatgtacacatccaaattaatttggctcaaatataaacataagtaattgttcttccatccatgaattatgtgatccatggcgacaaggctgccacatattcgtaaaaggatctactgttcaacacgatgtcttggcagtggtagcttgatgatcagatgaacgcatactacgatacggaagacaacataatggtgatgcagcgagtgcgtgtgcacgcgggtactaagtgagatcaaggaggcagaacaaggtgattttccagaactcatcagggagcaacaccggtatactgcgcagtagaggttccagccgaagtttgacacccatctctacttgaacgaggcaagtataaaatcatccttgctcagttagtacaatatctccaccatattctttccatgaaaccacccaatcccaagctgcaaagagatcgatgcaccacaaaaataagggagaatagagtggctgcatattctatttcacagcaaagcatatatatgccaacgatatttgttcttatataggcaggatgaggaaactacaccaaacgttcatatccctattaccttggtagcttgcaatgagaaaactcggagtgttaggcatgcttgtttcagcttataattaagattatcataatctagattattgtgccaaattactgtaagctagattataataaactagactagaataagatgcgagctaaaatatgtaatgccctcaattgtaagattactgtatcaacaaattttgtaggacaacacaccaggttctaaataagaggtgtgcatccaccatatgatggttcatcgttcacaacaaatcatccacgtacgaataaatcgtccacataggttttaggtacctacatttacccctttataaattgaagggtgatgcacttggcagtatagttcaaaactggaaggtgtccacaaccacctgttgttacatgaacttactgcatgaccaggggatgcacatgctttgcgcagtatcaaattaatgtcacagggtcaatgatggctgaattattgctatcaaacaccgttgctaaaagcacagttgaatgagacttcaaattcagattttggatattgaacatacattttgattctggtgccaacaaaaatattaactcatccatacattgcatgcaaagctccatccaaaaatcagatgtatcaaattcagacccgttccctttcccttcgaacaccttttcctaacataaatccttaaaaactatgatatggcaatgttcaattggtccaagcttttctccgcccgaaaccactccttatttatttttttgtttttggaaaaataatcccaaggtctctctactagtcatcgagttacaaaatcgtccccatcagcaaaatcagatatatgacatccctcaacttacaaaaccgttcattttagatccttcggtggttttgaacccagttttatccgacatggcggctgagtcagcatggccccacatgtcagcatgccacatcatcaccctctctctttgccctcctttcccttcctcctcctctttctctctctctcacttctctgcgcaggctggtcgacaggtggggaggaagccggcgtggtgaggccggagaggaggaggaagtcagcggccgacgacgggcgatgcggcggcgatggtggcggcaatgttggacaagggacaggcgcagcttctccagcgcatgcgaggcgcaggacgagcggcccacggttgtcacagcaaggaggggaacccggtgccgtgggtgcacaacggcatggtggaagacggcggctcgtccagcggcgcggccatccggtgctgctccttttttttttctttttcttcttcctctcctattctttttttgttctttccctccaacggagttgccagatcagcgcttgcagccggtgcggcgaccctggcgcggggtggagtggctgtgcaacgtacggcattttccgacggaggagggcggcatcagcatggccatgcaagtctagggtggcggttacggcatgggctacccggcagcgaccgtgtgcaatggcagcgcagcgcggcgcctgagatggcgtggcgtgctgcttgtcggcggccaggacagcctgcgggctgctcttcctttttctcgtttctttgatttgctctttctatttcatcttcctgatggccaccgacctcctccccacccgctggccagcctgcgcaaagaagtgagagggagaggaggaagggaaaggaagaggaagggagagggtgatgacatggcatcctggcatgtggggtatatgtgggtcctaagctaactcagtcaccacatcggataaaacggggttaaaataaccgaagaacctaaagtgaaaagttttataagtagaaggatatcatatatatgcttctgcagtttgggaacgattttttaaatcgatgacaagttaagataccttgggtgtactttttcctttttttttcctctcttaggctacgttcgttttcagtggttaccaactccccctctcgttctccatgtgcatgtttttcaaacggctaaacggtacgtcttttgtaaaaagtttctatacgaaagtttcttaaaaatcatattaatccatgtttataaaaaaatagctaatggaccactctgtttttcatatgggagggattagttcccatcctcctgaaacgaacacgccggaccagcctttctctctctcggcccatttcaacttttcacccttcactactgtgcagccaagttcagcacctccaattgtttcttgtcgatctctgtcagcttttgtcccaaatgtaacgggtggcgcacgagttaactgcgttggtttgtaagctctagatcggttctactccctccgtactataaaataccaacttactatcaaatgcaaaatattttagtattacgaatttagacatatatctttcaggtttagattaatagtaatagaatatgtcacacgtaatcctagattcattttttaatggaagagagtagttggaacagcacgccgcctgctgtgaaatagttggtgtccagtgatattgctggttccttaaattaaaaaaaaaagattccccagaaaaatatgatcagccacctccctgatctcctcctccgaaccacaccgttccagcacagccgggccgatcaccatggcgccccggccgccgaggcttgccatgctgcacacgaccgcatgctacgctcgcagctgcaactacctagctaccacgatccacagtggtgaaagctaacacaggtagagaaaccatctttggtcagtcgatcaaattccacaatagtcccggttccattaaaaaccgggatctggttaaaaaaaatttaatctttacacaccaaccgggactaaagatgatttttagtcccggttcatcccctgtcagaggcatgtgagggagccgagaatctttagtcccggttgatactaccaacgggactaaagattaccattttagtttcggtttattaccaactgggactaaaattcaacatagtatataatccctagtccttatcctctactccacaatcacaaccactttctcacacacacagatcgatcatcctctcttctccccctccttccctctcctatcttacacagatcctccccttcctccttccttcccccttcccttcctcctccctcccctggagacggatgaggccgctcctccttccttcccagccccttcccttcctcctccctccctggagacggatgaggccgcgccgcgcggacgcggtggacggacggacacgcggcgtgcggcgcagacgtgcgttgcagggtgagcacatgcgcgcaaacgtcctccctcccctaaagttacttgttgtctctttttttttatattttttgattcactaagatgtaattttgtgattcattgtatggatttgagatgtataatctgtgatgtatttgatttgtgtgtaaattttttaggatttgcgatattttagatttgtgtgtataagtaactttaagatttgtgatgcagatttgggatgttactttatttggggatttggggtttgatttgggatgtgcatgccatccgattcgggagaaaataaaaaagtaacaaaaaaaagaaaagggtaccaacaccaaccgggactaaagatagatctttactcccgattatttcacccgggactaaagataacgatgtttagtcccgaattcatagtctcggttaaaaacccgggactatagggaattacaaaccgggagtaaagacagtttctctaccagtgtaatcacaagccacacacacatgcatctatccgaagactaatgacatctaccaatgctaagcgaaggcgctgggacctttcgtcactggcacaaatcgcagagaaccatactgttcacatgcaatgtccagccaacatgatcaaagtggtcaaaatcaacaatctcgtacttgccctttccgtgatgacacccattcctcagcgaagaacacacgatgctgtcacatcaagtactgttttgattactgctaattaagtatgcaaattaacggggagacaggatgaagaaagctagagggagaggcaaagtaatctactgcaagtagaatacaagaacggatcggaggctcgggaatcaatatggagtatatatgatgtgagttcgtgcatatagggccttgaattctaccaaaggacaactgcgctaggatcagctgaatttcatttggttcgcattcatggctgaattctttgataactactggattttccactcatggtggggatttctcaccggcccgttattacatggcaaagattatttttcgttcattgttttgcttctcttttctttgtcttcaaatgagcgcctttggtaagatcttaaaccactgtgtagtgaaagcaagatcatcatgtacgtacgactacgattagaacacttggatcaccatgggaagaaaactcatttgcggtcatcaaaacaatttgtgaaattccggcgtttagttaatcaattgaaccaccaaaaccacatcgacactagaggtttctggtttgggaaggagctatctcgggatcgccggatagtccggccactgtggattgggagagagctaatgatcccctgcgttgtcctcattttgatgcggaagagaagaactacggtagcacattggcatactagagttaacaggggagatcgagatgagattggggaattttttttaccgttttgaactagtttgacaaaaaatatttgaccagagcaactgaatatcgggacataccagtgaatccaatatttcaaaaattttcttttgaaatattttattatgggttgacgacaagtcgttaggtccgatgaaaaatattagctatctatccactactatctagcggtgaaagtggttacagtgaccttagtagcaacctaagtttttgagttcaaatccccataagaacgaattttaaattgggcgcgaagtcatatgagcgcatatatcctgttgggtgtaatacctattctctaaaaaaagtatctagcaataattgatatggaaattaaattagaattttatgctctgcggtatcaaaaggttcctgggctccaagaattatttttagattgtgcagttttacccctctgataaatctaaatgttatgctataccattcacaaacttaatatagagattgtgagccgttcacattaattacatggttgtaccttggaacaaactgtcttcagtatatggcgttttttggttcttgtcgtggtgccctcaaccagggtttgcaaattaatttgttttgaacttttgtgttggggttagctgaaaatttttattatttgaacaaattttagccgaatttgaataaacttttgaccaaattcataaaaaactgaaagccttgaaaatttcgggctaaatagtttcaagtgcgggggaggggataccaaaattgccaaactgccctcaaattgtaaattgcaaattgctcatagttccgatatttgaaacaaaaattgcaaatagtgcgctcaactgaagaaccaatccatgtatgtttgatgtttcactcaaatttagctggaacaacctaatcacaaattgctgattcctccacggatcaagtgatgcctggatacaggttcctaaaaacgtccaatgcttcaatcttgacttaacgatacagggtagtcaaactggaccagtcagttacaaaacattggtttcagccgcagttttgcagccatctctaacttgagtcggttatctatttatctgtattggagctcaagctgatcagtgtcatgacgatattcttttcacgacaccacccattcccaactaatgggatgcaccacacaaattaaaccaacgagaacaaaacggtcattatatgttcctatctgaaagaaactgtgtgtatgcattgatattggcccttatataagccaaggatgcctggatttttcattttagatcttttttaaaaaatattttataaatagacccctacaaaaatttattcttggaatggatccttttcgcgccaacgacattgacgccgtcaccgtggtccaacaaagacgttggtggcgttccccggcctatcctctatataaaagctaaatcacttatatgaaggggaagtgaaccatttaaaaaaaggatctatttttaataagaaatatttatatgtaggtcctcacaataaataacattggcaccgatgacctatttataaatattattttacaaataagtctttttttcaaaaaatatttacaaataggctatcggcgccaatgacattggtgcactactacaggagatgtcataggtgtcggtttctaaagttaagggattaaaagtggacttattcctatttttttcctctcttggccagaccagcttttttccctttcagcccatttaaatttttcacccttcacaactgtgccgccaagatgagcacttccaattgtttcttgtcgtgctctgtcagcttctgtcccgaatgtaacagggtggcgcacgagttaactgtgttgggttgtaaaattgttggtgtccagggatattgctggttcctttaacttaataaaaataggtttcccataaaatagaatgatcagcatcctcccttctcctccgaaccacactgtccctgcacagccgagccggccatggcgccccgcccgaggcttgctcctgcacacgaccgcactctaggatcgcagccgcaaccacctaccgcgcacacgcgccgcaccaaggtgaccaaccgttcgacggcggtgaaagctaatcacgagccacacacacaagcatccgaagagtaatgacttaattatctaccaatgcttataagcgaaaatgctggacctttggtgactggcacaaatcgcagagaatgataccgttcacgaaccgtgcaatgtccaaccaacatgatcgaaatggtcatatccatctatcccatacttgtcatttccgtgatgacacccattcctaagtgaagaacacacacgatgctgtcacggcaagtactgttttggttactgctatgtaacatcagttaggatcgacctgctcgtttctcttagcttgtgtgttgttagaatgcagaagtgtgcaaattaacggagaaacagggtgaagaaagctagagggagaggcaaggagtaatgtactcctaggatagaggctcgggagacaatatggagtatttatatatgatatatgctaccagaggagaactaggatatgctgaatttcattttgttttgcgttcatggctgaattctttgatgactgaattttccattcatggtggggatttctcaccgtccccttattacatggcaaagaatttcgttcattgtattgcttctgttttctttgtcttcaaattagcggcttcggtaacatcttaaaccagtgtgttgtgaaaacaagatgagatcatcatgtacgtacgactacgattagaacacatggatcaccataagaaaactcattttttaggtgacttgatataccaaccaggctccaattaatgtattggaaaggggggaaattatgtgggtcaccaacaattccagcgtttataatcaattgagccaccaatgcggtcagggagagaactaaattaagttacccttgcgttgtcctcatcttgatgccgaacagacgaacaatcgcacattggcatagaagagttagcagaggggttttgcagccatctctaccttgagtcggccatcttttgataagagtcggtgctcaagctgatcggtgtcgtaaagatattctcttcatgacaccacccattcccaactaatgagatgcaccacacaatccaacaagaacagaaaggtcacttattagacccacccggtcaacacattcaagatattacttccttcgttttaaattattggttattcagttttgtcctaaatcaaaggtttgtttcattaatcattaatttctaaaattaatatagtttaatatgattcagtgtttgacgtatgacagaactgggacagaggatgcagtaattattctggttgggccatgcaaaattgcaaattagctaggaccaatcgaaaggtgattccacatatgagttggtgcatagcatgctcgcgctagcacatttgacgcaaattaccaggtggaatcctatttcgtcccatattgttctttctttcccatgtgtatcctctaaatccctcgttttatccaaatattgttgaaaaggtgaaatatacccccacaaaaaaaaaagaaaaggtgaaatatgatgttctcttcaaacaacaactcatttttacctacctacctaagtagatcatgctagtttgatattggatgatatctctttcctttttctttctaacaattccagtgtagattacctcttcatgactgaagcaacaattggggtgatttggagcaaatcttatgttggttttccattagaacgaaagtgtatcacaattggcataacactgccaaaaaaaaataagaaaggttaccagttttgccatccccatggaccgtattccggtccaa

SEQ ID NO: 2341 - DNA, 2019 bp, Oryza sativa
aactcttatgaagaagtctaatttacccctatggtatggaaaataaataaatttatagagtatagaaatttgttgtatgagactttattgagtttgtaaaatgcgaggtagtatttatgaaaaaaaatatttttaaatatgaaataaaaattaatatttatcttctaattattaaaaattttgttcgtagcttatttattggttagtagaacaacatgttttctatatatagatatacgctacacaaatgatttttcataactaaataactaatattaatttttatgtcatatatacaaataaattttatgataaataatacctcgcataataaactcacagatataatagtctcaaataatacatttctatcttccaatactatacttcataattttatatgtttcttcgtaccaaagggcaaaatagactttttttttataggaatacaacagtcgacccacgattagctaacgaaaagtgtatgaaaaggatccaaactaaaattcatagatatacaagagaatgagcaaaattcagagacatggtaggaattacgtagagaaagtttaaagggtacgtacgcagagaattttctcaaagcaatgtgtatgctctcttagccggcgaacagaatcccggcgtcctcaatctctcttcaactcccaaactgaaaaactcaacaatgcctctgaacttgaagacaagtgcattggcgctgcaacaccttcagcagtttttctgggttatattcatccccttttatttggaaacaacgctagtaaatcggccgtagtggccatcatgcacgcgacacgatccgcaccgacgtgcgccatcccacacgtcagatcgtgccgtgcgagactcggactccacaacagactccacgattttgacgtgaactcacacacctaaagtcttacacacgacgtagctgctagccagctggcccacaagcaaaacaaagaaaagaacgacaaactacccgatgaggaacagtgaaaaatagaaaatgcctaaaaagacaacgccacagacggcgagattgacaacatgctctagatcctattcctagtgtgacatctcaaatgaactttgctgcgagagctataacataggtcatcagagggaagtgagaggcatatgtggtgatggagttagttgtaaatttatctcctttgaacttacgttagaggtaggtacgatagacaaagtagtaatgcaatggcggtgcaacatatccgcgaggaggcagcagcccaatgagatggagatggaggtaggctgctagcacatagcatagggagacttttaagagctatgtgaacggcaacaccagtcgaccacagtacaggttccatccgtattcttacaggtatctcttccttattttggtcagcatgctcagcatatacgactccatatcatgatattctttccacgacaccacctattccaagtaaagaaatgcactatactaatataacaactgagaatagagtgacttcacattcctatcagacatgaagtgtatgcttagacattagtccttatataggctaaaggaggtagcatgaggaaacaaacccaaacatgttaacataaattatgttgcgccagaatttgtgatgtgtgagcagggttttcaattttgaaattgtatttttgcctgggaggaccaaaatttcggaaattttgtggctgaaattatttgaaattttgacttattttgaatgaatttgaataaaatttgaccaaattcacaaaaatttgcaaaacaccgaaatttcgggcgagatgtgagcctttgcttgcttcagttattggcctacggtaacataactcttatattagtcacttactccctccgtcctaagaaaaacaatctctagctttaaacctggacatgcccatatacatgttcatagctaggaactgacttttttaggacgaagcatgtaaggaagaagtaaacatttggcctttttttatctcataccatcttaattgaagccc

SEQ ID NO: 2342 - DNA, 9788 bp, Oryza sativa
  unsure (1)..(9788): unsure at all n locations
caacggcgtcatctattaaaaaatagaggtagtaaattttaggtttattaattaataaaaaatatttatgtagcgtataaatatatttatattatatagaaaacatgttttagtactatgcacaaaataagctacatatatgtattttaaaaattaaaaataaatattatttttatgtcctatctaaaaataaactttgtcacaaataatatcttgcgttataaaatgataaatataaaagtatcatacaacaaatttccatactctataagtttatttggttttcataccatagggcaaattggacttttacacaagaatttaacggtcaactaacagaaaggatatggaagatatccaatccaaatatacaagagaataagcaaatttgactaggaatcctatatattttaggaactgccaccatctctatcgaggatggcccccaccgtcaaccttgtcgtcggaacccaccgcctcctcgtcggagcccacccgtgtcaaacttcactgacacctacatgtcgaccacaccaagacgtgctcctgctgcccggacttcgtcacccaacaaatctgttccaacctatcttagattgaccacctatcaatctagtcgttagccaaagccgacgaatcaccatgttgccttcatagttgctgaatgaccagagcgccacgtttggccatctctttattgaatgcaactcgccaaaaggcccgacccacccccgccggtgtgtttgattccaccgaccgagaatggcaatcacctccagcttcaaccaagcccgagtgtttggcctcatgtcaccttgttgaaagtagctttctagaaagttcgagtcaccagcccaaagtgtctgaatccatctattggatcgcaatttgcttctgccaccatcaacccgagcactgcatctggtcatctccttgttgaaaacatccatcgaacggttcaaaccaccgcctgaaatgttatatccaccgatcaaatttcgtttatcaccaccatgctccaccttgcgtgcacattcgtcccttcacatcctgtgtaatcgttgtagcgtggagcacctcccacgtacctctaccatggatttcccataagctctcatacaacttgttctaaagccggcccccaaatcacaattggaaactaaacatgaaagaaacgccatagaagagccaaatttgatgatgacaccgatgaatgatatttgttaacaaagttcaaccgaagcctatatccttgtggcactgattatgggtgctccatcgattcaggcatccaacattattacaatgtattagagttacaacgagcctcagccgaacgtcggcagccactccctctcgcctatggtaagtcacgatgcggttgcaacatatctacccctttatttaagagataggctagaatagagtccgacgcttactctattcctaacacctagtacaactctatgtcctaaactgtaaccgacatattcgacacaaactctaacaccattcaaccatgattggcctccattgaagccacaattaggcttagttttttaacactgccaaataataataagtttaccagtcaccagccagaagcactacaacatatcctcaccaccttcatgcccggcagccggcgacggtgctagctccgatccaacaccggataccagcatcatcaccacacacacagctccatcccaaccccctggtgcgctagagcaggctgagatgcatatgcctccttcttgcccagtcatacaccaagatccacaccatcaggttgaagtgtacaacaccatggatcatctgcgtgccggcacttccaacccacgacgacctcagcagccgtcggtttaactgaggattcaactttgcaggacgggccctgcacgagcatgaacgggatgagacggcgagttgagcgcgcccagttgacgtggtgggcagcatcatggtgatggcgaaggtgaagtagtacaattgacaaagcgaaaatgctgaggagggtggcctctgcaggccacagtgaaaatgttgcctggtgtgtaaagaagaggaataataacagacgctgaatgatgagcctttggagcctggaaggaacaagcaaattgtagggaaataaggcacgtatatatgcaaagaaattggatgagtcaatccatgcaaacaacgcgtgtcgctgtaaacaccggccagcaacgcaagcagatagctatcaaagacaccaaacagaaggaagtaacacaaaaacgagcaagaaaagacgaacaattaataaaggaatcagacgatgagattattggcagcggcattagacgacaccaacagagaacgcagcaacaagcaggcatcgatttgccaacatccttcgttcggacgaccataaaataaacagaaactaccactggtagaacggtacgtcagtaaatcaagaggagagggaaaaaattctagaaaaaagcagggaaaacggaaccccatgggacttagggagttttatgatgcgcgcgaggaggcagtggcccaatccgtcagataaaggcagggctgcaggctgctcgcactagaagactttacggagttccaggagcagtagcaccagttgaccacagaaatacagaatatgtttcatccgtagtctcctggggatctctaccctatttaggtcaccatgctcagtctgttttagcatgataatttttccatcttggttcctgttatggcattcagattaacgctttgctccagctgaattaggttggttgctatattatgggtgatacattattcttcaacttgctccctaactgatgttatgagaaatggtataatctgctccatatagtaaagtacactgagacttaaatcttctattccttcatcttcttcgactcaccatcatcgattgcatctctaattgacggtcctccacctggtgcatgcgtccccctctgtgtcgtcccttgactctcctctattaatttgttaagctttttggttatcataagcaaatcgatattatcagcagctagtactccaatcacagtttgtgaatctcacatggcctagacgaatgcatagctgtgtgtgtaccaccagaccaatcactacaaagtgaccactgcgataacctacttgtctcggccctcttcctggttcctctctcattcctaaggaagaaacaaatgcttgcagtggtgcccaaattaacaagcagagatagagtattctaatctgaaggggtaggagtatactccctccgtttcaaaatgttgacaccgttgactttttagcacatatttgaccattcgtcttatttaaaaaaatttgtgaaaaatgtaaaactatatgtgtacatgaaagtatatttaacaatgaatcaaatgatataaaaataataaataattacttaaattttttgaataagacgaatgatcaaacatgtactaaaaagtcaagtgtcaaacattttgaaaacggagggagtatatatgaacccaacagatcgagaattgtttgctctctctagtttgtatattcgtaccaatacacattaagcagtgttgaatgtgtaatttcagctgtggccccccaaagtgtttcaattgttagagcatctccagcagggacctcaaattcagcccctattcaatttttgagagttaagatcaaaaaactagatccagcagggaccctactagagccccaaaagtgaggaggccctcgaatcctcccccaaggccccagtcctgggggctccggagcacgcccccatcgtcattttttttggcgcggataataattttgcttcgcgcattttcttgttattcctgcacggctgcgacgacggatcttctccggcgagcaccgacgaattcccagcacctccgtcaagactgcccccgaaaggtaagacttttccatacctttcttgcccgtcgatctcaaggccttcggcggcggtccatgcgcatgcccggccgccgatctcccgccatctgcctggccacacgccggccgtcgcgtgccctccaaggctgcccgcacacacgtcacccacctgcacgctgtctgcccccacgctggcctcctgcccccattgacttttctagagaaactctaagtaggtcatgtgctgcgggggttcagtggtagagtactgatcaattttctgaataactctgttcttgacacaaatggacatgtggtggtagatggttctggtggagactgacttgtttttaataatttttttggagaattgtagtggactttgtcgtcaaggaaaatctaaattctcaactagtaatggttgtgtttagttcacactaaaattgaaagtttagttaaaattggaacgatgtgacggaaaagttagaagtttatgtgtgtagcgattgcaatggcttggagaataagtctgctggagtttgttagcagatgcgggagatgcggcgatcaggatctgaatgaccgcatcagtagcgtccgtgtgcgtgagtttagcgcaggtgtgtgtagctgaattcagagatttgcggatcgtgggatggcacgattttgcctcggattcgtttatttgtatcgagtataagtaggagtcttagctcagttttttcatttgtaagttctttatttagttgaatgaaaaaccaccagaaaattgccccacatttgatcgttctcgcggagaattctgaaatttctcagttttttcctctgctctgaatttcctttgttcttcgttactgttttagtctgttgccgtgccggacatctgcagtttgcacgcaatgtgttcgatcagaggttatcgccaacaaacagcatagagagaagttaaaggctacttcatccttatgggtatactttggactgaagaaaacaactatccgatgcaaacagcgattcagcgagtgaaaagccagacaatctgaagtaagtgagagacgggtggtgacgtcgtgtaataagttgtggattaatcttccctgaagttgagaggtaggtgaggtaacaaattattgctagaactttgtgttgccatcccaagttcccaactcaaaaaactagcaaggaagcaacataaatctatccctatactaattgggcactttctacgaactctcacgttaactataaagatctaaccattagattagattgacggtaatatcaggaccgtagatttaaactgtaaacatggacttttaaagtccaagcaatctagcgttagaaattggtccaccatccaatctctttaactgctttaaaggcccaaaacccatatatgtgcacgtattaatctcagccaccacattagggtattcacctacatcgatggctgccacggtattggcggacatcgctcccgacaagacggcggcaacttcgacctccttcatcgtgcacccgaggtttggccgcaattgcatgcaggcaaagctccatatcgatgtcgaccgaatgcatttgtccttgcggggtctcagctcatctattaagaattgatctaaactgatcctacagctacgattgctgatttacgtacacaagtaagattttgttcgaactttctccaattctagctgttcatctgcatgctcttcatctggctatgccaacatatgacctaataaatttcaggtgcattgagatgttataattcacccaaacaaacaagttcgattgcacccaaagagatcgatccgtggtcgtctcatctgctctttatgaaggtacgtaatttgtcaatttggatattctatgccaagttttgcttgcacctaggaaacatccatcgtaggcgttgcatctgtaaaccatgcatgaagataattcatgcatggttgatttgtatggtctcttatatgtatatatattcgaactttgttgttctatagctttctgcacattcaaactaattaatccatgcgtgctgcttcgttgtatccgctcattgttatttaagttgatgccatatatatatatataatttccaaagacaaataacacaacttatttgtctctcgacatgatataaatatatattctttctcacaaacagggatgatacaaatattttcttgagagttcaagacaagtacaattttatattaataattagacaattaaaattgtaacttcaagtttgacaagcagcagccataaaaatatttttgcttgacagtccaagacgagaacaattttaaatttaataattttgattagcaaactttaactaggactctttttatctaatccactataactccctattctaattatgacagagttctaaacatcttcgactatcaatatcaatgtagcatttattagtttaatcatcataaaatcgtacccattgattatgttggttttatattaaataaaacaggccatatgctctttacatttatagattttctaaaaaaaatgaaattaataatatggagctgtaccaattaaaccttggactacgtactatttagcattgctattaataatttatgaaattcaaaataaaaaatagcagattgtaacaggtagggattgattttatctaatcccactacaatgtgaaaataaattcaaacttaataactatatatcgatttatgaccatgctcaactgtcaatttagcacttattaatttaattatttaattcaaaactaacaagttattttaattctaatctactatattttaaaaataaacaacacatctgtagcataaaactgttcatattattgtaacaatatataattatacccgtgcaacgcacgggttgacgtctagtaatatgtaattctgggtattgcaattatttgcataaaaacagaagctgctcaagaaaagaaggtatcaaatcaatttgttcagcataatcttcaatttcagatcgttgtactagtctcttcgttcttgagttatccatcgatgcttgcaggttttgaagatctgggaggcttgactccccactgtagctttccacttctcaccgtcatgagacgtccagtcctatcagatctacactcagttttcctgctgcctcctattcataacaaatgaatatcaatataaattgtttttgagaacacaaaaaaggacaagtacaccgagtgttccatgatgtccaagagatatatgtttggttatataaattttttagtcgatcaaagatatatgtacaactacaaagcataggtaggggagagcaataagtagcaacatattttatatcaacatcatcaccaaatcgtgaagaggaggtgcatatttactatacgggatttgcattagataaaagggtttacatgggatttggttataacattcaccctcttctttaaaagagcgacactttggggaccgcagatattacatgaaacaactaccaatgcaattataaggcattggtatataaaagaaaacattagttcagggtggtcaataactcgtgttcacacgtattttttgaaccgtcgtctaaaagtaagggcatgtagaaatcaggatttttctcaagcagattccatgaccacccgtaaaaatcaattttcatgaatggccggtaaaaatgaattaccagattttgactttcgtaggcacaaaaggtaccaaaaacatattttaggcatctatacatggcagcgaaacataaatcacaagtcacatgattttacctatgagcttttcatgattgttggaaggatatgctatttgtttctcacttcaccattctaaacttggaatatacattttgcacgttgaataacttcaaatggaaatgtcatcagatgtaaacttgtagatcgcgttgagttatacacttttgacatagaacatgtctctatataaggtcatttggaaaactcaaaacttaattttcagtcactaatccataaaaaaagttgattcaataataattagtgaaaaaaaatgaaaactaataaacaaccatttctgtcagatggattaatgcgtgcaatatatatatatcgtcaacattgtcgaacaagcattatgcaaatactacctccgtcccataaaaattgcatttctagctaatttaggacaaaatagtaggattggaaaattaccacaataaccttatttaatgaacccactgtatgcacacattccatatatacaaatgattaaaaggaagtttgagagaattaacccatataattagcatacttaataaaattacaagcattagcagctcaaattatgtgagatggaatgaaacttatatagatgaatcaattggttaggccccacatggctagaaatataattttgtggaacaaagccttggagctagaaatgcaatttttatgggacggagggagtatatgcatattacacacaatattttacactgaaggaaatacaagtccatttattccaaatcccagaaaatatataagcaaaagtaggtggaaaaaaaacaagccaacagacacctcgatcgattaattatctgtttgtttatttacttacctgcagttatttatttatgtagcatcctatgaatagatgagcgagagaaacacacaccaatcgatttatctttgaacggtaaataaatttgtcagccatgggagacctaaagctacccaagagctgatgtctccctccatggctgtcctatctccaaatatcaccgcgatgatgacgcgcaccaccgcgccgacgatgttccgatctcgctccgacggaatgccatggagaggaccaccttcaccgatcatctcctcgctgatcgccagcatgatctgccctccacatttcatgtcccgagctgcctgccatctcctccgtgcgatctgcttgatgcaggacacgtgcagggacacggcctcgccgccgccgtcgacgacgtcggagttgtagtagcaccattgctcctggcggcggaggcggcggcagcagtgatccgggccctcctcctcctgtctgctgcataggctgcacttgctgaacgccgcgatgtcgaaggcgaccccgtcgatagtgatcttggctagtccctgttgagaatagtcccacgttacttatttatggggttgagccaacttaaaagtgagggaatctctcacctctttaactagcttttgaggcgtagcaagactttctttcggttggtccaacgtctcccggttttggaccgggagttcctgcaggctcgcacagcatgggtggaggtcgaggttggcgcctgagcagtggtagacgagaccgaacacatggtcgccgcaggtgtcgcaccacctgccgccgctttcgcctctgccaccaccggtggcggcggggtgcggtttctccggtcgtccttgcggtggcttggcgagaagctcgaacgtgcggccgaagagatggtggtagagcgtgctcggcgcatgggcacagaacttgtgcatgttgaggtcctcgcaggtgaggcagtggtacctcggcccgtctccgggctccttgcaggcgtcgcacttgaacggcgcttcgccggtggtggtcaccattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2343 - DNA, 690 bp, Oryza sativa
acatctaagtccgcctattgcttgtggtacaatatgcaatcgtttggacatgcgtgaattctccggacctctaaccctaggagacacagaacctgttttgcttcatatgtcgtctcgggcaatgtgttctcctgaggaagcatgtccttcagtattcccaaaagttctgtaaaactcttgtctgaccatccactactagccttcaacttcattaggtctaatgttgctgataatttggtgtgcttcaacttcattgagtctccgagtcactgaccaacctgctgaacttcatggaatctctctcgttcatagctgggtcatcaacgtcacgtaatatgtcttgcagcatatcagttccacatcaaccatttcaccgcccaatggagatgggacaaacatgtcatgctcttcttcatgtccttcttcatgattgtctgcaccacttccgtctgcagctgcaccatcagtacccagatcttgctctccatgcttcacccaacatgtgtatctctccatgaatccccggcgtatcaagtgagcgtgtacttccttttcatcgtccaaccaaatctcattcctgcaatcgttacatggacaacacatgtacttgtcatttcttcttatcctatcctccactcgggctttcataaaacttaatacgccatctctatactccttgtactgacacct

SEQ ID NO: 2344 - DNA, 2546 bp, Oryza sativa
tcagttaaccatccaaaactattcatactcaaactcccttaaactattaatccatcatttcgcctataactagttataagccataacatttactagcaaacaaaagtaatacatagataaaattagaggttgttcatattatagccaaaataaaccttacaattttggcaagttgataatattattaaaattttgataggatttcttatatatttaccaaagtttggtaattaaatgtagacactttttttttaacaatcttgtcaaaaagaagttatggttaaaaataacatcactctgaacaacccctagtatacatatgttgtgaactatgatgaaaacatcaaaatcaactttaaaattaagattaaattccaattgtgattgatgctgataaattgaagagcaattttaacttcagaaaatattttaaaaataatttaggtttttcacatattttcaaccacttaatttggttaaaatttggccactcaaatcggtttttactttttaaaagtataaagttttattccaaaagtactctcattgcttcggtttaccaccttttcaaccacaaaaggtaaacggtaagaaaacactacaagcttgtttggcacagctccagctttctttttctgagttagagtccaatcaaacagtttcggatccatctaaaatgggaatagagctagatgaaacattatcacaaaataaaagaggtggagttgagtttaaacggctacacaactccactccaaacctaactcctagagctaaaattaagtgtccctttgaatcacacgatttaaaaaacaaaggtatagggaaacataggattcagacaggaatgcaagtctaaaataaaggattgcaaaacataggaaaaacataagaatgatcgtttgattgttggatcacagtaaaaatacatgaattagataaagagagatagtcttaaaagaaattttctaaaaggttagagtttttgctaagttttctccaaaatctatatgcaatgagcaaatttcatatgatttaaaaagtttcaatcctttaaatcaaataaccacgtagaaaaaaagtcatatatgagtatgaaattacagcgtagaatcctttgcttggggccctaagagtgacactctaccaaacaagtcctacttctatgctaagcgaaacgatatatttacgaacacaaaatataatttgtgaataaaacttttatatacgtgtagcgatctaaataaacactgaaaatttaaatttcaataaaaaaccctaaaatcaactttaaatttaacactgaaaatttaaatttgggctaataaacatatgcaaaagttaaagccgtaaattgccatgtctgttcatcttgcttatcagaacggaataatctttacacgcgtggcatatagtatgttcttgcaaatttgaacactcgaggccgcgaaagttccagaagaaacgcgttccactgcaacacgcggacgagcgtgacgacgtcagcgtcctcggaacgcaagggcactccggtaatttctccaccccttctcttggcctataaattgccacctgcgccgcggcgaaagaacgcaatctcatcgcaagaaaagaaaaaaaatcctattcaaatcgaaacccctctctttgatctcgtcgccgaggaattaggaggagagagagcaatggccgccgaggagggagtcgtgatcgcctgccacaacaaggacgagttcgacgcccagatgaccaaggccaaggaggccggcaaagtggtacgtttcctggcgcagaattttggggattttttttttggggttttgttcaccagggggtcgcggttcgtcttagatcgataggattttgaagaaatttaggatttaatttcttgctgagatttgtggcatgtggtgaaatcgcgaggagatcgattgtttctattttggcgattggggcgtagggttgtcgcggatttggggattgccgattctggtgggggagattttagtagtagattttcatgaatatattttaggatgatataatgaacaattcttttaaaagaaatctgttgcagtaattacagggcactctgtatttgacatgattaatcgttgatgtttggattttaccatgagatggggcgatttgatgcttacatctgcaagcgaattttcatccgctatctgtatagtatttgactccataggcgaaattgttagtgtttaaatttaccgtaagatgggatggtgtgatgtgatgtttaggtttgctccagttgtttcatgctgatgattctctaatttgagtataagctttgtttaaatatatagatatattcttaaatagtactataatttgacatgattcgccagagttgaaggaaatctggttctaatctagttcaattgttgttatggacaatagattgccacttcacatgtcttggcattgttatgatgtgatgctttgtacagataagcgtccgccctgtagtattggatttggtttcttgctgcgcggcataaacgaggattttgaccaag

SEQ ID NO: 2345 - DNA, 9430 bp, Oryza sativa
tttttcagttttgtttatataagggcagggctctgcctgccaatctatcaaggaagaggagggaaaggagtcatagcatgttgagttgttgttgggctaaatggttcggcccgtctctgagtgggccttatcgtcgtcttcggggttagcccaaaatttaggggtactacatactgagggaaagagaaggcgaccggggctctgctttcctctatccttcggttttttagtggttttaacgaccggaattgtaattttctcacttgatttgaagatgtggcttgcaagttggaacaattaaacactagatccactgatccacatgcataataagatgaaaaagaaaagaaaaataggccttggatttgcccaaagatttccaagtcggcaatttctccaatccacgctcgcgagcactcgggctagccagaactggtgggtgacaaattgtgggagtctgggagagattgggccagctatggactaaagaaactcaattcgactatagaagtaattgaagcaaggaataagtatattttttgtcgttcatcttatgtactcttgcttaaattgtctccctcaaccataaaatcagatataacacattccttctctttgaaaaccggtgcaaatcgactcattcaatagtacgggaaacggttactacaggtgaggtccatatgtgacatatgatatgtcattgagatatgacaaaaatatgtggtaagccccacgtgcaccggaaaatctttcgggcctgtattttacaccagttttggatcaattatgggccttccaagcaggccctaagtttaatattttgaacccagcgagcaggttagggcttatttagttggcaaaaaaaaatgttgccgcttcatatcacatcagatatacgaacatacatttgaagtattaaacgtaatctaataataaaacaaattacagattccgtcaggaaattgcgagacaaatttattaagccttattaatccgtcattagcaaatattttactgtaacaacacattgtcaaatcatggcgcaattcaggggcgtagccagctaggtggcaccgtggtccatggaccacctaagaatttgaaattatagtatatgtgctagttaatataataaaaattgtatagtggaccacccttttaattggcatattacatatagatggaccacctttactttaaatcctagctacgccactggcgcaattaggcttaaaagattcgtcttgcaatttcctgacgaactatgtaattgttttttttttctgcatctaatactgtccaaacattcgatgtgacaacgtgaaaaattttgtttggaaactaaattggaggaaaaacataggaattttggatgattccaattctataggaaaatttcctatgaagccctttgaaacaaaggattgaattctatccaatcctttgaaattcttatggaatggacaatcctatagagattttggaggaaatttagcaagagcttcaacctcttggtaacttttctttgagtctatctctctcatccaattcctgcgtttttcctgcggttcaatcaaacggttattcctgtgttttgcaatgctctgttttccacttacattcatatcaaaattctacgttttttctattcctacgtttttttcaatcatgcgattcaaaggggccctaagcaggctcctattccacgaacatacatacacagtccaactaaactgtactcttatatatacaccattgatttctctaaatggaaaaacacaacgcagagctttcatataggttgtgtttagttcagcgtaaagtttaaattttggttgaaattggagatgatgtgactgaaaagttgtgtgtgtatgacaggttgatgtgatggaaaaggactgaagtttggatccaaactttagatctaaacacagccatagtaaggtacaacagattgcagtcctacttttatttcaagagcaggtagaagctgatgacaggttgatgtgatggaaaaggactgaagtttggatccaaactttagatctaaacacagccatagtaaggtacaacagattgcagtcctacttttatttcaagagcaggtagaagctgatgagagaacaaaatgctaacaacaaccctatgtttaggaggaaattagtaccagctggctgtacaaaaatcactactggagtagtaccgtgcatgattagcaccagttcagctcgagacaaatcaatcaccagcagctgtctgttgggttgtgttcacatcattgctacttccaaacctatcaaagtttaatagtaagatttagttccaaacctattaaattttaatagtaaaatcgagtagtttcagaaactctctcataaaaacattaataaaatacgataagggctctaaattaaaatagattcaagtataagcacataaattggaactatccttccattgtcgcaaatattaacaatgttctacttatgtatatgcatatgcccctatccagatacatagctagaaattatcatatttaggatccgatggaggtatgaaaattagtactacatccgatggagggatggagtggatgagatggcttcccagtttggacggcccagatgagagcacaactgccaaccgcaccaaccaccaccccagtagtccagtacaccgaaccctgagcacgcgccacgtaggacgcccgcgtgtgaacggaaccccacgagccggatatttcgtggaccaaacgcgcatatgcgccacgaaaaaaaagtccatattgccaaataaaattccattttcaaaaatcgcctaaaaaacaagctaggtttcatctgggcgaggccgtagctgacaaaaaacgaatgaaaattaaaaaggctatgtgctacacgacacgagaaatttaaacatggaaatttatcgcaactggagcaagttggaatcttcccagcaaacacgtaccagccgcatacctacctacgaatacgttttttttaaaagaaaactgagtaatatttactttttttttgtaatgtactgggagttagatgctgctgtgacgatgagtaagcacagcgtgtgttttatagggatgtgaatgtgcaaaggggctagaagacttgtattttattgatgaaggaatggttcgtaggaattgttgggaattttattttgttacagttgagtcgttttcaacgaaaacttaatttgagaaaagaaactggtagaatgcattatatcagttttttttttaccctctatgtatggtgagcttcattggtggcgaggagagctgacatgagacgacaattcaacataaatcaagtctcataatctatttcatggtattttggttcgtcatgtttacatatcggcctctagccttgctgctttgctagcttgatccactagtgatctttgttttttctttccttattggtagcaaccttgtgtttcaaccaaaatatatatatttcttttgttgttgaaaagtgcaaattaagaaacaggaaaaaaaaacaaaatactattacacactattgaaaacacatgtaaaattcaatcacatgtacatgtgtacagtgaggtggtttgtttagaaaaacaacatttgtttttttttaaaaaaaataacaccggaagctttgatggaaaagaaatattagagatgcaagtgaggcgggtttgtaggctttgaggcccactaagccgtaattgtcattatcttttttatctgtttatatactagtgggtgaaaaataaactgatgtgtatgtcttacgcatgatagcatgctgcccgcttgcattcctagaaaatacttcctccgtttctccgtttcttaatgtaagtcattctagcattttcatattcatattgatgttaatgaatctagacatatatatttatttagattcattaacattaatatgaatgtggaaaattgtagaatgacttatattgtgaaacggatgaagtacttttgaagagataatatatattagtgggacaatcgactttggaaaagaaaaattcaccaagtaagagctctagtttattctctatgcaattagaaacacacgaaagtagtccagattcagaacaaaccatatgtgctaggcgacatcattcattcttagttaagctctatagaaccatatgcattgaacattcctatacgcttaaatataaaacttgtatttgaaaaagtccacagtgaaagctcctaatctttctttttttaaaaaaatatcttaatataatatttctccattgttcctatatttctaggttcccgcatggcccatatgtgtaaagaaaaagaaacctcacgtcagtgttgtggtaaatatgtgatgtcgtcttttaaaaaaagatatgaggtgtgttttttttttcaaaatgtactccctccgtttccggttataagacgttaaactattttaaatttgactaattctacagaagaaagtattaatatttacaacaccaacattgtttcattaaatctataatttaatatattttctgtaaaattagtcaaatttacagtagtttaactttaaacaaagtcaaaacgtcttataacctgaaacggagggagtatattctagagttaatgaaaaatcatgctctcttattggatttttgaaataaaaacatgggaatcgcatgcctctccagtccctagttggcgaaaagaaacgaaaataaaaaaacaaaaacgttttctttctgaaaggcaggcgaagaaacgcatctgtcacgcagcacttccacgcgttgctattcacacaaaagagagagagagagagaaaccaaacgaaacgaacgccaacccaagccaacccagcccaagcgagaggaagaagtaaacacggcaaataatcaacaccgcattaaaaatcttccatccaagtcaagcctcaagcgactcctcccccctataaaagccccctctcctctcctccaactctctcctccccaaagaaatcgcttcttcttccgcctccgcctcccatggcagctcccagctcgtgggacacctccttccacgaagcaaccacagcaaggcaatagcgccacccaccgctcgcatccacagctgctgattcgtaggaggagcaggccagggagggattcgttgattttatttggcagggaaggagatccgagaggaagaaggggaatatagatcgatggggaagtacgtggagctgctcgacatgggggtgcgcatcgccgcgcggttccactcccactgcccgcagacggcgaggatgtactaccacccgccgccgtcctcctcctcttcgccgtcttcctccgccgccgccggttcggccgacggcggcggcggcggctgcgcgggcttcgccgcgaagaggatgccccgggccgccgccgacaccgcggagatcatcctctacgccgtcgtctagagttagcctctagactctcgatccagacgcttcacgaggaaatggaggaatgtatttttcttttgtttttctttaaagaggaaaaaaaacaaagtggacttggagattggttggtttattgatggagtgaaatgaaatgaatggaatgatttgatatttacgtgattttctttttgttttcatttaagttcgtactactactatctttttttaatgcggacaaatattttcaaaatacaacaaaaaagaaaaggtatggacggctgaggatggacgcgtcacaagctaagcaatcaaaatctcaaccaaaccgaatcctaggaaagctccaccaagaaataaaaacaagaaaaaaaaaacgagaggcgcgcaggacaccaccagaggcgcagatctttacctttttcccccgatttcttggtgcttgtgcctaaattcacgccgaattcgtgtgtgcgtggggggcacgcgtttgggtgggcagagcagagcccaagcatcgcggagggctgagttgctggtctgtagagcatgtttggtatagctctaagactcctaaattttgagtctgaagtagtttatcttgtgagagagctctatccagctccactctcagttttagtggagagagcttcacccaacttgttttgatggaccttaaaactgtttgactgagctctagcttcacacacgagcgttttggtgcgcacggcgcgggggggttagctgtagctgtgtggtcgcggtgatgaaatgaatttgccaaccgatctgccgatacgatacgggtggtatctggggaaggaaagatttttggaattttcgtgatctcacgtcgcacatatgttgtgcgtctaggggtaggccggcggggcggcgattctgcggtgccacaccaatttacttcatcatacagagtacttacttgctactccatccatctcaaaataaaccgtaattaaatttatttattttaagataaaaaattatttgtttacttaaaattatttattttaagatgaaaaattatttgtttattttttttaacaaaaggagtacgggtaaattgatagtatatcgtatcctctctagcaaacgattgggttaaagtgaaactgctaccaacgtcttttttttcttcacttgatattttggacatatggacggtttacaccacatctccgcatggtaggatttagtatcaagtttacagctcgagcgttcaccacccaaaatccagtaaattttcttcggaacttttgtggagtacaaccaggcatatgccaccgaacacaaggctgtgtgttctaaagaaaaaaaaaacacaaggctgtgctccatagttttcttgatcgaaaacggtgacggaaattcataactgacggagcatggtttccgtaaaacttgtattgtttttgcctctagccatatataagatcttttttcttctatattttaccaatgccgtattgcaatcatcactaatcactaaataattaacgggaaggctaaatggctgtatgatagatggaatttcctaaccaacacagaacctttattcccttacaaacaatatggttttcgactgttctcatcccttcccgctttgattcactacaaataaaaaactctgttactccaagcaagacctatgtattgttgttagagggatgtttagatcgagggacgtaaagttttgacatgtcacatcgactattatatagggtgtcgcatagtgtcggtgatatgggccggggtatcaggaccagagggaggaggttgcccccgatacccacgtggcactcctccgagggggttaggcccgaggtagggaggcggccgcccctccatgcctgggggtcgagcactcgggctgccccgaccccctccgcatgacaccgcgtgtgcggggttaagtgggcgcccccaacacccacctaaccgcatttaaggcaacatgagtaggcgcgccacatcgcattaaatgcggtgcgttgtgcgcccgaccggtttgtgaccggtcgaatgattgatgagaccggagtagtgcgcctgcgtgctgctcacttgtcaggcggcgtgccgcctaacatgccccctcacgtcatgatgatgagaggttatttagcctttcatcccagccggagtcggttcatccgacctagtcaaaagtagggtttccatttctcggtgtaagtgaggactcagaagtcttcactcatttaatggtgaatggcatgggtgtcccccgtgtcagctggttggatatgacggccccatgccgcggcgtctgtgtgtggcttccaagtcaagcaacaagacatgcaatgtcctccttcacccttaggtagacttctacgcccatgtggcaacccattgggatataaaaaggaggtccaagcttggtgagggagagagatcggttcttggctaactcacgcttgaatttcagagattgaagtgcgtgtattccatactcgatcaaccaagcacaggagtagggtattacatgtataaaccccttttgtctcatcatttctggggccccgaccccgtctacatcacatcttccaccgagtcctcgattttcacccgctgcccccgaccgaactaacaaagggggcctcactgtcccccgcttgaggagttcacccttcgatacatagggtgttcgggtactaataaaagaactaattacaatatccgttaacaaaccgcaagaagattttattaaggctaattaatccgtcattagcatatggttactgtagcaccacattgtcaaattatggagcaattaagcttaaagattcgtctcgcaaagtaatcacaatctgtacaattagttattttttagcctatattaatactttatgcaggtgttcaaacgtttgataagatatggtgtaaaattttagagtgggatctagatatgcccttatcttctggatgaacacaacagagaacagatcagtggaacagatcagcatgtttggaccatgataacgttattaccagctgcatatttgtatgctgcgtttgctcgcccgtgaacctgacttgccgagcacaagaggaagggaggaggaatatgcttttgtttttgctctaccttttttctcccatccgtcacagctgctgctgctacggttgcttggccggtagtagctgtaggtgaggcaaaaaaagacagagcacctagacagaaacacacatgcaagatgactgtgtgtgagacattggagtatggccgcattcagcaagcaaggcatagacggcacatgacgtgataccctcacgcagcagctagtggcatacgtaatccatttgcattcttgcttgcagctgggtgctaactcctgttaatttgtttattacaactagtagtacctttgagggctggattagtttttttttcttaaaatacgatacaaacgcaagcgtccacaatacatgtacaacctccctctaagagttatcacgaagcgtcttgctgtcgatgggtaagtcgcttaccattgaaagaaaaattactcgtaaatacaagcactcatgttaaatctagggggtttttatattgtggccaaaataaatcttattttggcaagttggccactaaatgtaggtattttttatagccttaaaaaatagtatggttaaaaatggtataaatatgaacaacctctaggatttgaacccgagaggattggttccaccacaagaaacctaaccagtaatttggcaagcttagagtactccctccatttcaagaaaaacataattccgatgttgatttaacataatttaggataattaatatggatatgaggttgtccagattcgttattctatttggtgttaaatcctcgcttaggttattttttttatgaagggagtagtaaagaatcaatatttttttcttctaaaatatgaagtactcccttcgtcccaaaatatagcaatcttcgagcggatgg

SEQ ID NO: 2346 - DNA, 3086 bp, Oryza sativa
tcaaaggttgctaatttactatattttgggacggaagaagtaactatcagtactagttaaatattttggaataaaagccgtactcccttcatgccaaaatataagtacgtttggactctgatatggtctccaagatgctatttttggctaacaatatatataaaagtaagatgttttaaataaaaagatttgcatattatgatagattgtttaaaaataaatctagtaacatcaattttacatgattactcttttatttttgttgcaattaatagttacagttaaaaatttgatttatcaccatacttaaaaatgactatatttttaattttggagccgcgagatacagtatgacctgacctctgatgagagtggttgaggagggtgatgtcaaagcgggcgtcggtctgcgtggttgcgatttttctctcacctcacgttgtggaaaaggatggggatgggactatgggagaggttgggcggcggtcggcggagggtcctcgcgtgtgagtgccttcttcaccgaatgcttcgcattcgcatgcaccttttgtttcttcaacgttcaatggaggaggaaagcgtccccgctggcttttaattatttttctgcctgcgaagctgaccgttggtacatggtagtaatagtagcctccgtcccctactataagctattttaacataatattttacttatattgtttaactactcgtcttatttaaaaatattatgtaaatgtaaaaaacaaaaagttatgcttaaagtattttagataataaagtaattaaaaaaataatagttccattttttttaataaaacgaatggcaaacagtgcaagcaaaatgtcaaaatcccttatattagggatggagggagtagcgtttttacccgaccgggaaaagcctatccctttagttttcaattcttatttaggtcaatttttttaagtatagtacagtggacatacacaccactatacacaacatcacactctcacatattcacgaaaacgccctcaagcacatgtctaatgaaatggaaaccaactacgcatgtctgatctcattaaaatttcattaaatacctacttatgtgtgggtaaaaatggtggatttgaaccctcgcatacccacgactctattgttacaccatcagatatcggtgatgaataagtagataatttgtggtaattacttgaaattacaaacaactaaagcacagaaagttttgcctaaagaatattacgacgtttagaagttcaggaagagagcctgttaatctattcatcgtgaacaaagtcaacatcaagttgcttggtttccgtagtaaaatagcacatccgtagcgctactagtggtagcttactacgtttgggttacgtacgtggttatcacgttaagtttttattatctttcaatccaccgtgttcatgttttctatgtagtggttaatttgggatgactaacgaaaggcctcaagccattagccagcaggtaaacgtttgtactccatgtgaccatgtagtttatttaaccatataatacccctagttgtaactcgaaatatatccaaacgacatgttctgctttttacagtttcattgttttgcttatacatatgcttatctgtattgcttatcaataacttttaaaataatttataaggtattaacataaataaatttgcatactaaataaatattgtattgctctctccatcccaatttaatcattagaatactaatatgcattactcattatgtaaatgattagataccatactacgatgtcatttatttttacacaaataaatgagtatataccggttaaatgatgataaatttaaaaagatcacaaaaatcttttcaaattgggataaagaagaaaataaattcattgcatttgttcccgtcagctactagcgagacttcccggcacataaaacgaagcagcgttttagtacgtgattaattaagttttagctatttgttttaaaaattgattaatatgattctttttaagcaactttcgtatataaattttttttttataaaaaacacaccgtttagcagcttaaaaaacgtgcgcgtgaaaaacagacagaggagttggtaacttgtactaccgaatagagacttggtcctggtcggtgctccacccaaagatacagagcacctacacacagtgacacacccaccacacagagagagagagagagagagagggggttgtggtccttgtggacttgtggcgatgggtggtgggggtgctgggggtagtggatgggccgcggagagtcgtcgcgtgcgctttccgttgttcatttttgggttttgcgcttgacatccggctccggcgttgctgcaagaaaaactgaccgttggatggatggatggccgtggtccactggtcctcgatactgttgcctgttggtacggcaccacaccactctgtttttattagaggtaagtttgatagtacagcccactaccagctctaaatcagtcaatgtagtagctaattcatataatagttgcttgctatactattaatatctggttccacctgtcatacacacattacgtcttggagcctgtgctgcaactggctatagatctgtagcccgctgctcttctctctcttcatttatctctttaaaatatatttatagctggcttatagcctgctattatacctactcttactgcaccaaacccacaaggtcactgtgcctttcgcttcggtagcagtcaggtaggcgcctaggtgcataggcctctctctctctctctctatctctctcggtggtgttctgttcatcacaattcacagctcatggcttggccagtttggcctcatcactgcactactcaacgtaaaacaaaatgaagtactgtagaaccaaggcacagaagccacggtagatgtcagaacgcagtattacttgtttcatcaatcacttttaataatttatattttttttcttttttacttccaatcatcctctcatatctaaccataaatcatttaataagagacattataatatttttttcctcgaacctaatcaatactgcaggcctgt

SEQ ID NO: 2347 - DNA, 6941 bp, Oryza sativa
gcatgaaaatgcttcccagtaaaccaattgttttattaggccacaaaattggcatgatattttttttctctgagacagggtagattatactatattaaataagagaagaaattacaacctcgttgttacaagaaaagaagagataagacaaattttacatgatactattgatttaccacacaacaggttttccacaagtcgatcaactcttcaaatcgtgttgcgtgggatcatcttttgctcatgaaaggtagtgtggagtttgatcttctggacgaatatgggaaagactcatgggtgctctggtatgccaagggcgacgagcaaaaatatgatacattggagggtggatgtgaacctggcaaatggcaaggttcaaaccagcaattgtttcgatttcatacgacttgatgatggatgcagatgcataagtatgcttgacaacacattcacaatatcaacacgtgttatttccgctcccgttcttcgaattcttaagctcatccagctgcgatgagaaatgcagagtaagtgatcaaatgcccagctctttctatacaaaacaatctttttatttggacttcaaagtaagctatccaaatgaaactgaaaaaggaacaaaaagagacagttctgaacccagacagatatgatgatgttatcagattttcataagttatttttttcctgaaagtacagaactgtgcttaagatgttaactgtcataatgagaaatctaaattgggtccatcaggattcaggaataccatctagcttgctgtgtgccagccgattactcagcagatgctatagctatcctatgggctgatggaaaactccaagacaataagaaaggcacaaccatgaagaaggaaacatcgctgaggacagaatgctatatacagaactaacaaaatacagtcaaggaattcatttgtgtatttgcacctaaattcatacagtttaatcggactgaaaagtacaccactgaagtattatctgagtggtggagatcctaaacacgcgcaataccaaagtgcaagagccaactaactgcagtgaagtgaccacacataagcaccaatcttgatagacaagtaaatgttagatttccatagagatctccatctctaacatggcattaaggttgtaacacaaaatgctactgtccatatgaatagatcgagtagcaatgcatttacgcaaacacattaaaatgctatatatatacctgtctgcatgtttccttgtgtgtctctaaaagctcattatacttcaattgcaaatccaacttctcagctttgagcttttcatagtcggatattgatggaccacccagcttctgctgaacaaacctgggatataccagcatgtttagttgttggcttcttccaggacaatcaattattcatgccatcttatagtcaaatcaactcactcgaccgcagatgaaggcttgtcattctcctcatataatgcaacaagaactgcaagatgataaggtggacttaatcataatgtatctagccagtggcataactagaatttgttgatataaacacataaggaacataatgcaaacctttcgtgagagtatcaagcacaccactggactcgaggtactttctgaacgcctctttcttggcttctctatcctacaaagaccatcacaaggccatgatcatcagtttggaaaaacaaattgtagcacacatagctgcaccgtatggagatgagtttgaatttggtttactcgttgtagtacggttttttatttatgtgtatggcagtacggtagtatactagtatgctagcatgtgttctttctatgctaccagcttgagagaactgaagcttttccattccaggacccaggacactaagctgaaattaccaaagctgcgaagcaaaatgctcgcggcaaatggcaaattggaggaagattgatcaattcttcctcacaaattgcacactactgtactatactgcaccctacagattcaaccaactaaaccagtactctttaccacaataaataccgcatttgacctttgacattgactcgctgacctccatctccatgcatatgctagctatactaatctcaccgcagaatcaaacatctctctcaccaggggcggatccaacaaacaaactgttacttgtatagttgtattaaggttaaggctctgaaattaagggaagagcttcttccagatctagaagagaagctagggttaacgaacgaacgaacgcaagcaagcaaattccagacccgatgggagagagagatgaatcagaaaagaggatgcggatgctcaccataatcctctcccctgctctgctcgccagatggagatcgccgcccctcccctgttcagccgcgactcgtcttggcggcaggagacgggagattttctttcttttacgtcacaaagggaagggaagacactcgagactctaactactgagaattaagaatttgccactgtcacacatgtcatatactaataaggacacacgtaggacacaattcatattatagacggtgagtagtaaattcttaattactacctccgtcctataatataaatgattttgagtttttgtttgtattgtttgatcactcgtcttatttaaaaaatttgtgcaaatataaaaaaacgaaaagttgtgtttaaagtactttaaataataaagtaagtcaaaaaagaataataatgccaaaatttttttaataagacaagtggtcaaacagtgcaaacaaaaactcaaaatcccttatattacaggacggagggagtaccattttaaaagtggcaaaaatttaaaagcctcagacgagtactctcacttttatctcaatattttactactttaagactagctatttctttataatgactagtggcccacattctaaaaattaacaaactcggttagcgatcggttagcgatttgtgttaacagcaaactcctcatactaccagcaaccactaactgttattccacgcaccgccactactgctctttcttcatgagccaccatcgttcctcatcactgtctttgcatgtgcaaccgcaccctctagttacactgcatgagccactttttttccctctccctctcatcatgcacactattgtagggactcacggaggcaggagtcgacccgatgaaaagcggagacgctagattcaggctccttcttgctggagctagcggttccctgtcagagggaaaaagaaaatggagagagagagttagtgtgtggttgctgagtcactggacttggagatggatgaaataaggtggtccaaattgaaatgtacagttagttgttctgtaaataaaaagaatggttaaaggatgacataatatgaaaatttttaagaatacattgtacgaactgtaatttacttttttttctttagcacaattaaagatgagttgtctattacccgatacttctgtgatatactaagtcttaagcacaactaaagatgagttatctattacccgatagtcttgtgatatattaagtattgttgggtcagtgtacttggctattactaatagtctcatgatatgttgacgcatgaagatgtagacttctattaacacaggctgattaattatggcaagatagattcagctaaaaaaagataaaattaatgccatcaattttgctcagcaataaagcattcgattatggtctccttttctcactgcatgatatacgattgtagatatttccgtaattctttcatattatttttttctacatatacattaatttggactaatattttttctcataattagatagataataaatcatttttcatatttctcctataaaatgtgaagagggcattgtataatttcaaaattatattataagtgtatgtaatttaatgtgtaagatatgaacttatagtataagatttaactttttataaaaatgtcgcacgatagtagataggtaatgaactaaacaaccataaaatatatagagaatctatcgtgtgttattgattttgtccttattctacaatatgtcactaggtttgtcaagttctaatatgctatagcactttgcttaacatctataacataccatcgtcgtctagttagcttccgttagtattatataattttatcataatgaccgaaatagccatgggacgaaaaattccaaataccagattgtaaaatttccaaagtttgagatggatatcttctctgccttgtttataatatgatatttcggaatattcggccaaattttcgaatttctatcccggggatatttcggtcattaaaacaaaattatacagtgctaacgaagtctaaatggacgacaacggtatattatagaggttaagcaaaatacgatggtatattgtataacttaacaaactcagtgccatattatagaacaaggacaaagtcagcggcacacagtggattctcttaaaaaataatctagtcaaaaaagtttatttattttattcaaaacaaaacatttttttaccaaacgcgttaggagaacttcaaaagaaggtaataaaaaaaagaggtttagtcattagctcaaacacacatggttttgataataatattgctacaatcagcactcatacttgcacatgaatactagcatctaactcatatgtgtgtgctccgtaatatatattatctatgtttttacatgagtaaacaataattattatatttgttaataatattgtaattatataaggtacctaactagttttctaagaagtggaaaaatatttttgttaaacataatctagaatgctataaagattaataatgttgaatgctatataatcatatataatcatataatgttactcccaacggatttggaggttggaggaggaggagaaatggcgcgggcgagctatcggctggatctgccgccttcaactgatgctggcgaatctcagaaccgtggaggagaaggaggatgcgtttgcgtgaagccgttgtacggtggaccagtggtcgatggccgctttcggtggaccggatccacattaattccccagttggctgggttggaaactttttttcccctccacttgctagataagcgttagattaatatctctatctctactattataaatagaatagaattgaagatgtttttattggtattttaatatgttatctgtgtttgagttagtttttaagtttgtttacttttaaaaatacagatctgtgtttgagttagattttaaactcgtttgcttttgaaaatacaaaaggagtcatataagaaatctctttaaaaaaactcatgctaagttaaagatgaaatatagctcacgatcttctaatgaattttaccataactaaaccgtataataataataaaattaaaatagcatttacccgttgcaacgtacgggcattttttctagttagataaaaaacctagaagatagattaatataatttattaaaacaactattttacatattttctaaaaaaatacatcaaatttcgcagtttggaaagcttctgtatagaaaataaaagagcagaagttgtgaaatgtagagatgtttggttgggatacactattgccaaagtttgccataattccgttagctaacacgcctaacatgtgcttaacaaatttgaagccacactttagctataagagagcaaatttgacatacttttatatgccaatgacatgtgaaactcatatcacagtgaatgaattttgccttaagtatggcacaaactaaacagacgcctaacttagtaaaacatgcctaacttaagttatggtatggtgaggtaaattattattgtgaaccaaacaatttcgtagtgcagaacacagcctaaaccagctaaagggaatgtggagctgctatcttctcaagaaaactgtcatgactcggtctgaattcgaagaaaataaaataaaatactactactaattttttttctgtattgcatgaaattattcaaattattttctaagaagaactagagagtataaaaatgttatttcctttttaaacttctagtattttttttaaccgtagagcgtagcaaaatttcccagaatcatttggcacagtcaaattcgaacagaaatcaagaaaaatagaaccatttggccaaatctggaaaatggaattttttgaattggatctaactcctgcaaaacttctgcgtataaagatcaacgaattagcaatttagcacaaactaagaacaaaaacttaaagttcgctatgaagaggtgctaggaaggatatgcaaatatacattgcataggaaggatatgcaaatatgcaacgcaatgtgacgtgacatagtaacttcagttgcaaccacattgatttatttttgttaagttattattgcatcatgtgtttaaattcgaatagccagaaaagatgatacattgtcagtttgtcacacggggtaagacaaaatccaagctcagaatggcaatagcaataatgatttaactatgttttcggatcaataaacctaaccgaatgccattccctaaaaaaaaaaggctacactgttagttaccacaaaagtactaacgaacagagttttgagaaaactagtaattatatacaactttttagtttctacccctttagaggcatttattttcaccatgcagaggcatgccttgatctaatatgtaactacccgcctcgtgcgcaacttttatagattaacttgttgatatgagtattctattaagccctgcgccgggatgtcacacaatataccgtgggctggtttgggcctggaccaaacctgtatcggcctctatttaccatataaacatttaattttgtcaggaaaatatcaaagttttaagagggttatatgcggcctatatatgcattcctattatttttg

SEQ ID NO: 2348 - DNA, 864 bp, Oryza sativa
ttcgctatgaagaggtgctaggaaggatatgcaaatataccttgcataggaaggatatgcaaatatgcaacgcaatgtgacggtgacatagtaacttcagttgcaaccacattgatttatttttgttaagttattattgcatcatgtgtttaaattcgaatagccagaaaagatgatacattgtcagtttgtcacacggggtaagacaaaatccaagctcagaatggcaatagcaataatgatttaactatgttttcggatcaataaacctaaccgaatgccattccctaaaaaaaaaaggctacactgttagttaccacaaaagtactaacgaacagagttttgagaaaactagtaattatatacaactttttagtttgttattcatggtgtgtttagattccaaaaaaatttggccaaaaatgtcacatcaaatatttggacacatgcatatagcattaaatgtggacgaaaaaaaatcaattgtacagtttgcatgtaaattgcgagacgaatcttttgagcctaattgcgccgtgatttgacaatgtggtgctacagtaaacatttgctaatgacgaattaattaggcttaataaactcgtctcgcagattacaggtagaatctataatttgttttgttattagcatctttacaggcgaaatatgtaaaattttggccgaacatcttaaacacggcatcagttattcttgaagcactaggctgcgtatatttttatggacgatatagaagaaaatctgtaccataactctaaatttttttatgctgaggatatacaactgcaaaaagcctgcattctgccaacagaagacagggtgcacgatgctgattttttgggaatc

SEQ ID NO: 2349 - DNA, 8358 bp, Oryza sativa
  unsure (1)..(8358): unsure at all n locations
attttgcgacagaggatactgaatatttctcctcacagctatctgctaggagccaataacttttctccctagcattatgccattgagaaaacaattgacaatttaatctaggactgatcatttcaactatctctgtattattatccacttctgcataagttcactatttggtgaagcaatttgtgacttccagcatttcttggtcactacatgagataagaccatagaacaatccattttctatattaactgaatatatgaaaatctgatacaaatgttatgtatgtttttttttcaaatgcaaattagtttctgttgtaaacagatcataacagactcaaaagaccctcccattattgtgctttttttcgcggggcagcggaaagccagctgaagtttattaagggaaaagaaggggttttaacaactgttacaacaaaattacagtaagcaaacagctgagcaaccaacactagagcacaggcagctcaactcacagcactgctaagaacatacagcaagcaacaatcaacaatcaaccaagaggccgcaacagacccgcgaccctccacacctcccactcatcctcgatagttacacaaagacccgggttattatgctttctaatcaacgcatggagaagaaatatgttcgctcggctcaatcctccttaagcgacaacttcagcaagaattgcctcttgccagcaattcataattataatacatctcaatgaatagatgatcaagtgtttaattactgactgaattcattttatttctgaaaaagaccatcaacctatataggtccatttgctaattgcagttggagatcatcatattttcgtgaccttgtggaagttttttgcatcataaaagcaactaaggcaatgaatatgaatcattatgattaatgatggattttattttatttccgatgaaacaggtcatcaaaggccatttcctaattggagttggagatcatcatatttttgtgaccttacggaagtttttagcatcataaaaacaactaagacgatgaaaatttaaacggaactaataaaactgctcttgttatttaaaaataaataaccaaatgaagttgatgtggctaaaccaataaagcgcacaaacataaccaaacaattccatggatacgagctatatgatgatgtgagaccaatctttaccttgtcacacactccctcgacataataaacttccagtgtacacacctactccggtatagatgctcgtttgagttatatcccagaaagtgttagttactggattataaatctgcactatcccttccgatggcatctgcaaccagagtactacatttccctcatccgtcacaagcaacggatgcactttcacacaatctccaatcccatagaaagatggatcaacattaatcctgtactctttggaccatgtacccttttcagaatcagttagaaaccatagatccaccacataaaaatgataatcccaatgcgctgtacacaaagtgtctttaattccagccaacataaaatgatagtcaaggtcatgatagctaagtctgtcattggcttcctcaacaatgctcttcgccggcccctagagggtcatactccactgctccatcgcgaggtcgaaggaaggcaggcaacctgcctctagaacggagggcgaacattggaggatatcgaagttgaagtaagcagcccctttgaacacaactccatcggtgcagaaacaatcaagctgtacaggtggattctccaccttcctccgctgctgtccaccgacgccgcggcggctgacggtgataacctcggacacgtaacgatctctcaatgtcttcacaatctgaactagcttacgctctcatgtgggagatgctacctggccaaatgcaaaccaggcaagaagcattgagcagtctgtactgacgtcgccatagtggggtaaagcggacatggattcggtggtgggtaaggcggagatggatccggtggtagggtcgagcaggtgaatgctatgctccttaccgtcgaggaagacgaggtcgtctgaggtcgcactcacaaccatgcctctccccacttgggattggggttttgggatcagctgcttgacaatgtcgccagacaggtcgacaagatcgacacagaatctggggaagctctgcacgccgatggcgaggaggagggcggcgtgaaggggggtggcgggcggcgtgcgcggcggcgaagagcgggtcggaggtgaaggagcgcgggcttggcggggaggcgaagcaagacctcgtgcagcatctccggtggcaagacgccatcaaccacggctccgaaccccttgccctcgccgacgtccatcgacgcgccgcggcggcgaggctagggctcacggcggcgatgtctgaggctcacggatggaagtatggaaccgcggctcgcagcaatcaaggggaacaagtctattctgccttccttatttgtttctgctaatcgaaacttctccctcaaccgcaaaacaaaccggactgagaactttcttcatcttcgaaaatcggtgaagatttcgtaagtggttttatgctgaaacgaaacgtgggacccacgtgtcaacgactcattccctatcaagggatgtgagcatgcgacgttcgctagatctcttgtgggtgtcacgccccaaaaaattagccaaatttttcagactattttgtgtataatttcttgtccaggaatcaagccaggtaataatatcataaatctttatacatatcgaaatataaataaagcgtaaatacttgcagcacagacacttaatcctcacactaaaaagaaagtagtggcggaaaaggagcgatcctgatgacgctctctctcgtggcccaatcttctggtgaggggatagctttctctttgatcaagcgcgacgtttgcgatgtggctacgaccagaacaagttcaagacgtcgtgtaatcgctaccccacaaacgatatcgtaccaaccgtgacgcgtggttgatgatccctgcaatgctaacgagagaacattttaagaacaagataggatgtaatctaaatattgtgaataggtgattaagcacaaagaaatagttgtaattgaagtggtaaatctaatcgattaggcaaatcaacacaccaactattggcggctctcaatgcatagtcgccgactaattgagcgagaactagagacatgatgaatggcactttgcaaaattcaactaaacaaaatccaattgttttagagggtctacataaacatttatagaggttaattcgtggagctgaagggagacacttccgagatggccctagtctaatacaaggcctaaggccaagttcagattcagcaacaacgatgattcccattgactcgagataaatttggatgaaaccggattagggtggcaatttccccgttgggccggggacccgcccctacgggggcggggccgggggagttctcacccgtgggtgagtggggacagggccccgcataattccggcgatggggacgggaatcggaattaacccgcgggtgacccagaggggccccggatatgagttatttctataaaagttgcacattgcaataatatagacgtaggggtgaaaacaggtcaggttcagtcagatctcatccttcccatatcctaacccacaatttataattggaatcgggtcggacacggatagtatcaactacggatataaactcggataatatcgggtataaatatagaacgaatacgtaccaatacagatacatacgctatcggttacgagtacttattgagacaaacatgtattacacgtactagacaataatacctaagcatagtattatcgtagttaaaaatcattttatattgttgttgggcaattcctcactctcacacagaaagtctcgatttctctctcctaatcctaaacagtcatctctctaactctctcttctagtcctagacagtcaatattattgttagtaattgttagacagtcaatattgttattgggccttgtggtgaatgcttagggtgtgttcgcagctggttcctaacccggaataacacgggaaacggagcaatccattagcacgtgattaattaagtatttgctattttttaaaaaaatagattaatatgattttttaatcaactttcgtatagaaactttttacaaaaaatgcaccgtttaatagtttaaaaaatgtgcgtgcggaaaacgaggaagatgagttgagaaaaagggtgccgaacacacccttagtgggttggtggttggtcttttggctttattagggtaggcttgtattagattatccgagtaatacccggatatttaacagggtaatatccgtattttttccggataacccgtatccgtcggataccacgctcccaaacccgatcccatatccgacaataaatagttgtattcggactcgctacctgtgaaaacatccggatacccgaatttgtcccgaaataatatggtcgggcgggcggtcaggaaatatccgtcccgttttcacccctatatagacccaacaatcgcattcaaattaacatataaaagctcaacaccctagttcccctcaaccgtaatccctttccttccttgaaccaacccgcaccgccgagggctattgaaattttatcatactattattcagtgtattgcaatatttgtatggagtattaactccatccggctgatgcaggaccccggtcacccgtcgggtcccctgtgggggtggggatgggtgatgtttttcactcgacttcgtttctggggtcggggcggggatacccgcatgagggcaggggacggggcattccaacccaacccggccctgcccgccccgttgccacccctagaccgaatgcgtttgaaaggtgacgagataagctttctatcaagctcaagatcatctaaatcagagtaggcatgagggcgctatgttcgtttgaagtcagtgttatctccggaggctaaattggacttggacgtggaattatcattggaacgtgtaaagttatatgcgtatatgatgaaatgatgtcctcatcaacgaggtttcagctccactccacaagtaaaaactcaactgggggtacaactgtatgagccttggctctttaactccgtcttcaacacaaaatcactatatatgaaactagacctgccttaacttaatgaacaggttaattaattgatctcattttatagttaacctatctcatgcttatagttgcattgcccattcttatctgacattgtgcagctcgatcggtgcaccagcaggtttgttccgtcccctttcacaatgagaagtcattttaatttttggcactttcgacctgtttcgtatggcaatggagcctccaagttgcacctaaaagcctaagctgatagggaaaggtggacaattcactttatacacttcaacactcctcctcacacgagaccccctcaagtctcagcgtggaatattggagtgggctgcaattattttatttnnnnnnnnnnnnnnnnnnnnnnnnnnnnnnnnnnnnnnnnnntgataccatattaagttgcatgcatcagccagttgcacctaaaaacctaagctgatagggaaagacagtcaattcactttatacactccaacattatccaccaccacgccggtagtagaggaggacaaggaggaggcggaggcaacgatgacggggacaaaagaggaacagtagcggcggcggccaatgttggagtgctgctgcacggtggccgccggagctaggcggtggcggtggcggtggcggtggcgcttgtgcttgtgctgtcagccgccgtcctatcttgttgtcgaagaatccatcttttgaacccatctcgtcgaaatcctagagcaccaaaacacccctacctggcgcgccactgtcgacgtttgatgtcgcaattctggtatttgcatagtatggagatcgtcggtgctaggatatacgcgagactgaggtaaaagagacggagacagggacttttatacaggttcgggcccctgaattatcaggtaataaccctacatcctgttggccgaagccggtattgctcttattcaccataatcacaccagtacaatatgtggggtagcctatctaactgttgtcgacatggcggtctgaaggtctgactcgtagtcgacaacagggtagtcttcctcctcgaatccgtgcccggcgatatcagagaaaaagacaatcccttcctatagattaccaaggaatagtaatctttttttataggtgaaattagattggatttagatatataccattccttgattatatgagaaacgctttcgtctctactgacagtatccagagacaccataggggactagccgtgtctatccctgaagtcgatattcggcgtcttgtcttggtgtatgttgtcttgtatgttgtggcctctgttgttccctccagtctatggtgggtgtcaattgaggtggtcgtgttgtccgtccccctctcctcctagagggccttgtatttatacccataggtgtccctttgttcaagtagaactagggaaaccaatatggatataatccgaatagttcttgtcgtttccatgtagaactctggttgtctttccttatccggaacttcctccatatccgcaggttgtttccatataggacatggtatgtggtgggtcctgccgagatttagtcaactactattaggtatgtggtatccataaccctgacagtagtagagaaagaggatgacacgtggatcctactttattttttaatttatttgttgactgagatgtcacgtggacgtcacgtcaacaaaaccgttctctaaaaccatcaagagagtcaatttacaccggttttaatagttgattggtcgagaactcagggatatgccactagttaagggagtcaatgtgaatcttattatgaatcttattattcctgggtatccatccccttaggtctagcccagaacgatgagtggaccaaggcccaacagccacgaagtgccgtcgcacgccgcaccactgcacagatgcaggcctcaggagcatgtcgtggtggttgtgttcggcagccgaggattgtaagaaatttctcgcgtgcatacttttcgaacggttaaacggtgtgtgatttttgtaaaataaaatttataagaaagttattttaaaaaaatcatattaatctatttttaaaatttaaaatagttaatactcaattaatcatatattaatgtctcatacagtagaattgttcttttagaaaggcagattagtagtctttgtcaaaactgttattacagattatcactgttctgctctgttaatttccttctagttaactgaactatctgaagccacaaggaatggcgcatggaaactcttctgtaacttttgagcttctttttttttaacaaaatgggatggcttcatcgcattgtacatatggcacattcgcagaatatccggcaatgccacgccatgactcacgatggggtcgctgggtcaagtcagcagggaaatgctcctcatcgtgcacgacatgcagtaaatcggaaggaaaaaaaaaagacctgcttttcttttctttttctaatgaacaaggttggatcatgatctttattatggatgccaaaatagttttgtcgcaacgtatttggaaatcttgggtgtctagttcaagcggtaggagtaaccactctcttaaaaaaaaatactaccactaattgcagcgggttttgtttttttaatcaagagtggttttgattaaaaaaagagtttcagtggaatttacaattttttagggcaattattttttgtgaaccaccagattagtgtcgattataagtgcaattgagtagctcggacaaatcagcctatgaacataggcctagtttagttcccaaaatgtttttctcaaaaacatcacattaaatctttagacacatgcatggagtattaaatatagaattaaaaaaaactaattgcacagttagggaggaatcacgagacgaatcttttgagcctaattagtccatgacttgccataagtgctaagtaacccacatgtgctaatgacagattaattagactcaaaagatttgtctcgcggtttctaggtgagttatgaaattagttttttcattcatgtcccaaaaatcctttcgacgtccgatgaaacatccgatgtgatatttttttttcgcaagctaaacaggcccataattgttgcagcaaagtcagtcaaggagacatcaccaaaatacttcataactagtgtatcactgtggagcag

SEQ ID NO: 2350 - DNA, 679 bp, Oryza sativa
tgataccatattaagttgcatgcatcagccagttgcacctaaaaacctaagctgatagggaaagacagtcaattcactttatacactccaacattatccaccaccacgccggtagtagaggaggacaaggaggaggcggaggcaacgatgacggggacaaaagaggaacagtagcggcggcggccaatgttggagtgctgctgcacggtggccgccggagctaggcggtggcggtggcggtggcggtggcgcttgtgcttgtgctgtcagccgccgtcctatcttgttgtcgaagaatccatcttttgaacccatctcgtcgaaatcctagagcaccaaaacacccctacctggcgcgccactgtcgacgtttgatgtcgcaattctggtatttgcatagtatggagatcgtcggtgctaggatatacgcgagactgaggtaaaagagacggagacagggacttttatacaggttcgggcccctgaattatcaggtaataaccctacatcctgttggccgaagccggtattgctcttattcaccataatcacaccagtacaatatgtggggtagcctatctaactgttgtcgacatggcggtctgaaggtctgactcgtagtcgacaacagggtagtcttcctcctcgaatccgtgcccggcgatatcagagaaaaaga

SEQ ID NO: 2351 - DNA, 613 bp, Oryza sativa
ttgattatggcctgttacctgttattagacaccacatgtataatttggattcactgaatggtttgtgctacgtcttgttactgatgactgttaatcattatgttgctttttctacactgttagaaattttatgacatggcagttagcgtagtagacaagttggatcaatttattaatttaactttgcattagcagggtcattttcccttttgctaattattgttgccataccttctcactgtccaagtatcaacttttataggaagagcaagaagaagctctgaaacaactaaggaagaatctggttattagagcaaaacccatgccaagcttctatcaagagggtcccccacctaaggttgaacttaagaaggtgatgcaccgatctcctgctatatgtgcttgagctaaaatgattatttctgtttttcgatgtgtgctcattattgttcatgttgttgaatgcaattttaattcaagtgataatatctcaacccattactgtttagatcttttccctttaattgaactgattgcgtatctgtaaaaacatactcgactacatgcttgttcctattgttatctacataggccctgttcaactgcacttgtt

SEQ ID NO: 2352 - DNA, 22737 bp, Oryza sativa
accgagacttgcatttctgcaatgtaatgcctccaagatgccaacctgccatacagagaacctcactgcgtcctattcccccaaaccagtgttctctttgctacagggccatgattattgtgagaaaaattcaattatttcagtcagaatggaaagcatgcatatgcctttccaatcctaccacccatggtagtaggttcagctttgatgcttatctgaaaactatacaagccaaccattgcacaaagttgctcttaattgcctaatcattcagatcagtggacctctgtaactctcactaagtcattttcaattcttttcttttctcaaattaaaacctttaatgaaaccataattattggtctctgatgtagctgtgttagaggtgcattcagacttgtgcaaattgcaaatattgcattacttacatggtatacatagtttacatgattaaagtagaattatttgtataacacatgataagacatatgtcaacatctaaggaatgagagagaggatattgaccagatggggacttgagaggacaggtgagcaatacgtgtacatatattatatatataaattttataacttattttggtgcaaataatgcatgcaaattgctgtatccgtgtgtgttcatgcattgcattggaccatacaagatcaccgacttgtcaccataaagtatccttggatggagacccctttctcctctacttctagatgccccatgaatgatggtaagctggcaaatctcatggtatgggccatttcaatcatttatcagaatctagcacataaaacaagtaaattaaacattttgaactaatttgcagggacgattaaaaaacaaacgatgcaataataatcttcgcttcctcaaagaataattcctaggttgatcaatacttgatcaaagttgcccacattaaaacaaaaggataaataaattagtatatccctttgtgcatcatggagctcccaattgaaaatgttatgaaagcagcaatggatgcctccctgcaatagctggcaatgtgcaagtttgcatgttcatgtgttagatctattgtgtaccagagcttgacatggatgtccttatcagagacagactcacaactccaaacttggacttgtgttttgtagctttggacaccactatagtctcaatgcctttttttcctgcctaatcaaacacaaagaattaaacactgatcaccaacttgttatctttcagatgtcagctcaggaaactttgccttatgttactactgaatgacacactttgctttgctgtaccccttggataagaatgccaccctaatatttcttctttgaataagagacgtaccaaatatgaatgaaaaacatatgcatctttcctgattgcactttcttgcactactgatttatggtcagagaatgctagatacagccatgcatgtaactaactgaagccaatgaagattggaagtaattgcacttggcctacctaaactgtaccctatcttcttcagattcatagcacagtcacaaaacgttatactacatctttcagtttcttccctacaatatatgctaaatctctgaaaaaaagacgagcaaatccaatcttgaaactgtagatttactttgtcagaagggcatgtcgaacgtcagtagcattgttcaacagtacagactttgttgctcttgcaatgtgtcggcaaggtaacctctgaaagtgagcagcggctgatcgagattgctgtcagcaattccccctcacaatgagcaattccccctcacaatgatcatgaatcctttgagctaccatggtcatgatcatggtggcggcaccgactcgcgccattgctcaaatccaagaacccatcaatggttgtaaacatcgccgatccgtatcgcctatcagcgtcgaattgctcgatcttcggatgttcatcatcatcatactgaattactgatcatggctgttctgaaccttgtactgtgccatcttgtgcaatgccattgatgttcatgacctccttgtccttgcccatggcgtgctgctcatggttgctgcctccggtgtcagaggagctcccctgcaaatgctgctcctcttcgtcgtcgtcggcttggaacgtgatctcctcaaaccggccgtgcagctcggcgcaccgcctgcagccatggcgctccgccgccgccgccgatgacatgaagtcgacgagcgagccgcaggacgacgacgacgacgccgccggccggcagttcttgcagcaggcggcggcggcgccgcccggcgcgtccggatcatcgccgccgccgacgagatcgtcgtcgtcgtcgtcgtccgtcgctggacccggcctccagcccggcaccagcgcggcgaccttgccgtcgatcagctgggcgatgcgagtcacctcgtggtcggtgatgtccagctcggcgaccatctccgccgccacggtcatcgccgtgtcggcctcggtgtcgaaccggaagcagattatccggccacgccctgccacaattcagctcgaattcagacgaaattcgcccccacatttgacatcattttgtattataaatcaaatcaaatttgaacacccgccagttcaaaaatgcaacgatcacgtacctgtgccgttcttgtcggcgatgcgcaagccgaggtagacgccgccgtcgtccgtcctcctccccttgatggtgatgtccacgccaccgacacgctcgttggcgtcggcggcggcggcgtcgtcgtcgtcctcgtcgaacagcatgtggatgtcgcggagccagttgtcaccgtcgtcgtccccccgctgcacggccgcgtccacgtcgttgtcgccgacgctattcgacggcgacaagccgccattgctgcaggcatggtggtcgtcgatgcaagcaggctggtgcaggtagttgtacatcagattgtagtagccaacgccaaaaccgccatgtccatcgccgccgtcgccggagaagaagccatcatcctcaagcggcagcaggaacgggtcgtcgagcagctccctcgccgccggccgccgcgccgccggggcgaggcaccgttcgatgaattgcctcaccaccgggtcgctcaccctgtacaacgccgcgggcttgatcccctgatcagaaacacgcattctcttgatcaaatcgtgtccaagaattcacgagaaattctgtggtgatcagatcatacggagatgactcgcttgtagatttggatgggattggagcactcgctgtaggggtaatcgagggtgaccatctcgaggacgcacatgccgaaggagtagacgtcggcgagctcgtcgtaggactcgtcgtacacctcgggagccatgaactccggcgtgccgacgcagcgggcgtggccgccgccgcggcggaacgcggcgaggccgaggtcgccgatcttgacctcgccctggttgccgttgacgaagatgttgtcgcacttgaggtcgcgatggatgatgggcggcgagtgggcgtggaggtaggcgaggccgtcgaggatctgcgcgcaccagcgccgcaccgccgccgcgctcacccgccggtgcctctccctgtactggcggagcgtgccggagacgaagagctcggtgacgaagttgagggcgcggcgcggcgcgtccacccagtaggcgtggaggcgcacgatgccgcggtggcggagcgcggcgaggaggtggacctcgccgtagaaccgctccagctcgccgccgccccgcacgacgtcgcgcagccgcacctggttccacgccacctccactcccctccactcatcgaaccccctatacctgcacccgaaaaatcattccaaaatcaatcaaacactcaaattctaatcaagaaacacaatcaaacagaggattaaactaatttaggagaataaattggatcatctgatgaacttacacaatctttgacgatcccttgccaagaatctcattgaactgcagagagagagagaggaagcattaagaaacaaggtaagaagaagctggaggaagaagacgatgagatgggattagtagatgattactctgccatatcttccagtgggatcaacctcggcatagccagcctcagcgaggaggaggacgccatggccatggccattgctctgctgctgcagggctcccatcattctacacacactctgctcagctcagcagcaacacatctccattgatccactcaagaagaactcgtgagcgtggcacgtcgatctcgaggagatggaggtagagagagagaggagacacctctctctgttgctgcgtttttttaagtactattattcctgggtaagaacaaatttaatggtatagccaactactagctccaaatcatctatagttaatttaatagctagtttatataatagttatctataaacttatattgcactattaatttctagtcccacctgtcatacacatattgcgtctttaagtccgtgctgtagtactgctcctctcttatcttttatctttttaaaatatgattacagctcgtttatagtctgctattgtacttgttcagagctagtgagttgcatgtgcgtgattagagatgaaggagacggtgattaggctatgctacgagcaagtttaatagtatagccaactactagctacaaatcatctatagctaatataatagccaatttatacaatagttgcttactactatactattaatatctggttccacatatcatacagacattacgtctttaagtccgtgttgcagctggctacagatctatagtccgctgctcttctctcttcatttatctctttaaaatatgtttaagctattgtactgctctaatgacggtgcttaagcttagtggatgctgtggtggcggcgcttacgaaaagtggagcagcttggaagctttgaaaaaaagtttgaaggcgatatgacaaattgataaggtgttggtctgcactgggcgtagaatccaggagctgcaatcaggaaattcttggtctttgtttccattaaaaaagaatacagtgataattgaaacttcgttcccattcaaagatagtaatggttgagacattggatatgtgggcagccggataatgtgattttttttctttcgccattagttacatcatcagacacatgtacaccacctgtagacacatgaatgcatatgcatggttttggggagaatatggaggggtttgtccggcctgtatgagcctaatctcttatcaagaaaagaaaactgaatgctcatattcagtttttctttctctctctttctatgggtgttacccagatgccgaagatggtgcaaaattgcaaaaaacctctgataatctataattctatctccattttatattataagatgttttaactttttctttagtttataaaaatattagtaacatctactacataatcgttttgtataagaatattactatatttgttctacaaatttaatcaaaatttaaaaagttcaacttagaaaaaaaaatcaaaacgtttttcacatacacattgacagacggctctgacaagtagataaccagatacctgccggtagtagaaattgcagcccagcccaccaaataacaggaggtcaaaacggcaagacccagaacccggtccaacaacatcgttctggctcaacaaaggaaagggccacaaggtggcagcattcacgttattataacaaaatgaacaatagtcgagaattacggcggagaattttattatcaactgcaacagttcaggcacattagcaaaaccttttaataattaatcccccattagacatatcttcaattcaggtacattagccagagacgacgatctgttgttacgttatggtgacgatacacatgtgcgacagcgatactgcataaatacgagatccaaaattaagcgtgctaattatctgcctcctgtagtagcaccgcatctatgtccttttttttttcgctttacctcttctctacttgcaacatgcacagtctgaagcgcaagagagctcaacgccatcttgcagaagctgacaggtagggtgctgatcactcatcatcagtactcagtcatcacttcttcgcctgccttcttgatgcagctccgatgaggagagccttcccaacaagcccagtgttgagcacgcagacggcagccactgcgccaccgaacaccacccatttccagtcgaaccctggttgaaccgctctggaattctcactctcatcgatggttttcgctgcattggagggctcttgatccagggggcaactggaactagcaatagatgtcttggtggttactcgagccatgatggcactgcgagagagggtgttctctgtgtctctcatttgctggtatgctctaaatccggactggaacttctttacagcaccccacatgccatgccggacacccaccttggcgacatctttagggatgcccatgtcctcgtagtggaccagcgttacttcacatgcggattgctgtccatcttgtttcggtgattgaactgtggttacccaaacagaaaagggaacagaatgtcaaggtataaacatttgtgttccttcttgaccaaaacttgtgatgaaaggaactaattcaggtgaagtaagaatagtggtaggaacaaaagttacctgctctaatacgccaacttgagaaatacagttccacacgccttggtttttccttcttaggcaaagctggataaggaactccctgcaaatggaagtgtttcagtgctcacaagtctctcaacaagcatatgcgctataatagatagtagtcaaattttctacatagtgcattgccaacaatcttcaaatacatgtatttctaatgttgattatgcaagaatgctaggccatggcgtctgattctctgggctgagatccaggtttgaaatttgaaccaaatgtaagaagagctacatgcatgagctatgcaaaagtatcctctagaagccagacactattgacttcgatctccattcacatcaactacaccttcaacaccttaaaatacaatggatgtatgtttgatctagcactctcaaaaaaagtaagtacaatcgtatcgatgtcagaattgcaatttgcagaaagccaggcaagattgctacgcaacaaacaatgttttagtataccagatcttttgttcactaaaagatctgccttgtagtcactaataaatctaattaccttctagacctagaatcctcatccttttagataattggaaaatatccagcctctgcgtcaagagaagcacccagaccgctacctagaatcctcaaaaatcagatactatctctattcatgaatatttatcacttttcaccacattttcttctgaataaatatttgtcacttcatgttcccaagtagaatttccagttttgtccttattcccctttccacttttggcagaaaatagtaagtagtttacttactagggttaatttggtcacatataaatagccttcgcaacagaacattggttaagcattcgtgaacagaggtagtatcttgcaataggtgctcatacaattacagtagttaagcacttaagttagatatccatatgagaacatcagccaaagccaggttagcatatcataaaaatgtcttgtgaaaatagtaatactggaaccttgtggtagaaatacctttgtaacacaatagtaagttttcccagattcccatatccgccgcccaaaaatgtattcacggtcactgcaaaagaaagggaactacaaaacaagcaacatgttgaaattacatgattcaatatgtaatttgggggatatgcttgtcaagagatatgcaggtcaagttgtcataccttttttatccagtgaataatcatagttccattttgggggaactcctccaaaattttgaaatatgcaagcatgggatcccacttcagacgaaattcatcatcccagaagaaatctctaacaagctcaggagtagcatcctcaaaaatagtgcgactacagtacatgataggtcccacctacaagcaaaggaagatcagtccattagatgttgcactataacctatatgctattgatttggtcacatcaaacgtagattcattgaaaagacaggaaatgaaccaaaggtgcaaagcaaggaaatgaattaatattataccacggcaagccaaggtcatcacaggattttaaaaacataaattctgatcttggtacagttgattcaactttcagagtttttctttcaattcagatgctagtatttaacttatttctaatacagggccctctaatcatttacgcaatcacgctatacatatactttgacatctgtttctttcctacaatcccattggaaaacatacctcaggctcacggcgccaggccttgtaagtcatgttggaagtggtacgttccatcaaatgctgccatgttgtatccccactctccttgttatcaagaagttgtacgaggtgttctaggtccttctcagtgacaacatgatggccgccctcaaaaaatgttctaatatggacagaagaaaaggattttagcaaacagtttgttgcataaacctatattgaagtcagtttaaatagatgcaatcatgctttgaaataactttttgtttgcattagttattaactactgtaacataacaaatgggtcacccgatgaaaaaacatatcaactaggtcaatatataacaggcaatcatgtaaaagttcaattatgtccaacaagtctaaaattctcaagtcctaatcagcatttgaaatttcagtcagaagctcccagtcatttatgttgatgatggcttgatgcattttatgtcagtacatcgaccattgatcacccacttgacccaatgaactcaatcacatcaaattcagttgctaaagaaagaagaataagtctgttactcaactccacaatttggcaataacagtattggtcaaattcaagggtaaagtacaatggatcatcttattaacagttgtacttaacaaatagcaaacgaattttcttgtactaatccttccactatatgattttaatatgacacattgaaacccttgatacgcacaactttcacttaatgttatctgtcggagcataaatactacggacatcaagcaccttaattttaacataacatcgataatttgaaattcaagcatgccataagcataaattcgctctgtcagtacatgtttttttagataatggattttcattaatccagcctctatagctctgtcagtacatatggcatcatcatcagttcagttaaaattatgcaatttcaccaaaagctacggcgctcctaacctgccatcagcattagtcaccacagaattgagttgtgagcacattgatttcgattatcagtaataaattcaatttcgagatggcgcacacctagttcccaacggacgcagctaacaaggcaaacgctgcgcattcccacctcatcctaccacgctaacccacagcgataatagataatccaactcaagaggatcccacctgccatcgacgcaatcgccggcgtccccggaggcgtcggcggcgtcgtcgtcgtcggccaaggcggcgtccttgcgctggtgcttgccgcggctgccgaaggcggtggagaggagccgcggcgcgacggagaaggcggagagcgcggtgcaggcgagccagaggcggcgcgcgccgaggcccgggggaacgtagaggaggcggaggcggcttcggaaccccaggtagagcagccccgtccatcgcggccgccacgcccagccgatgacgagcccgatcatgacggccgcccagatcggcaccgcgcacagcagcacgtccaccgccatctccgccaccgccggccgccgcagcagccccaccgcctcctcgtaccaccccgccattgctagggctcgaagcttcctccctctctctctctctctctctcctctctttttttccccttgcaaaaatggagaaagggaaggggaaggggaggagagagacacgggccagggcgacgagttgtttttggaggggtgggtgaaacatgcgtcggtgaggctggccggtggggccgcggggatctgggcccacctgtcagtggcagcgggggaggggcggttggtgaggcgggcccacctggcagtggataggggtgaatcggcagcatatgcctccgacatatacgggtctcgcgaggcggactcgtgtttatccggagaccggagtggatagaaataataattaatttagcgtgcgagattcacgatgagatccctccgcttgtgacgtggcggggcgttaatggccgcgggtaatcgttgaaacggtacgggcagtggggattggtcactggagcttgctccctgacacatggggcagccaattaattactgctccgctctgctttgacctgcaatgacatgtgggcccagccatctggtatgttgatcgagagctccatccataaattcgtactccctccgtctcataatataagagattttgagttttttttatttgtacttcttgattgctcgtcttattcaaaaaaatttaaaattattatttattttttttgacttgctttattatccaaaatactttaagcataacttttcgttttttatatttatacaaattttttgaataagacgagtggtcaaacagtgcaagcaaaaactcaaaatcccttatattatgggacggaaggagtattaattttgacttacaataatcaaatttgaccaatggtataaaagaaaatgctccatattagtttagtcaagttggtactatattgttttgtgttctagtcaatgtagtttatggaataatgccttacaataacagatattatctttactattaaatcatcgatggtacgagttgaaattaacaaatattgacaattggaatttgggagatcggtcatgtttgatttagattattaaacgaattattaaaaaataaacataataaatagcttagacaagttaataatgtgctagaaaacatctttttgagattgttttgttaaagcatggtgcaaataattcggtaaataaactgaaaagaatatggcaggagtaattatttctgtagcaacgcacattcagatggattcatggagtgcgttgcgaaatattcagagttggtcgaccttgttgatatcggttgaagacaacagaaggaatccagttaggcggctgcctcctgcatatcctaagcgaagcagctgggtcagttcagttcactttctcgaatacattttcaagaggtagcaacagctaatagcacgaataaaatatgaggcggttgttcaatgatgacacaaacaaagctgtaccgaattgacattttgagtctcaaccctcaacgatcaaccagaacatgtgattgcatcacgacaattattcgatcagaaaggaacataaaagtcatggaggaaaaacagcagagagatcagaaaagcgtatatgaatatataagctcgtgcctgtgttaattgagattccagaagaattgtcacaaaccgttgaggaacatgagcctagacgcttaagatacaataatttgaaatcacattaaacgcatgtgcaggatgtactgccaatccgagcagagagcaagatttgcaaagaaaacaaaaaaaaaatgtagctagcacatatactacttgtacaatcctcgagtgccatacatagaagagctacacttgaaaacaaacttctcgaaattactcaaattgagctacctttagaagaactatattggctttgcaactttactcaaccaaccatttcttgtcttgcaaaattcagcagcaccatcccttgttgattgaccgaaaatagcctgtgccccgatagtaaacctaatttaccaaccagcatcctccaatccctgcaacatcatgatgcatttaaatactgaagaaagcaagtaccagttttgaaataactaaacacttcattggaatcgagctcctagcaactgatgatctctttgctactcataaaattttgggggcctttcagtactctcaatcttttctgaagtaatctatgtgaatgctcaacaaacaaacatcaaggtaaaatatgtacccttggccacttttaatcaaatttacatattatattgttgaattttttttttgtgtgcatggacaagagtaacccctgtctagtccaagctccagccaacattagtactacaccatcttgtccccatctcatcctctaacctagcccctccagcagtgcctcctttcttcacaatgcattggcatccataggaattgagagcgactctactgcccacacctttgcacagggcaggctttcgctgcatcaagtgggatgaagacacattcagggtggcttgttcaagtccataaaaaaactgagcacagctagaagctgatgaagcagttcactgtctttattggaagggtcaagtccgatttacccccctcaacactattgcaaaagtacaatttacccccttcaactataaaaccacaagatacacccctcatctattcaatccagacacttaaccccctcataccctgttttaggtggtttagggctgagttgtcttgacattacttgttctcatacaaaccttgcttctgacacattttgtgttctcataaagaacaaatccctgtttgtcattacaatgtcaacctggtgctattaagacttatattacttgttccttgtccttgcttctgtttcttttttttttttttggcacagacctcattgcacaaacaatatatatgacaggaaacaactgatttatatttctgtaaagaccttgggggtttctgcaaacaactgatttatatgacagaaaacaacgataaatttcttcttgtccagaacttggggggttttgctgttacattgcatggctacattttgatgttttgatctactaacggtatatgttcttcgctgtatgagtcagtcactgaaatgcaccaaattgtgagttccaaagaccacgaggtgccatctgggagaaatggcacaggtaaaaaacaagtgcctgcatcaagctaagtttgcaagattcagtggattatcaagacaactcagctctaaaccacctaaaacagggtatgaggggggcttaattgtccggattgaattgatgaggggtgtattttgtcttgtttcgtagtttagggggggggggtgtaaaatgaaatgaatccatggttcaagttccaggcctcacttaaatgtgacattgttcatagtgttaaactgacatagttcatgggattgttctaattaataatctgacacggttcaatacaaaaacctcgcatggccctgactagtctgggtggagaagcaactcgacagatccatcctcagaatcttctccagagtgaagtcagcaggaccggaggagaagaacatattccggttcagcgcgcttttgtggctgccatggcttgccgttcgatcaaggttttggggtcgggttgggaatgagttagggaattcagagctcaggtcttgggtggggccaggaatagccagtggtaaaaaacatccagtcaaaaatgcattgctaaagaagataaaaaatcgggcaaagggtatacaatggcatgcttggaagcaacgccagtttggaatgacatatttctaagcctcaactgatcagtggcatacatctaaagtggtaactatggagtagcaccaatctagtttttcttatattgagtacttgttatgggagcaaatattctggttgtgatatcaacttggactaccacgctgtaaattgggcttccccaaggcagcaaggccccacttacactagaatgaaattgagatcaagatttacatactggtcaacaaccaattcaaaataaagtatcagcttgcaagtattcaatgatctatgatgcaatgcaactcagtaaatcacccacaaagaaaaaaaatgtagtcattcagattgtcaaagttcaaactctaagatgcaatgaagctacacgcttttgatgggaatagccagaatgtggtccagaaaaaggatatgcatcagaactatttgttcacattcagcttcgagctttcaactatcataactgatatgtactgaaatttatatttacctgtctaagttatgacatgattgcctctactttggatcgtacttcaaccccagagaacgcttctaattaacttataatttataaaatactgtttcagaaatctaaggtggtgtttggatgcagggagactaattttagtccctatcacatcggaggttgggacactaattagaagtattaaacgtagactaatgacaaaacccattccataaccatggactaattcgcgagacaaatctattgagcctaattaattcatgagtagcctatgtgttgctacagtaaacatgtgctaaatatggattaattaggcttaaaaacttgtctcgcgaattagctttcatttatgcaattagttttgtaattagtctatgtttaatactcctaattagtatccaaacatccgatgtgacagggactaaagtttagttaggggtatcaaaacaccccctaagtaatcacactggaaaattaggtggaaaggaattgcattctatgtgtggacaactggactttaaagtgggtcaccacacacaagtcatataggtgtagattctaaaatagagacctgccacgcttgaatagacacacttgagactggcaattttatgaggtttcctatgttataaactgtcactattaaaccaccatgcgataattccacattttgttaccataataatccaatattcacatcaaatgaaaaaaaaggcccataacctatgttggacatctttgggctcaaccctgtcggttaactggtaaaggttcaatctgggaattttctcaacactacataatgcaagaccagctgtgattgacatgttgcaagtttgtttgatcacttccatgagcaaagtttgtatcataaaggccattggaactcattatttatgcacaaaataaatactgattaacacatgaaacacacctatattgatatggtttactccacttatcaacaacagaggcaacaagacaatttacattgttttcaaaaatcatttgtaactacgagattcgaccatccatagccttgcattatcgatacaattgcaagcaagtacataacattagtctccatttgcaaattaagaggcatcacaatataaccaagtagctcatcctccaatgcgcagtacataaatatccaatgcgcaatacataaatatctagcccccagagcatcttttaaaacttctaacgtgatttttttatactctagttatgcatctactgcataatcataaacttgcaaggacggataattatctccaagcaaaagatgccataccataaccaccgggagcaatcacatgcgtggctgcgggcgaaggatcatgatgatgatgtcaatggccatgaacgcgatgagcgggctgaggtcgagcttgcggccgaacacggggggcatgacctcgcggcagagcgcgaggaaggggtcgcagaggtcgcgcagcgcggagaatggctggcggtcccaggggatgttggggaaccacgagaagagcacgccgacgagcagcacctccctgtacacccccagccaccgcaccaccgccgacatcgccgcggccaccggcgcccgcagcggcgcgaggttgacgctccgcaggccgacctccagcgtcgagagcggggccagcagcccgcccaccgccgaagccgccgcctccgccgcggcgcgcggcggcggcggcgacgagcggaggccgcgggggagggggagcgggcggagggctagggtttggggcgggaggaggcgggtggcggggctcgggaaggcgcggcggaggaggggaggggggcgcaggcacggggaggtgaggacgccgtgcatctcgccgcctctctggggttctggaaggttctagaaggggtggggaggcgaggaggcggaggaggagatgaaggtgggggaggcttgcgaagaggaaaggatatggtgtgccaattgggatcctctcctgtaatgtatgtgcagtaagtgccactgacatgtgggcccggaataggtggaacccacatgccagtgacacatactgcaggtgcagtacagtgtacagcagtggatttgctactttttgtgggctccacttgtaagtgggtgtgtgttttgtatagtatccatgtcaaactggattaggctgcgttcagcatctctagttcccaaccggaaacaaacagttcgcacgaaaaatggagcggtatattagtgcgtgattaattaagtattagctattttaaaaaaaaatgaactaatttgattttttaagaaactttcatatagaaacttttttaaaaaaacgcaccatttagttatttaaaaatggtgtgcgcggaacacgagggagaggtgtttatatacggcttatatactccctccgtccctaaataaaaaatgattttggttgaatgtgacacatattagtacaacaaatgtctagattcgttgtactagaatgcatcacatccaaccaaaatctatttagggacggagggagtatattagttctaaaaacaaacttgtctgtggtcggcaattctgcatctataatttcataacttttttatttacaattccattgtgatgaattaatggccggccagattttggatttctttctagcaaaactcctattagaaagtagaaatccagataactagttatatatgaattttagacataaccagatgataatagataagttgtgttaatagtttaatatgtcatgattatttttggttgtgattgtatgaattatcatgacagtcatgtcaaaagttataattaaactcatgtagccatgtcaaatataattgatagtggcaacaaaatatactactccctccgtattttaatgtagggaaaattggaaccatgccattataattttgtaaaatttgagatatgtcattctgacccacatgtcattgactcatgtgggtaatacatgtcattaagataccgatgacatatctcaaactttgtaaaattataatggcatggttccaaattatgctttaatgtatgacaccgttgactttttaatcaaagtttgatcattccttttattcaaatcttttgtgcaaatatgaaaatatttatgtcatgcttaaagaacatttgatgatgaatcaagttacaataaaataaatgataattatataatttttttgaataatacaaatagtgaaacgttagataaaaagtcaacggcgtcatatattaaaatatggaggtagtatttttttcacactgttaaagcatcagagtattaactattttgtagggcgaagaatcaaaattccatcacatatattcgagatgaagcccaagtgtccaactcccaggccctgcccacccatgggtgatgggccattgataccctgtgggttggcctgtggactattgagattatagcagcattcccttgcatgaaaataattctgagttttgtatttggaatcgattttttttctttttatgaactgttgcaataaactgaaatgactaatgtattattttcctcctgagaaatatcttttggcaatactatagttcaaacttctgacttctgaatatagataaacgaactcgatcgttgaaatctaaggatgaaatgatgaatgattgttggcagcatgtacttatatattttcagatataataacagtaacaaatcacatgtttgccattttcctttaacagcaagtactaactcgagggtacaagcgaatccaacaacaagccaaatcactgggcggaagcacaaatacctttggtatattaaagatatcaactgcagacctcgtcggctacattttttttctttcttttaaccatcagctgcattgtcagctaaccatcttcttatctttcaatttctacttgaggcaacacaacatgatcttcatgggaccaagacaagatatacaacttgataaacacatcacaaacaggtgcaaaaagataaatatattggacattagagcatctccgacattaggtaattttgcagagttgtagatgtcatgtcactgatagataacactaatgctgaaatagttatgaatactcgggcacagtaatatactagtgtttagttccaaagctgccaaccatgaatatgcagtgtcatactcataccccttacttgtcattaagacatttaatagtacaaattacagctccattaataataccagggcaattacttaaattagtgcttcaataaccacagcttagaaaaatcctaataactacattataggattccacggtgcagaaaagcatctgtcctagaaataatagcatgatggaggatgccaaagcaaatcttccacaacacagggaactactttccctgtggaaaaatcaacagaatgttgatccctaaaggaaaaccaggcaggcaggcaccaccaacatagaatgggagctgtttacggctttacgcctagaaaaacatgtgccaagtcagtcattatatatattaactgaaccaatcaagtcaaataaaacattagaaaaatcatgcataatgaaacattgatatagagaatctatgcgatcctaaatatgcaaaagacaaagtaacatctatagctactgaacagtgaacatattaagcttctagaaaaccaacatataagagcaatgcgtgttcaacacttcaactaacaattcaataacttgcaaatacatatgcatatcgtcggaaaaatacacctgctttctctctgctaattaagttcagcgctaacaggcaaaaaagtcttgcatggtaacaagtcatggtatgattttaatagagacaacgttgcaatcataaatgacaacgataaccaaatttcagttgtgttgattgcggctgctgtgcttagggagttatctaagagagcttggaacatatacactctccaggttcatgactgatcaaattgtgttgtactttgtcctcaaggtcactacttattgattgcaattttttgttgcaaaacctaagaagccagtacttcttctaagccctttagcagctccagacaagcagctgtgagactaataattgccaaccttgtatgcacatatcttatactaatccggtggaaagccggtagattccgaacaaatttcataaaccaaaatttaaatacaaattcccttagtttaccgataagctcatgaaaaccggtcggctttggcgaaattccgggtgaaatcatcgaaatttcaatcggtagctagaaaaagaggtaaactaaaattgatttcctttttttaattcgttattcttttcttttctactgtaaatttcagtaaatacatggaatacatcatttttttcgaaaatttatatcccaataggttctattaatatcatattatttataagattttatttgattttttcccttttttatcaattcaaatttgaatttgaatgaaactcatcgaaatatcagacggcttctactttcgagcctcgttgaaacctcggaatttcgcggaattcgaccggtttccattggaattgtgaaccctggcacatattggtgcaactaatagttcatttgtgcggccggttaagcacaaatgcaaagctgaaccaagaacatcttataacaatagttgtaactaacacacacaaaatgtttgtcaagaaaataagcaatcagtgctggtaatgaatacagacacttgtaacggtttgtaaacccaatcgagaaatgtgtgtacatctaattgcaatacattatatccaattaaaatgcaaagctacagccgcacagctgatctgggactgttaatagtataactttaatactaggaaaacacctaataattaaattgatattaggaaaacacctaataactagtaagccctgggtgcaagtgcaataatcagtgaatgttggagaagcccaatagaatcattcccctggaagcaaggcttcacttaccccctttctccactttcttttcactctctaccccttgctttctctctgaaagcttatctgtcccttgttccttcaggcagataagggaaacaatgagcttgattaattacctctagcaccacaaaatgctccaatcaaaggaatggttactactaaagagaacaatggagttaaaaaaaaattggtcaccaaccattgtctattaaagcaacatgtgtagatatgatgaatgatgctggtaggacttggtataaaatccgccgtaagtcgtctttatgatgctggcgacaatgacggggtttgaatctcctgaagataaagatagagatgaatattaagtgtttcacgtaaaacgaggtggtaatagcgtgtgattaattgagttttaattattataaacttgaaaatggattaatcttatattttagaacaactttcatatagaaagttttcacacgaaacgcaccgtttagcagtttgaaaagtgtggcacgaaaatcttaatcttcatccaaatcttattagagaaagaacagggccgattccgaggttgtattgtgcaagacaaaattccatgtgatggtaaaagacaatggtgtcgctaacaatggtaagaaacgcactggagttgacacatagattcctcttaccaaggaagagggaattgcaaccgatggtgctcaccaggacaaccattcccagcataaggtcgggtagcctgtaaactgaaaaatgccgatgaacactactaagatttgaggtggtcaccagatctgaatctccaagccgcattccaccaaattgtaggataaatgtgcttcgggtgttcttgctggacatttggcaatcaatcttggcggcggcggcgaggtgtccgtcggtgaatcgatctgcaatctctggttcatcgtaaattggcatgatcatatactccctcagctccgtttcattttaagtgtggttgtaagttttggtgtccaatatttgaccatccatcttatttaaaattttataaaaaaaattaaaaaataaagtcacacataaaatattatttataatttatcatctaataacaataaaagtattaatcataaaaaaattaaataagatagacagtcaaacattgaatacggaaactcacaattgcacttgaaatgggacagagagagtaacacatatagcttgccttggaatgacaatggggagaagaaattcttcattctcctgtttgttgaaatcctccattcatccattgcttatcgccggagatggcgacggacacatacaccgttccaaatagccacatcgtgagcgagacgactccaccggcggccactctgacagcggcgcgcgcctcgacgtctctgagacaaaaccacttacctcacatggctcacgtatggcagctaggtgtccagcggcgggaactcagcgatgccgccggtgaagggggtggaggaggcggatgatggcggttgttggagtgtataaagtgaattgcctgtcttttcctataaagtgcaacatgcttacttaatatggtatcagagtcagaggtcgcgcagtggtcgcggaagatgagagagacggacgcgggcgatggcgccgccggtggagaggttgaagaagctgacgaaccccgcgcagcttgcacggcgacgacacggccgcgcgggcaggtggtggctcaccagatcctccgggagagatgcccacgacgaatcatcccgagtggcggcgacggcggaggcggccgaccggccgtcagccgccggcgcgtgctcctgctgctgcctccgcacgggatcaaggcagccgggcgcttgctgctgctcgccattacgagacctcgtcggcgatggcatgccgcgcgcgtagacgatcggcgccggcggcggacgagctcgtcgcccgcgaggcggcggcggccgatgacaaagtctagggcatatcctcacggcccaactctttgtttttagactagcccaagcccaatctactgggcctcacacaccgatggcccatgggccattgctagctcgtggagaatcatggagagcatgaccgatgcaaataaattcagagcttttgtactactgtattactaggtcgctatattttatagtgcattaggtcgctaggtcgttccaaaatgttatcttttattaagagttttattctttttttgcgtattaaaaaaacatattgttgtagatgggtattgcatcattttcgacaatagttcagacatcagggtacagatgaaacgacttctcgtatgaatcttcagttctgagcctctttcccaacttgctgaatgaaccttggcagatgtgaaatgatcagaatgctgatacattttcagatatagttacaatgaaaaatcacatgctttgctcttttcctttaacaacaaatattttgggaatttgtttttttttcctagctaatttctgaagaatttgtactgcttcattttattgcaagtgactctgatgcaatgatgcattctatccatccaatggttattgttagtcatctctcacgcaaattttgccgaca

SEQ ID NO: 2353 - DNA, 2452 bp, Oryza sativa
catttgcatagattttttaaataagccgaatggtcaaacatgtgagaaaaagtcaacagcgtcatctattaaaaaaatggagggagtattaaactatcaggtcgaatttctctaaaactaattataactatttagataactctcgagagcgtactagtgatcagctctcctgtacacaataaagagagttagagagcgcaaatgaaagtttgctttgaagtgagcctgtggatattgttggttgggctcgttgccgctgacaccggaggcaggagtggggcccacctgtcctttgacttttcaacgccctggacaaggacacgcgggggaaaactaacccagccggcccaaccagccacagaagatcccggcccaccgcgccgcgccaaaaccggcggcctttcaaaagcgccggaacccaccaccgacgtgtccggtcccccaccgaatcccagccgtccgtttccacaccaacgccccagatctttcgaaagcgcggggggccagtgacgtaattgttgccaccctttaattaacacgagtccccccgtcgcgattagcgcgctgaggtggcacggattaaaaacaccgcggacgagcggggcctagctaaggtcgatgacgtgtggggccccgggagcggtggggcccacccaggtgggtgtgggtgtgtggattgcggtggttaaggtgggggctcgtgcggtgtgtttcgctgcgggtcgcgtcaccgcggaacggaacggaacggatcggcggcgtctcgtccgttttgggtgtgtgtgtggtagttagagagtgcttagcttgggagattacaaccttaatcatgccgttttcgttatctcacatctggcaagtggtgtgaagatgatgtttaaaatgtgggtggttaggttgaaacctcaatcgttggctattttatcataattcaaggatacgcaaataaaaagaaacccaggtaaataagatagtagaccatgttgaatgcttaaaatgatgatgattattattcggtttactcattgtttgtgaaccttcattaacacagcctatcatttgggagatttacctagcctagtaatgcctagagttttgtatatgttttaaatctcgtgttttcaaatcaagtattctttatagcgatccaaatctagatattcaaacacataacatatagcatctagagtttgcatgtagtgacggagcgtcccatatagcaagtgatcgagctagccaccgaagagaaccttaccctatgcgccacaaggccatctctactaggtatactacatatgtcatctatttgctgtcgagagaaagacaaattaaaaagtgttgattgtttttgagtctgtaactatattggtgggtcgttacttactatgattggtgctttagtgggccgacaagtgcaccagtggacaaaaccgacgtgtggacacctcccgctcttgcccccaaccgctcaacgcctcaactgtagcaccgccgtgctttacgccaccacctatcctattcattgtccattgtcgccactcgctcgttttatccacccgtcacctaaatggccattacccgtcttatttggcctacatatatttgtttttttgtgctccatcattgtttgcatgtactcccaacccttttcaaaggttatcgaaacaatacgtcattgtttttcaaagtacatgtcatacaagatataaatattaaataaacaaaaatagtgaagcgaacatattttcctacgtagccctttgactcaaaggattggaattttccaaatcctaaaatttttgtatggaatgacttatgtacgtaggttttagaggaaacttagcaagaggtccaaccatttggaaaaatttctgagtctatccctctcatccaatatttttcttacggttcaatcaaacgattatttctatatttttcccgtattttacaatcctctattttacacttacattcatgttagaatccatgtttttcctatttctcaatttttttcatttctacgattcaaatgagccctaatactataatacacacgcgcatgtatcttctacacccatttgaacactgtcgatttcatcaaacatcacaactataataattgatcgaagaatgaagattatataatacgagactaccatgcactggtttattttctcacaccaaacatgaaagcaaactaacgtgatcacacaggtgagaggtcaccgctcttcgcaacgacaaaacactgctccaaaacccatttaatctaattaaaataaaattatcattactacttatttaacgattcccagaatcagaatagccaacgaaatgctaactaacccgagtttccacgtggctggtcaaaaccaaatcccccctcctccccgcggtaacctcacccggtcaccggtgggccccacctaccccctccgcccccacaaacaac

SEQ ID NO: 2354 - DNA, 1399 bp, Oryza sativa
tatatgtcccccaaatgggaaagctggtcatacagaagttatgagtggcaggcatgatgaagattcttcaagagggcaagaaaccccttctactatagactcacatatgaatgggaatgtccaggatggagtgcctgcagatcaagatgtgctgaagctggttgatcaggcacgaaagtgcttcttcttgcccagttgcagccaattaaagccatggtatagctgaacaggaagagtcaaaccacactgttcctcagccatttgtcctgcaactgaaagggaggattctggagaaggagattgtacttccagtgcctcatcccaccagcaacggtgaaaaactctctgataaaagtagcacctcgctggcaagtatggcgaagaaggtctgacatactctatttcacattgtatcatatatgttttatctgctttgttgttgcacaatcgcctgaatactatttaattttggaataaatgtcatgatgcatcattttgttggtattatctcagtaaatttctgtattcttttagctttaaccttcaggtatgggtcatctatcacttgaaatggtgcaacatatgctttgatttggcaattgggatgatatttggaagatcctacacagttatctaaataagccacaatttgttgcatcaacctgaaccccctatgtacacaagaaaatttttattagtttcttttctgtttacttgagtatgcctgtgactgcagttctgtttggctggcataaactgtagtaagctctcttgagatgaaataagccagttctattgacaatattttccatggttatggattgcagagtccatcagtgacacccaggaagcctctgcaagctgacagtacttcccatagtcacgaagatgattcatattcggttacttcgtatcctttcagatattgacttgatttctcatgtgtgccttattcttcgcagccacacctacactattcataatagctacaattgggatatagctacatgctttgaacattttgttccttgaattactaaaacacagaaaatttgtctaactttttctttaatgtcttcaactcttcataactggtggaaaactagaaatatatcatgttctctttatttctattgggctttcctgagcttcattcatccagaactgtaacttcagcaaggactggaaaaattaagaagacaacagttcctgtcgcacctacttttatatgtggtaatcgtcttgagaagaggggagaggtacgtatttaatttcatcatactgtagagaaatggctttgtaagttaaaggggacagcattgtaataattattctagtaccgttcagttttacacaaaattggaagaaaaacgcaaggccttggaagaggagaaactag

SEQ ID NO: 2355 - DNA, 1270 bp, Oryza sativa
cagataagcgtccgccctgtagtattggatttggtttcttgctgcgcggcataaacgaggattttgaccaagagtattatatttgaactgtattagatttggtttcttgctgtgcggcatcaacgagaattttgatcaagagtagttagcacttaccaggctgatatattgttgtctatggaattatcaatggttcttggatttattttctttctgtgcaacaacaacaaggttgccaaagaatatttatctagtatgaaattctgaactagtggtacttatgcttgtcatgccaataactgtgaggctaccgttattctttcttactgcgcaattgaccatttgttcatgtcatgtttccatccctaatgatggccttttctggactgtttgatctacaggtcataattgacttcactgcttcctggtgtggcccttgccgcttcatcgccccagtgttcgctgaatacgccaaaaagttccctggtgctgtcttcctgaaggttgatgttgatgagctgaaggtgcgcagagttgcccacaatcttccaaaaacatttttgtcacccctgtgatagtgagtaatgctgttttctttatccaacaggaagttgctgaaaagtacaatgtcgaggcaatgccgaccttcctattcatcaaggatggtgctgaggctgacaaggtcgttggcgccaggaaggatgacctccagaacaccatcgtgaagcacgtcggtgccactgctgcatctgcttctgcctaagaattctcgcaggcgcaagttatcaaataaaggccagcacctggtgttgtagtaggtattagcgttagtcatcgttatcgtcagtttggcttgggtgtcctcgaatatcatgcgaaatcgattccgagttctctttttaaaattcctgatgatgatatatagtttgtggaaatttggatctggctattctgtacgagtttgctgactattaaagcaattattataatatgatgatgctggcaagcttgtagatagcttgaatttgtcctgaatcctgttctgagcttattattcctgcatggctgcatgaacgacgtttgttcatgccatgaattcgagatgatatctctaggcagcatctacttctagccatgctgtgtcctttgctccaatgctactgttatgcttgtttctgaagtatccagtcgatgaggataaggacagctagcatttgttgcgacagtagtaataactgttgtgagttgtgacagtaatctgttcctaact

SEQ ID NO: 2356 - DNA, 859 bp, Oryza sativa
agctgcagcgatacccctcatacaccagagggtaaaaatggaagtgcagcatgttgccggttacatcgtcacagtattgggaactccaaagaagttaacagcaggacccaatgttctccgaagagtgctccaaagactggagtagccgcaaaacccagagcgaccaagggcgtcatgaagaatgtgggaaagccaggtgctgcgaatgttgctgtacaaacctaactcatgatccattcccattcccgtgcaatttttcgatttaatttatacctcacatcgccgatgacggcatcatgtcccgacaacagtgtgtttgttgctggattattttttttgcattctccttgtaagaaccttggtacagagaccatgtggtattccgtgttgtaaatttgtcgaggttttgtaagggggtaaccgagtcagtgctgtaagaactaatctggcagccgataggctgttggtgtgacattgttgttgatgtatggcggcgttcgcagatcctatggtattgtatttaagcatcaacttgttattgttgatattgttgcaaaatctgcgaagaatgtctgcatatttgaattcgggatcgccaaaattctgggaaaaagtacagagaagtactgaaatggcaaatacctccctcatgcattggatgtctctctctacgttctgctgctgccatttggttcaaccccattatcacatggaagtacaaaactttgaggagaaaataacttcgaaatgttggatgcacacttttctttgcaccaaaaataagttgtcaaaagacttgaggtccacatttgtacgatttggttgataagatctgactttgagcaaaatcgactctctg

SEQ ID NO: 2357 - DNA, 1664 bp, Oryza sativa
ctaaacaacacctatttcccaggatttaattggtctggagggagatgaaatagtggattatctgccatcttctggtgaaaagtattgctccctaagcatcgatttcacttgttgattgttttctgattagtgattagttgatagttgcagatttactatataccatcttttgcttgcattaccaaagtacggaacaaaagatccatcattgagtggagataacctgtgctacagaattagacgtagcaatgctgtcctctatttttctgtagtaggtggcagttctgcttggagttccctgtagtatattgttaaaatcttcaaagttgaatagcttcctgtctgtgttccagccttttgggcatcgtgtatgggatttaggtgaagtagcctctgggtgtttctcatatgaactaatgttgcactaaacttgaacctctgtatggttgctaattaatagtaatgaccgacttacactatattaagaaacctcagtaatgtctactcttggccatcaatgtcttagtcttagtcatctattaatatgcacaagctactctgttggtccctagtaattttagaattctattgtttgaacggcacagattagcttagacctagttattctcattgtcttatccagtattgtcttctttgaaggctggaggatatgactaatcagctgaaaaaacgaatgatgaagaaacgcaaagtcaaaactcttgcatttgcaattaccaatgatgtttgcatagaggtgaatacatatgcgctaatccgttcaactactccaggtatgctctaacaactggcgatatttacttctttatctctttgcataatgttgctgtgagaatgtatgtataggcttgttactgtgacatcctttttgtaggggcaattacatggcttgattctatcagcaacctgccattgaaggtgattcatgcttcatgacaaagagatcaattttgtgttacttttttttttttggggggggggggagattcggagttataaaatatcaagttttatgcggtactttaacaagaatgtatgtgtaggctgaaaggtctttcatatgcaatgacactggggcccttattcaggatccacaaaagcgcttccaggtgtacaatgagtaagtacacacatgagactggtgaaccaaagcggtgttatttttgtataattttctgggttgggttctgtgatctgcttcttgattgcttcatcaagcgcagaagtctacagttatgagtcatggcacgatcattgtctcgtcattccgtcatgttgttccttttccgtttcagtttgatgcttatatttgtaatccaaaactactttatcatatattcatgcacttttttgcacagcaaaattgttaaattctctactcgtgaattgtctgatgtgaagagggtttcaagtcatcatctacgccttttaggattcaagccactggactaccttaaagattatcacaacttaagaccgtcaacatttatttaccccagtgatgaggtaataacattacttcatgtacttcttaacttcaatcttgaggccctcttggcacagctccggatccaagatttcttggagctgggtattccgagctccacaaatccatggatctggatctgtgattacgttgataa

SEQ ID NO: 2358 - DNA, 5766 bp, Oryza sativa
ctgcatgctacttccaaactaaactaaatctgtctgaacatatttaggattgtattgtggtgtatgcttatttctttctcagtctttacttaaatctagggtgcatgttaggtttacctccttttgtttgatgcagcaaatatttggaagcactcgtgttttcgttgctttacatagctcaatgcggcgtcttggaaggttaagtcgacttattatatttctgccataatttctttaattttgaaagggtttagaaactgacatagttataaatggacataatgtatgtcaagtcataaaatgtactgtggattaaattaattaacattactgctcattttttgggataattagtgaggggatgcaattgaaaggggatgttagttttgttgaaatatcactctatgcgatagttatctcaaattacagctcactagtaatatgcccgtgctaaatgctacggtccaattttatttgtctttaataattttcaaaacgtcatgttagccaaaaaataaaaataaattatatgatctgagctttacgtacatcaaacaattttcacacataacacatcagtctcctttagatgtagataactcaaaataaacacataacacattagtttcctttaaaaagaataggcaatcgaagaaccatataatatagatagaattccttgatatgccaaaggacaaaatagctgaaaaaatatatgttggctagcttatgaaatgccacaaaaacagaaatctaactttagaatcaattaaataaagtttgcatatagtttgagccagaaacatcaaatagtaatactcccgcaaatcctaagatatcatttgaaaaggatgtgctcgagtgaatagtgatacaggccgccctccgaaccttctaaatgaactcaacaaagcaaaattacttagtggtttcatatttaaccatacaaatagttaagccaaggcactgtcatgttctaatattcagattagcattcaagtgtccatataagccctaacaatttattccacttatacttaaatccaacccattcaactcacgttatacattggaaggaggaactacatagagtagagctctcagcgttggtgggagattacacaggaaaagataaagctaccaacaaaattcagcaaccttaggggattactgaaatgtgtcactctcgccatcctccggcatccaaaatctgctctgaaatcctctgaattagcttctaatagtgatctcctcatggaaaacccaccttttagaagcagaaaagagctatcaaagtgaaaagagtagtagttattatttctgtcaagtacagataaccaagaacatatttgttaaaattgtaagttttatccatcgagacagaacagaaacataaataactgaaaagttggactcttgtgcatctgtaagatttgagtgaataaacactaaggatggaccatagcagcaacttgcaaagcacaggcttttttagctagtttatgcaaaggtactcaagtgtccatagaagccctaatgatgcattccacttatacttaaaatggaaaatgtcaactaaaccaaaaccatcgccaattaatgtagtccattaattatccatgctaatccagttcttccataattatgcctactaacataagatgccataagtaattacaggaggcctcccatctggatgacagaagagatagattgcttttagcaagaaaactgaataatattttttaacacaaaaaatcgcaagatacaataaaccagtccaatcacttaacccaaatgagaaaactgtatgccagatggataccttgttggtctggccacaatatagaacactcaagaaatctagaacgctaaagatgtgctcaatgaaatgcgtctgtgctgccaacttcacggtcgcaccagagctgctcccctacatgaaaaaaagaacacaaaataaaaaaagaatcagaaaaaaggaggccacaatttccttcagcggatgccagcttagaacgaaagaggttccacactttgtatccaaccttagtttcactcttgttacgtgcatacacaaacaacattgccttgcacactgcaatatagaaataatagatgaagttctagaaatagatggatttcgttactgcttaaggcctcaacggacttggattcgccggggaccacgctccttgcccgcacttcttcagatcttgttgcagagaagactacctcctgacctcttccaccactctctccgcatcctgcatgaagcagagtatcatgtatgatggacaagatgataatggtgaataatatggttcttatatgcttaccatgtaagattaaatggagatgatgcgggagagagaggacactgggagcaacgtggtcacggtggattgcgaccggcgcccggcggggcgtggacgcggccgaggagagcttaccttgttgcctagatcgtgtcaccgctgtacgcctcccattcggcctccgcatccttgcctcgccgcttactaccgcccgcctgaccgaagaaaatccctcctacatctgccgttgtcgcgtccttggtcctataaccggccaccgcctctgctggcgcaagggcaacgacggcgctagtgttgagggggcgccggtgtgtggaagggctcgagggcgaggtggcacaccgaatccccaggaggcagatatattagcggcagctccagtcagccacggcctagatcagcgatgcgagcggtggtgacggcgacgtgatttgcgaagttcggcgtgatttttgcgcagggagggagggagggagcgcggtggggatgtagagagcggatctgggagatggagagagggtggcggagagccggagaggggttgtgctgggttctggcggcggagcgaatcgtcggcggggagggctgtgcgacggcgattttgcggagggaggcgcgggatgggggtgcgacgtgcgagggcgaggccgtgagggcggcggctggcgatttggcggagggcgaagggcggtgtgcgaaagaaaagggaaaggaaaccgagcggtgatcccgtgcgtgcgattttccgctggtgaccccgcctgctaagttgttgattctgatgcgtcagatctcagcgagataatctggaccgttccatgatgaatgaaagaatgaaagaatgagtaaaagtatttgttgaactatagggtagataatgtacaaagcggcacagagttgtttgaattgttaaatgacaatagaaaatgttttgggattttttgccaatcttgtcattgcaattcactgagtttttaagaaaatgagaaaaaggaagaaaacaggtgttattttatgatttgtaaagctatactgttgttgacatcagggaatatatttctttaagtcataggctcaaatggtttgtttatttggcacctttttctgaactgtaagtttccagtgatgtcacttaggctttccgtcctaatgcaagtcatgtatttgtgacactaagtgactgggaatatgtattccgtcctaatgcaagtcatgcataggcaaaggtcctctgtagcctagtacatgcttatactaaccatgcatatgatatttcatgtggtcattttatatggttacatggtgcatttgaaaacttacaattatgaattgtaccatttcaggtttgcacttgcattttacgggaatccaactcgcccacaacttgtagcccttattgcacaagtgagggattctctccatgtctatattttgctttacgacatttgctgcattcagaattctagtttacaagtacaatatcagtgacctagttaaaacatatatatcaattgttaactaatgggttaatcctactgtgacgttgcaaaagaaagttcttatgctatttggaacttttcgagattgattgtggtacaaacacctgttggctacaaaaaaagaactagactgagccttgcttctttccacatattcccagcagccacctatatattaacatgggtgggaattgggaaaactggtaaagtgttttgtgaaatgcataacatagagacgcacatgcggccacatattttcgttttgtattctgtctgaattttgtttgtcagggattcttattacatagctatatcttatatactttttgaaattgactctggagaaaaataacaggaagaggttacttctgctggtggtcaaattgaaccacctggaatacacatgatctatcttccatactcggatgatgttagatatcctgaggaggtaatgattggcaccgcatccatatttcatcttttcagtaagctaataatttcaccttggcgtgcaggttcatctgacttctgatgatgcacctcgtgccacagatgaacaaattaagaaagcttcaaatctattgagacgtattgatttgaagaacttctcagtatgccaattttctaacccaggtaatcactgcatttatttgaacctcttattcacatcattaccgacagtactacattgagggtctgtttggttgttgcctaacattgccataactcagtttgccataggtgtggcatggcaaacaaagtgtggccaacaatttgttggccacaagtgtggcaatgtttggctagaaaatgagtatatgacatgtaggcccatgaaataagaaagtgtggcttgccacaactgaaacaagcaaccaaacgctaagctaacaatctgtggcatgcctaacatgtggtgtggcaatgtgtggcaccaaaccaaacagcccctgagttcatgtatttgtgaacctatccttcatacataaattctgataccatctgtgagcaattgctgctataatccgtagagctcattgggtcctgtcaataggcattaaagaagtattatgaacactccaatatgcagtacgactgaactattctgatcattgttcatgttttctattttccaccatgaaacagcattgcaaagacactatgggatcttggaggccttagctttaggtgaagatgagatgccagatgtcaaggatgaaacccttcctgatgaagagggcttggctaggtacttgtttttatttgtctattggagtctgctgaaatctccaaacccttatctgttcctctcgaatggaaattattgaataactatagagtcaagcatgttcatgttatttcagacactgaagatgaaagtgcagtctactacatattcaattcagttttacttttttgcataacaacaacgtacaacagtcacctcttgcttatgtgggttgtttcctaccactcttatctcaggccagtagtagttaaagctgtcgaggaatttaaggcttcagtctatggtgaaaattatgatcaagaggaagccgaggcagcagcagcgaaggctggggcttcaaagaagaggaaagcacttactgatgcagctgcagagaaaagtgcagcacataattgggcagaacttgcggatactggaaaggtaagcatgcaggtgctcttaccgatgggacaacaaagtgttctctaggcactgaattttactatgaaatatcttcttaatgctccaattaatctgataagaaattgtcttccagtagtttacccctctatggttctatccaccagtaattcaaaatgctagcttgcagtttgatatgccaatgtattacggaccttgcttatgtatgcaccacagcccaaaagttttgaggcacataaataaaatgttgaaggctgta

SEQ ID NO: 2359 - DNA, 441 bp, Oryza sativa
tatcacaggggttgacaaaaatgtttttggaagattgtgggcaactctgcgcaccttcagctcatcaacatcaaccttcaggaagacagcaccagggaactttttggcgtattcagcgaacactggggcgatgaagcggcaagggccacaccaggaagcagtgaagtcaattatgacctgtagatcaaacagtccagaaaaggccatcattagggatggaaacatgacatgaacaaatggtcaattgcgcagtaagaaagaataacggtagcctcacagttattggcatgacaagcataagtaccactagttcagaatttcatactagataaatattctttggcaaccttgttgttgttgcacagaaagaaaataaatccaagaaccattgataattccatagacaacaatatatcagcctggtaagtgctaactactctt

SEQ ID NO: 2360 - DNA, 3810 bp, Oryza sativa
cattttcttccatcggtttttcttttgccacgcgtacgtgcatgctgccggttaaaggcccgtttgcttctaagtttagggttccttttatttaataattttggttttttaatatataacatcattaactttttaagatatgtctcatcattcttttttattttataacttaatttatctttaaaacttctttaaaatgtttgcataaaagaattatataagacgcatagtcaaatgtaaatctaaaaatcaacgatgtcatatattaaacaatgcattggctccatctttttcattaatcattttgcaattcaccgagcctgttcaataatatggattttacagtaatttcatagaaaatagtttaacctgtatatgattgtagcattctagaggaagtaaaataacttggtggcactatgaggatgtgctacttcaaaaatcctctttccaagtcctataataatcaatggattgacgggctgatagtggtagagctatgaattttgtaaagccatgacaaaccttataacccaaattaactaagactatatatgttacaaatctttagttaatttgggttaagactatatatgttacaaagtaaccttataacctcattattttgtgtttctagctgggatgtcgctcggcaatagccattgcatgttcttccacctgtgggccgggccagctgattccacaagtttttgcacatagttatggtatatatataccattgatacttgaatcaaaattcatgaaattttaaaggttattgaggaattgactcccttgcatagggcgtgaaacattggcaatcatccattcagcccaaaaggtggatcctcctagtagatgatagtcgattcgactagtgttatcctagagattctaggatcgggagttagaaacagagtacctattagtaatgagtatgtgcataactttctagtatgatttcacagttaaacgttaggtactataaatcattaatatttgaattaaaaatcatgaaattttaaaggttattagggagttgaccatcttgcagggcttcggttctaactctgtcattgtcgctcgaccttaatggtttgagggcataaactcctagccatccatcccgcctagaaggtggatccgcccttagatgatgaaagtcgaatctaatcagtgtttatactgctaaagattctaggatctggggttagaaatagagtacgtgtattaaggaatatccgcatgcacatagctaacttttctaatatcaagccacaatcgtgcaacatacatacatgcacctaaaagttgacaaaaactcctaaccatccattgttgctaaattagatcgtgcagacaacattctccttcttttgacacatgagcagggaaaaggtcaccctgcgcacccatgcatttccatgttgcttcccctggaaaaatgcatgcacgtacggcagtctgaaaatgacaccaccgatcactgatgagtcgcacaccgtggtcgctctgtgaattgatgatatatatccattgacaacctcgtcaactctgctcgacagcttatctagcaaaatttcaatttgaaagttatttttttactgatcgatctaggtatttttacatcatatatagtctatatattttctaactcttgcttataaaatattaagggcccctttgaatcgtaggattgaaaaatcataggaatatgaaaaacacaggaagtattatgataggaatacaagtataaaacagagaattgtaaaacataggaaaaataaaggaatgaacatttgattggaccgcaggaatcagatgagagagatagactcaagtgaagttttacaagaggttagagtggatgttaaatttcctacgtttttcctctagaatcgtaggaataggaaagtttcctacgtttttccttttctcatttctacgaatcaaaggcatggataacataggatttcaattcctttatttttccttcatttatcctcgaattcaaagaacgcctatgtttatattgtgtttcttaaaaaacagtggaagtgcaaaatattgttttaaattatttttggatgcttcgtttatcctttttatgatttaccagccgtggctcaaccaatcagtcacttcgtctcccctttgcgacaaattattaacgttgtttctaagtcaaattccaacgcaaaacgtctctctctccccatactccagtaactccactagtgatgacactgcacacaggcgatcgacaatatgtattcatgcatgcatatgcatccgtgtgactataaatatgtgcagagagtgcaaggacctactgcaagattgggcaccgatagaattaagcatttgatccccagtcaaaaaaaataaaaaataagcatttgatcgatcgatcgatcatgaggtttaccgcagtggtagcagctattgttgccgtcattcttctcgtcttcctggtctccggcggcatggcggcgcggccgatggtcaatatggagaagaccacggccgtgccggttgtgaggaaaagtggtgtggtggtagagtcgtggacgatggagagctcgtcgctgccgtccggctgcaccaacgggaatggcgccggtggctactgccgccctcctgctcctgccggtcactaattaattaggttgccgtcaaccatcataccatatggttctatataaggtttaccgatcacaaatttgatcatgcatatagttaagatttagcagatgaagcttgatcgtattcttatagcagtatataggatgaatgggaaataaaatgtatgaacatgattgtaaattcttggtacaccacgcctccagatatgtaaccccaattaaagattatatatttatatgatattgataatatttgttgttatctttatcctaaactagcatggtggcccgcgcagattgtgcggctagcatcattatattttctctcatataatagcatatatgttttctcattatattattcaaatatattaaaatgacaacataattttaaattttgcaataactttacaaaactactaatgtttaatattcatattatattttatatatgtgttagttattaattatttttaatattaaattttagttatttgtaaattatatatattcctatatggactccagactcgttttttaatatttctttttttttattccgaattttctgtaaattgtatttctatatagaccctatgctcttcttccaatattatttatttttatttctgaatttttattatttctaattgtatttctatgtggactctaaattcatctttcaatattctttaatttttaatttcgaatttcagttacttctaaattgtattcctatattgaccttaaactcttcttcccatgtttttcttaatttcgaatttcagttatttataaattgtatttttatacggactctaaactctacttttaattttattatatttattccaaattttagttagttttaaattcctatatggactctattctctacttctaatattccttaattttttaattccgaatttctattttttttcttaattgcatttctatatggactctatactctacttctaatattccttatttttaatttcaaatttctattatttcctaattgtatttctatatggactctatactctacttctaatattccttatttttaattccgaatttcagttatttcctaattgtatttctatattgactctatactctacttctaatattccttatttttaatttcgaatttcag

SEQ ID NO: 2361 - DNA, 4590 bp, Oryza sativa
tatatggactctagtctcctcttttaatattccttattttttaattccgaattttaactatttctaaattatatttctatatggactctagtctcctcttctaatattccttattttttaattccgaatttcagctattttctaattgtatttctatatggactttgccttttctttttctccgattaatgtgagaatttctaaaccatgagagcgaacatggaggctaccttttctattcctttaataatataatagattatagtaatttttaactatatgtccgaacatactcttgttcagatagatacatagtcaaaaattgttatattctgatacacggacggagtatctggtaccatcatcggtaataagtattgggtgtttataagatttcaagtacaagattaatttgatcctaattttcattatatgatcgtcctggcggctgtacaagctgatcgagttctttgatctcaatggataatcaactaaccgtgcgtgtggtagttgcaattagttattggattctttgctatctgaactatgattaatgccgatgctgaaacagtagaaaaataataggaatgcatatataggccgcatataaccctcttaaaactttgatattttcctgacaaaattaaatgtttatatggtaaatagaggccgatacaggtttggtccaggcccaaaccagcccacggtatattgtgtgacatcccggcgcagggcttaatagaatactcatatcaacaagttaatctataaaagttgcgcacgaggcgggtagttacatattagatcaaggcatgcctctgcatggtgaaaataaatgcctctaaaggggtagcttaagacttggcgctgatgataattaattagatttattttttcacgaacgcgtaaaagattgctcgtaaatatatggtaagtagatttagatgtaactacaaggtgcctttgatatctcaagggatttgaccaatcaaaagcagataattataaatatttgatctgtagtcatcttagataaactaatctagttatgtgttggctaaaattgagacaccacactttttcacttaatttcggtcatttttttcctatttgattgcttcctctcctatatgtaaacatgcttatttctcctatctcttcttccaaatggataataaattatttttaatcctaattctcttatacatcgtgtattagaaaaatcacaatgaaaattacaatataattactctttaaatttgaaaaggcacaatataattataaatgcaagaatatatagtttatacaatataaaaaacaatttgattgttcttttgtgaaaatatgacgctataagtataactactctcccttttgagataacgtgactctacaacagacgagagaattattgccatctatatttggtgagtcccagccgtatctatagattcaatgaatatggccacatgcccacatatagctagcactaatatataccatatccagagacatttacagtatataccaggccccgggtcgcccgggccactaagatagactttatgctccttcggttaaaaaaattattttaacttttagacaagtttttatcatacttttagactttggccatcataataatttctcaaatgcttaatgtaaaaacaatgaagtgatatgcatagatatatcttgaaagatataatgatatcacagatttattagattttttactcttttttaaattattctaatagtattggtttcaaaagtcaagagaatattatcttataaatgtcaaatatttacaacatgaggaatagcattagttttcatcatggtagcaacaatgtgtcctaaagggactggcccaagccgtggcccattttggttttctcctgacccacaatgctaatcactctagaatgcagttattcactttttttcttaaggggctaataatactcatacttttccataattccattggtttgttttgtgctacaaattcaaaaagtaatagcacaaaacgccatgttagaactataactactactccatccgtttcatagtataaaacgctttgacttcttcactaatctaattttttaagtttaactaagaaaaacatagcaacaatttcaacaaacatactatagaagtattttcaatgtgggattcaataaaactaatttagtgctatagacgttgctaaatatttttataaattaatcaaacttaaagatgtttgcttgaaaaaatattttataatataaaacggagggagtacaaatctacgacgatgatcagaatatcagatcacactgtgcagtgtggccaaaatgtccatgggagaaaaaccagccactcctgggccgatagcccggcccatatctggtcaagcccaccaccagggcccacgggcccatcgtccctcctactcctcctccccctcgcgaaaaatatattttccttttccaccattcccaccgccgcttcgttcgccggcgatcgatgagcgcggcggagctgtgcgacgccctcgccgccgccgggttcgacggcgacggcccactcgatctggacagcctcgagtggccgttcctccagggggacgacgcccgccgccttctcgcctgggtctcctccaggctccgccccgccaacgtcctctccgccaccgacctcgccctgtaccactccccatcgctcgatccccttcccccccccccccccccacgaaattctctctgatcgtcgcgttctagatgttttgggggggcgttttttcggaattacgcttggttttgggggggttgattgattcgaacgggatggagagggtatggtatgggtgtaattgtttggaggtttgaggggttggatgaactctggtgtgtgctgggatgcgaaatggtgatgggcaaatcggagttgtttttgaaacttgaggaggagaagggctttgatgagaaaaggcgcagcactgcacatgctttctgaagtttgatggacaaatgtgtagtataaagtactataaaccatagaagtcagaagttgcatgacactatctagttaaggttgtaggtgtagttatactatgagagctggtttagttggatcaattgcacgttaccaacttatgataatatgaattgtagtattacacaatgtttttttgttactgtgtaacgatttctgatgatgcttataaagcttaattataaattggtgatcttttttttttaaatgcaggtatgagcagcttgaactagaagggaaacttttggaggtatagagctttttggtttctttgtttgataaacttaaatacttggactgtgagttacatgtgatggttattagttaggcgaaaaccatgttggttaacaaaatttactggtatgattagtcttgttttcacttatcgcaatgtattagctctatctagtgagtggcatgctgctaattgagcaccgacttttagggggaggacttagactttgcgtttgacagtatttcggccttctcagagactggagaaaaccaggaagacacatttctgacagaagaaagtcttgagcacatccggtatgtcatatctcgtcttacacaggaaaagcattcgatgctcctcttgtttggatctgcatatgtagttgtccaccttctgttgtgatgtttacagattacaagtataaatatttatttggtttaacacgtgttataaaatggcatcattccctaatttatttggtctagatgctttggtaaaactgaactcctacattgagagtgattgacagatggttctgtcagtggtagcgcagccccacatgattcgctccatgtcaacacctagtcttatctcgttaccctgctgttttgatctcttcattgacataggattttctgattatttgttacagtgactcaaagcttacactcagagctgaagtttctgatttggaaaggcagcttgcttctcttgaatggcagcttgatatgcttacagcacaagctaccaccattactcagggaaagaagtcacgtgtatctgctaaaactaatcctaatatacaaatttcaagattagatgagaaacttgctaagagaagtttagaggtaaaatgttcctttgttttatcatccaaatcagaggccacattactgtattctactgttcttggctgtattttcatgagatagatggaactgaaatatgcttttcatattacaccatgatactcatgtctggctttagaacctgtcacctatctagcctataatcggttggaacatgatagtgtttgataactaaccagaccagtagactttatgatctaatggcctagggctatcagtgttatctgatcgtccgattaatcgtgattaattgtcctgatcggtcccctaactctgatcagggacattcatttgatcagctcgatcagaaatctgatcgtccgattaatcgtccgatcagagcacctatcaatcacttttagaactagtcttaaggtttagcacatgtgaatatgtgctactactgctagttgctttatactagggcaagtgagtaaaaaa

SEQ ID NO: 2362 - DNA, 1209 bp, Oryza sativa
acaactgagaagtaaccctgcagctccattgctgctgcttttagcagtgaataggcacttgacatttttgcccgtccttcaatctggcaagctatctttagaaactgatgagcagcaagttgattaaccagataattgatgaactgcaagaatgaagaaatgcctcagtgactacctatttatgtaggaaattggtttgcaccaaaacaactgactgttcaaaagatacccttttctgctggcttatgtagcattcctgacgcagaaccttcaaattatgatcccctggaaggtcacagtaaggaacatgcaattatattgccgcaacagagcaaagcattttcaaatgatgattcatgagaagatcacaccttgcaaaatatttgcaccctcaagttgagcaaggtcagcacacaggcttgtaataatctaaagttaaaaaaaacattatttttttatgtcactcacaaagaaaataatatgtcacagttaatgcataagatagccaaacggatgaaaatgacattaaaattggctataagcagcaggaacagagtaaattgaagaaggggtgacagatacataattgcaaagacaaaccagtgaacatgtcagttttctgtagtttgcatttttggagcaatctttagcgtaactgtacattctttttattattttgccggggctgtgacaccatgttgataaagtgtgcttcataggaatacatcattgacccaaggtatcacagaatgcaattaattaaagaactctgaagcgtctgagataaaccatttgcttatccatggtacattaaaaaccaaatttcatgtacataataatttacctcagataggcatctcttcacttgaagtgaaagatccctaagctcttcagcaaactcagagtttctcctcctgaggatgacatggcaaatccaaaaaaaaaaaagaaaaataaaagcagatacttaattaatgaaatgtgaaaattttccgaaacatcacatgtacaaaggtttgttcaagtactaccatacaataaataaacaatccatacaacctaaatgttctcataaaaagatgaagcgctttctggtagatttcgttcaatctactttttttaaaaaaatatatgtcattataatacaatggaaccaagctgtttcatttagagatgtcccataaggatagtaccatgttctcaaaagtt

SEQ ID NO: 2363 - DNA, 99620 bp, Oryza sativa
  unsure (1)..(99620): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtgtcccgatcgtaattttcttcttgtcaaaaaaaagttgccaacataaacatacattgcaattttatgctttgtaaattgggtacaatatgatcaattataatgcatgacttgccttgctctcgcactgatgagacctcagcaacgtcttcgagaaaccgcagatcgacgaaacggccgaaaactacgcgataaacaaagcacacaagcaaaacatgctataagactactgaaacaggaaacaaaaccatttttaatggattctttgcatttttatgaatttactgagacttgaatggacttaaacggagctcaggtgaattacttatgaattttagaagataaactgtgtttttactaataaagaaaaagtccttaattattttcttgcgcaataatacccagggctgacgtcagtgaggggggggcgggctgcgccgacaggcggggcccgcatgtcagcggcacaaggggagagggagggggcgccggcatgtgggccccacgggcaatggctcaagggggaagaggggggtggcacccggttggctcagctcggcttcaaagccgagcggagaccatggcgaccggcggtggcgtgcgcggctgccgaccgcgacgaccggcggagggaggcggcggcggacggccgaagcggcggcacggccaaaggcggcggcgcacgcgggaaggggagaaaagggagggagagggagtcctcaccggagaggcggcggcgaccagtgcggaaaacaagggtggcggtgacgaccgacgatgccgaggcgcggacgggcggcggcgacacctgggagggagcggagagggggttaggagaggagacgacgaccacggcggctaccattgccggccggagatggaggggagggaaaaaactcaccggctcgcgaggagagaggcgctccggtgggattccggcgacgcgaggcggcggccgggaaagctcttgtggcggcgaagctaacggcggcggcggtttggcgcggcggcgactctagcggcggcggcgcgcggccgaaggcggcggcaagcggcggagctcgggtgtgacggcgcgggcgcggtagagggcgtgggagaggacggcaaatgggggaaacgagggaggggactcgggggagggtttttatgggcgagggaggggcggacgtggccggggagatggccgaaaccgccggcaacgtggggaggagagagagagagtggggtgggattcaaaatgaatcccgcccacttcgtgcgtgcgtgcggacgggaagggcggaggagtggggcggcgacgtgggcgcgcagcacgggcggagtggggcgcggagaacggcgggaaacggcggcggcggcgtgggcggtttcgacggcagcggcggttcccggatgtaggagacgaccgacaggtggggcccacctgtcggcgtcccgagagaggagggaggggcggcttgggccggcccacaaggaggaggggccgcgggagagggatgggccgacggcccaacaaagaaaaaaagagggaaaagaaaagaaaaagagaaaaaggattttcctaggattaaaaattgcactttggtgatttttaattggttaaaattatttccaaggctctgaaaattccactaaaaatcctgttaatgtattgtgacatgttgaactcaaggaaaatcccacattgccaattccaattattaaatgcctttattaattagggatttagctctaggttaattaagataatttcttcgagcaatttatttagccaatttttaaagcaaggagagggggaaactttagggcgtgacaaacctaccccccttaaacggaatctcgaccccgagattcggaagagctggcgaagaggtgcggatgggcggccttcaactcatcttctctttcccaggtggcctcttcttctgagtgatgactccactgaaccttgcagaatctgattactttgtttctagtccttctctcgctggtttcgaggatacgagtcggcttctccgcatacgtcaagtcttcttggatttcgatttgatccggacttgcctgttcctcaggaactctcaaacatttcttcaactgagagacgtggaacacattgtggatgccaagcatgttggagggaagctcaagctggtaagcaacttcacccctgcgttccaaaatccgatatggtcccacaaagcgtggtgccaactttcctttggtttggaagcggtgtactcccctgagcggagtgacacggagatacacataatcccctgcttggaaaacgagctcccttcggcggttgtctgcatagcttctttgtcgagattgcgcgattctcaatctttccctgacagctctgactttctcttctgcctcatttaaaacttctgtaccaaacaactggtgttcccctgtctgatcctagaagagcggagtacgacacctccgtccatacagtgcttcaaacggtgccatctgcagactagcctggtaactgttgttgtaggagaactcagtatacggcaagcttttgtcccatgctccaccaaagtcaagggcacatgctctcaacatatcctccaatatttgattaactcgctcggtctggccatcagtttgtggatggtaagcagtgctgaagttcagacgggttcccaattcttcttgcaatttctgccagaactttgaggtgaattggcttcctcgatcagacacgatcttcttaggtacaccatgtagacacatgattcttgccaaataaagctctgctaacttcttccctgagtaggtagtatgcaccggaatgaagtgagccactttagtgagtcgatcaacgactacccaaatagaatcatgccccgatgatgtcctgggcaaacccgtaatgaaatccattccgatttcttcccacttccattctggaatctgaagtggctgtagcaaacctgccggcctttggtgttctgcctttactcgctggcaaacatcacagagtgcgacgaattcagctatttcccttctcatgctgacccaccagaatttttctttgaggtcttggtacatcttggtactgccaggatgaatggaatactgagtttgctgagcttctgtcattatcaagtcctttaactccttgttttcaggtacacacaatcttctccccatctagattgttccttgttcatcttcaacaaaacctcgggcttttccaactctcatgttctttttgagctctgctatttcaggatcacttgcttgagctatgcgaacctgctccaccagtgtgggctgtgcctctagagtagccacgaatccgtgctcaactataccaaggttcagatgttccaaatcgcgttgaacctcacaacatagttgctctacccatgcaacattgcagtagctcttcctgctcaaggcatctgcaaccacattagccttgccgggatgataatgtattcccatatcataatccttgatcagctccaaccatcttcgctgtctgagattcaaatcaggttgagtgaagatgtactttagacttttgttgatctgtatatacctcacaacggttaccgatgagatagtgccgccaaagctttaaagcatgaactactgcggccaattccagatcatgcgtcgggtagttgccttcatgaggacgcaattgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattctgcagaccagataaacttttcttccttcttcaatagctgtgtcattggcttagcaattttagagaagttctcaatgaaccggcggtaatagcccgcaaatcctaagaaactccgaacctgagtgactgtccttggtagggtccatttggtaactgactccacatttgctggatccacagctactccttgagcattcacgatgtgaccgagaaactgaacttccttaagccagaagtcacacttgctgaacttggcatacagctggtgctcttttaacttttcaagtattagccggagatgctgcacatgttcttcctcgaacttggagtagataagtatgtcatcaatgaaaaccatgacaaacttgtttagaaattccataaacaccttgttcatcaaattcatgaaaaaagcaggtgcattagtgagtccgaaagacataactgtgcattcgaacaacccgtaccgagtgatgaatgctgtctttggaatatcctcttcgcggatcctcaactggtgatagcctgatcgtaggtctatcttagagaacacagtagctcctttcaactgatcaaacagatcatcaattcttagcaacggatacttgttcttaatagtgacctcattgagtgcgcagtagtcgacgcacatccttttggttttatctttcttttccacaaagataactggagcaccccaaggcaacgtgctcgggcgaatgtatcccttctgtaactgttcatcaacttgcttcttgacttccaccaactcgttggctcccattctataaggcctcttgtggatcggtgcagttccaggtaccaagtcaatccggaactcgatatccctttttggtggcattgttgtcagatcgtccgaaaaaacctctggatactctctaactatgggaatatcttccaacttcttagtggttttctccactgctacctcttgttcttcaatagcagcctggttcagactgatccctggcttctgtggcactggagactggaaggtaaccacttctcccttcgcattggtcaacttgatggtgaggctagtgcaatcgatcactcctctgtgccttgttagccaatccattcccagaataacatctagatccttagattcgagaagaatgaggttggctggaaaaatcaacccttggatttcaactctcactgacgggcaatagtgagttgtggtcatgccacctccaggagtatgaactcgcataggtatcttaagcttcactaaagataacccatgtgcaccagcaaaacgcttggaaatgaaggaatgagttgcaccagaatcaaacaatattactgccggtgtcgagttgacgggaaatgtgcccaatatgacctctggtgctgactgtgcctcctctgcagacgcatgattgacacgggcctgcacaaacttgggtccagcatgtcttggcttcgggcactttccaaccgtgtgtcccggtttgttacaattgaagcagagttcgggctttccttcgaactcctcgggctgttttgactgagcaggcagagctggctaaactgactgagctggaaacattagtggacttggagtcgggttgaggctgtgcttctcgctgttgccgtgactgccacaatggtagatcctgccgaagctacccgggtggtagggacggtgctgccggataatcatggtggaaggtccaccctaatgtcccatcatgaagcgaggcttctgactgttcccctgggaagttctaaactgagatgccttcctttttcagttcattttgttaccctgctcctcctgacggatagctttgtccaccaacttctgaaagtcctcataatctcgggagatcaactggttggtcaattcatcatcaagacccgacaaaaacttctcctgcctctcggcattagtgcgcacgtcctcaggagcgtagcgcgcgaggcggttgaactcgtgcaaatactctataactgttctggttccttgttgcagagaatggaactctctcttcttttgtgccacaattccctcgggaacctgtgctttattgaaactctgacaaaactctgcccaagtaacctctgtcccagctggacgggtcaccacgtagttgtcccaccaaacagaagcggaaccttgcagctggtgtgtagcaaaagcaaccttctcttggtcgttgcattgcaaaaggttcagcttcttctcaatagcatgaagccagtcgttggcctcgattgggttggtggtacttgagaaagtgggcggcttgacacggagaaattctaacagtttggattgaggtggtggaagaccaaactgcagtttctactgctgctgttgtgcttgctgctgcacctgctgcaacacctgatggtactgttgcatctgttgcatcatcatcgtcatcatctgagtttgattgtccaacacctgagcaatcgttaggttctcgggcagtggggatgaactgctgttaggtgcatcgttggcacatgctccactgatctgctctttgctgccactggcgttgttggagtcacgggaaccattccttgtcttcaccatctggagggggataggtagaaatatgagaaaaggaagaaaaacagggggctcagaaactaatctttcctataagtttaagtgcaattatcttaatcgtgattaaaacactgaaagagaggcacacaactcctaattgaggcaaccataccactgacacatgatatcgaccgccgactaatccaccagcaacaaacctatgcacggaaactagcaggcaaacaaaactaggaagacaataaagctaagggcggcgactctgaagctcggagcggcgcttgcaatcgagggataggactgacatctaaagatggacaagggataagaaccaattcatgctcgaatccaaattaaacgaagcaacaaatgactcaaacaaataactgaacatgatgatttttatgcatagaacatttttcatgaacccagataaagacacaattgcaactaaacaataaattaatgcatagactggatgcatggaaaatgatgcgcataacattgccccatcgaacatagacacgacctaatgcataacccccaatagattcccgactgactgtcgaataaactccaactaaaatttttctaaagctctagactgagctaattttttaaaaaaatcagatccgaatgaacgaccaagatttttcccgcaaaccaaagaggcaaaactccaaattttcccgaaacaattccaggtgcaaaaggcatatgcagatgaaaaaggggttcagagggctcttaggtttccagttggcttgtcctacggtcaaggtcggctctgataccaacttgtcacgcccagaaattcacgaaccagaatttcgaagctgaatgtgcattaaatccctgtccaggaccagccagggtacataaatgacaattgttgacatacagatccacgtcttacaaaaatagaaaagattacaaatgcagcggaaaagataaaagcgagctaaaccgggaagcttgacttcagcagcggggcgactccactccacaggcaatccttgacggcagcgacaaaaccaacttcaacaagacagctccaactagaaagaccttcagctctggtgtgggggaaaagagagcaagactgagtactacccactgtactcagcaagtcataccggaagaggaggtatgatgtaggatataaccaaagaaggctaggggttcttttgcacaaagctagcatttaaaagcagtagttgaaagcagtaaaacagctgtagtaattaatcaatattaaccaatcactgtccaacgctacaccacgttgcaacaagcccaaccaaccacctgaactacaccagttcattaagctaaactaggggtgagactaatcacgatgaatctggttgatcacccataaccgcgggcacggctattcgaatagttttactctggctagaggtgtacaactgtacccacaagatacgattccacacatgtcgccatgccccgaagtatcaccatgatactgcaaagggggaaatcgtgacaagaccctcccctaaccatccacaccacgctaaggtttcacccccacccctcaaaaggcagtgggcggtcccctcttgcgccgcggtgaatccagcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgtcatgggtgcgaccagcaaaaccatgcacccacagcccaccattcagtgtattttaattaactaacaccattgcggtgacaccaatccaaaactatgctcatagccaaagtctatgtaataatgtgatccccatttgtgtactagttgagctaagcatggctaagcatttcctaaaccaacatctaatcattttgatacccaagttatcaatggcatatggtaaacaataaatggctgagtaataggacccatcccacatgacattgtaaaagaatgcgacatttaatagaaatgcgggatatttgtaaattgggtacaatatgatcaattgtaatgcatgacttgccttgctctcacactgatgagacctcagcaacgtcttcgagaaaccgcggatcgacgaaacggccgaaaactacacgacaaacaaagcacacaagcaaaacatgctataagactactgaaacaggaaacaaaaccatttttaatggattctttgcatttttatgaatttactgagacttgaatggacttaaacggagctcaggtgaattacttatgaattttagaagataaactgtgtttttactaataaagaaaaagtccttaattattttcttgcgcaataatacccagggctgacgtcagtgaggggggggcgggctgcgccgacaggcggggcccgcatgtcagcggcacaaggggagagggagggggcgccggcatgtgggccccacgggcaatggctcaagggggaagaggggggtggcacccggttggctcagctcggcttcaaagccgagcggagaccatggcgaccggcggtggcgtgcgcggctgccgacggcgacgaccggcggagggaggcggcggcggacggccgaagcggcggcacggccaaaggcggcggcgcacgcgggaaggggagaaaagggagggagagggagtcctcaccagaggggcggcggcgaccagtgcggaaaacaagggtggcgatgacgaccgacgatgccgaggcgcggacgagcggcggcgacacctgggagggagcggagagggggttaggagaggagacgacgaccacggcggctaccattgccagccggagatggaggggagggaaaaaactcaccggctcgcgaggggagaggcgctccggtgggattccggcgacgcgaggcggcggccgggaaagctcttgcggcggcgaagctaacggtggcggcggcgcgcggccgaaggcggcggcaagcggcgaagctcgggtgtgacggcgcgggcgcggttgggggcgtgggagaggacggcaaatgggggaaacgagggaggggactcgggggagggtttttatgggcgagggaaggggcggatgtggccggggagatggctgaaaccgccggcgacgtggagaggagagaaagagagtggggtgggattcaaaatgaatcctgcccacttcgtgcgtgcgggacgggaagggcggaggagtggggcagcgacgtgggcgcgcggcacgggcggagtggggctcggagaacggcgggaaacggcggcggcggcgtgggcggtttcgacggcagcggcggttcccggatgtaggagacgaccgacaggtagggcccacctgtcggcgtcccgagagaggagggaggggcggcttgggccggcccacaaggaggaggggccgcgggagagggatgggccgacagcccaacaaagaaaaaaagagggaaaagaaaagaaaaagagaaaaaggattttcctgggattaaaaattgcactttggtgatttttaattggttaaaattatttccaaggctctgaaaattccactaaaaatcctgttaatgtattgtgacatgttgaactcaaggaaaatcccacattgccaattccaattattaaatgcctttattaattaggaatttagctctaggttaattaagataatttcttcgagcaatttatttagccaatttttaaagcaaggagagggggaaacttcagggcgtgacaaaaaacaagagaaaatgaaaaggctctataaagattgtaaccaattaacaacagtttgcttgaggggatccttcattctgcagagatgcagaagaattttatttataaagagagacttccaagattgtaaggttggctacaaatttctgaagatgaggccatttcgttgttttcagatgtgccaagcagccacgaagaagatttctagaaagccaggctgattgaactgccatcttgtgtaagctgtcctttggtaaaattcaagattggcattccatgagattcccagaaactgccaacaagcagtgctaaatggacagttgaagaagagatgatatctggtttccctttggttagtgttgcacagtacacatgatagatcatcatcttctttggcacaatgcctcctatccaacatatctcttgtgttcagtctgtcctagaagaataaccaagcgaagacttttattttcattacacacttggtcttccaaatccagatcagagatctgggtgcttgaatggcagcaaaattaagtttatataatcgtttaggggtaaaacagctgttattccaaatgaaactccatgaatctcaccttccttgttccaagtgaaggtgggttagttcttcttgaaggttgagatactcacaataggcttgataagagagtggtaacatgaaagaatcctccaatggcctgggacacatagattgtaccaaatcatttttatatagagatgaagcataaaggtgatgatattgctgacatttgaattgatcattccacagatctgtccagaatagagctgtagtgcctgtccttatgttgcattttgcaatttctctaaaaacatcaaccagaacaataatgtctttcaaccaaaaagagtctttgtttgttagatgagggactttagttaccaggtaagacttagccacaagattaacccaagaaatatcagctgtagagtaaactttaacaagatgtttcatgagcaaggctgcattttggatttttagattaatcacacccaggccccccttttcttttggtgtacaaactttttcccatgaggccaaagattttctggtggaatcagggctatttcctctccaaagacaattctttcttgcagtatctatggccttgataacagtgacaggtaattgtagggagcacatgtaatatgtaggtattgatgataacacagagtttattaaagttagtctacccccttggggtaagaacattgagcttgttgtcagcattctttccactctatctaccaggggggcaaaatcaatcactcttggccttgtagttcctagggggagtcccagataagtgaaaggcagttttccaacaaaacatccagaagacctgcaattagatctgccttttcttcagagagattgaggggataaagactggattttgcataattaacttttaggccaatcgattgagcaaacatatttagtagtgccttgaagcaaaagatttccttttgtgaagcttttagcaggatcaaagtgtcatcagcatattggatgatggggaacccactgccatcattttcattgattggctttgaaattaatccaagattgaaagccctatttactgttctttgcaagagttcagcccctagaacaaaaagaagtggagataaaggatctccctgcctaactcctctcttgcagataaaagaaataccaggaaccccattcaacagaactgcagagcttgccgaggagaaaatcatttgcacccaattaagccacttttgtgggaacaccatgctgtgcatcacagataagatggttgtgtgttcaattgtatcaaaagctttttcaaagtctaacttgaggatgattatttctctttttgattgttggcattgatgaatatactcaaaagcccatgccaaacaatcctgaatggtcctccccttgatgaatccatattggttttcactaaccactttgagaatcacaccttgcaatctatcagccatcaatttggtaaggaacttaaggctcaaacccattagagaaattggcctgaaatcattaactgtttctggagaagtttttttttggcacaatggtgatgtaagaattattcagaatctgtaaatctgtagattcaacatgaaaatgagccgcaagtctgtagaagtcatgtgcaatgatgtgctagcgttttttcatgaaaaaaccattgaaaccatctgggccaggtgcattatctgctgggattatagcgatgagactatcaatctattgtgtgcaaaacatgtcaatcaagcactccaaatctgttctaggaacaaaaagctcattcaagttaaaatccattgttgggaagcaagagatacccatcctattcttgaaactctgatagaacagatttgccttttgatcatgcagataaactatctaaccattttgattcaaaatttgtgaaaccgtgtttattctgtacctttctgtggcaatagattggaaggacttggtgttttcttctcccagcatcatccatctattagtacatcgttttttccaatatattttcctgaattccagaagttttaagatacaatgtttaactacctccctgaaattccattcaattaaagaaatgcatctctcttcttccagaagatcaataaaatcaattactttattagagttactcaagagaagcacgattctggacaaatttttactccaaagcttcagtttcttcctcagaatttttaatttgtaggagatatattttgcaggatcatgaaaaccaggatctagcatccaaacttgctgaaccacctcaaaaaagccttgtgcttcaacccagaaattttcaaatctgaaaattggggacttaggaattttcgtatcaatctttactacacatggtacatggtcagagatattcctagttagagggagaacagttgtattggggaaggttaaagtccaggatgcaaaggtgaaaacccaatcaagtctttctagcaaatgattttgttgcatattgctccaggtgaaccttctcccttttaaagggatttcaagcaaccccagggaactaataatctcattgaaaattaaaatatcattcatgttagctcccactttattcttgtcatagataaatctgtagaaattgaagtcccctagaaaaagccagttctgttgagcatcaatctggatatttttaaaccaggtcacaaaatctgatcttttggggccattacatggaccatacacacaagtcaaggaccatacttgggaggtgaatctagaagttaactccacagtcacagagaaagggttaacttctttgggtgacccattgaagactcttgaggcctaaacaataagaattccacctgatgcactcatggagggggcaaaagcaatagagccgaagcgcttgggggcaaatttcttgatgtcaaaaagctcaaagttttcctttttagtttcttgaaggcataagacctggcagccactgtcttcaattttctgcctagacagtaacttattttcagcattcatatccctcttgttccagcacaaaacattccaagatttaaaattactattcattatcacaccattgagggaggggcaaaagtaccaaggctagcacaactaaccgaaaaacaaaccaaaagccatacacacaagtcttggcagtctgacaggacaaatatctgataaaataactttgacagtaaacaaattacagaccccttgagcatgataaaaggaaaacacaggtctgtcaataaaactgagtcttctgtcattatttatcctccatgtttggcctggttatcttctgtcttcttttgcccccccccctaggctggattctgccacctcctcaggagagagcccgcacatgtctacccccatcttttgtatgaccaaaagtgaacaatcaggtggagaggagtcagagttcatatcactataagaagtttcattgaaatcagactcctgcaaactgctatcaataaagagttttgaaatacctgcaaattccttaagctttttagcaaacctgccccttggcttcccaatacccattcttggatccatctgcaaatctttggttgccttgtcttgcagtagcctagagctttgtcttctgtaaggactgtaaagaatggtcttcccatctttcttctttataggtgccttggggggaagcagggcaacaagggccacattgattgggctagagtggggcattacactgattggtagaacatcctcaatcaccctttccggcagaggaggagaaatggacttgaaaggttgtaaagcccattcagattcatgttggcccactgagggagaggaatcaattccttggcaggaccaaagttgagaagggattggccattctcaaagcagcagggataggcttgtcctggatcaaaatctgcatgatgccctttgctttacagagaaagtcaatcttgtctaatatgcctttcattggataaaagtaggggtgccttggagcttcattcctagcaattctgttcagccgagctaagaattcctgtacttgtgggtccaagataggatcctggactgtttccttcctggctgatgagagaggtgtggctatctgctgaggcaaaataagctgaccagggttttcttcaatctgacccattggatggtcttggccccaggcatcttcttgctgttcatttgcagcctgttgttgctgcactgcttcgtcccaacctccagctccctggtttccagggttgccaaactgccagacattaccatcatcaggatcctcatcaactgcatcatcagggcccggctgcggaccagcagggggaagatcctcttcagtggggaaattaatcaaatccccttctagcatgaaaaccaagattgtccaagattcccccccccccacacccccagcgccaagaggatcaaagagaacaatctttctcggaacagaatcctggtccctgttctttgccctaacaaaaacccttcccaatattctatctgcatccgcctaaaaggttaactaaccaaaagaggcaactaccaggtgcacatgatggcgatcattgaaatcgagtggaaaatctagaaacatgaaccaaccctctctatggaagttagccgccctccaattaaacctttgtcatgattaacaaaagtaaccaagtgaaccccatcatagaactcaggcggggagaggaccagagcatccctattcatagcagacctcatctggaagaaaccttctgcaaacgggtgccggaagctgttacgaacctcatagtgtagcttatcttgtatgaagttggcaatgagggcccgatgatgatcccagtcctgctccagggggattggctcaacaatggccacacagaagtcttcatggttccgagcagggcgctgcgggacagtgaggtcaacccgcgggatgcagaagtcacccccaacttgcacaacgtgaccctgccttaggaagcgctgcggattagggttaagattggcaattgggggcagagggaagctttcggtgggaagcactgtgtgtttgggagaagaagggtttcgggaggaagaaggtgagatttccggagcattagttttggccttccaaacagcagtagtctatttctttgaaatatacccaatattgtgaaactagtgagagttgaatgaaaacaggctcatgtaattctctactaaatctgtttttgctttcaatgtttcacttgaagggcatctttgtttgttttcaacgaattgtttatttctcgtcattcagttagttagaagatgctaacagttctacgcttgtggaattgtgctttctgtatagccgcttattaatacgagttgtttcttttcaattagtaataaagcataatagctcttctagctagcagcctagcaccataacaattgtacggtactacagaatttgcatttcatataattgcattttacactgcgggcaacaccaacaaagtttccacaacaaggtccacatgtgcaaggaattataattgtcaaaaagtaatgttatataaatatatgtagtacttcctcaaatattctacaggaaactgccacatcaaagtagtcgaacgcggtatacattcactactacagaacttgacatcgtgaacagtctatccgtgtcagggccttacgaaccgtcacatccctatctgaccagattaaacaacgacacataaacacccttgcagacaatttccataggcctttaggctgggcccatcactaatgacactcataagtgacggggagaggttatcgcccaacaaagataatcattgacgggccacaacctaacgccatcaccgatgagtgtcatcgttggcgagcccaacaataggcccgacaaagatatatgttaaactctgtcaccgatgagtacggttttttgcgatccctagttattgactgttatcgatattacacactataaataccccaaccaattcgtggaatggttatcccaaccaaacgtactggtcacatttgtggtgagacgtgtaggtgggcaaattttgccttttttaaaaaaaaagaaaaacagaaaatatagaaaaagtctactaatgtatggaaaaaataaatcatccctacaaattttgtaatacatgtcatttaaaaatcatatctaatatttgttcacttttgtagccatggaccgatattagatgtacgaaattgatcgacatagcaaagagtatagaagtggcattgcaaattttataaacgtggcggagaagaggaaaagaaggaacaatgatgacatgacttgtgatgacacgacttgtccatgtccagattgcaaaaatgagaagatgttgatagcagagtagatatatactgtcatatgatacgtcaaggattcgtgaagggctacacatgttggacgaagcatgcagagcaagaatcaatcaatattgcagatgcagcgagtagtggtcaaaatcagaaagaagatgaagctgacatgtttgttccttctctgttgggcggtgaaatggttgatgtcaatcacgatcttctacaagcaatattgcatgatgttgaggagtcagctcgatgggctgtcgtgccttcgggccgacccggcacggctcgagtcttattgggttgtgcctggaccgtgtgtgcagcctgtgggctggcacggcaccacccgaaatgtaggtcgggtcgtgccgccctgactgacctcggcccaagcacggccgtgcctggccgtaccgggccgggcggcccatttggccatctatataccgtggcgcgtgttttataaattattatgggtgaatagctaaagtggtctccaagtttcatctgagactcagtttagtccttgatatttcaatctatccatattagcccttatccttgaacttatccttgaacctacttagaagccacatggctaaacataactaataactctcttgataaatgacacttataccccctcattcacatgtataaaagaaaaaattgcatgcaatgaatttttttatagataatgtatagtaatttacataaaacgaaaataagttatgtacttgcaagtgtatacgatagccattgcttaagtttcatgtgcacatgttgaaataatataaaatacatctgcaatgttgtttattcatcttggttttctcttttctattgtatagttgtatacaaatgaagggcaaaagggatattttgcaatagaaattttgactagaaatagccatatggcatattaagtggatccaaggacgattttaagccaaaacaaatacttagaggacttatgtggacaaaatgaaacctggaggaccaaattaagccttcgtgaaatttgagagactaaattagctattcgcccaatttttattaggatgcttacttatttcctacaagggagacgtgttggttcatgactaaatagtattttgttggagaaaatgtgcaactttggtgcacatgacgataattgatcaatttctaccaattatagtttgctataaggcaaaatctaaaccgagaggcttctcggtttagtgttaaccagcgacgaacgaattgtgagaagaagtactgctacatgtgctgacgtccatacttgtttttcctcttagacatgcatgtctttttcttccttcttataaagttttctctcaaattacttatccgatctacaatccaattgcaccattatgttcgttacagttaaatcttcacaacaagatcttacatgattatattacaatgaaaaaatatttatatttgtaaattacttttattatattcgtaagttacttttatcatatatatatataagttacttttatatttgactaagttacttcttagacatataaaagtaaattcaataaagtctaaaaggtatttacatgtattataaaagtatcttaaaacaaaatgaaagtaactttgtcacgacattagaagacattaaagttctttctttttgttataagttacttctataatatatgtaaattacttttaagctttattaaatttacttttatatgccgaagaagtaatttagtgaaatctaaaagtaatttagatttattataaaagtaatttatattttttttattaaaatataatcatgtgagatcttattataaagatttaattgttacgaatacaacggtgtaatcggatcgaagatcggatgagtagtttaagagaaaattttatttgaagtataggtagatagagtctcttataggtgaagtggtagctggtttaaacaaaccaggtaccactagttgtgtagtcacgtccttgctataaatatacgggcttgtttgcagaaactatggaaataaatgcaagagaaattctaatcaattataggagatttatgttggaatcataggagattcggccattcaacctaccatcactcgcgaactcagagaaggatggaaacgatgaatggtaatgggccaatagctcttacctctttgctgcagtttcgatctaaggacctatttagtttatttagtttctacgcagaaacttttcaccctatcaaatcgaatatttgatatatgcatggagtattaaatatagaaaaactaattacacagattacgtgtaaattacgaaacgaatcttttaaacctaattgtgtcatgatttgacaatattgtgctacaataaatatttgctaatggcgagttaattaggtttaataaatttagagacgaaatctataatttattttgttattactctatgtttaatacttcaaatatgtgtccgtatatccaatataacacgccaaaatttttcaccctgctgctctagacacagcctaaatcattcttttttttcgcactccctcctcgtcatgataccgcctcgctgtaacacatgtagtactaaatcatctttttcgatgaattgggaaacggcttctagtggtcaccattgacttgctagttaacagtgggacccacttgtcaataacttttttgcttacctctccccggtctccaaccctctctccccctcttcctcttctctcacctttcagcaacaatggcgcagcagtagtggcctggatggcggcggcagcggcggcggcgccggacaacggcgcggtggggtgcctggcgtcggcggtggagggcccgataacgtgaatggcaatgggccaacacccctgacctctgctctgctgcagtttcgatctagttctttttctttttccgcgcatctcgctcctcgccgtctcgctgccgccgccgatgccggtccgcgttttctccgtcccttccattgccgccgttcctctcggccgcgcctctgcttgtggtgccacgttctccagcgccgatgcggcggctgtctgcagatacgccagccgtttggtcaggcacagcaatctccggcggcaaaggttcttggtgatctgccctacggattgttcaggttctcactgtttccctgttgttatctgttactactaccattttaccgcattattgtatattcccctgattcgttaatctagggaagaggtagtagaactggaacacaattcaattcaacgtgctgaaatgcaccgtcagagctgatgccatttctagtcaatgctaacggttcagttctgatgcattttcgatttatgaaactctcaactgttttaccctacatagcccccttgtggtagcttctagcaaacctctcaaaattgtcctaagggtcttcagggtttttaggtagtatttgtttcagttatttacccaactttgctatcctatataaaagagaaaaatctacctaccaccagcattctggcttgcactgctcacccaacccccttccactccctcagcacgaccggtaatagaggcataaccataattaaacatccaaaggatatatcttgattacagataagctagggagcaaaatggattgtataggagtttgtatgacagataacatactcgagatatttatcgaaggaaacctacaaaaagaaggggattatatatttctcaggtcagacaactagttagaatgttagatatatataattgaagttcattttcatatcagaaaaggccatatttttagttttacagaatgcatcatttcttgcaatgtacaacactacttacaacatttattcaaggggaaagctcttttccttgcactaagagggcatacttaaattatacattttgagaaatagtattcataaaataagacatgagacaaataatattgtggtagtagaaattaataataccagaaagaatattagagcccatgccaagggattatattgtatgtttaatggcaaggacattatgagcaaattatcacttactacatacagatccattcaaaacattatgctctaaagtatagcagaaataaaagtgaaacatatcctctgcaaattgcatggctatactaagaattacagcggatttagtgtagaacagctcaaaacagaccatgaaacttcatctaaaaaaagtaagtatgaagtttcaaatatcttaggtaattttccttcccaagcacctttggcaaaccaacgaagagcaccggtgatgagtaccctagttttggtcatctttttgtcggcgctagtagcatactttagttcttattattgcattccaatgcaaagtaaccaataatgtacttgtatgtatgttccaaatcttccattgaacaactgtacatgtatatataggctgcagttgtataacttcggctacaccaagtaattcaacaagtttgtgtgtgtgtgtgtgtatgtctcagatagcaaccagaagaagttatgtatatatgctcccagctcaatcgacagcacagcaaaactcaactatacaacttacaacaataagtagtaaccgaagaggatcttgttgtagaagatggcaaatcatatcttagcagctgaaaagagttaaaccatccacccatgcatcaaatcaatctcaaatgatgagaagataattgaaggcttcgaaaaagccaatcatcaaccatgcaaataaacccttctaggatcacgccaaattaatttccacaggcatggaactgaccatgatagctccccagcggcccagcccccgtcctttcttcttgggcaataaatcaactgtaataaccatccccttggctcaagatagcagcagcaccattcctctgcttgtcttgattcacagagatgagagatgcacattggtccaacttgatcagaaagtttgattttattaccatataaaacagctggtcacatgaaacacattttgtaaggttgatccgaatagaccatcaagtttcaaatctctcaactgttttttcttccaaagcttttgctgcatagttggcagcaacattgggaaggtaacccacaagattaactgaatgtcatctggagtgtaccttttcccgttgccgttgcactcgtccatgccatgataaattgtatccctgtaggaattcagaaaggaatcaatttcttcctcggatccatctctcttgcaccaggaaaatttccttaacagactagtaccttgcagtttgcctccccaatcaagctttcgcaaagcattgatgatttcgtctttctctgttgatttatcacaaggtagcacaaacatgatgaatgcatacatccacaggaaaaatgcttctctgttccttagagggactagagaagcatgtgtacagataagatactccaaatccatactaataaccttgtccccagtgttcattaagtttaggagatgcatcacgtcttcaggtatatcctccttgtgttgtccaaacactatttccataattattttgccagcatccttgtagtttttagataccaaagagtcgttcttgtcatcaagttcgcttcctcttaattgcactatcccatcttctctgataaaaacatttgattcatcaaaattccgtggacacttcccccttttgtgcaggaaatatagctctttaagtagtgctctgatgacaaatttggcttcctcagtcatgaggcgatataccctttgacgcgttggaccaacaagcataactggtgtatgcttgatatattcgataagtggcttaaattccagatcacgtatgtactccgcataactgacatgatgtgtgtttctgttttggtacaaaagaagcaatggtcaaatagatatcaagagtttgcagaaaacacatacgaattgaacatatagtaaaattttagaagcataggagtagaaattacagtaggaaagggaaatgatggacgttactgttactcttcattactaatatgaaaaattgacaaagagttgcattttatacatactagtctgtccaatcgttatgcacgtaaagaatttctattgtgactgattgtttagattagagctaggactgcatgtattcttcatcaaaaaatccaggccaaactcaaataaattggacaaataaaaacaaatatcaagtgaataatcaacttatcacagtttattaagtatttccgaatctagcaattgaagttgacctagtatggacattttttatgaatacagaatatgttcacccctatatctaggatttttttttctttaaaaaacttctaaacaacaaaatataatttggagcacttatgctatgtgcacaagatatgccccattccactattagtaaatttaataaatctttcacgttaaatttccctgcatgcaaacaccacttggtttgtaatatatagaacatggggaatagctcaacttggtcaatcattattgccaaattaagtgaaattgtagaagaatcaatggacataattaagcatcagtacaaaattaggactgtaaaaggtggcaccaaacttctctctattacacggaggatgtgcacacgcgcacaccgcacatgtttgtttaagtgcccctttagcacagtatgtaacacaagcttaacaaatggagccaaaggattgaggcattgaacatacttgtgagagaattttacttttgattagaagccacatctagaggatttttagttatagctagctacacaagcagctctggcttaaaagctgttataagaagagctctatcattatctcattaaatctttgtgtaattgtggaaccagggcttgaaccacatcaacgtgctttccttatgaccaaattgactgtaataaaacatccaaatctattgccatgacataatcgagaggatattactataggtaattttggatgttacaatatatagtgaacgagctgtaaagaaaagggtgaaggagttaccgaaacgggaacacgactcctctctttgtgggcaatgaatcaacaccaatgtcattcttgttcgtgtcttgattcgccgatataggcattgatccaacctaaaaggaaaaattgttgcttttgttgcaatttgaaacagctgaaggatccatgatcacaccaaactccttgtccatgttggatccaaatagactatcaagttgcaaatcttccaactgtttgttttcccaaagctcttcttgcatccttggcagcaacattgggaaggtaatcaacaggattagttgaatgtcatctggagtgtaccttatcctttcctcaccgtatttgtccgtgccatgaacaattgcattcctgtaggacttcagaaagtcagtgatttcctttttgtagcacatatctttctcccgcctgaacaattttttgaggagattatcccctttcagtttcttgtgccaataagatttgtatggcatatcccctgctggtttgtcacaaggtagcataaacatgatgtgtctatacatccacaggaaaaatgtttccctgttccttagagggacaagagaagcatgtgtacagatgagatactccaactccatactaatagccttattaggattgttcatcaagtttaggagatgcttcacatctttaggtatatcatccttgtgttgttgcaacactatttccacaattattttgtgagcatcctggtagttttcaaataccttggagtcgctcttgtcatcaagattacattctcttatttctgctatcccatcttctctgataaagacatttgattcatcaaaatgctgtgggcactttcccattttgtggaggaaatacagctctatgagaagtgctctactgacaagcttggctttttcagtcatgatgttgtccataattggttcagcctccttatattgggtgagtggtttgaattcctcatcgtgcatgtacttctcgtaactgatttgatgcattttgctgttcaagtaaacaaaaaaaagtagcacaggtcaattagtttcaagaagcattggatactaatgacaatattaaaagaatgaattgatgaacaatacaattactcttcactaccaagcaatgaactcagtggacatattgagacatcacgtactaaataatggatcaggttaaaattagaggttgaagaaaacagtcgacagaggtccataaatatgccacttactatctgtctatctccatcccgaaaagcatataattctggctagatgcatagccaacttacaattttttttttaacggagctagtactctctccttttcaaattgatcatcatatatatttatgcacgaagactaaggataatttaaatcatatcaatcaagacatcatgcacatattttccgacaatgcatgtatcgattaaaacaccatgtcaatcacaccttagcatgtacacattctctcatgctacattaattgtattctgatgaaatctgtatccattcggttatatgataattaatttaagaaattttgaattccattatatgatgatcgatttggaaggagtaagtaatacacaccttacacatataagccatggataaatttgtccatcgatatggacatcaaatcaatattttagtctctattgggtagggtcaagtccctataactgtaccaccatgtgaagaaacctctcactgacaagattgacttggtgtggcaaagcatccaaatgcattgccacattatataatcgagaaccccacatagataattcgctaaggcattattcggtttggaggggattaaaggagaataatttcacactataataggtgtgggataaatccctttcaatcctttcattttggggattaaccgaacaaggcctacaagaggaaatttaggatggcactgtacgggactcggatcctcttcattgctgttgctactgcagagaagcatgttttgtgcattagctcaaatctaggccgttcatccaaaagaaatggctgtgatttcttcttgcttcaatctcttccatacttccacttctcttgtgacatatacattagctctgcctcctatgctcatggtcatcagttcatatctatgctcatggtcatctcgctcatggtcatcttgttgtgacggacctcccttgcctttgttggcttaataacttacccgtctattccaaacatctacttgtggaaaaatttctaagcggtaacttctttattttccgttagcacgcttcccgaacagttaaaccgtatgttatatgaaaaatatttctatataaaagtttatagtaaattaaataattaaaaatagtcatgtccgaaggagcgattgagattagtattttagtgacacgtaaaacgagacaagtcattaacgcataatcaattaactactccccgtttcatattataagtcactaaccaaacttgttaagtttgacaaagtttacagaaaaaacaataatatttttaacacaaaacaaatatattattaacatataataaatgatagttttaatgtcactaatttagtgttatagatgttgctaaatattattataaacttttgataacgagaaacatactcatagagaacgaaaaagttacagttagaaatcactctctagaactcagttattaccgtgagtacagtgatgtgcaaccccatgacatcatttttaagatcaccacaatagagtatgaacagataaatttgatagaatgaagccatgaagacataaagtgtgaacagacaattgatttgatggttgagagcagaaagagctagagttttgctagaagtacgcaaccgtccttgcttggatggatggctcggatttgagctaatgcacaaaaatgctcctctgcagtagcaacagcaatgcagaggatccgagtcccactgtacggtgggcaagattgatgcattgcattagtttgacttacatacaagaagcatgatgtaccaaaataggatgtgcaaaacaggatcaaccactacattcagttagaaatataaacagcattacgcatccgttctaagaaacagacacacaattaatgaatgttcgaaagcaacaattgcacctctggattttcttccatatattttttttccattacaacgaagccacacacataagggtgcatcaagttctcataaacagtatcactcatccgttctagtacatgcgtatgcttgtgagtcttatacttttttatatacataatcaaacacaccatacatatgtttatttattttagaaaagatgaatcaatatgcctgagaaaatcataaatcgcacacacacatatatgcatcacgccacgtttgattcatggagctatgcaccttgaagcccgtaacaaacttcatctaaatcagtgatcagtgttacaaaaaggtggctaactcccgatctgtgtccgaaaagcaacaattcgacctatcagtcgaccccatctgtcgctcctagcgggaaaataggaaaaaaaataaatgaaaaaaaaaaacggatgctgaagccgacagattggctaagcatttcgaagagatcttcccaaaaacggaaggattcgtactaaaaaggcccacccacccgaaagcacacaaagggcgggggatcggtcgtccgatcaaaactcatcataggatttattaaagctggaaaaaaattaagcaagatgtcgtgtaaaaaattaagcacaacctcttgaagagcggaagaggccacacacgagctggccggcggtaaaactccggcggaagaggttggacttaccggagagaaatcacggcggtgcacgtaccggagggttttggcggcggcggccactcttgtagggagtactacgcatgtgtggtacggaatgtctctgtcacgtacagtggccgtcgctccatctgacagcagtggctacgctggtttgccgtgggcccaatctcaggccctacccgaatctattttccacgtggttgctcctagaggtgacaggtgggtgggacctgagagctaacggggcacgacgtggctgccgcaacagcaaaagtagagcacataattaatacaattgagccaacataagctacttcctccgtccaaaaatatatcgatgtgatatatcccaattctacgaatctagaaaaaaataataggtatatcacatatatccagaaaaaattgaccatggagaagaagatcaaagtggagtggccgccgagagcatacgatgaggaccatctgccgctggccggtggcatcaaagtaattggaagagcccccgtcgctgctaaccggtggcggtggagccgggcggaaattgaggagggatatgccccggcgagaaagctaggctagccttccccgccagagtcgaccaggacgccgatggcgcccaagagcgtcgcagctagctggtaccgcgcgccaccacttctactgctcccggcgccagcgtcgatagactccggcgggcggaaaggctgagcaaattgagaaacggagaagctcgatcgatttgccgccgccatgtgacacagctccggattgacttggggtcgacgacctctctctctctctcccttgacgaccacgatgcttttgctcttgcaatggatgccgctacactatcatcgtctcgttgacatcctcttctactgatccagagcaggtatacctaaacgtatttatttttaatgactcgatcgtaataatgtatagctgacctgaccctttcaaagtcgtctccgtatttgtaactacgacgcaattctctgtagctacattcctcgaatagtctcacaacgcgcacctatgcatgtactcacctttatgaacgcagatacatacatcgtatcgctacgagttttcgaaatttttttcgaaagattaaatcgacatatctaaaaattaacgaaatcaagctaacttaattcgtggaataaaatttccttttaaggaagaagaaggtgcattgttttttcagcaggaagaaggtgcattattgttcccggcacatgattgacgggacggtacgtagtttttgaattatcttgccatgaaacaaacaagcatgtatggacttggtaatatatacggtatatcgatcatcctagtttacgtttcacaacgtaagatgttttttgttttgaatatattcatgcatggattcttacatatacttcatatatgtgtgttcaaattaatatgcatgttagtgaatctaggggagggacatagaaatcaaaacatcttattgtgtatacgtgtgagagagagtatttatcaagaattttcccaactaatgctgtacagatgatttcttttggatttttgtttgattcaccattcacgttatgacctaactcaatttttttcagaaagagggcgtcctggaatatttaaaaatttttaaaaggacgatgccataatgtttgggtgtttgaatgtaccaacagcctaaataatccataaactgttggcccactaaccggctcgttttctcattatccaaacatcacgcgacccaattgagtagaatttatttggaataaattcacttaaggtctctctatttgtcaccgagtttagaattcacccttgaaccataataccatgttttggctcatgtggcgtttacgtgacattggcgtggcacttaaagttagagaaaatcatagaacccacgtatcagtaagagtcggtttaaaaataaaagagaatacctaactaacacattaatagattaactaggtaactagtaattaattaagtagaattattatttcaattagcatcattagaaataattaattaatcgctaattagtacgattaatctgctctgtgagaccgtggtggtatctcgcaccgggttcatattctctaccatagtaactatctttatacacactgacatgtgagacaataaaaatgtaggacccatatattagtagtaaatgtaatagtagtgatagtcaacacattatagtaaggatcctcaagcggctgccagctgacagctttcaaactcatcatcatcactccccaaatttaaaaggagtccgtcacaactctcctgctctgccgccgctgcagtttagatctcgaaattttttcccccttctcgctcattcgctcttgctcctcctggctgatgctgccgccgccgccgccgcgcagcaaaatgcccgccggacggcatcgccgccgcttccttcctccacctccgttataccatccatccccgctgcagtctacgaagtaaggatggcggtggcggccgtcgctgttggtcagccgcagcggtctcaggtagccaagttcttggtgacgtaagagttaagacttggcgccgttctatttgttctacattaccttattacatcgcccttctgtatttttttgctttcggtatttttgtgtcatagattattactacccatagtattgatgcatttctgttaaaatggaagagtgcaatatgaagactttgccaggataactacgctgtatctggttggtatttgcaaaacatggcaactagttattgacaaagaatcatctggccacatactatgaaaaactcgttgtcaaagctgaacaatctacattgtttctacctgttaaaaactgttctcatatcataagttcataacctgatgtcttgactagtgtcttcaaatgtcaccaatttactcaaattaaaagaacgatacccaggtagaagcgcattccaaattctaagagttctcacttcacactttaattttacactttatgactactagtattagtttcagatctgcaaccaattcactgcattttttttccagagtagcagtatcgacataatcaagttcaagtagcagagcaacattttagtagcagctcagagtaataggggcctgtttggcacagctccagctccacccctcctgaagctggagctcagccaaacagtttcagctccaccaaaactgggagtggagttgggtggagctctctcacaaaatgtactagagttgtggagctgagtttaggcagctccacaactccactccagactcaactcctggagttatatttaggagttggagctgtaccaaacaggctgcagggaagccggtgaattcagatcgttagcttcgccggattgaggttggggagtgcggatcagctgaatgcaggcgtcgtctcccagccgagaaaatcaagacaagggaaaggtgaagaagaccggggatggtggtcttcttgggttttgggggaattgcacatagaatattagaatgatatagaattagggaggtgaggtgacatactgtaggtgtttattggtgtagttgctacaatgcgaatttgcgaggtcacacggcacctctccgttcctccctgcatcagaacaatcatggccattcattatgtgatctaacggctccgaacgatcaatatagtataagcaatagtagtagtcagaaaagttttttcgtcgcggtacatttgctacagagtcatggcaatctttagccgtttgttcctgatcttgtggtatgggcgtctccgtcggcgtttgcggcagcaatagctatctgaaggaatctttttactcttaaaaattgtttgcaatacaaaattgctctgattgtggaccaaatgactagccagataaagatgacggacccttatcggtgaaccgtgatgcaagacagtgacacgtaattaagactggttcccataagacttttggcggcgctcccgtggacggtgcatctcgttcgttaatcttatttgttccaatccagtggaagtgcacccgttagctccctgcttcctgcacacatggcgtgtgtgtgagagaactgagaaccttgtacctcatggcaataccctggaggcctggaactggcaagttgccttttaattccaaaacaaaaacaaaataagagaggaaaagaaaaaggaaaaacaatgacatactttggttagcttatcttggacaagtcttctttaaaaaatctctcggacaagtgaatattattaatgtatgtactatctccaaatagtatcctagtacgaggttagatataatctagtattataaatttagatatgcttccctatgcagatttatagtactagattttttgtgtatagtatactaaagggtgaatagtcaaagtagtcctccaagttttatctaaggctcagtttagttcttgatgtttcaatctatctatattagtcctttaaattttcattttagttcaaactcattcttaaaccaacaactctcttgataaatgacacttataccctcatcattcacatatataagagaaaattgcatgcttgatttttttatagataatgcatagtaaattatgtaaaatgaaaacaaattatgtactagcaagtgtatatgatagcaattgcttaagttttatgtgcacatgttgaaataatgggaagtacatctgcaatgttgtttattcatcttggttttctcttttctatctagtacatagctaaatacaaattaagggcaaaagggatattttctaatagagatattgactacaaatagccatatggcatattaaatggacccaaggataattttaaaccaaaacaaatatttagaggagttatgtggacaaaatgaaacgtgaaggaccaaattgagccttcgatgaaacttgaaggactaaattagctattcaccctatactaaactaaattgatataattttgaaatggatgaagtcataactaattatttcctcttaaccctatcttgcaacgtaaatatacgcttcagtctcttttttatatacatggaaacagggcaacaactgtctcacacggtcactctcaggcttcccaacttttccgtatactctctccatatcaaaataaaccaacctagctataaaaaaatagaatttagtacaacgaattctgacaggtttttgtccagtttcattataccaagttatatcccatgtaacctagttggtttatttaaacttgtcacacctaacctagttggtttattttagaatggaggaagtaattgtaaggcatgatgctgaagtcatatacggtgagcccttatggatggaagttttgttttaaaaaaaaatggagaaattcaatccaaagaaataattcctacatgagtataggattataggattgcttcaaagataattcaaatgataacgaaaaaatcctccatattttgcaggaattctagcaaggggtcgaacctcattgtttcaaacttctttgagatttccaaggcactgtctctcaatctctctacattcttattaggaaaaaaatctaacaataatacaattaaaatagctttcacccattgtaacgcacgggcattttttctatttaatccaaaagaatgtgggactattcaatagccgccgctgttgccgcagacagccaagaagagccggagccatggccgaattttttggggactttgtgaagggagaaggtttgccggaggagggagaggaaggtagcaagccactggcgacgaagtcgagctagcgatggcggcgatgtggttgtcgacttctcggggaaacgatgggattgggccaatccagtggatacccatgggttgaatctaatctggaaccaaacttttgcagccaaaaccaaacaatccaaaccatttcccatctccatccaaaccagtccagtccatcaggtgcaccaacccatttccacccgcccaaagctaacccacactgaaatccaacccactatatccatttattagcaggcttactcgtgtagcagattagctcatgcaaacgctcagtcgaacggagccttagcgcaaactgactacatgagaattgagattaagccgcgcaaacatagcagatacttgaaatttatttaccagcatacatacaacagcactgcgctggcgctgattgcttcactataatagaagcattcgagagacctgacatgttccaacctctcttacgggagaaagaaaagaaatagtagaaccactagacatggaacagcagatcattacagagaaatgatcatatttatgattcttctatctccattttctgctcttgttcatcttgacagctttcagctcctgcattcaccacagccttgcgatacttctgattataccgcaggattactaccgaaatgaaagctgcagataaagaaatagatccatgttagtctcatatttaaattagaaaggcatgttgtgcatatctgctaaggctgttcagatcataatgaaaacttaaaaaacgaataatttgctacgctgtatgaaacacaagaaaaaccgatcacccaaataaaacacatatatgctacattatacattgcatatcagctcaatctatctattatattattaaaacagccttgaaaggaggcaccacgttcgcggtagaaaaagagaaatatctacaccgttagatcgtggtgggtccaaattataacggtgtagatcaattcataacttatatagttatgaaatagaatttgtattcaactaggaaaaggatattccatctctctgtattggttagcagcatatgcatttacgtatattggagtcctgatagtatttccgtatggtgtccgatttgggaaagaaaaaataaagaagtttgcatgcacagcagaactggaaaggtacatgcgggcataactacacatgtataatcacatattactaccagtaacatagcatttgttgccaagtgttaatttactgtgtattaaagaagacattacgttcgttcattgtgtaggctagaaattctcacatcaattaatcagagaaaaaatattttaatcgttacatcatgatgggtttagataataacaacatatattgactgatatagctgtatgtaaaatataattgtatctgtataaatagagttaagagttgtatatgaaatctaagcttatagaaaaagaaaaagttgtatacgaaattaaaatatacttttatatgaaccgtaaaggagtagggtggtccagaaaactatgaaatagaaccctaatgacgattaggtttgatttttagaatcccaataatataaataggagggatggcgagtgggccataaaggagtagggtcgtgatagttgataggacttttatagagtaaaaaagggaccgcaacgatgatcaggttcattttttaactaacaatgataatagggggagcgggcaggatcgggtcataaagatgtaaggtggccacatttgatgggatctctagaaactaaaaaacgaaatccgatgagacaataaactctaaaactctattgtccgatttttaaaggtcgcagggaagatgaatataagccgtggcgggctgagcaacaagtaaagggggtgtcagttgtgtgactttataaaactataaaattaaaaacccggtgatgataaagtttgattttgaaaatcctacaacaatgagatgatgatataataaattttataaaaatcatgtgtaaaaatttaaataattttttagagaaaaataaatatttttctatggatgctagccgcgcaattgcgcgggccaccctactagttatcttcaaagcatgagttttttatcaaataatagcaactcttcattgcagctcatgttgatttcaagtggtgcaagtaaaagagaaagtacaagtaggaggctattatttttctccaaaccagacagtttttcatcacaatttagaggcaacaccaaatacttccaaagaaaatattttttgtatcacgcacaatgcattacctacttatagaaatcaatggtctcaatattccattatgtttctcactatgggttcttgggttggtttatatgatctttaagttaggcttccaaacacaacactcctgctttgctactcttattgtatagcccaagtataatctttgcaacaggatacatgctggtggccggtctgagacagtcaacatataaagaagaaccatctttctacttgaaatttttcagtaggttcctagccagttcataaaaatggtctccttacagatgtgaccaaacactgtatcgaaaatacttttaccagtacctagtggatacataacatttttcatgaaaagtacaatggttataaagttattccaacagtataaaccatatcagcatagatacctgcaatgatgcgggtcttcacactgaacatgttccagcacattgtcactgctgtacccgcaacgagtttcttgcggggacaagacttccatgcttctagagcccgatctctcaaaatttcaactaaaaagaggaggaaatttagcctagcgccctgaacaattgacatatagcacggagaaggttaactcaatagaaacaagtaaatcatacctctcttatgaatttggcttgaatagcagctataaagctttgggagtgtaaagctggtgaaaaaccctgcaaagttccattaaacacaacaagcttcagcagagcagtcaccctaaacattgatattcttctttgtgtatacaatcgtacctgtggccagaagtctccatactgtaaccagactaccgtatttagcaccaaacagaagagcaggtaatacctaagattcggcaacaatagacttctgtattactcaggggaccgtttgtgtgccaaaagaatgtcatcaaattcggtacatgcttactttgagagtcatcgatggttcaccagagaagatcacttgtgcagttgatatcatggagtttgcaactggcaacacggctcgtgcagcacgaagcacatcatcttcagtcaatctgaagctccttcccctctctacctgctgcctgctgcagatgagaactcagattgattgccttgattgaaatgggtttacaaacagattgccactggctcatactgtcatacctctgaggaatggaatctttgaagaaggctaagcccaagaccatcacacccaagtgacaaagcgccgagattgggctgcagatcatcacccgaaagccgaaactcagtaacagtacatgatcaaaagaacgaaatgaactgcaaagcaggaaatccaggtagaaggggatcagattgcgcaaacctgaaggtgatctcccttgaaaaggagcaggagaagaagaacatggatcccaacccaaaccagagtgccgatttcgccacattcttccacatcaccaagtcgacgatcctttcccagagatcttcccacccagactgctcgagggcatcagcacctgcgccacaaatcgagatccgattagacacgaactcgaggaggcaattccccatacacaacgagagcaagagcaaaagagagcatctggagcagtgattttctcgaggcaaaaattagccccaaaccaataagaaccaacaagagatggcttcgctaacctcgtatcgcatcggtgctagccagcaccaacgccatgctcgtatcctccttatccgccgccgccgttgccaccttgtccgcggccgcaggcgcggccttggtcgccgccgcccgggtggacttcctcctgcgtgccctccgcgcggcgtcgtcctccacctcgatctccttctccagcctccgcctcgccctccgcccgttcctcggcgacgccaccgcgggcgccgcgcactgctccgcggccacgcgccgcctccgcctcggcggcgtccccgccgccggcgccgccaccatctccaggctctcgtccaacccagccccgcgatgccgcgaccagttgcggcgcgccgacccgggcggcggggacatcaggaggagctcctgcagcgagcaccccgacagctgcagcggcgacggcatgggcgacgacctctgcgcccccgcccccgccgcggacttccgcggcggcgtcgcgacctcctccaccgccgcagcagcagcagcagaaggggagtggtggtacggcggcgcggggagcctcgcgggcggcgccggcgacgaggcgtggtcgtggtcgtggtccatggccatggccgccatgtgttcgtcgatttgcctcgccgcgtgctttggtcggcgttggatttggaaggtgtatttggcgtattggagaaggttgggttggggtttaaggaggtgggaaagcgagagcgggtgggggagatttttatggggcccacgtgtcagtgtgcgtacgtgcgggaatatagccgttggggaaacgggacacggccacacggcaagcggtggtgcttttccaggtgtcagaatgaattgcggtgatgtggatgacaggtggggtcatgtggaggactgaggagtgggtccggcaagtcggtgagggggagtttgaaccgtttcggagggtggaagggtggttggtgaggaactgatgaggatcgttaactcacactctcacagtgtggagtggttgaaggaaataaagctcgatagaggaattaagaatggtactactaggcctcctttttattagcatatttttcactctgttaaactgtgcatttcatacagtgcatttcatacgtaaatttatatagaaattactataaaatattatataaatatgttttcaagattaaaaaaatttaaatttaattaattaatcatgtgttgattgtatttttgttttatgcacccatacttaatcttcatttttagcactatcgaatagcctaaattctcaattcgttttcccatttgctatttagcctcacatcgttttgctctatggctaataaggcgtaaattaagcaaggcaattataaataatttatgagtaaaacttacatatttatatttgtatgatttataagagctaatgttaaaaacaaactacactaaaacttaaaatcaagtttaaaatttaaatttggcaatagctgatagaccaataaacaaatgacataggtgtcaaataaagttgattgccgatgtctattatacattaagtgaaatgtttgttttagagcaggtatagtagttagtgaaggaataagttcaccagaggtcactcaatataacagcgagagtttttttgaggtcccttaactacaaaatcaaaaatgttcacttctaaactcactcaaaccgtgcaagggagatcccatggcagtatttatgtccggttttactgacgtgtcattctagttagaaaaattaaaaaaataaatatacagggcccacatgtaagcgatggtgtaggccccataactctcctttcttgcttttccttttctcttctcttctctccttctctctagcaggcacggcggcagactcggcgtgaggcggccggcatcgaagcaggggcggcggtagcgggagagggggagagacggccggcgcgatggcgagctcggcggcggagagtagcggcgcgcggcgcggcggcgagggagaggagcggcaggagaggggtcgccgtcggtagcagctggccgcggcgcagcgcgccttctgcctgccgctcacggggcacgtccttgccgccgcggggaccgggaacaccacgcggaggcaggtgctgcaggcgctcggctgcggcaggggcagcgcggccgacgtggccaacgtgggggctgcggctggcggcgtccgtggcggggagcgccgcgggcgacgagatggccgtccgcgccgcgtccgacggcggcgccgtgcgcgtgtagaaccgggtgatggaggagtggcgccgtgcgctcttcgtcgccgcgcgggagaggcccggcaggcgcgacggcggcgtggctgtcttctccgcgctcaccggcgacctgcgccatcgtttccgcgtcgcgcacgaccgtcacgtcaggtccttcacccccggggcgctcgccttcgacaaccggtgcaaggcgacaaccggtcctggtcggcctcgagcagctgcgcgacctctcgacgcatctaccgcacctgtacctccttgcggttcctcagcagcttgatccgcgccagcgccatccgcagcgccgtcttgctgcggcatccacgagacaaaaaagaaaagaaaagaaacactgttagcccttgcaagcacgcgccgtctccgcgcacacaaacgcgcgcggagagttagcgaggacgagatgatcttgggcaggcaggcaggcaggcgggcaaactgaccacttgtcgggcttgaagcccatgtgcaagacgccggacagcttcaccttgctcctgtgcatctccgcgcgctcggtgacgccgacaagctccagtggctcgacggcacgggcacgctcatggcggcgaccatgttcccacggacagactccttcgtcagcctgctgttcatgcgaaaaacacatactagtatgagagatctgcttaactctagtgcaggtcctaaatcttgctttcgggttcaaaaacgtgccagttgatttgattctgcaatcaacaagaaagaaaaacaagaaaacaaggttaaatcaataaacgatagccaatcggctaaaggctgatgacatatcgttaattattgagccaacgttattggcattagatcggcaatgaagaattaaacaaaataaagttaaatctgctcgatcggctgtagatatcaataatatataatctacttctagaagtatatttaagccaaatgattgggatagatcggacagcaagccgagacagtataaatcacttatgcttaaaagtactttaagacgaagatcatatatatatttataacatagccgatgaaacagatttaacacgtatcgactagtactccaataccactctatattaggatattaaaagcagatagactataccagacaataggcctaatatattttaatgcaataaaatcttaatataaagggcagatttagcatattgagtagtcatgtagagagcaaagtagctaaatcaggtaagatcggctgaaactccgatactatctctattgataattataaaacaagttagaattatagctatagatattacttagtaggtcgaactcgatgcagcattaagcatagggacaaatataatatctacacaagttgatgaaaacctctgcgagatggtaaatatcaatgttgctgtctaaccccatcagcggccttctaaccgtagatgttaaccgatttagtgttagacaacgatattgatagaaattatatagcatatacgataactcgacgatttacataaccaagattagagtgtcataaagatgtaagcactaatcccaagaacgcaagccgccatgacaagttttacctcttgttgaagatcgaaatcgatgcagctcaacccaaaagcaagaactcgttgaaacaataaaaataaaaaagggtggcgatacaccgaaagtgttattgaactgtcattgttaattacatgggatcgggttatatttatacccgagatatatgacagttccttgccggacacgactcttatctccaacaaaatttaagatacgaacaaattgtaggatcgagatgtcgactagaggggagtgaataggcgattttaaaactaaatggcacctaatcaaaactaacctaagttgctaggcttggtgagggttaagtctaactaagcaactaagttatgttttgcaaacctagggtgatagtggctcaattaattctctaggaaagtaaatcacactcctatgtcaaagttttgcaatcctagggtgatatgatctcaagtatgtctttaggaatataaattacacaaatataaatgcgacaatcaaataagacaaggagacaagagatccctccacaaattggttgttgttctaatttaaacgaaggcccggtttagatggcaaaaatttttgttttggggtgttacatcggatatacggacacatatatttgaagtattaaatgttgcctaataacaaaacaaattacagattccgccagtaaaccgcgagatgaatttattaagcctaattaatccgtcattagcaaatatttactgtaacaccacattgttaaatcatggcgcaattaggcttaaaagattcgtctcgcaatttacacgcaaactgtgtaattgatttttttctacatttaatactccatgcatgtgtccaaatattcaatgtgatgggtgaaaagtatttgttttggaaacaaaacagggtcgaagtttcagcttgtttctagtttccacttaggcctagttttttttctcaactccaaacttcaaatttataatagttaatttataatagtatatttaacatatactctactgctatatagttaaatattagaatgtttaatcatcaaccactataaattcatatagtttaacaccataaaatttttattttttccactatgataaatacttttataatatataatccacatcttgttaaattatagggatatccaaaaattaagagtaaatttcacaaaaactaaatgtacttttaccaaactatcacaaaactacaaatttaagatgaaatatcataaaaatataggtttaggaataaaatgatgacaaattacatgttctgcatgactacaccaagttaagtacaaaactacaatatttataactctaacataatagcagtgacatgaattcaactgtaaaatatacagttttgtaataacttgagtattaaatctacagttttatgatacttggccttatatatgtagttttatgataaatcttgtgttaaatatgtagttttacgatattttgatctaagtacttatagttttttgtgaaatttactcaaaaactaacttctaaagatagacacaatgaaaaaaaaacccataagtaactaatttgaattggtttgctcaaatcagatgcacatgcgcacacacccatttagtcctacacaaatgtgtcgtatacaggctgacgtattcaaatcaactgtaaccaagaatgacttacagttatagattacagcatttcccgacaattaatacattacaaatacaagataggtttgagttcacctgccggaagaatacgatatacatgtttgacaaggtaaatgatcatcttggtcacagcaacagattattaagaacaacatttgggtgccccaacgcgtagttgccgatgcaccacaataatgaaatatctcaacacctttgtgcttaggtttccagtttgccatgcctctggcagaaagattttatcctttcaaaggcatccacaagagatggtatatcgatggcgaaagtgatgcgaacccaattcttcaatcctaatgcactccctgtaaaatatttttttttctcctgagaaatactcatgtgcattggggcagaattgagtagccaagaacaagaaaaggcgtgccatctggacaaattaaactccttttcacgctgtgtcttatcttaacctttattttcggtaatacgcaaaaggtttgtgtatcgttgcattaagagaaataaagttcagtacaaataaatacaacagaggtaaatgttagcctaattcttgcaagtttcttaacctttatttgtgttgcctttccatgtaaggttgtagaatatacctactagtgtactacacattatcattaggaaattggtgaatggtgaaattgcattctaactaacattgtttagtatacttacactatatgttaaagcaatgacaaaatggctgagatataataggaaggcatgccatatgataatcaagttcaagacaatgtttgaaacgcaaaggctgctatgaaaaaaaaaacaatgcaactgtgtctcgcaatgtaccatgatgtctctgtcataataatgacagaagcataatgaaactaatcagatgctgaattcgttgagcatgagggatctattgtggagatggtgtatacactatgacctcattgacaacattgatgctacaattggtccagtgtattaacactagttggacataagattcttatcccacgaggacccgtcatatgtctgtagtataaaaataacgcgcacatagtggattttgatttatattgctaaatggaagtaataatggtcgtcctgtttttttaccatacaagaggttgaacatttatggaatttgtacctggcaaaactatcacagactcctcttttgccaacctgcagcagaagtccatatcatcatggaagccatccaagtaagagagatccaattttacctgaaaaataaaggatagacatgaattagatgatgattgagattaggatacaaaactgagccagttcatccagagcatgttagcctgtactttttcttaccatcacaaacattgatccctctggcttgtgtggacatgtaatgcccttgatgtcctttattttatcataacataaatccgctgcattccttaattgatcgagaattttgttgaagtaatcttcttttgtgttggctataatttgagggattgctccctgtgaataagaatattagaatgtaacacactttctgaaaaattatgttgccatgcatgtgcatgcttgttagagagtttgtgtccagaaaaagaggaatatgtctgtaaatcatattgccataaatgatggatgtgaaaataagaaaggcacatatacctgaacaaacgttgcaggatcagttgagatgttaatatagttctcaattgattggttaacctgtcatgaaacattttagataagaaatccaattgccagtgcaatataattattatcctttttttgtgaggaatataatgacaaaatatccccttcaaaatgtaattgaatgcacatgcagcaactaaaaagaaaaggaagggaaagatctgggtagcatacaaaaatactatcagccaccgcaaaatggtgcactaacacattattctagattctatgctaccaacgcaaattaaccaagtatttctaagaagaaattatcaggctagacaaatgtaaaaaacctagccaggtgtgcttatttgctaaactgttttggagcctggaatcaaagaggcatcaaattcatctgcacttctgcagtttacccttaggcagaatgtgcagctttgttaggcaaatttacgagcacaatacaacttcgcgaaccaatagtgaacctagtcatggatcaaaacaagatatgcattggatgttggaacacagatcgagagttaaccttggcttcctttaaaatgccatttggatcacatgttgctatccaaccaagtcgccaaccaggtacaagccatctttttgaaatagatcccaaggtgatcactgggacggtcttcccaaaaacaccaataggtataaaaggattattcccaaatgccaaatggtcatatacctcatcagcaattatcagcaaaccaagtttcctggcggtctcggcaatctgtttgttaaaagcacataaatggcaaattgcatcacacaacaaaatacccagtaccttacttgtccaagaaatatactcacttttgccaaatgatcatacgaatacacgcttccacaagggttactgggattgatcacgacaattgcaacagtgttctcatcagcaatagcttgcacaccctctaggtctacctcccagcctctctctggaatgagatcgaaatgtcgaacctctagattgctgaatgtagtccgtgattcatacaatggaaagccgggtttgggaagtaagatgttggatccgggctgagccaaaacagagatcatgacttcgatcgcttggacacatccggaggtcaggtaaatatcatttgccgaaagctcataaggaagatctcgagataggtattctgcaatagcactaaagtttaaacaagtaaatatgagagatacacaccattcaagattgaaatctttgggaaaatatcatgcagtattgacaagcaggaattttaaaaaactggtattgcaagtaagagaagctaaaatattttacagatgagcgcctgacttagtactttttttacaagaaatgcacagagaattcttttatttagttaagaacaatatgaccatcaccacaagaaaataagagagaaggatatgaacatgcattcctaagatggaaattgtactactatatggataagaaacaattagaacactgcagatccttttctttttcctttgaaattttctgaaatattgttccacactctaaacatgccgatttacattttgttagttatttagtgcaacaaaacatcaacaaattcccctttctttcctcatcaaaatgttaggagtcaaagcatatctacatccatagaaaagagataagaatgacaaaaatggaatcctattcctccatttgcttttagtaaaaatattattattataaaaaggaatcaaatttccagctccatattgaaccattctccattaaatttacctcgcaggtaaatttcaaagtttccagcttggaaggtttgaggccctgtttggtatcccagcaacttgtcaaaagtaccttttgtttttttcctattcttgaaatagcatctccctatgtactcgaatatttgtccaagtcaagaaagcaccggtaaggcaccagacaaaataaatgctcaatcggccagaaattgtttggtgccaggggaaccagggaatccggtgaatacactgtgatgccgggtttgaaaattccaaaataaatcatggatgtatcataaatttaatttgacagtcaccataaacattgaagaactgtttccttttctatttttttcttcttaccggaaacaagaggtgaaaaaaatatgtaattacaacttcgtcgtgcaaccagtatgtgaatgaggagtaccaaacatatcttccatggaaaaaagaattcaaactagaaccacaaaataattaaagagagaagaaaacaggaaccaaataacataagctaaaacatcaaagagttttctaacaaaagagctaaaacatcaaactacacatactttatgcagttaaatttgttgaaaatactaaaaaaaatccaagtatgcaaaatgttgcccataaaaatattcaaatctgtttttctgatcagtcacatactagaacataagcagagcacagtgtggcaagggggggggggggggggggggcancttaccggccccccaaaaggacccccacggttagggaatttccttttgtcccccctgaacggaaccccttaaacaacggtttcttagcgggcggccccgttgcgttaccaggcgtacgcggtggggtcgccgttgccaagccgcaggacggggcgcggcccgccggcggcggcggcgtcgacggaggagttgacgcggttgagcaccgcgcggatgctcgtgaggccggcggccgccaggggcccgccctgcgacgacggccgggagaagcgccaccgcggcgtggcctccgccccgtcgtccccgcggcgcttgccgccaccgacaccctccattgttagctcgatcggatgccgctcttcgagcggtttatccaaatttgttcgtttcgaaggtgaacaaaaatggaaatatattctccccatatatcggcggtgctgtaccctgtactgtactggctgtgcatcgtcacagatgtcacaataattatggtgatatagtatttttaataggaagaggtagaacatcacgtatcacgtgaacgatttgtttaacattattggttctaaaatatactccatctgttcaaaaaataagcaatttatattttgtatcggtactgcttgtccggttgttatatccagtatccacaactctcatttatttaaggcatggtttatattcaaacttttttctttaaactttcaactttttcatcacatcgaactttcctacacacataaactttcaatttttctgtcacattattctaatttcttcaaacttctaattttgacgtggaactaaacacagcctaactttttctcttattacaccaaccaccctcatactcagccatgcatttctaagttccaacgaaggctctgattagattccaattttcttctttaaatttctaactttttcgtcacatcgaactttcctacacacataaacttccaacttttctgtcacattgttccaatttcttcaaacttcctattttggcgtaaaactaaacacacctgaaatggagtagtatttcgtagtcctgtcttggtccacaaatgcatatactgtatgctctctttcgttccataatgtcatctagtgtccatagcattaaatacattgtcacataagtaaaaaattctactccctccttcccaaattgatcattatgtaatagaattcaaaatttctaaattaatcatcatacaactgcatggatacggatttcatcagaatataattaatgtagtatagtatgtgaaaatgtatgtatgctagggtgtaattggtatgggattttaattgatgcatgcattgtgggagaaatgtgtgcatggtgtctttattgatgcgatttaaattgtccttggtcttggtgcataaacttatatttgggaaggaggaagtatgtggcaagagagttaacgaggagatatgtaaaaagatgaagaaatcatttctcatgcaagaaactatctctacacaagaaccaataatgaaaataataaggggatagatagataaaaggagagagaagagaggtgattggatgagaatttaattgaacacaccatccattgaatacatagtttctacacagtgtctatatgatatggcaagtatagaaactacttcatagtttttggattatggatagcccaatgtacgagaccgttaattttttatcccaaaatatataaaatttagtataaatatataaaactaaaagttaagattatattttctttgatgataaaacaagtcagaaccaaataaatagtatttatatatttattttgaataaaacaaatgatcaaatattataaaacaattcaacacatcatacattttgagacggagggagtatgtacccaaactttaacaacacattatatgattgaaatatgttaaaagcttagtataactattttttttcaaaatatgataattgaagagttaattctagtgaaaattgaatcctatagaatacctcattctatggaagtcccaaccttatagaaagtttgatttgagtctttatcctttctaaaattgttgtgtttttttctacggtacaattaaacggttattctgtaatttttttcttttttaataatcttttttagtacttgcattcttataaaaattctgtgttttctttagttctctgttttaatcctatatctatacttcctataaagttataacccactaattctaaaacttaacatgcaaccatgccacatcatcatccactagcaataattatatattcaacctcatacaagcaatatcatctacaatctatttaattctacaaatcaacatgcgtccaaacatattcaatcatcatctctcacatcatttccataatatttttataaatatatgtatcatttttcggtagcgctattccgagcgctagagcgcggaatatatatatatatttgggaataggcgaggggcgcatctttgtattaagaaggaataaataaaaaacacgaaagggacaagattcaggaggggggaggaggaagaaaataaaagcctaatctcccaacgaatgtggcgaccttccacccgacataagggtcgccatggccggtatcgcggctctagccaaccgccaaaggtccgcttcgcccgtcatgtccatagcaatttccgcccatgtcctgctcttttggttgaagacctgattgtttctttttttccaaatcgtccacgccaccaaagttgcaatggtgtcgaaccctcgacgatgttccttggccattcttttgcgactgtcacacagccaggagtgaaaggaatgctcattgagaggcagacactcagaatgaccaatagctgaaagagcaatccaccatagctggaatattgttccgagcaccgcacatcacgcccagagtccgcaaaaactggtgtttgtttgcccacgttctatctgtctagattagttctatttaaatttggggtaaatcaattatagatccgtaaaatcggtggtcggttgaaaataattgttgtaattggtttatctctgtttccaatcaaggagctgaaagagcaatccaccatagctggaatattgttccaagcaccgcacaccacgcccagagtccgcaaaaactggtgtttgtttgcccacgttctatctgtctagattagttctatttaaatttggggtaaatcaattatagatccgtaaaatcggtggtcggttgaaaataatcgttgtaattggtttatctctgtttccaatcaaggtagttacgatatggtgtgcaacaaactgagaccaaatcttgtagtaatcgaattaacatcacgcccagagtccgcaaaaactggtgtttgtttgcccacgttctatctgtctagattagttctatttaaatttggggtaaatcaattatagatccgtaaaatcggtggtcggttgaaaataatcattgtaattggtttatctttgtttccaatcgaggtagttatgatatggtgtgtaacaaactgagaccaaatcttgtagtaatcgaattactgtcgatgtaaataaaaattgatggtgcatgtgcctgtagtaattagattaacgacaaccatgattagtgaaatcttgtagtaatcgagttactgtcgacataaatgaaaaatgatggtgcacgtgcttgtatgtaacgtctcgcctctcccagaccgggctcgcttacatctggccgctttcataggtcatagattgccatcacagaccaacacaagccttttctgcacactttgtcgagaccggcttccggaaaagaagttgcaacttattgatatgagtattctattaatcctattaagccctaggctgggatgtcacaccctcacccccttaagagagatcgacgcccctgtcgatcaacccaggccaggaacgtcccctcttggccacgtccatgtgtccaatgccagcgcatgtgccatgctgtgtgatcacagaccaacacaagcctttcctcttggccacgtccatgtgtccaatgccagcgcatgtgccatgctgtgtgaccactccgggtccacaccagccatgcataccatgccgctttcataggtcatagactgccatcacagaccaacacaagccttttctgcacactttgtcctcactcatgcgctttcataggtcatagactgccatcacagaccaacacaagccttttctgcacactttgtcctcactcatgcgcaatcaggaagaatttcctgatcggtcacccatcccgaaattgctccaagctaagcacgcttaacctcagagttctttcgagatcggcttccggaaaagaagttgcaacttgttgatatgagtattctatttatcctattaagccttaggctgggatgtcacattgtagtagttggattatgaacaagattggttgatcaaatcttgtagtattcgtattactgtcgatgtaaatgaaaattgatggtgcattaacttgtagtaattgcattattgctagccttggttgatgatttcttatagtgagtgcatcaataaggagggagttactggggcctaattagtttatcccaaataatacgtgaataaactttttacttattcattgaatcactccattcaaaatcacaggacaaaaaataaagattttacatgcacatcatagtaaaagcacaagaacaaaaattttacacacaaacacagcaatacacgcaatcgccagttccttgtgacggctgaatggagtttctgtccgggggggctaatgggcgatcgatcgccagggcgatcgcccagcgatcggatctgcccccctgcccctataggcctcccacttctccccttcctcatccccttcttctcttcctactacagtacaccacaaaaattttttaaagaaacaaaagttagaaaatttatgtatagaaatattatatataaaaaatttgaattcaaattcaaatttgaattcaaattcaaatttgaatcgggtatgtaaacttttgacttataaactttggatctataaactttaggtgtataaactttagatgtatagaaatactatatatagaaaatatttgaattcaaattcaaatttgaataggatataattcaaattcaaatttgaaacatgtatataaactttaggtctataaactttaggagtataaactttagatgtatagaaatactatatataaaaaaatatttgaattcaaattcaaatctgaattggatatataaacttttgacttataaacttttggtctctaaactttagatgtgtaaactttaggtgtataaactttagatgtataaatttactaaaataggaaagtaatgcggtgccaaaaaaggaaactaggtggaggggtggagggggggtgaatctgatcgccctgggcgagcgagggcgatcgctcacccagtagcatttccggtttctgtcctgctagagagagctagcaagaagacaaagcggcggagatgcaggctggagccaaggcagcaccaagtctagccgctgcgacctcggtaggagccggatccggcgacggagccaaagatggaggtcgttgttgctgttgtcaccgcctcactgtcataaactggggaatgacagaggtgatgaaacaaatcacagtttcttgccgatgttaccaaatcgattaaccatcacaaacaggatctccgccatgcaagggagaatagagaagcacgccaaaatgagtgctcaacccaatcgaagtcagactgcatacaatcaagaaggataaagaatttaattaatcatagattatatacaattcttgcaagaaataaagaatctcattaggaattgttgagagaactcaccgtcctcatgacgtccacctcgtttgccatgggccagacgtctcttcagcatcgatctgaagcagatgttgctgcagtgaggcctgaagcagtgccttcgcctcaagcgtcgccggccaccgttcaccggccaccgccatcaactgccacggtgtcgtcgtcctcctccatggtgcgtcgccgatctgtgggctgggatggtggatcgattgagatctggaaaaaaaggaaaaaaaatgaagtgggggcgagaggggttggttgggtacgggcaaaatagaatatataccagaagtagagaggttgtttttatcggagtaaatcatttactccgataatggtgggagcacgatgcgggacgtggggtgggatcgaaagggaagttgtttttattatcgaagtaaatcgtttactctgataacggtaggagtgggatgaagggacgtggggtgggatcgtaaccagggaagttgtttttatcaaagtaaatcgtttactccgataacggtgggagcgggatgatgaaatgtggggtgaggtgggcctggctgatacacgtttggcgcttggaatataggagcgtgcagtgctcccaatagtagttctaatcttttttataatatttaacataaacttatcaatatgttccacattgaagtgcgagattcatttgtttgttttatgctaaaaactgtaagacctgatatttcatttgttttccttttacccttggcttgattgtaaaaaaaaatatatattgaaaagtactaagtaatccccgtagcaagacgctgggaatcacttagttttaaaggaggcctaactgttatacaatgggatcggaatagtactatacaattaaaattttggagtctaatttacttaatcacttaatttttctcctaaacatgatcatcgatctggtgcttaatgcaaaattttgatataactgaccttcttgtgaagccattgaagccgttcaatcggttttgcttgttgttcttcctttctcttttcttattcttcgtctactttgcttgttgttgttattcctttctcttttcttattcttattctttgtctgctttgaatagcatcttagccggggcagagatgtcggcttctctgttgacaaaaagaaaacttgtagagatcacctcatgaaccccttctagcatcgagtcgatcgggcgacttagggtgtgttcggctgtccaactgagtggttgtgcagtgctgctgctgcaataattatggtagaaattgtatgtttgctactgtggttgttggctgccatcctgtcacaccaaacaggcccttaaattagtgttttaaaatcaagacttctggtgtcttcaggagcggcgcggtgcacccgtcatcgtcggtgcatcccttgtcaaagccttccatccattttccgatcatcgttgtttgcttcctctcctactgcctcacatctgccgctgctgctatgtagccactcccgctttccgcggcctcaggacgctggcatgcttcaatgcctcgcaagggaacgaggcaaccgatcatgctgggatatcgggagttcgggactagggattggcctccggtagcccgacaagtgccttatccagtccctctcactcttctctgcgtagcgtgagtgctggagaaaacatgggaaacagtagcagcatgcatgggtagcttttgaatgtggatttggataaatatctatatctatactaatataaaaagaagttgcccccctccaatgctacaggccaaatcatcccccaatcatctttgtcctcagccgtccgatctgttgatccaacagcgaaatcaccgattccgccatcccaccaccacacaaatccaccgcgctatctacgcccccacgctctccccgcgcgatgactccgccgccgcgcctcctcgcgctgctcagatgcgcgctgcgcctcccgacgcttcctccctccaggccgccgtcgtcatcgcgcggtcccgacccctccagtatcccccccatcccgcctcctcctccaccgcgtcgccgatggttccatgtcgtcgtcgtcgtcgcgcggtcccggccagctgtccaccgcgccgtcacagatccagccatccctcataccggactcccccatcccgacggccccatcccagcggcgaggaggcgccgtcgcgcgggagatgactggtggggagagtgaagagggagaggcggatggcaaccatccctctgtcacgctcgctctccaatcccccttcacagtcgagccctgcgtcgtcgccttcccccgccgatgccaccacatcaaggcacctcacgcatggagctctttccccgaagccggatgcaatggccggtccctcgctaaggcgcccagcagatccggccagttgcctcagcaacagagagtccacggacctctccgctgctctgtaagaggatctggactcttctgccaacgaggccactgtctgatccaccatcgtaggggattctttccgttccctaaatgcaccacatatcttcccctccggaaattatttttttcaaatgaaattgatagaataccaatggctgttgtaacaaggtaatttgccctcaacctttagcttttcaaattagaatcaatttaattacttctttgtttacgcgcatcattttaccctaaagactgatgcttgcactgatgtaccatgttgtcatgggggatgatctagacgtgaggactgacaagccatctcttgatatgtttcttgctgagatgaggaggttcgaggtattgccatgtaagtgctctcacctataatgttctttatactaaacacaatattataattttacctggcacaagtgcattgcatgttgttcgggtcaatttggaaccagtatttcaagctccttcttctgtagcagcagttaaaaattgctggaatgtgacttcgctcctcctcgctcctgtgtactgccgccacgccgccgcatcctcgccggagccactttcttctccatccaccgccggagccgaggtccatcttacagtttaattcctcactgaatgttgactatccctgccaatccatcacacgattccctctgaatgctaatccattcaattaatttcctgcactggtaatatctctcccatagtggggaatcatgtgtcttttgtacaaattacataggttattaaactggattctccatttcactttagaagttgattttcttgctttcttggctatatttcctgtcatcacatcttacatttacaagtaggaacgaaatgatggccgactaccttcttgatcactgcgatgtgccccttcgcttcaaggatatgcataaatccaaggtgattctcatcttccaaatctttatctcgatatttcccctaggaataaaagattccaaacccatattcacctatttacagtgagcattaggatcattttatagaaaaagatatcgaggtgatctagaagttattatacattaggtctgctgcttcattataatagatcatatgtgtatttctgaatatatcttctttgtttggtttttcccagtccggcactctgctactattctaggtaccggactacaacctgtaatattattttgcggtgtactgattgggtggttagatttcaaaagcaatttcaaattatctgtcctgtccaataactattgccagattacccaggtgccatgtacaatactatttttttttaaaaaaaagtggcactgaggaagtttgagaaccagtatgtactcctaccaatgaatatcacatcatggtgtttcaggttttgtttaagtttggaaagaaaatatacataatttgtggcaaataatgttcagatttgcagattaacatgctaccaaggtcaaaactgtatgtaatacatgcaagtgtcagattttttttgttcccctactttactaaaactgtaaattaggtttataacgtgtttctgatatataacaataagagaaatcatgatatcaaaaagtatctgttaatgctataaggcatctgaatatattggcttacttctattgtttataatacaggttgacattgtggccaactggagattttggtaaaatcctatcatgtttcaccatggcatttcactgtttggcgcacggtatttaggagctatttgtatagtaaatgctggagtattgaagtaaattatatgttcagcttattaactgcattgcgataagctttgatctagatccggtttcaattttcatttgtgtggtcgcatcctttaatttatatagcttcataagagtatactccgaagtacatgccgttttatgtatttttatgccttcatattctgattgtctaatggctctaaaacaacagacgggtggcctcatcaggcgaattgctccctatgcaacctgacatttcaagatgacacccaacctttttgttcaatgtgctttcacaaacaggatttggagattgctcaggagctaggtgaatgttggctttccgcttcccagtgacctcaatgtagacttggctgattggcagatggcttcaaggagaagcttcagagattatctcagaaaagtttttggtacactcttcttcttcagagattgtctcagcaagttgtatggttgtgcagctctttggtgacatcaaagaagaaatcacaatctggagggaggcaggcttcatggtaggcgaaaaacgattggcattattccttttgtagttttttctctcccgctctttgtaaccggttttgacaacttcgtgtggacgcttagtttgtaacaccatctcataatcttaatgaatttgcttagcctactcttgggccagtctggctaaaataaatgtaatcagagttacactttatttgttggaaacataacttgtaaaataaaactaatcatttttatcctaacaaaaggctgctcaatgctgcaataatttctgttgaaaaaggaagtggcaaaacaacatgtcttttgctactttgttctgtctgtttttcttgaagaattctctaattttattgtgattagtcttttgaaaaggctatattaaagaatttcttattttgttttggttctttctatatgcacaaattaatagctctataaattcaatagttgaagagaagcaatgttcagaaaagttgaatatgcacttgatatatatgtgttaataaattacctttcaaagtatgtgtactttctaatttttaaatgtgactatatattttcttgatatatattatgacaaacgtgctttgcacgtgcatgataactagtaagcacgaatcttaaagataaatcttatggccttgcagcaagtcactttattcgaaaatcaacgggatgaaataacttgactctcatggcatcgggaagctactcagctaagtcggcgtacatgatgcaatttgagggcacaaaggcgaagcctttcaagcgcattgtttgggaaccttgggcaccgcccaaatgtaagttctttgcatggctaatactgcaaaacgaagtatggagagcagatagacttcaaaggcgtggcatggcaaaccagccgctatgccctctgtgtgggacaacgctggaaacgtcgttacacctcctagcaaagtgacggctttccatcaggatttggaaggaaatggagcgctagacatgctatgatctgcatctataggattggcaagagtatgacacagcggtgcagtggtgggagggattcgtttcaattcctggaataccgaagaagcccctaaaaacgttgatcatcatggtttcatggatactatcgaacgaaaaaaacgcaaggatcttccggaatacggcgcaaacgcccacagctctgatccaggccatcaaagatggagctgcactttggtatagggcaggcgcccgatgcctaactgagtttgtaccgtcgggagagtaagccttttccctttcctttttgtgcactatcactttctttaagcaagccttgtacataaaggtgggagggattcgtttcaattcctagaataccgaagaagcccctaaaaacgttgatcatcatggtttcatggatactatagatcgaacgaaagaaacgcaaggatcttccggaatatgacgcaaacgcccacagctctgatccaggccatcaaagatggagctgcgtatagggcaggcgctcgatgcctgactgagtttgtaccgtcgggagagtaagccttctccctttcctttttgccggctgtcactttctttaagcaacccttgtacataaattgaggccatgccctcctctattaatacataaggcaaagtctcttgcctttccttcagaagaaaaagaaaaatctggttgacaaatcaaaataaaacaaccgacggttgtgcagcaagtccattttttttaattacgattgggtttttctttactaattaaacttactttcccatgaatttcattgaagttcacatagaagtttcagtgttggattttatagtccagaactttttcttgaaaaaaaaaattgtagccgtaaagcatttaaaaaaataagcccgaaaataatactagaaaagaaagaatataaatgcaaaaatgccaagcacatgttgtcatgtgcccttccaagcagactatcctgtatataccatataacaatacaaggattgtttgctaaccacccatatcaggtggtgccccgtatccgtggagggcaccttataacgacgtaataaacttgcaatgctaacgatatggtacaaatcagattataccgggaccacaatatgtttaccgctaactccgtatccaaatttgggcctgcacagggttgtcggcccactagaagctacctccgtatgcaaaggcccaccgagaggaagcgagatggcggagatccgatggtcagcacggtggacgcgtcatcatcatcagaaatttggtgccccaagctgaacacagtgtccaaaaaaatgttgactatctggactgatcaactggcaacaaagtttatcacaaatatatatatgcatgagccatattcatatgaaaaatgcaatgcctcgtgaacttaaatttgatttcgaatatataataactaataagatacacaagttcctcgattgaggaatttgacgacataatgtgtgctgatttaagtgtccaacttgattcaactttattctcacatgatgccggttctacacatccatgagtacggatgctgaaagcctgaaactattcacgagctagctggcttccttgattttaccatgcctcttgcagaaacacttggttctctctagaccatcctctagtaattgtggatcaaccgcgaaggttatccggagccaattcttcatccctaatccactccctgcagtgaattacatttacactgttttattcatcttccattatctgaaaatacatactagtcgcggcaaaattcagacagagtaaaatggtcaggtcattcctgacactgaaatgcgttcagtgacagaaacacaaccatcagatgatctacagaaacatatccataatttaccaaaaccagtaaattaaactgatgttctaattactgtaattacctgggcagatgaccacggattcctccttggccagcttgctgcagaagtcgacgtcgtcctctatgccatctagggaagacaggtccagcttcgccatgacgaacatggagccctccggcttgtgagggcaggtgatgcagtcgatctccttgagcttctcgtagcatatctccgccgccttcttcaccaccccaagggcattggtgaagaacgcatcgtccgtcttcgcgaggatgtcgggcaatgctccctgctcgatcgatcatttccatggcgtcatcgtcacagctaattaattgatcttcagagaagcgaagatgcgcgacaactgaatttggatgtgtactgacctgaacaaatgttacgggatctaccgagatggctcggtagtcaatgactgagtcgatgatctgtggagacagagaaatgatccatgaggtagttgatcaagtttttcaaatcaattgcattttggtcagtgttttaaatagcgggctaagatatttagtggttgaacttctcaagcagctataggtaggttctatttgtgggttggggggggggggggagcaactagtgagaatctgaagaagctcctagcttctggattctttaactatagcttctcgatcagaatctgagtaaaaatatgtattttttaggagcttctggtagctagagattttaggagaagctgtagctgccaaaagctctcccaaacaatagtggactaaatgaggctatagtagctaaattgtatatgagagtaaatagctactccctccgttttaggttataagacgttttgattttggtcaaagtcaaactgctttaagtgtgactaagtttgaagaaaaaaataataacatttttagcccaagataaatttattatgaaaatatattcaattattgatttaatgaaactaatttggtattataaatattactatatttgtctataagtttagtcaaactttaaatagtttaactttgaccaaagtcaaatcgtcttataatctgaaacggagggagtagatccttctcaaacagttataaccagggatttagggcatgtttggttggttatttaagcgccctcaacttaacaagtgtggcggacgatttaagcgccacacattcaatgaagaaacatgcggtagagtagttcatcgctgttgaattttgtgcggtagtctcaggtgcaataaacaaacaaacagtgggctaactatctgtggcacgcctaacttgaagtgcggcaagaggaggcaaccatccaattaacaggcccttaaaaccatgattctggctaattgagaaatttagacagcaagcaaattaagcaccttcttgttcctgaggattccgttgggatcggtggcggcgatccagccgaggcgccagccgggcaccatccaccgcttggagatgccgcccagcgtcatcaccggcgccacgtcgccgaacacccccatcggcacgaacggcttgctcccgaacgcgaagtggtcgtacacctcgtcgctgatcaccattatccccagcttcctcgccgtctctgcgatctagtacgtacagatattaatccggttatgtattacgatttgtcatcatcgccgatccgaattgatttgatcagatgtattaatcaatcaaaaccttggcgaggtggtcgcgggagtagacgcagccgcaggggttgttggggttgacgatgaccatggcgacggtgttggcgtcggcgagggcctcgacgccggcgaggtcgacctcccactcgctgtcggggaggaggtcgaagtggcggaactcgaggccgctcagggcggcgcgcgacgcgtacagcgggtagccgggccgcgggagcagcacgttggcgcccggcgacgcgagcacggacatcatgatctcgacggcgtggttgcagccggcggtgagcaccacgtccgccggcgagacggcgtaggggagctcccgcgacaggtgcgccgccaccgcgctgcacatattcaatcaaagctagccatgaggacgatatcgacttctctttagagttcaaaccaatttcatctcttcctgtcacgaaagaatttcttgaaccgaaactcaaaaaacaaacaaatatttgcccttataatatgagatgcaggtaacggatatttctccttttcaaggcagccacaaaattgagcccataaccgtcggtactaattcatgaaatatattctattagtatgagatttatgcgtttgaaaatcaccttatagtatgtagacaaagtgctaattcctaccgaaatatattctattacttctgaaattggaaggtgacctggaaaaattcttaaaaatcatgaatttcagatgcctttgttacgatgccagtctaaaaagaaaatctcaaaatcccctcaatccgcacatggttatctgaaaattagtggggtggcatgaagtcggcatcgcatcatcgctcagatcggaaatcaaatcagaagctagcatctctggagtcttgacactgaaatactactatttctggactgattgattggaatctcattagttaattaccgactgatcgatcactagtcaccacgccctatatcttttattgccagtggctggtcaatgggaaataattgaagagtcttatttatgttattttttgtccgcatattgatttgatagtactatttgtagttgagcattttctaggttgtccacagggctatgttactactctgcagctgtgttcttgggtgagcgttggaaaccctcacctcccgcacagaaaacagcgcaatggatttgtgcacgataaattaagtattagctaaaaaaatattaaaaaatgggttagtatgctttttaaaagcgactttcctatagaattttttttaaaaaattacaccatttaataatttaagaagcatgcgcgtggaaaaaaaatagaggatgggaacaagcagcgccgaacagtgtagacagtttgagaaggggtagagaatattagaaagatactgtatgattaattgagtattaattattttagatttcaaaaatagattaatgtgtttatttaaagcaactttcctagagaaaatttttataaaaaacacaccgtttagtagttcgggaagtgtgcacgcggtaaacaagagaaatcttctctctattaccggctgccgaacgcaggtgcctgtacatcactgttttaaaaataataatatagccaactacttactatatagatatttatagtttatctctcagcttactcatatagtgattaacttttcactataaatatatggcccacctatctttcccacatattttattggttcctttgcctaagctggctgtaaaattacagcccgcttctcatctctctcctctcctctctcatccacttcagcattcagttttcttatagcgctctataagaaaacgatttgtgtcagagctttgttcttgtcttagggtgcttttatattccctacatttcgcttatacaacttcattgtttggtgctttcttttattctatacgtttttcgaaaactttttatattgatgtttctttttagaaaaatcaaataaacatatttttaagtttgtaatagttaatactcaattaatcatgcatcaaaagtttatcttgttttgtgcgtcgtcataaagctaagttgaacctcacatttgaactaggccttaattgaagatactctatttatttcatattataagacgttttagcctctcttttttttttgtctaaactaacattcatatgaatttagggcctgtttactttgatgccaaaaaaaaccttaccaaattaatgccaaaattttggtatagttgacaaaattttggtaagaatttcttatatagttaccaaaatttggcagcaaactaaatgtagctattttttttgacaacttcatcaaaatttggtaaggttgaaaatggcatcaaagtgaacaggcccttagaaatatatctgaagcacataaatagatccatggatgattgtatttaaaactaaaatggcttacaatgtgaaatagagaaagtacttatttgcacatggaggataattagcacttcatgttccagttggaatgattcaagaggagatagaaagataggtatagagaggtagtttgagttgttggaatgtttttatttagagaataaaatacactcctaaaatcaggctgattgagtagtgacttctttagtctaaaatattatcttctgatgaaaaccatagaaaagattgatttcattgaagaaatattatcgtatataaaattatatgatatgcgattttttctataataaattaaatcaaacattaattatgtagctagctagtgtctactcctctgtcataaaatttagctatttctctttttttttcatgtgattaattgagttcggccttgaaattctgtaaaaatatatgtacaatgtaccctatgctaaagtgtgtgctaatttatatatataaatttgaatatttggccaaaattcaccacgcgtattcacatttttcacacgatatttcatccaagaaaaacgtatgatctgtcatccacttttgcacgcgacgacgtacctgcacgccggggcgattcctacggcgggggagtagtagttgtacttgccggaggcggcagcggcggcgacggcgtccgtggcggcgggcgcggcgcggaagcacgcgaacgcggaggggtcgccgtgggcgagtggcgccacgggccgcgcgtcgccgctcccgtcgaggcagcggtaaatccgtgtcacggccgcgcggatgctctgcgaccccgccaccgccagcgccggttcgccgcgccgaaccgccaccccgccgtctcgcctttgccgccggcgccgccgctctccatggtggtggagcagagcaggggagaagaccagaagagggtggtgtgcgtacagcgcgtgtcacaatctgtttcaattctttgtagtttttgtaagtagggatcaaatttgacccatattgnnnnnnnnnnnnnnnnnnnnnnnnnnnnnnaatcttgttgggggcgatcatgtccttgatcaatttaataatacactacttgtcaattaactgattctatgattaacttatggtgttagagcatattcttcagcacaaaatttacatgggcaatgctccgagtgctggtatgaccatgatgcttcagattgacgtgtcatgtgtgccaacgtgccattaacacaagcaatgtgtattttttaaaggtaatgtattctaaaattacatttagcctctacgtctaaacacgtgcatagagaaaagaaacaagaaaattaagacgatacgaacgtatcgacctgcattacaataatgtcattttaagggaagtggagagtttcatttcacggttaccaagagtgtcatgtcatctaatgagatttgaattgatgaatgaaataagatctctaacatagaatttcattttgcaatttcgtaggttcatcataacatttaatagcaatacatgggattggatgagattaaactttttatctctctttataattatattgtcatgtcaccaaatctgctaatatggtactccctccgtttcaagttataagacgttttaactttgatcaaagtcaaactgcttaaactttgatcaagtttataggaaaaagtaataacattttcaactcaagacaaatttattatgaaaatatatttaattattgatttgacgaaactaatttagtattattaatattactatatttgtctgcaaacttagtcaaatttaaaatagtttaactttgaccaaagtcaaaacgtattgtaacctgaaacggaaggagtatgctatttattgagaatagaactcctgtatgaaactactattgggattggcctaagttgctatcttataacaccttttagaacgaactgtcattaaccaacctaactattagtgcgttatttttctccacacatttttatcacctactccctccataaaacaaataaaataaattcaaatcctggttatgaaactggataagtatttgttcaggttcatagcgaggatttaattcttcctgtgatggaaggtataatttattatatttttgttacagtgattttcggagattcgtttcactcaatgttaatcaacattgagtggtagtacgaactaagcactggaaccttccgttttagcaagttccagtggtaacttatcaaatctgataatagaagcagtgatatgcaatttctcttagaatatctggttctccaaacaacctagattcttacccaatctctaagaatctatagttatataaaaaataaactagaaatcagaaactgtattgctaccaaccaactacatcttagaatcttaacctattccaaataaaaccgtagattaaaaagggcacaacaaaccaacaatttgatagaagcatggctatgtgttaattaacaagagcatggcaaaccaacaatttaaaccaagtatttgcagggataagaattgttaagtggcaaccgagcaagagcatggcaaaccaaccatttgaactaagtgcttcagtgatagggaaggggaaatgtaatgctcattatccaagcaaattttactgaaacacgactccaatacaacggtcttgctttcgtattcgttacgcgtaaaattttcgagttcgacttctaaacagttttagttcgtaccactagtacagaaaagatttttccatacaggcattttgatttctctgtgcggttatccggcaccctgtagccggctgtctgcgaaaattaatattttcgcgtgcgggtgggtcgaccgcacgggataatcgattatcccatacggttgtgttatactgcccgcacggaccaaaaaaaccaaaaataaaaaacaaaaggaaaaatcgctcgagcgccaccgcctcgctccaaaaaaaccaaaaataaaaaaaggaaaaatcgctcgagcgccaccgcctcgccgctccccgccgcgcccggccaccccggcgttgccggccgagttgccgtcgtcctcctccgcttcgccttcctcctcgaccaccgtgactagcttggcaccgagcgtggccatgccggacaggaaagacgccaccgacaggaaagacgccaccgagccggtggagcgtctgatggtggtggtggccgcggcttggtggagaacgtagttggcgacgagcggggtgggagcgttgaggagccccaggccgccgccgcgcccggccgccgccgcctcggcctggccgccgctgttacgctcggcagccgtctcgcccaggatgccgccgcgcccaggccaccgcctcgcctagccgccaccttggcccggctgcctcgcccagccgccgccgtcgcgcccggcccccgcctcgcccaggggagggggaggaggaggggaatctggccggggaggagggtgggaagccgaccggttgaggggttgagaagaggttgagaagagataaggtagagagagagaggtgggagccggttgagaagagataaggtagagagccggttaggtgggagtggttgagggagaataaaagggaaaaaggaggagagagataggaaaaaattgaagtgggtgagagggaaaggagggaggaatatcccgtgcggttgggataggacgtccgcacgggaaaatcgatttttcccatgcggacgacaccccagcgccggttccctatttttccgtgtggttccacttacagaccgcatggaaaaaaaagggggggcgtccaggaaaatcaatcgtgtagtagtgtactaacaaattagataaattatgctataggtcatcgtgactttatggttttagctatagggcaccacgcggagtgactttggggaagatactcttaaaagttagatattcgctggtagacaccgcacccattaaaataataatttttagtttaagagaagagagaaatcacgtgaaaactctgaaatgcccttgggcccatatgtcagatctgtaatctctctatctctatctctttctcatgtgcctctatctctttctcaagcacacgcgcatgagaagaggaagaagaaggggaaaacgaggcctcgtgtgcttgagaaagagatgatatagagagattacaaatctgacatgcgggcccaagagcatttcagaactttcacgcgatttccctctactctttaacgggaaattattattttaataggtgcagtgtccaccggtaaatatccaacttttgagagtgctcccccaaaagtcacttcgcgcgttgtcctatagctaaaaccacaaagtcacgatgtactgtagcaaaatttgccaacaaattaataaggtgatacgatactttgctactggttcttgcttggttgctatgtaccatttttgtgaaaatagtcaacttttaacttccttaaatatatttttgatctgtatatttttgatctggtttatatcttagatggtgtttagtaaggctccaattcctggatttaactcaagagctgagaataaagtggagttatgaagcaacctaaacacaactccacttctttaatttattttgcaagagcacttcaaccaactatacttttattttgggtggagatgaaactgtttggctggactccaactccaaaaaaccagatataacgactattctaacttttaaaaccggtgcaaaccggatataacgacaaggaataagttcactggaggtcccttaatttaacagcgagattttttaaggccccttaaccacaaaaccagaaatcttcacccctaaactatacaaaaccgttcatcggaggtccctcggcagtatttttgcccggttttactaacgtggcatcctagtcagcaatttttttttaaaagtacttgggcccacatgtcagctgcatattctcttttctcttctcttctttggagaggcgggcagatgcgggtgcggcgaccggcggcggtgcgggcgtggcggggcgtgggaaagaagcaggagaagaggagaggaggcgggcccggagcgggcgcggtaggcggcgagcggcgcggagcgagctgcgagttgccactcaggtcgagcttgagtagctgcgtgaggtcgccaatcggccaatggcggatggaaccacgacggagctcaacatcacgtcggcgaacatgttgccgttgaggaatatctcagccaaggtgttgcagttggtcaggttgtccaagaactcccaggcgccgccatcatcggtcggcgtacggctccgacgagatggacgccccgctcctgtgaagcctcccctccctggggcgggggctcctctcatcgtctcccacgcccgcgcggatgctctccgcggcaacgtccgacgccctcgtcaagatcaagccaggcgagataagcatggtctccggcatccccaaggagcacctccgccgcaaagtgcttctttggacttactctgatttatgtagtgtcgatagattcgctagccctcgcagatccgtgtgggaatcgctcgagatgtcttggtttggtgggttcctttggttgttactcgggttagggatagagcctggaggtgtcgagtcgtgaacttgttggaattaatagatgggctaaggctcattcgaagattaattctttggaaaatcacaaaagcccacctcatgggatggcatgcatgtggagtttagtaccaccttgcttattctaggagagggggacctccttaaaagggaggatgccctcctagccacttaaagcatgtgtggtggagagaagaggggaaacacacgcgcgcgctcgctggcctggcctggcagggcaggcggcgcacgtgcacgacgtacgcgtcgaatggtccgcaaaattggctcctcacccttgtgcagatgcagcctccttttgcagttttgttttgctgcgggattcggatttgttttgttttggaaacattccaaaaaatccggtgtgtgaaaacggcatggaatccggataggttacgcgtgacttatccggttcggtttacgcggacgccctgatcaggcgatctatctctatataaaccgagccgctgccttcacgcaacacacgcgaaatcaatctagggtttgcctcctactctgtactgcgccgtcgctcgtagactactccatcccgctcgccggcgtgcaccggcaatcgggagagcaggtctccggaacctctgccttcgatgtcctgcaccgggagaaggtagcaataaggtttttgggaagcgcttcgcgcgactgctccctgttcgttcgcgacggctcgtcttcctcttcgctcgcgtgcttcgcgccttcgtagacgctcgcaactgcgagtagttcctgccgagcaaccggtctttccgccacctcggtatgtgttcaacatgttgcgcatatttgatctgttcaggttttactgcttagtttacatgtgtagatctaatgatgcgttcaatctagtttacatctgcaatgtcatgatttatttatggaataaattaaatcattatgtgcttataatttcaacaatccaaaaaccttattataggcgctgtgattttactatggctggttttgccgatgcactgaggccggataaattcaccggtgtgcactttaagagatggtagatcagggtcactctgtggctgacggctatgaaatgcttctgggtgagtattggcaaacctgaaggaattcttactgctgatcagcagaagcaattcgaggaagccactctttgtgggatgcattcttagcgttcttgacgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagttgaacaggctcatgagatacaaaccatggctaaggaacttgaactccttaagtgtgtcttacccgacaaatttgtggctgggtgcattattgcgaaactacctccatcatggagaagtttcggtactgcactcaaacacaagagataggaatactccgttgaggggttgatagcgtctcttgatgttgaggagaaagctcgggaaaaagacgccgcgtctaagggcgatggtgggcagtctagtgccaatgttgtgcataaggcccagaacaagagcaaggggaaatacaaagctcaacagaccaccaacttcaagaagcagaagaagaacaacaatcctaaccaggatgagaggacttgctttgtgtgtgggcaacctggtcatctggctaggaagtgtccacagtgcaaggggatgaaggcacctgcagggcagacttctaagtctgctaatgtgaccattggcaacactggagatgggagcgggtatggtaatttacctactgttttttcagttaatcagtctactaattggtgggttgatactggggccaatgtacatgtttgtgctgacatctcattgttttcttcttattaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctaactagagacaaatttaagttggtttttgagtctaataaagtagtcgtgtctaaacatggatattttaatggtaaaggttatgagtgtggaggcctgttccgcttttccctttctgatttctgcaataagtctgtgaaccatatttgtggcagtgtggatgatgaggctaatgtttggcactcacgtttatgtcatattaattttggcttgatgtctcggctttccagcatgtgtttaattcctaagttttccattgtcaaaggttctaagtgccataggtgtgtgcaatcgaagcaacctcgcaagcctcacaaggctgccgaggagagaaacttggcaccaatagaactcctacattcagatctttgtgaaatgaatggggtgttgacgaagggtgaaaaacgatatttcatgacgttgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaatgagtttgacttattttgtgaggaacatggcatcatacatgagaggacgcctccctattctcccgagtctaatgggattgctgaaaagaagaaccgcacactgactgacttggtgaatgccatgttggacaccgcgggactacctaaggcatggtggagggaggcattgttgacctcaaatcatgtgttaaacagagttcctaacagaaataaggacaaaacaccatatgagatatggattgggagaaaaccatcactttcttatttgcgtacatgggggtgcttggcgaaagtcaatgtactaataacgaagaagtgcaaacttggacctaagattgtggactgtgtctttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaggcaaccctctgaaataattcccagttcaatcacaccaccagaacaaactgaacatacacatgaacatgtctctgaggaggatgtcagtgaagctcctcgaaggagtaagagacaaaggacggctaagtcatttggtgatgatttcactgtgtacctcgtggatgacactcctaagtcaatttcagaagcatatgcatctcctgatgcagactactcgaaggaggctgtccatagtgaaatggattccattatcgctaacgggacttgggaggtgacagagcgaccctataggtgtaaacctgtggggtgcaagtgggtgttcaagaagaagcttaggcttgacggtactattgaaaagtataaggctcggcttgttgctaagggctatactcaaaaagaaggcgaagatttctttgacacttactcacctgttgctagattgaccacaattcgtgtgctactttccctagcagcctcacatggtcttctcgttcatcaaatggacttctcgttcatcaaatggacgttaagacagcttttcttaatggagagctggatgaggagatctatatggatcaatctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttggaacaaaccttgaggtgataaatgaggttaaatcattcttgtctcaaaattttgatatgaaggatttgggagtagctgatgttatcttaaacattaagctaattagaggtgagaatgggattacactcttgcagtctccggaacctctgccttcgacgtcctgcaccgggagaaggcggcaataaggtttttgggaagcgcttcgcgcgactgctccctgttcgttcgcgacggctcgccttcctcttcgctcgcatgcttcgcgccttcgtcgacgctcgcaaccgcgagtagttcctgccgagcaaccggtctttccgtcacctcggtacgtgttcaacatattgcgcatatttgatctgttcatgttttactgcttaatttacatgtgtagatctaatgatgcgttcaatctagtttacatctgcaatgtcatgatttatttatagaataaattaaattattatgtgcttataatttcaacagaactcgtggtacagactaaagtgctatcgctagttgacgttcgaatcgtggagtagatagaaatgcgaattcggtgatgaagttttacacttgtatggtttgaactgcgtttagaacttgggaggaatgtgctggtccacgtgcgcccacgtcgatcggctgggagctccccacagaacacgttgttcgcgagtgcgagaccttgcaacgacgtcatgttgaagaaactcggcgggatctctccggtgaggctgttctgcgacaaggctaacatgcggagcgccgggaggtgtgacaagccgtcggggatggaacttcccagaaggttctggtcgaactcgagctgcacgatcttcgtgaggttcgccagcgatggcgggaagtggccggagagcgagttgtggctgagctggagcaccgtgagattcggcaacgcgtcaagccaccgtggaatgccgccgacgatcgaggttgttgtttttgaggtacgcgacgtcgagggcggtgcaattgtggagcgcgtcaggtatctcgccggcgaacgcgttgtcgcataggctgagtgtaacgcctcgattttcgttcgggtttaaaaaatcatttaataatgcattttctagaaattaaataaaagttaaaccaatttaatcaagtggaattatggagggaattaaaatttcctttaaaaatcattggccgggaatattctgtaatattctttgtgccctaatgtactctctagaattttccgtgagttttcggagctcaagaaataattttaaaagcaccaagttcattttaaccaactaaataaaaagaaaaacaattaaaatcccccttcctctctttgggccattttcggcccaactcttccttctctcccgcggcccgcgcgccccttttctctccctctcgggccggcctcctccctcggcccgctcggctctctctccctgaagtctgctttacctccctcacccgttttcccatctctctctccccaacaggtgggacccgaggccccacctgtcatcttcttccccaacctcccgtcgccccaactgccgccatggccgccggtttcaccccacgacgccgcggctcccgcgctccaccccgccccacgagcgcgtgaaatcgatcccctccacctcctccacctttccccccactctccccgcgaaaatcggcgccggttaacccctccaccactccacgtcggcgccccacttcgccggccgattccgccacgtccggcctcgatcccgccttcctgagcccacaaaaagcacccccgtgctcccctcgtccatttccccttgtttcccgggcccggcactctctccctcgctctccccacgccgctcccgcgcgccgccacactccggcgaactccggccgccgtttcccgtcgctagggtcgccgccgcactgctccgccgccagcgctggctttgccacctcaagggcacgctcagccgccgtttcttcctccccttccaccacgcgaaccacctctccaccgtgctccctctctccatcggtccccggcgtgctccggccacctctagccgccgccctagccactgccgcgccgcgccgtttgcgccgccggcttctccgtgcctcgccgcaccccggcctccgctccgtttccctatttaatcgccgcaaccacccttccacagtgcatcccaagccacctccaccctacgccgccgggccgccgttccgccttcgtcccgaggagcgccgacgccgagctcccccgcttttccccgcccctcgtcgtcgcgtccttggtgagctcctcctctccctccttgcctccctcctctgtctcccgtgcgtgctgccgcgccggtggccgccgccggcgaccaccgggccgtgcgtcgccgccgttaggtcggccggccggcttgtcgccgccccgctcgcctaggccgcccggatccccttgccgcgccgcgccgccgctttcccgcgtgcgtcggccgtcgccgcaggaggccgcgccgccgtgagccgttgctcggccgggccggcctaagctgtgcccgtgctcagccgcgccaccccgtggccgcccgatcagctcgggctgatctgggccgtcggttcccgtggaccggcagtggaccaccccgtggtcccagttcacggtggaccactcccttgcccgctgtcatgtggggcccgcttgtcggcgccgctgccctttgatgacgccagcaggagccttttcctttgataaaataattaacaattgcacaataattcgttaataattctagaaattcatttaaatggctcaaaacttctaaaattcatatctaattcattcaaactccgaattgagccattcaacttgcaaaattcatctaaaattgagctctacatgtttgtttactttttatgtactgtttccttggtttttattagagtttttcctcgttttgcgtgcctgcgtgtagaatccgtcatttcggaagatcacggtcgcaaggataagagttcggaagattgtttgaagaagcaaggcaagtcacacattccccttgagcatgttgattccaatttataaatgttttactgtttgcaaataaatatgcatattttgctaattacatggggtcagggttttacctatctgctcgcttgtgccatatttacttgatatatgtcctttgtcaacattgggtaataaatcgactagctcatgttacttatgtgacctagctagaactatatgcttagccatgcttaattaccactagctcagttgatgggataattaccgtattagaccttttagtatcagaatgagctgcgtgctcgagacatctggccatgcttcatggtcgtaattatccaactaaaatgcgactgaatggtgggctgtgggtgcatggttttgctggtcgcacccatggcagttaaggacggctgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgatggggatgggggtgaaacctgaggtgtggtgtgcttggctagagtgggttatgcgaagggtcctgtcacggcctctttccggtatgtcgtggtggcatgtcggcgcacggaaacgtgtcgtggggctgtgtcatgtgggtacagttgtacacctctgatcagagtaaagttattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccatccttgtatccccttgcacatctgcatcgttagtgtggcttgctgagtacggtggttatactcagtcttgcttttattctcccttttcagaagtgttgtgtttctgagctgaagatggagttagaggaccaagtctcagaccccagttgagttttgcctgtggagtggagctgaagccccgctaggatcgcctttttccgctgctgtcgttctgtttcggtgtgaggactaagtgcctcttccgtaagtattttacgctttatttacatttagaactgtatattacttgtcgttttgtgtaccctggctggtcctggacagggatttaatacgaaaaatagtctgaaaatttgggttaaatttctgggcgtgacactgagataccacatccgccggagccagccgaggccatcggcgatgctcccggagaaggcgttggaggtgaggttgatgagtagctcgagctacgtgaggttggcgacggccggtgagagctcaccggcgaggcggctcatggacacgtccagcgacgtgacacgccccgctgcccacttctctgcccgcggccgcgctcgcgcccgcctccactccgctgccgcgctcgccctccactgctccgcctgccgccgcctccctcgctgaagaaaaggagagaggagagaaaagagaagagaagaaaaagaaaaagagaagaaaaaaatgtacagctgacatgtaggctccacatactttttaaaaatttatttgctgactaggatgccacgtcagcgaaaccacccatatatactgcttagggaccttgagtgaacggttttgtatagtttaggggtggagatttctggttttgtggttaagggacctcaaaaatctcgctgttaagtggagggacctccggtgaacttattcctcacgacaatgatagtactgagagtgatatttgctaggtccaaaggccagaagcagcgtagctagctatagtacttggtagcttgggcccatgtatgtaacttgggcctggacttctttcgtcccgagccttctaatccagcccaagagtaaatgacagtaagcaacggcagcaaaaagtacactacctgagtaaacggataaggaaaacaatgtacctgcacgcctccgcgattccggcggccggcgcgtagctgttgtgcgcgccggaggcggcggcggcgacgacggcgcccgtggccgccggcgccgcgcggaagcacgcgaacgcggcggggtcgccgtgtccgagcggcgccacggaccgcgcgtcgcccctgtcgaggcaggcgtacacccggtacaccagcgcgcggatgctctgcgacctcgccgcctccatcgccgggttcgccgccccgaaccgccacgccgccgccgacgcgtcgccgccgccgttctccatgagcacacctacagcgagcgatgcgtgctgcttgtgagagtagtgcgagtgtttggctaaggaatgggaggtgtggcagcgaccaaagccgtgtgcaatgcggacagggagccgtgtcgctacagcttgatggatgatttgatttgatcgcgtcgcatcagcgtgcggtgacagtgagtattcttggaagtatctgctttgttatgttatgacaatgatctgtaccaaattcaacagtcaagattagtaatcgtgctgctcctacaatacctaggacgcaccaacgatttttctctttctcgtaccgtgaaaagaacactgtcgggtacagaaagtactgtcacagacgctacttcatctctttcatataaaatctgacacatcataatactataaattataagtgcaagtaggtcacctgtgaacccacttatagcttaaaataagcgagttcacgtgttagtttagcctataagtgagttttcacagatagccgcttgcacccttactatgaatctagacatatctttggccctgtttagttccatgggctaatgtttagccctcacctttagcctcaaattagccctcaaggatccaaacaagtaggctaattttgagctaatgtgaattagccccttcaagaggtgctaagagcatatccaacagcctctctatcccactctcagccaaattctagccattctagccaaaaagggtactccaacagcctctccaaccggatggctaagccatccggctggccaaaaccctctctccactagccaaatttagccactctatttggctggccaatggtgggtcccacacagccaaactcttccatagctccatccccacacgggcaaccagggagaggcacgggaggagcacgaacagaggacgagcacggcgaccgccggccttcgatcgccaccgcatggcccgccagccgcctccgctcgccgtctccgcgcggcggcgccacccgccgcctccgctcgacgcggccgccggtctccgcgcggttccggtgccgcccgccgccccgcgcggcgccgcgcgccgcctcggctcgccgcggccgccggcctccgcgcggcgccgccgcccgccgcctccgccctccgtggcctccggcctccgcgcggcgccgccgcccgccacctctgcgtgccgcggcggccggcctccgcgcggctccgtgcagcaccatgcccgccgcctccgcccgctgcggccgccggcctccgcacgacgctgcccgccgcggcccctgaggctcggcgtcgtcgcccctgaggctcggcgccgtcgccgctcgttgttctccgccggagaggatgcagtacagctggagggaggaagtagtactagagaatgggttggaagaggaggaagaatagtaatagagactgacatgtgggtcccatttgtaatagacttgtaatagagagggtagatggagaggctgttgaagtgaacaactagtttgactagccaaatcagatagagagttggctatgcgggtgtttggagagttcgatttggagaggctgttggagatgctctaatggggctaattttgtgtggggaccattaaaaagcagccctctctcaccttctctctcctctctctccatcttttagccttaaattagcccatggatccaaacatgccattctaggctaatgtttagcctactaattcatgactaaacattagctcttaaaattagccctgggctaatcttccaaacatggcctttgtctagattcatgatactagtgtcacagttagtacagttagtactagttttgttttctctaagacgtaggaagtacaaaaagtgcaaagcacttctagggacaagattcagaggggtagaatatcgcctataaggcatcaccacttatctctatcaactcacaaataaacgctcattggctcattgctatagtacctatagggcctatttggggagtttaaaattctgagaaacaggtggttggtagccagcttttaagaatctgaaaaagctgggttttcgagcttatggcttctagttcattttctgtactctacaactgcagcagctagaagctcccctaaacatgcccataatgcaggtagtaagattttatgaagtgctacggatgtccaaaagtataataaggagttttagaattgaacacgtatgagtattaagaaaattggtggaattaaataggagaagattgtgattggttgagaagagcaggtaggtaaggaatttgaatagcttaatgttgtgattggttgataagagaatgtagatggagaggttgttatatttgtttgaatatgtgccgaatatactagtcctatttagttacagttggacttgaagttgtaataggtggtagggggtggagttagagtcggactctgtaacccaaatctctcttaaatggagggggggcaccataatctaaccatggcgactacaatgtagcgtagacacgtagggagatgatgacggcgaggccatggactcgtagcagctaggagctatgttggttgggaggagcggccataatcagagccccggggatgtaggcttcggctgaacctcgttaacaaatatcgtgtgttcttatgtcgtcatctggatgccttgggtgatcatatgactgaaacgatcgggatggttagtcgttgttccgctatatcgactaacttttataacaatagtttggaacaaatattaagactaaaaattattatattttagaacaggggagtaaaagacactcctacgttagggaatgtgaaatagcacggtcggttgttggctacaagcttatgtgcactgtaaattggcggcccgggtactaaatccataacgaaaagatatcgtcaaacaaaggagtaaattttaatttgtattgtgtatatagactaacgttacgtacaaatagacctaggctttaggctgtgttgttttgaggttaggaacacgtaaaatggagcgatgaattggagcataattaattaaggattagttaaagaatttaaaataaattaatacgatatttaaaatcaactttttatataacttttttttaaaaaaatataatttagcagttaaaaagtatgcacgtgaaatataaggaagtaaaagttaggagtatgtagtataaaacgcaccattaagccacttttcaacttaatgtcacgtattttataattttagaagtatccactcctgtttatgcatcttctatccatccatattagaagaattatccataagtacaatgtactcgttaaaataaaatagtgcatgactaatgactactggggttatatagtagtagtagaacacaatatatgtatagatggttgaccgaggaagcttaccaaccgtcaatgattataatttgttcaaacttagaatgggctatgggcatttgaggtggcttgacaatgttttctttacgaagtataaaaatgaaatcttcactgaacatgtgtttacattgtcgtcgtgggctatgggcatttgaggtggctttaatgatcatcgaacacttatcaaagacaacagtaacaagctcgttctagctagatcattggaggaggatgtgaaatctacaaaacaacatgagaatgttaaaacatagtaaaatgtattaaaatggattaaaccctaaaatttagggctctatatggtcgaacacatcacacctgcccatgtatatgttccatgcatgtcatctaaaagtggtgtaattgttactccctctatccataaaatttcaaaccctagcttcccaaggtaaaattaaggaggaagacaaacgaccaaactatccctaattaataaaaaagttgtattgatgggtatgtgaggggtatttaaaagataaaatttttcttgatttgcgaaccgatggtaggttagtactccctccgtcccaaaaaagataaaccctgggtttccgtgtccaacgtttgactgtctgttttatatgaaatttttttataatcagtatttttattgatgttatgtgataaaacatgattaatactttatgtatgacttatctttttaatttttttcataattttttcaaataagatggacggtcaaaagttggacacggaaacccagggtttgtctttttttgggacggagggagtagatagaagttggtttattttggaatataataatttaaacctataatttgatttacagaaaacttagacaacggtatcctgttggaacaggatacccttctatgagacattacttgatacctgatacctgttgtggtatcagttgcatggtactcgatacttgtgatacctgttacccagtacctgtgatacctaggacctgatacctgtgatactcgtgcaagagaatagttaatatatctatcccgttgcaacgtgatcccgttttgtagcagccctcttttatttattttgaaacagagggagtagagtataaacagacactcaatgggaaggtgaacccatgatttgcacgtaagggctcatttgaatcgtaggattgagaaaacgtaggaataggaaaacgtaggattttaatcgtagtgtaaaacagaggattacaaaacgcaggacaaaacacaggaatgaccgttcgattgaaccgcagtaattggattggatgagagatatagactcaaaagaaagttaccaagaggttgaagctcttgctaaattttctccaaaatccctataggattgttcattccatagaaatttcaaaggattagatatgattcaatcttttgtttcaaagggcttcataggaaattttcctataggattgaaatactaaaaaattcccatgtttttcctccaaattaaaggggccctaaacaagatcaagagctttattactccacctgtggctccgtcccaaattatagggcgccccctttttaaggaaaatcaaatttggtatcttttgactaataaccatactacctatatatatactaagtataatgcatgttatatcattatattcatattttgaagtaatttcatgtgatgctaattttatatttgttgggattatagaatgaaataaaatactggtcaaaatatattatatattattgaagaccacataaaaatatagcgcttataatttggaatagacagtattttttaacatcacatctagccactgttgccatcgcctcaacaccctagcacgcttcccctggcttaggccaggcctgccacaccggacacttccccctcccctctcctcttcctcctcaagcttgttgccatgttgttttcccaatctctaataacttccgtagcgctggagacaccatcatcaccgacaccgacaccatcatcacctttgacccctctcatttcccttgccttcgcctccgacaccggactaacatggtcctccatctccgtggcttcagctacagcgctgccatttcacaatcaacccattcatgtttaccacttaccactaattatgtccatctctttgaagcttagaaggtgtttggatcctttagttgtaggactaaaattagtcctaggactaaatccatacctgtttgaatgtagagactaaaaaaactaaaggtcaataattgcactatataaagaccatgttaacccctaacaccatgtaaagagaggattgtgcatggggcagtgagtagaaagaagcaactttaatccctataagctcctttcatagggactaatggactaatgcacttttaatcccttttagtcatccatgtttaagactttagggactaaaggggattaaagtgaaggggctaaagttttagtccctccaaccaaacaggctcttagggaaaccaaagtcccatcgaatatcatcgtttaccaacttaaaaaaaaagcattagagcaagtttaagattgagttcaatggtgccttttcccaagctcaccttacttgtttttcgcgcgtatgcttccaaaatattaaatggtgcattttttttattttttaagttgctttaaaacaatcttagagcatctacaacaacatggctatttttgcctctccaaatatcctatttagcaaattgccaaaaaattagagagccaaaattgagtttcactccaacggtctctccagttcaatctccaatttaacggtgggtcccatatgtcagtcacactttttctttgtgatctttttcatccacttctttctcgtcttctcctcttttctctgcattgcaatggcgcggggggtggagacgatggacgccggcggtagcagtgcgagtggcggaggccgaccggaacggtggggcggtggagacagtctctctcttcccttcttttattttctttcctcttctcattttcttcccctcctctcactcttgattcccctttctccttctctcctaccgactccgggagggagccggcgctaggcggcgatgggcgcggcgatggcggctggatcagggcggcggtcagcgcggcgacggtggagggcggtgaggtggaggaggcacagagcgagggggcgccggaaggagttgatgtgggccgacggttggcggaggcggccatggcacgacgacggcgacggcgtggtggcgacccggccggacggggacagagtgaggaggcagcttccggggcctgcgattggtgctagggagggaggcggcctcgtgggcggcgctcggcctggtgcggcggcggcccggagtaggatgaagtcggcgtcgacgacagcttcggtggccttcggccaagggaaggcggaggcggtgggtggcgaagaccggagagagcggagcggcggaccggaggaccggcggtgccgctgtgagtgatgacgactgacggtgcggcggcaccaccagatcccccgaggccgatgcaaaaggagaaggggatgtggcggcggcggtggaggagatggcggtggacgacggaagggacggcggcaggcggcaacagggatggcgccggcgccagtggcgcgctcgcgagtgtagagagagaatataagaggagatggggaaaaatgcgtggggcccacgatttggaaaggcaactctggctagccaaagttggccagcgtagggaggagtttagccagtcagatggcttggccagccgtttagcaagtctgttggagccccttttttttcctcaaaattgccaaaatttaacttggagagtgagattgccactatgttggagatgctcttaccaatccatttttaaagcttttaagctaatacttaattaatcatgtgccaatgagctagttcgttttccgtgtcagaggggaccttcgcaatcgaacacaacctaataatatagccaactacaaactaaaaaaaatgacacatatactgtcatctaataacctacttatacagaaatatatactacattattaatatctagcccacctcttatacatacaaatacttcctccatccaaatacttcctccatcccacagtaggtattttgaccggatgagatatatctgtaatatgaatgtacacaacccataccagaatatatcttattcgatcaaaatcctttatattttgggataaaatgagtatataatgtattggagctcgtggcagcccttttttcctctctaataacatactctcagttccaaaataaagtacggacatgacatatcttagtaatacgatttggacaaccattcacatacatataggatataggatatatataggatgtggtatatcctagtactgtacatgaatatgagcggtatatttagattgatagtatataatatatcacatttcatacttccttcgtcccaatatataggaatctagtatcggatttgacatattataggattatgaatctggacagtttcatgtccagattcgtagttttaggatatatcaaatccgattctaaattgctactccctccgtcccataatataagggattttgactttttacttgcactgtttgaccattcatattattaaaaaaaatttggaattattatttattttatttgtgacttactttattatccaaattattttaagtacaaattttcgttttttatatttacgcaaattttggaacaagacgagtggtcaaatagtgtaagcaaaaaatcaaaatcctttatattataggacggagggagtatatattacgacggaggagtattagatttattcggcagtacaggatgagaactaatccctcctgcaagcaaaatagagcggtctattagcacatgattaattaaatattagtatttattttttttaaaaagaatcaatataattttttacagcaactttcatatagaaattattttgaaaaacactagtttaaaaaacgtgcgcgtgaaaagtaagcgccaaactcagcctattgcagtcggaagaggtaaagtcgtcactgatgtacgggccccacttccgttcattgcaagtcgctcccagcgcacgaccgtcctgtcgtctcctaccctcgttccggtcaggggaatccccattctctgcacaggctcccgaccacgaaaagatcgctgaccccgaccttgacccgcgccgtcgcgtcgccttcggaatccaagaacgatgctcgccgccgtcccggatcgacctccattgatccgcaaacgccgcgtccgccccccgccctccaagctcgagcctcgcagccatcgacctcgatccgcttcgcgctctgtcggaggcgcatcttggttcttccatggcgaccccccatcggccatacatggcggcaagctagctcccgtctcaatccgtagctttcccctccttgagcctggactactcctttgattcttttgttcttttttgcttcactagctaattgtctgattgtacttctcttcttgcacaggcgtggatttgcagatgtcgcggttcacagggcaattctgctggttatcctacaagtaatcatctactcttctcttcttgatgatttctgcaataaacaatagtctgattctagaagacagacagagctatcctgttgccgtcgagacttttaactctgattattgacttgcggttctcttcacctcttgtttactttgctggattaaattactaggttactctatatgtttgagaaaattgcgtggatgacacgtggaagctgagtgtgatccactgggactgaccacttcatttgttgataaactaaccccttgatagtaatggcattgactaataatacactagtttactctgacttgtagttttctttcttgtttaaggtttgctggctagcaaggataaggttgagcggaacagaatatggtgttctactatgccctctacgtgtttgagaaaatgacagtatgatgaatgcaagtgtgaacaatccaaataacccactgatcccttgaaaaccaggaccatgaaaggagtaaattaagccaacgggtggatagtccattgataaaccgcctgcccaaggtaagtctgtcagacatggtgtcttcactgacattgtcacacaggccagctaggaggaagagttccagctcccttccagttccaggacgttgttccaggtatccatcatgtgcttcttgatctcataccaaactatttggatgcttcacgctgttcaggtcatcatgctgctaagtttctcttgttgaattgatcgattccggccattgcttaccaggaaaggggcatgccagcatggggctgctattagtttctatttgttttgcatggtgtgtggtgtttgtttagtcgatggggatgtgtagatatcatttatcaaaaagaaggctaactgtgttgttctacttgacagcactgttgaattacacctgagtgtaaagaagatcgacaaagatggcagttgtagcaggggcgatgactgccctcattgccaagttgactaccctgctgatggaccaatacaagctgcagaacagtgcgaggggcgacatcatatttattaaagccgagcttgagagcattcaggctgcccttgagaagttgtttgaggtgcaggtaactgatcgccaggttaagatttgggagagggatgtgagagagcagtcgtacgacatggaggatatcatcgacaatttcatggttcatgtcgaaacccatttgctagccaagccacatgaactcaaaggattcatgaagggaagtttgagcttgttgagaagagcaatggttcgctatcgtgttgctaccgacatcaaacgtatcaggaggcttgtcaatgagacgagtgcacgccgtgataggtataaggttggtactattgttgctgctgccaagactgagaccgcaattgatccccgtttaattggtatctatggagaggctactaaacttattggcataagtggacctaaggaagaattgaccaagctgctgatggattccaagggcaactcaaagaataaactgaaagtgatctccatcgttggagttggtggtttaggcaagacaactcttgctaatgtcatttatcaacagcttagaggacaattcgagtgtcatgcttttgtttcagtatccttaaagcctgatctaaagaaggtcctgagcagcatactccgtcaattcagtgaacaaggttatgcttggacagaaacatggtgtgctcaggaaatcatcaacaaaatcagagatgaaattaaggaaaagaggtataactaaccaaatacatgcttaagatcattgggaacatatcctgtgtacacaagccatcacgtgtacacactgtacaccaactaacaaatgtcaccaaaaaatctagaaaatttcatacatgtactttcaatagtattacacctacaagtacaaattcattatattttagccgtaaccaaaaaaatgtgacagttttaaggttataattctgtcagaattttgtttcttgttgttgctctctgtagaatgaatttgaagatgggactttacacgtaaatgtaatactattaaaagtacacatatgaattttcttagatttttctggtgatatttgttagttgttatgtacatgtgagtgcttgtgtacataagatatgctcccaggatcatcccatgctatgtgtaagcattttagcttgaagtacagctagaatttggagctagtagggatagtaaaatacatgcacagactgctaggtgaattaacaatgaaattaatccttttatctaataaaccaagttcaatgggctggcaaagtaatattctagcttagggtgctaggtgtgataacaacgggaagttcaaggggctatgaaagagaaatgtgaattcagggtgttcgataagacaggcaaaagcttagaggtctaaaatacagttcttttctttcggaaaactaaaaccaagatagcaaaattactagtttgatcaatttggattcaggcaacttctattctttgaacttctcacaaaactgcaaccctgtcatatcctaggaaatttttgcatgttggtccaaatattattgactctactctgtttgataccattaggctgctaatgggccgcgtcagcatcaaattggctgcaaatttttatttatttatttagaagtcattccctatcttcgaaaaagcaaatacatgctacataagttcaggaagtagtagccagacctaaaggttaggtaaataaaatgttcacatctaacatgattgaaactgagttcatgaaaccctatacttgtgggactgaactcatgagactgaacatgtagggaaactatagcttctggagatcctgtctttcctctccctcaccttctgtccaatgccagtactcgtggttctcagagcagagccttttgtgctgttgaatacttcatctgttacttgcctttgaaaggatccaattaattggttttcagtttcaatttaactcatgtcttgtgctaatgttatcacaaaaccacaggtacttgattgtaattgatgatatatgggagaaatcagcatgggaatgcatcgagtgtgctttaatagaaaatgaccgtggaagcagaataatcacaacaagcagagtgcttgatgctgccacgccatgctcttctgaggttgatcataccgtttacaagctgcagccactttctagtgataactcaaagaaattgttctacaaaaggatattctactgtgaagatggttgtccattggaactgaaggatatatctgaaaaaactttaagaaagtgtgagggagtcccgttagccataatcaccataggcagtttattggccatgagaccacaaaatttataccaatgggatagggtacacaatttaattggttctggacttgagaaaagccatcatgtggagaatatgcggcacatattgtctattagttattatgatttgccagcccatttaagagcttgcttcctatatctaagtatatatccagaggattacaatatacagaaagatcaactgatacgcagatggatttctgaagggtttatacttggagaagatatggatactttgcatgaaggaggtaaatacttcaatgagctaataaatagaagcatgattcaaccagcatacatcgacagtcatggaagggtgcatgcttgtcgtgttcatgatatggtgcttgatcttatcacatcattgtcaaatgaaacaaattttgtgacatcattaggtggtcagcagcccacatatcatccaaacagggctcgccggttatgccttcaaaacagcatatatgaccatacgatacgacaggagaaaatgaagtggccccgcgtgaggtcactaatcgtattccctcatgctaccaacttgttgccatccctttcgagattccgtattttgcgcgtactggatttagaaggttgtcaagacttgaagaatcaccaaattgagggtatcagtgatttgtttcatttgaggtctctagtactgaaggatacaaatattggtagtctccccaaaaagattggcaacctaagttgtttacatacactggacataaggcacactatcataactgaacttccatcaacagtcgttcatctaagaagactggtgcgcctactaattgatgcatcggtgaagttacctgatggaattgggaaaatggaatgcttacaggaaatatcactggttggtattagcaagtctccaaactttttgaaggagctagggagtttgacagaactaagaatactccagatttcagagagtactggtgcgtggcatgatagttatgagaatactttgattgattctttgtgcaacctgcacaaaatctgtgacctgtacatccatggctgtaaactgtccacagagttcatatcaaatataagatgctctccgcgatatctccgatatctttcatgtggccaattatccatattgccaaggtggatcaattcatccttattgtccctctccaccatagatttgatacttaatgtactccgacaggatgatcttcgtagtcttggtgccttacaatctctatgttgtctccgtcttaatgtgttcaaaattgaaccagaaaggttggttgttggcactgagcatgcaaagttccactggctagctgagttttcgtttaccactaatgccatggggcttatatttagccaatattctatgccaaggcttgaaaaccttgagctagcttttaatgttcgagagacaaagtattttgatattggcttggagcacctgtcctctcttaaggatgtcactgcaagaattgattgcagggattccagtatttttgaggtgcaaaatgcagatgctgccattcggaggattgcatatatgaactccaaccaacctaaggttcatgtgatcaggcattatgaacacatgttaatggatgaggtgaagatccagaaggaaacggaggaggaaaaggaggtactttctaaatgactaattaatggaaggcgtagtaacttgtaatacatgaagtttacatataaatttctgaatcatagggtcactttttaaattcatcgaaacaaaactgcaaaactttgtttttcttttttcttttttattatatctttatgtcttctttgcagatattggaaaataggattggtccatggggtggaaatggtggggtcacttgtgacatcaaggttgcacccaaacgcttggaaagcattactatttgtagcggcataatcatcgatgcacttgcattttcttacttggacaaagatggagagcgacacacgactagtttatggggtggtcttggtggtagtgttcaactggtgagttgatcattattattttttattttctttgcaaaacaaatatggcatttatttctttcttcctggatcgaatccagtaaaatgagcaacacaaatacaactcaattacattgcaagaattcagaggtaatggaccttaatttcctcgcagattgatcttgatgaaagagagtttcttatggaggttattggaactgtgggtccattcaatgtgttatctgaggctataacatcacttacacttgtgaccaatgtacgtagctatgggccttttggacaaccacagggtactcctttccgtactccacggaagaaaaacagttgtatcgtgggattctttgggcgttcaggaacatatcttgatgcagttggggtctattttcaccctatgtagatctcagcaaagcgcgaaatcctttaaccaaacttgtagtttatattcacattgtgtcgaatattttcttttgtttctttacatttcctgatattatggtcggactactcgtatttcaattcttgtgatctgttttcctttcacctgtttttttttctcagttgttcaaataacatcaaaagttgttttagcttcatatgtagtgcgctgcagtaaaatgatcacgtcattatggacagtgactcctgttttttttcttagttgttcaaataacatcaaaagttgttttagcttcatatgtagtgcgctgcagtaaaatgatcacgtcattatggacagtgactcctgtttttttttcttagttgttcaaataacatcaaaagttgttttagcttcatgtgtagtgcgctgcagtaaaatgatcacgtcagtatggacagtgactcctgtttttttttcttagttgttcaaataacatcaaaagttgttttagcttcatatgtagtgcgctgcagtaaaatgatcacgtcattatggacagtgactcctgctggaattctcaatatggttcaccatgtggaggtgtggttaggagtgtaaagaaaaaactcgggctcgtgaactcagctagaaagccaaacaagctgagccaagcatcctttttagctcttcgttgaaatgagctgtgcccgagctagcttgcgagccaattgtttggctcgtgaccctaggtcattatgtacttatatggattattttttagtggagttattatttgtcaacttgtaatttattatctagattttaaagaattgaatatatgaattagttttaagtacatgttgttgatttattctttgcttttcttaatgattacaaattatatatgaagagacgagccaaaccaagcctattatgttgtgagcctttgcaagcttggctcggctcatttccacccctaggcgtggtcaagaaagaggattttttgttttgattggtaccaatcaacaacatgatgtctatacaaagattagcttgaaaccgaaattccagcttatctctatcttaagatataaatgcacatctgcgaattgaacgaaccattttccgagcacaagtcatgtaagcttaacttttgttacagtagattgatgtaatatgtatttgaacaatccaacaaaataagaacaagtccaacaagttccacttagactaccagtagtccaaatgaaaactgaccatatcagtttgactccgcttgtactgttggtttgactgcaacatcctctgtactagaactatttgcagcaaggcttgcagttctccccaacgcccataagaatcatgaattagtttagggttttcggaagtggcttaccgtgcgagagatcgtcacctcatgcataggggcatttctcttcttttatatggcgccgtgggctgaaaatctccttcgtcgacattgccttgtgattggatatgtagtctatgtagcagtgccttcgaagatgctacactacttgctaaagactgcattttcacaaacatagtctgaaaccttgtttctagctagttaggctacaaccaatcccctggcagctgctcagcaattctatttcagattggtgggagtctttaacctccacactacaaggaaaagaaagaaacaaaatgatcggtgcccttctgactacatggtgtcagtggcggatctagaaatatttgtgagcccgggcaaatctaattaacaacgccaacggatatataataaatcccatataacttactatgtaccatacaacattttttttatcgtattgtaatttagaagaaaacgatggttgtgtttttgtaggctatgggacttagtaatttattatcttgaaaagcaaaaaaaaatataatgggtgctagaaaatttactttgccttcaggttgcatacgtctaatagcttgcactcaagtaatgggtaaaacgatctactagtaaacaatcatggtgcttttggttactctagatgattgtgtatgtaacatctattaacagattattataacatacttatattgcttcatgctggctgctgcatgctgtggctaagcaccgtgagttagaactaatctaatgatgcatgcgacgctggagcccgggcaattgcccgggcttgccgggccctagctccgccgctgcatggtgtgatgtttggctatagcgtaatcaaagaattttcaatcagaagtcgcaaagtgaaacccaagtagcattcctaataaaggaaaatatagacctaatagcacattctaggcccacctaatggctagcgcttccttaagttgtgttccttgctcccttgtaatcccctaaagagtcactctttagccggttgtcttttcttcttttgctgattgtaccaattggcaaactttatttcttctaatatatccagcaaatctcttgctgattgcagtttcaaaaataatggtgctgtgagactcgagggcgatacaacaacaataaaaaaactggagcacctatgatcatgacacgagtttgtcaagatgtatgtgtggccatgggtggacctcgtcaatggatgagttagtctcagttggcctgaaatcaacaaacaaaatcaaatagttttttttctagtataacggattcgagtcactcaattaattcttgcaatgacggaaaggggaaacatttcgaattcaatgtttggatttaattccaaccaggtttcaaaagataatctgttcattgcagctcatatgaatagtaattaaagaaagacatatctggagtactggagctcacattagacctatggagcattggatcaagaataaattttcagcaatgcttaattcttgaccttggcaaatctcagtaaaattattagtcaataataatagtatatccttccgcattccgctgtcaaaagaacaaaaaaaaaatcttccccacaagaataaaaacatatcaacctcaattttccagatcatgcaaaacatgatcaacaaaactcaaattattttcctgcaacagttcaacattatcatcaaaatatattaaattctacagaagaatttaaaccaacacccaacatgtcacaaagaagtatcaatacaagagtgcttctccaatttattttatttttagatgttcaaagcaacgaaagcataaagtgattcttttgcatgacctttccttattccctagctgcaattcacatgaggatagtttatcatttcagtgccttgtagcaaccaggttggtttaaaccctcggcatgtgaccttgaactggaggaggtagtcctcccatttttccactcctcactttgaccaacagttcttggagccattgctgcattgtagggtcatcctgcatttgtagtaaaacaaatttatattcagagttgattgcaattatcagcctagtctaatagtacttcagttggatgatacatactacctcaaaatataataaattctggttgtatatcttgtccatccaggtacatagctaaaaattattataatttggggatggaagtagtagtaatttttagtgaaaatgtatatctacaatacacaactcaccttagtaagattgttgaatgtcccatctataagtgtggtaggaaggcaagtctgcagtgcctccaagcccctggaacattgcagaggaggtagatcgaaatggcattgctggctttagaagtttgaaaaaatgaagataattctgcaaaatgaaagtgaggaaacaaacctaggattgtctgtgatcctaaggtaacagtggataatgtgcttcaacaaccttggggagggcttgtcatccattgaggtcaccatgcctgctaaggcagtccccacagcgaagaaccgatcagcagtagcgcaaatgtaaccaagcccagcgtcatccaagacaatcttttcaataataaaagttgccacctgcatatataggtgagtaaatcagtgaatggatgcaatttctaataagtttaccagaatggaatcaaagtgtatgtcactgaaaacacacatataaaaatgcaaatatatatatgatatacttaccatagatatatacatgattaatacataggtaacaaaaagaaaatggcaatatctagattgttagattggtacaattatatcaatcaatgaattgctacaaagtattccaaaacagcaagacccaaagtatacaaagaatcactatatatcaataaatgaattgctacaaattatactttgagctgatgctagctgaaaataaaaatgtgctcctatcaaactttacataggaaagaatactaaaagacaattaattaaaggtgatgttattttaggagaggattgatatggctggttacttacagtttttgaaagctcactgcctaccgccatggcatgcaggcagagaggaacaaattcatattgcagtagaaaattgatgacttctgtaccttcagcctgcatgtatcacaagtaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2364 - DNA, 756 bp, Oryza sativa
acttgagaattttcgtatcaatctttactacacatggggcatggtcagagatattcctagttagggggagaacagttgtattgcggaaggttaaagtccatgatgcagaggtgaaaactcaatcaagtctttctagcaaatgattttgttgcatattgctccaggcgacccttctcccttgtaaagggtaaggcttccgctacccagctaaaggctatactcaaaaagaaggcgaagatttctttgacacttactcacctgttgctagattgaccacaattcgtgtgctactttccctagcagcctcacatggtcttctcgttcatcaaatggacttctcgttcatcaaatggacgttaagacagcttttcttaatggagagctggatgaggagatctatatggatcaatctgatgggtttgtagttgaaggtcaagaaagcaaagtgtgcaaattgttgaagtctttgtatggtctgaaacaagctcctaagcaatggcatgagaaatttgacaaaacattgacatctgcaagctttgcagtcaatgaagcagataaatgtgtgtactatcgccatggtgggggtgagggagttaatttgtgcttgtatgttgacgacatcctgatatttggaacaaaccctgaggtgaaaaatgaggctaaatcatccttgcctcaaaatttgaaattaaaggattgggcatagctgatgttatcttaaacattaactaacttgaggggagaatgggattacac

SEQ ID NO: 2365 - DNA, 1071 bp, Oryza sativa
ccgcgccaaccgccgccgccgtaagcttcgccgccacaagagctttcccggccgccgcctcgcgtcgccggaatcccaccggagcgcctctctcctcgcgagccggtgagttttttccctcccctccatctccggccggcaatggtagccgccgtggtcgtcgtctcctctcctaaccccctctccgctccctcccaggtgtcgccgccgcccgtccgcgcctcggcatcgtcggtcgtcaccgccacccttgttttccgcactggtcgccgccgcctctccggtgaggactccctctccctcccttttctccccttcccgcgtgcgccaccgcctttggccgtgccgccgcctttggccgtgccgccgctccggccgtccgccgccgcctttcgcgccgtccgccgccgcctccctccgccggtcgtcgccgtcggcagccgcgcgcgccgccgccggtcgccatggtcgccggtcggctttgaagccgaaccgagccaaccgggtgccgcccccctcttcccccttgagccactgcccgtggggcccacatgccggcgccccctccctctccccttgtgccgctgacatgcgggccccgcctgtcggcacagctcgcccaccctcactgacgtcaccccccctcactgacatcagccctgggtattattgcgcaataaaataattaaggacttttactttattagtaaaaacacagtttatcttctaaaattcataagtaattcactcgagctccgtttaagtccattcaagtctcagtaaattcataaaaatgcaaagaatctattaaaaatggttttgtttcctgtttcagtagtcttatagcatgttttgcttgtgtgctttgtttgtcgtgtagttttcggccgtttcgtcgatccgcggtttctcgaagacgttgctgaggtctcatcagtgtgagagcaaggcaagtcatgcattacaattgatcatattgtacccaatttacaaatatcccgcatttctattaaatgtcgcattattttacaatgtcatgtgggatgggtcctattactcagccatttattg

SEQ ID NO: 2366 - DNA, 666 bp, Oryza sativa
tgcagttttgttttgctgcgggattcggatttgttttggtttggaaacattccaaaaaatcccgtgtgtgaaaaccggatggaattccgattgggtacccctgaattattccggttcggttaccccgacccccttgaaaggcaacttttttttttttaacccgacccgttgctttaacccaccacacccaaaatcaatctagggttggcctcctactttgtactgccccgtcgttcgtaaactactccatcccgctcgccggcgtgcaccggcaatcgggaaagcaggtctccggaacctctgccttcgatgtcctgcaccgggagaaggtagcaataaggtttttgggaagcgcttcgcgcgactgctccctgttcgttcgcgacggctcgtcttcctcttcgctcgcgtgcttcgcgccttcgtagacgctcgcaactgcgagtagttcctgccgagcaaccggtctttccgccacacctcggtattgtgttccaacattgtttgccgccaaatttaaaatttttttttgggggaaatttccccccttggggggtttttcaggttttactgcttattacatgtgtagatctaatgatgcgttcaatctagtttacatctgcaatgtcatgatttatttatggaataaattaaatcattatgtgc

SEQ ID NO: 2367 - DNA, 611 bp, Oryza sativa
tggagaggactatagccaaggaaagcacaccggattgatctaaaagaaagcttgcgatgattatatggtcgtaggtttggccagcaggcacacccgaacacgcgcaagtggctgaactcaggagttgcagagaaaagttgttcaaacggcgttttgaatgagatagcagaactaggcaacctgttaatgagatatgtggcggtaagaaaggcttcatcccagaattttaaaggaaccgaggcttgggatagaagagcaaggcctttctcaactatgtcacgatgcttacgttctgctgagccgttttgctgatgcgcgtgagggcaagaaacatggtgagttatgcctatcttctggaaaagggagtttaatttctcgtactcaccaccccaatcggtctgcatggtgagtattttggttttaaactgtcgttcgacatactgttgaaagtttaggaaggcttgaaagacatcggatttctttttaagaagatagatccatgtgtatttgctaaaatcatcgatgaaactaacataataatcatgtcgcccaacagaagtgggcgccggtccccaaacatcagagaatacaagagcaaacggaacattaga

SEQ ID NO: 2368 - DNA, 2272 bp, Oryza sativa
gaggtgagaacacttccacatttacaggttgttcaatgataacaaggggaaatggactcttcgctccgaggggtactttcaggaactaggatggagcttagagggggcatttgatgagagtgtccttctctggcatcttgccactgatttctgctattacactagtggatcatatggccgtgaaagatcgattcaccacaagagtgctgttcagtgccgagaactatccaactacatgatgtacctgctgtttgtgaatcctgagatgctgatgccaggcaccaggcgaaacttattcacaaatgcctacaaccaactaaaggacatcatcaaggatgagaatccttgattgaatgaaaaagaacttgtcttgagaatatttgatttcgtgcagaacccagtagagtcagcagacgctaggcgaaacttcttcacaattgcctacaaccagttaaaggcatgtatgcagagaataatcacttggatgcagcaggaacggttggtacatagaaagataagaaacactttggtgcatgagccactaagggcacttaggcatcgaataaccgccttgattgagaaggcacttgtggcacgaactacgccaaattttgttagaattgtctacaacaaactggaggcatttattcagagaataatcgcctcgcggcagcagcccctcgaggagataaccaatgaagacacaccaccatccgatggaacagggctcatcgatgacgcttggtccattgctgaagagctcctgaagttagatgacgaggagaaaatgtggagggtgattgaaggcgtgtgggtggagatgctctgcttttcagctgccagatgtagagggtacctgcatgctaagagcctcggcacgggagggagttcctgagctaatatctggttgctcctgcattatatggggatggaaaccttggcagagaagctgtcaagagcagaccttctaaacagagaattctttagctaattcatccactacccatgttggtgagccctccggcataattgagcgagttgctggtccattgacttctcatgatagcagatctcattgtgatgaaagagtagcggatccatctgccatcggagagataagcgtcattggggaagaacatgtgtgatgtatcacatatggtggttatgagagcagtgagtcccattttgtcacttttattgcacatcatgtttcaattcttctttcaatgctatgttttgtgtgattcagtgagtcatgtatcctctctaatgtcctgcaactctgtaaatattgaacctattttttggatgcctaatgtcctacaactctgtaaatattgaacctgttttttgaatgccatgtgttagagtgcgcagcccagcccaccaactatgggccaccccaggttatattgagcctgctccaccacaggcccaaccggagctacaactttaggtcctgagcctacacaaccagaaagactagtctaatggatgaggaccgccccaccttttaagtcgtgctccctcatcatcaattaccgatgtgggattaaacacaacaatctcccccgtcacatcaaccaatgtgaccccgaagacttgttacctgagcctcgggtctaacaatctcccctgtcacatcaacccatgtgaccccgaagacttgttacctggcctccccaccatgtgacccatggaaatcgttccgggactaaacccaacaccatgaaatggaattagcaaccatggttgcattcagattcagaatcaagcaaaatttgactgcaattcacatcttttctgtttattaggcgtaaaactgaactgtatgtgaaaaaaacactttaaaacctacttggggtcgaaaactgtatactacctccgtcccagtatagttgtcgctttgagtttttgtttgtaacttttgatctttcgtcttattcaaaaaattatggaattatcatttcttttgtttatgatttgctttattatcaaaagtgctttaaatatgacttttctgtttttatatttgcactaatctgttaaataagacaaatggttaaacattacaagaaaaagttaaagcaaagtcaaagcgactaccattttgggatggaggtagtactaaattaagtagtactactaacatatagttgtagtgcagtcaagagatataatcgactcatgaaccacatgctgcaagtatgataaaaaaatcaagttgaagatgccggtaaaccctagccgccgctaccgccaccaccgagtg

SEQ ID NO: 2369 - DNA, 2904 bp, Oryza sativa
tatgcatctcgcctaaagagaaaaaaggacatcttgtatgcatcatgtcacacgttttcatgccccataacttcgatttcatgataggaggatggaccagcgccatcttcatcaccataggctcctctagcatgagaagtcgatgcaccaggagcttgctctttgccataggagtctccagcatgtttagtggatgaattacctgagcgtgctccgtttgggagctctgctctcgccagcttctctgccaaggtctccattcccatgtaatgcagaaggagccagacatagcttaggaactccccgcctgtgccgagactcttagcgtgcaggtagcccctgcatctggctgcagagaagcagagcatctctacccacactccttcaatcaccctccacatcttctcctcatcttctaaattcaggagctcttctgcaatggaccaagcatcatcgatgagctctccttcattctcctcgtgtggctgctgaaccttgacgataattctctgggcaagttctctttcattcagtgacaggttcttctccttgacgatacccttcaattgtttgtaggcatcagtgaacaagtttcgcctgctgcccgccaatagcatcccaggattcacaaatagctggtacatcatgtagttggacatttcttggcactaaactgcacctttatggtgaatagatttttggcaccaagtagggcatccttcgttgagaccagaggaaccttgtatacacaagtcgtgagatccatgttggaattaatagatgggctaaggcccattcgaagattaattctttggaaaatcgcaaaaacccacctcatgggatggcatgcatgtggagtttagtaccaccttgcttattctagaagagggggacctccttaaaagggaggatgccctcctagtcacttgaagcatgtgtggtggagagaagagggggaaacacacgcgcgcgctcgctcgcctggccgggccggcggcgcgcgcacgacgtacgtgtcgaatgctcggcaaaattggctcctcacccttgcgcagatgcagcctccttttgcagttttgttttgctgcgggattcggatttgttttgttttggaaacattccgaaaaatccggtgtgtgaaaacggcatggagtccggataggttacgcgcgacttatccggttcggtttacgcgggcaccctgatcaggcgatctatctctatataaaccaagccgccgccttcacgcaacacacgcgaaatcaatctagggtttgccttctactctgtactgcgtcgtcactcgtagactactccatcccgctcgccggcgtgcactggcgatcgggagagcaggtctccggaacctctgcctttgacgtcctgcatcgggagaaggtggcaataaggtttttgggaagcgcttcgcgcgactgctccctgttcgtctgcgacggctcgccttcctctccgctcgcgtgcttcgcgacttcgtcgacgctcgcaaccgccagtagttcctgccgagcaaccggtctttccgccacctcggtacgtgttcgatatgttgcgcatatttgatctgttcatgttttactgcttagtttacatgtgtagatctaatgatgtgttcaatctagtttacatctgcaatgtcatggtttatttatggaataaattaaatcattatgtgcttataattataacaatccaaaaaccttattataggctctgtgattttactatgattggttttgccgatgcaatgaggccggataaattcacaggtgtgcactctaagagatggcagatcagggtcactatgtggctgacggctatgaaatgcttttgggtgagtactggcaaacctgaaggaattcttactgctgatcagcagaagcaattcgaggaagccactactctctttgtgggatgcattcttagcgttcttggcgatcgtctggtcgaggtgtatatgcatatgaccgacgctaaggagttgtaggatgcactgaatactaaattcggtgctactgatgctagcaatgatctgtatatcatggagcagtttcatgactacaagatggctgacaaccgttttgtagtcgaacaggctcatgagatacaaaccatggctaaggaactcgaactccttaagtgtgtcttacccgacaaatttgtggccgggtgcattattgcgaaactacctccatcatggagaagtttcggtattgcactcaaacacaagagacaggaatactccgttgaggggttgatagcgtctcttgatgttgaggagaaagctcgggaaaaagatgccgcgtctaaggacgatactgggcagtccagtgccaatgttgtgcacaaggcccagaacaagagcaaggggaaatgtaaagctcaacagaccaccaacttcaggaggtagaagaccggataaattcacaggtgtgcattttaagagatggcaaatgtcgcgtcccaaatcgactctaaaatacatcctcgaaattgtgccgagaataattaaaattcatgtgaaagcctccaacaattaaaatgtgcaaagataaaagtcaaataaggcttggaggatttttgtatatttcctaaaagcctaaaatgcgtaaataaattttagtggaattttcagagcacaaataataattgagaagaaataaacaaagttgaaaaggtttataaaaagaaaaaccctaaaagaagtcctctttcccccccttcctttctggggccggctcggcccacttctcttccctccctctctctcctctcctccggcccatcggctcctcccccgcgcgcgcgccgctgacaggcgggcccgcccgccaccctcgctgacgggtggggcccacctgtcatcgccttcctcgcgccgcgcgc

SEQ ID NO: 2370 - DNA, 13472 bp, Oryza sativa
attggctttgagcaactaaatgtctttagatgctgtttactgcaaccctatcccctttatattataattcccttgtactcccttgcatttattctgcatttatgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgatttgtatcaacttttggtgtaccttgcctcctgggacaaggattaatgcacgcacgtaaggaatgcccgttgggttatttccggtcgtgacaagttggtatcagagcctcccttgaccctaggacgagccgtagatcccaagccttagcagtattttcaaaaataaaaatcctttgttatttgtgaaaactgtctagtctctctctgtcttgctgcttcatttatcgtcaaaatctgatctttaaaatgttgtttctctttttgtttttgtttgtagatggccggcagcgtcacccgtcgtggtttggacatgactggcttcgtcttggagctgcggggcatgtgcgtggtcctggggtatccacatggagtggactaccaggccaggccgcttccggatcaggagggtgacgacgcggagccccacgctggttgggaggtcaccgcagtgatcctctctggctctcccgagcggacttcgctggcagtcaccgcgggtggagactccttccccgccgcttgccagaacgccgctctcctcgccatcggcacccttcaccagcgctacccggacgagttgcagcactcgccctaccgctaccaccctcgtcgcggaggagcctgcgactacgccaccttccgggatgctagctcggaggatgacgctaccatcgtgcacctggcgcgcatggtggaggcgtacgacgcggctcgtatcgacttccatcagatggtgcgtcgcgggatggtcaagagcaatctgatgatcctggagctgcgtcaggagaacctgcagctcaagaagaacctcgacgcagtggaggcgcagctgcatcagctcaagatcacccagggagagatctgccgccccaagcgtcgccgtgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagccttcggcgttggtagcacggagggtgcgctgttgctcaccttccgtcctggcccgtcgcagcagtagacgagcagttagtaggcttgcgcgtgtgtttttctcgtttgtcttcttgttgagtcgtgtggggcatggttatgccggtgtgtggcataactatgtcggagcctgtcttattttatttgcctaaacaacttgaaccttaatgaaccaatttaatagcagtaataaatgtaagaataatggttgtcgtgggtggttagttttaattgttagctccttctctgtttgctggttctgtgtggggttttcagatggtgacgaccaggagaaacgctgctaccggtgatggcaatcaacctgaaggcagcaccacaaccaccaaggcaacccacctccacctcctcctcatcagccaccaccaccaccagacaccaacgccattctcacccaaatcctcgcccagcaagccaacatgatgaatgctttcctccaccacctccaaaatccgccacaacagaatgctccaccaccacctccccaacactctaaactcgccgagttcctccgcatccgcccacctaccttctctagctccaacaaccccgtggatgcgttggattggttgcatgccgtggggaagaagttagacacggtgcagtgcagcgatgaggagaaagtcgtcttcgccgcccaccagctgcagggacccgcatctctatggtgggaccatttccaggctacgcagccagaggggcaacctattacttgggctcgcttcaccgccgctttccgaaggacccatgtgcccgctggagtcgtggcacttaagaaaagagaattccgagagttgaagcaaggcaaccgctccgtgatggagtatttgcacgagttcaacaacttggcccgttacgccccagaggatgtgcgggaagatgaggagaagcaagagaagttcttggcaggaatggaccctgagctgtccgtccgtctagtctctggggattatccggattttcaacgactggtggacaagagcatccgcttggaagccaagcacaaggaactggagtcgcacaagcgccgcttggcaaatttccgcaatcagcagggtgctaaccagagggtccgctacaccaatccctatccagggggatcctcctcgcagcagcaacaacagcagcagcaacctcgctccgcgcctcgacctcaattcgtggtgcgcgtcccacagccgcagcagtagcagaatcagcaagggactcgtgcgccccgtcctcctacgccaactgtgcagtctggtcaaggccgcagggacgcttcaggtccgcagcgtctgtgcttcaactgcttcgagcccgggcactttgcggataaatgcccaaagccaaggcgtcagcaaggccaagcgcctccccgctccaacaacggcgggaaggatgtcattcggggtcgtgtgaatcacgtgacggccgaggacgtgctgacaactccggacgtcatcgttggtacgttcctcgtgcattccatccctgctaccattttgttcgactctggagcttcccactcgtttatatctgtgccgttcgtggggagaaatcagttgggggtagaaaggcttagaaaccctctgctcatcaccacccctggaggggttatgacagcaaagtattatagccctgccgtccctatagaaattcaggggattccttttccctcggatctgattctgctagacaccaagaatttggatgtgattcttgggatgaattggttggctcaattccaaggagtagtggattgcgcgagacgcactgttactctgtaccgagggccggaacaaccagttgttttctttgcacccccaaccaaggtagctcgatttattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagctgggtactcgattaaatttcagcaccgcctatcacccgcagacagatgggcagaccgagcgtctaaatcagatcctagaagacatgcttcgtgcatgtgtactagatttcgggaagacctgggataagagtctcccctatgccgagttctcctacaataacagctatcaagccagcatacaaatggcaccttatgaagcgttgtacgggcgcaaatggcggacaccgctattgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacttggaattcgcagtggatgactttgtgtaccttcgggtcacgccattgcgaggtgtacacaggtttcagacgaaagggaagctcgcacctcggtatgtgggtcctttccgtatcgttgctcgacgcggagaagtcgcttaccagttggagctgcccgcctccttgggcaacgtgcatgatgtgttccatgtgtcgcaactcaagaaatgccttcgagtgccatccgagcaggccgactcagagcaaattgaagttcgtgaagatttgacctacgtggagaggccagtgaaaatcctggacaccatggagcgcaggaccaggaaccgggtaatccgtttttgcaaggtccagtggagcaatcacgccgaagaagaagctacttgggagcgtgaagacgagctgaaggcagcccatcccggtctcttcgccagttcttccgaatctcggggtcgagattccgtttaaggggggtaggtttgtcgcgtcccaaatcgactctaaaatacatcctcgaaattgtgccgagaataattaaaattcatgtgaaagcctccaacaattaaaatgtgcaaacataaaagtcaaataaggcttggaggatttttgtatatttcctaaaagcctaaaatgcgtaaataaattttagtggaattttcagagcacaaataataattgagaagaaataaacaaagttgaaaaggtttataaaaagaaaaaccctaaaagaagtcctctttccccccctccttcctttctggggccggctcggcccacttctcttccctccctctctctcctctcctccggcccatcggctcctcccccgcgcgcgcgccgctgacaggcgggccgccaccctcgctgacgggtggggcccacctgtcatcgccttcctcgcgccgcgcccgccgcccgcccgtgccctagcgccgccgccgccgccgaatccgccgcatcccgccgtccccgcgcgcattaaagtggggggaattactccccgcgattccctctcccgattcccccactttcccctctctctctccctcggattcgtccgattttgtgcccgcaaagttcgccggcgcaatcaatggcggccgagatctccgcgccggtttccatctcctccggccgctttccctctctcccgacgctatttaattgttccccgtgcctctctcctccgtttccgccgttcgccgctcgccctcaccgtcggaatcgcgctcgcgccgctttcctctctctccgccgtcgccgacgagttccggttcgccgccgccgtcgctccggacttcctcccctctcggcgtcgcctccttcggcttcgccgcgtcgtcgtcgaccccgtccgctcctccgtttcgctcgccgaccgtcggagcgccgtcgtcctcgtcgtcccgaaccgcgccgccgccttcctccgcttcggccgccgttcccgtcgtcgccgtcgaccggggtgagccgaagaccgctccattcgcttcccccttccctcctctctctcgggtgccgctccgccgcgccggtggtcgccggcggtgaccatcggggcgcgggcgcgtccccctcccgtcggccgtgccggcgaggccgccttcgggcgcgccctcgcggctgccaagtgggcccggccgtcagccgcccgcgcccgcgggtgcggctgacgcgtgggacccacggcgccggccgccgtcagccgcgtgcgcccggtccaccgtggaccgagaggctgacgcgtgggccccactcccgtggacccggtccgcgcgccctctccctcggctgacgcaataaacccggtttttaattaaaatttaaatgaagaaattcgtaaatatccatttaaagagcatataaacttcaaatggccatatcttggccaattgaactcggaattggaccgttcaagtctctaatttttccttaagaagtcaagaacccatttttgtgctttgtttctgctgttatgtggagtttattagagtaaaagcctttttcttttccgttggttgtgtagacgctgcagcttcggaagatccgctcttcgtggaagtcgaagccgtcggttgggaaagcgagcaaggcaagtcacatcatctttgagcatattgaatcccagtttataaaattatgttgatttaaattattgcattatcgctttatttaaattcccgcgttaccactgttttatttagccatgcctatttacctttgttatgaccatattattattgttattgttaatattattaccttgttcaccctagatcaaacaaaacctcaactagtggacactctactcatggcaccactagtttaattttaggtagatgcttcgcaatttaattaggtaacattaggtggttttacaactctagactttgggatattctcatcacctggacacactggaattgttggatcattgtggaattggcttcacaccgccccctctattcaaaatcccctaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctagtcataaacaaaagtacacggattggagatggatgaagtcgggggtcgatagacattctccagggcaaatgaaggttacacgagctgcggcccggtagtcgagatgtcattggcagagggttggtgccctgctgctaggggctcagtcttgcctgcctgtcccgggggtttcggccgtaggcaggattgggtcggtactcttgtctatggctaggatgggttggaaactatgtcacgtcttccgtctgtataccatggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacctgcttaacaactaaaatgtggaatggttggcctaggttggcttaggacgagctgggacccagggtcgggttgccagttcggtctgaatcatcataggccttgggttaaggcaggttcgtgtgggttcacggccttgattaataatattgtatagttctaggatcgggtttacaaattggctttgagcaactaaatgtctttaaatgctgtttactgcaaccctaacccctttatattataattcccttgtactcccttgcatttattctgcatttatgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgatttgtatcaacttttggtgtaccttgcctcctgggacaaggattaatgcacgcacgtaaggaatgcccgttgggttatttccagtcgtgacagcaaatcagggtcactctgtggctgacgactatgaaatgcttctgggtgagtactggcaaacctgaaggaattcttattgctgatcagcagaagcaattcgaggaagccactactctctttgtgggatgcattcttagcattcttggcaatcgtctggtcgaggtgtatattgtcacaccctaaaaattcaaaatctataaattgttgtttaattggaatttttagaaatgattttaaaagccttgaagagaagatctaattttaattaataaattccaatataaaatggggccagataaaatttcattaaatactttgcttaattttataattcctagatttttctgggatttatttgagctaagtaagtatttttaataaatgcaattgcatttaaggaataatttaaattgaaaaaggttttaaaaagtctcttttggctttgggccgaaagtcggcccaaaacccttctctctctcctcggcccaagtcggcccagtccgcagccgcgcgcgcgcgccctcgctcgctgtcaggtggggtccgcctgtcaggtcgtcgtcttcctcgcgtcggccgctgcccgaaaccctagcgccgcgccgccgccgtttccttccaaatccggccgctcctttccttttccggtgaaatcaatagaggggaaatgatcttcgagatctcctctaccttttcccctttggaaacatcggctaaatcggtttggaaatcgatggattcgagtttgcttcggattcgtttttcccgaagtttccttcgtcgtcgctggtcgccgtgggccttcgccgtcgcccttgaacccctttaaaaggatccccgagctctcctctacccgtcgccaccctcgccttcgcctctcgtcgtcggaagcgccctagcgccgtgagacctcgagccgcagtcgccgccgtcgctccagccgtgcgccgccgccgttccggtcgtcgtcatcgctcgggaaggccaccgttgggatcgccaagtcgtcgccgtccttgtccacccctccgccgtcgctgttgaccgccggagcatcgccgtcaccgtcgacccgaagaccgccgccgcttcaacctcgtcgccagtgctgtccgttcctcttccgccgtcgctttggtcgccggtgagttcgccgtgccgtccgctacccgttggtgccctccgatcgtgccgaagcgccgccgttcgccggcgagcttgcgccgtccgagctgtcgagccgccgagccgccgccgccggtggtgacgtcatcgctgacgtcatcgtccccgtctcccgtgagccggtcgtggaccgatcgatctcggccgtccgttttggatggattgatctcggccgtccgttcgcgtgaaccgccgccgtgcacccggtccaccgtaaccctagccgctgacgcaataaatcccctttttcttttcaaaaataattcattattgcgtcataattcaattaaaatacatataagtgttttaatccgattaaatcttcaaaaattcataactaattcatcttagctcggatttagttggttcaagtctctaaatttttctaaaattgagatctacatgttaaaaatatccacatgtacagttcatgcttgtttatgtattgttttggtgtttttgcttctttctgtttagattccgacgtttccggagagtccgttttcgcaggagaagagtttgaagagttccaaggccagcaaggcaagtcacacagatcccgaacaaccctttgagcatgttgatcctatttaaagctgttgtttctattcaactattgcatctatttacgaatgtcattgggtggaattaacctattgtttgttatagccctttttgttcttgattactttactccttgatacctcgggttattaaaatttgactagttgggctatatatattggttcagctagatattagatatgattgcttagccctgcttagaaacattagcacactattgggataacttatgattcacttttatttaatgatggcttaatgatagttcacgatggtcaatcgtgattggttaattaattaacgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggagcaccagactgagaagtggcggagataagcccacgggggtcgctggggagtccatgccttgtttataagggggtgattatgatccaggaaggtgcgctgcagtggattgtgttgtataaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgatttgtctcacacctctcatcataatgcaagatactataactggtaataatttgtttagctcctggtttggaatggtatattcctggtttggagatagatctgtacagccgggtatgttgtatagtgttggattaatattgtttaattattacttaactgttttattaaattctcaaatgtttgctaaatgctgcttttgcaaatgaaaccctattatgcgatcctttgttatcctgtgcacttgcatatttgctgcgtggcttgctgagtatgtcatatactcaccttgcgatcattcatcagaggaagagttctacaatgatgctgatggtgtggaggattaggtgtagccctggtcaagttgcctgtggagtggagccgtctgcgccgtttattttattttccgctgcttagatgtcgcgtcccgaaacgactctaaaatacatcctcaaaattatgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaagggttttataaaaagaaaaaccctaaaaagtctttttccccccccccttcccctcttgggccggctcggcccacttccctccctttctctctcctgtcccccgcggcccaatcggccccctccccgcgcgcgccgctgacgggcgggcccgcccgccaccctcgctgacgggtggggcccacccgtcatcccctacctcgcgccgctcccgccgccttgcccgtgccctagcgccgccgccgccgcgaatcccgccgcctcccgccgtccccgcgcgcaataaagagggggaaatcactccccatgattccctctccctttccccccatttttccctctctctctcgcgttcaaacgggcggatttgcccccgcaaacctcgccggcgccattgatggagcccgagattgccgcgccggtttccttcccctccggccgccatctctcactcccaacactatataaacgatcctcgtgcctccctccaccgtttccgccactcgccgctctctctctccgccggaaccgagctcgcgccgtcgccctctctctccgccgtcgccaccgagctccggtccgccgccgtcgtcgccccggacctcctcccgcttcggcgtcgcctccttcggcttcgccgcgtcctcgccgacctcgtccactcctccgtttcgcccgccgaccgccggaacgccgccgtcctcgtcgacccgagccgcgccgccacctttctccgctccggtcgccgttcccgtcgccgccgtcgacccggggtgagccgtggaccgcccatttcgtttcccccttccctcccctctctcggccgccgctccgccgtgcctatggccgccgccggcgaccataggggcgcgggcgcgccgcctcccgtcggccgtgccggcgaggccgccttcgggcgcgccccgcggctgccatgtggggcccggccgtccgccgcccgcgtcgtcgggtgcggctgacgcgtgggacccacggcgccggccggcgcaagccgcgtgcacccggtccaccgtggaccgtgaggctgccgcgtggtccccactcccgtggacccggtccgcacgcccctcccctcggctgacgcaataaatccgattttttaattaaaatttaaatgaagaaattcacaaatatccatttaaagagcatataaacttcaaatggccataacttggccatttgaactcggaattggaccgttcaagtctctaatttttccttaagaagtcaagaacccatttgtgtgctttgtttctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatctttgaacatattgaatcccagtttacaaaattatgttgatttaaattattgcattatcgctttatttaaattcccgcgttatcactgttttatttagccatgcctatttacctttgttatgaccttattattattgttattgttattattaccttgttcaccctagattaaacaaaaccccaactagtggacactctactcatggtaccactagtataattttatgtagatgcttcgcaatttaattaggtaacattaggcggttttacaactctagactttgggaatattcatatcacctggacactttggaatggtttggttattgtggaaatggcttcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggacgaagtcgggggtcgatggacatctctaggacaaatgaaggctacacgagctgcggcccggtagtcgagatgtcatggcacagggccggtgtcctgctgtgtcacgcccggaatttctatccaaaattccaaacgcttacatgtgtgttaaaccctcgtccaggaatcaaccgagacacacaatgacaatattgataatagagtacaattaaataactatttaatattcgcaaataataaaatattacagaggtagataattcctcccaaaaatataaaacattctacgcagcggaaaaataaaactataacaaactacagaacagctatgacgactccactccacaggcatcttaaccgagaacaagcctaatcctccagatcatcaccttcactgagatactcctcttctgatgaatgaatattgcaagaatgagcatatgacatactcaacaagccacacagcaaatatgcaagtgcacaggataacaaaggatggcataatatagctcatttgcagaaaatagcatttaataaacatttaagagaatagtaaaacagttgaataattaatcaatattaaataaacaccatacaacacacccatgttgcataggcccaaccacatttgaacaacccaaccccagttgaacaaattgaacctccaaaccaggaattgtccattccaaaccaggaattaaattaattaccacattattaccattaatgagtagtgtgagactaatcacgaaaaacattgctcaactcacccataaccatgggtacggctattcgaatagtttaaactctgatcagaggtgtaccactgtacccacaagacacaaccccacatcatgtcaccatgtgcctcaataccaccacggtacctcggaaaggagtcgtgacaataccccttgcacaacataacccatacagtgcaccttttctgatcat

SEQ ID NO: 2371 - DNA, 748 bp, Oryza sativa
gatctgtgtgactggcctggctttccacaacgcttcggagccttcctcgacagaaacgctctcctccgaacggtcggatactagagcaattaaactaaatcaacaaaacagtgcaaaaacaagcataaacagtacatgtggatatttttaacatgtagatcttgattttagaagaatttagaaacttgagccacctgagacggatctacggttatttagttatgattttccgaagttttaatctattagaaaatcgagaaaaagaaaagggaaaggagatgatgacgtcatgctgacgtcagcaatggcggccggttagggtttgcgagctcgccggagctagggcggtcgaccgggtgattggaggacacctacgcgtagaaaacatcgagacgaacccgatggtactcaccacaacgtctatcgacgaacggtgatggccggcgacgaggaggaaggcggtggcagctcggcttgacggcgacggcggagctccggtggtcggcggcgaaggaggacgggcggccgagcttcctcacctccgtgcgcacctaacggcgacaacggcaagcggcggagacggcggacgcgtcggcgcgacatggccgaaagatggccggcggcggcggcggctaaatgcacgtggcggcggcgctacggtgcacgggagaggacgagagagggggcaaacggaagaggacgacgaggggaagctttataaagcattggattgaagagatcgaactcc

SEQ ID NO: 2372 - DNA, 782 bp, Oryza sativa
  unsure (1)..(782): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcctttattttcaataggtacacatagcagaatctagtgcaatcttctatcagtgtcatgaaatatttctttccccctttagtcaacacgccattcatttctcacagatcggaatgaacaagttctagtggtgccaaatttctcgcctcagatgccttgtgaggcttgcgaggttgtttcgattgaactcaagtatgtcacttagagcctttgactaaagtgaattttggaattaaactcatgttggctaagcatgtcatacaaccaaaattcacatgacaaa

SEQ ID NO: 2373 - DNA, 437 bp, Oryza sativa
tggccatttgaagtttatatgctcttaaatggatatttacgaatttcttcatttaaattttaattaaaaaccgggtttattgcgtcagccgagggagagggcgcgcggaccgggtccacgggagtggggcccacgcgtcagcctctcggtccacggtggaccgggcgcacgcggccgacgggagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggacgaaggcggcggcgcggttcgggacgactaggacgacggcgctccgacggtcggcgagcgaaacggaggagcggacggggtccactaccacgcggcgatatcc

SEQ ID NO: 2374 - DNA, 2706 bp, Oryza sativa
cagtggcaaagccgctaacggtttggcgggacttctagaaagtaaaaaatgaacccaaacaataattatgttcgattttaaaaatcccaataacaataaagaaaggaggcaacggatggacattagaggagtcgagtggcagtgtttgatgggatttctaaaaattataaaaacgaaacccactaagacaataaactctaaaaattataacatcaaaattttaaagtttccaaggagaatgaataggaaaagtgatagatcgagcaagcaaataaagaatagggtaacttttaaagactataatattaaacacgaggatgatatggtttgatttttaaaagttttaaaataatgagataactattcaataaaatttaagtaaaatcatattaaaaatagataatttcatatggatgctagccgcgcaattgcgcgggccacccagctagttaaaactaaaaacatctcgaaacaaagaccacagcttctcccctgcatcccaaactgtgtttttctccataggtacaagaccctttcaagatttcgtgccgcaagcgccgtgtcgtccatcccatgccgcaagcgcaggcctccacggcgtagcggccaacgcaccggctctatccccggtctctcctgatctcctcgcctttcctcgtcccacttggagaagctcacgtcagccgtcctcaccgcacagggagccaccgcagagcaacagcactcggacccagccgcccggtcaattggtacaccaccatccatccccgtgagcgagcccatcccatcatcccacctcgccaaggcgccacgtgtgtttccatttccatattttttgccatttctatttttgtttcggtcgattaccaatttcacatggctcggccggtagaaagtcgaaaacaaacaccggtcggctcacccctgactaggcttccttatttctcgatcctatcttatctctttcccatgtatttctatattattcaacatcatatcagagcggatcatttagtcaactctctcacgcttccgccgccattgtccccgagtgggttctaatctcctggggacagccatccccactcgtttttttcttcatcgatgtcgttctcgtcctagagagatcaatctcctggtgctgtgcgtcgtcgtcttcgtgtcgttgaatcagcagcaacagcaccagcgacctccacacgtgcccggccagtcccttcatagacactgttccgttatcaaggacatgtcgacgctggtgccgagtcgctgctgccctggaacccctcgaccccgacctcatgccgtcacgggcggatcttgtcagccctcgccaaccatcgatcccgccgcccgatctggaggacgagcgcgccacctccggctcgtgcagcccaggttgtcgccaacacgctgccatcgactcctctgcagtcatcaccgccactcttaattaccaccactagccctcacctggattccaccggtcgagcacgcctgccgggccgcctcctttatcgacttcagccgtgatctgctctgcttggcgccctccaccagcccccacaactctgggatcctctactccatggccactgacttctcgctcgcaactatcaaacctagcaaacttatatcaaggtgggctatatatggctttcattttggcataaaagcaagttttagttcacaatcttttgcaaagggattttataaagcaattcaaaccatgaatatgaatatatcacaatatttataattgtaataacataacacttgttgtcctccatggcaacaagtctcatgatcatcgtcatagtcaccaaaactcaacacaaatcatcattccaatgccccattttcataaacacatttataaatcaagtactcatgacactccaccaagtcgctcatgactctgcctatttggtacaactttaccaacatgatgtgtatcactctagtctgtccggtacctgttggtaccaccgcacaatacacgttgaatgtggtctagaggtcacaacacaacctttatattatctaatgcctagccttgcaccagcacgatgcatgttactccacattacacctagaatgtagtgtcgctaggtggtgggtccatgccttgaacctaacaacgtaggcacaaccaacgtggtcccctacgaagcacaacaccattgtattcgataaacttagacgcccatgccgtgaggcggaatagttagtcgtcccctcccccgaacacacacacgaatgaatcatccgcacatcaaacacacatacacacatggatagctcctctagacaggtcattaaataacttaattggctaaggccaccccataaatagaacttgtggatgcacgatatactttaattggtgacacgaagtttagtccttaacagaggaacttgccttattctttggataaatcggacaactcctaaatctctccttcaccactaacgcaattaatctatacaaaatgacatgatatgcaaataccgagagatgcaaaaaaaatccaaaatgctctaaaatgcatgatttgtgcgcagtgggttggtactgacctatgatgaatttaagtgagagaatttctattttatcacttttcttttgggagttatgaattttataattatgctctattaaattttttatgcagtttagaatcaagtttttttaagtttcgggtc

SEQ ID NO: 2375 - DNA, 2796 bp, Oryza sativa
ttcggcccaacccaccatgccaccgttggatgcaggttttgactggacggttgagatgaagccccaatgacagttggagggtattaccgaccattgtaaccatcacaaccgtcatagttcagctataaaaggagctcctcttcttacttcactcacacacttcaagcaagagctctcttatattctctcaagttagtttagtgttcttaaactagtggaataggaatagagtagaaataaggagtttggaagtcttctgaagagttcgggtatggctctagtagctttcctttcctcttttgtaagccttgtactttatttagaatactcttctttatacatttatggtattgaaatactttccgagtatattaatgacaactttacattatgttcgtgttatactgaatatactgctagcttatctaggacatgctttggtgcgggtataatgtttgcatatgcaattactctatgtcgtgacgatgatattagagtagtatccggtagtttagacgtggtgtctagattacgggatatcattatttggggttatatgctgcggatgagatgtgggccgctgatggtgacagctcagtacgggtattcctccgcgcgtgtatataatactacgttaattccctggggagggtactcctacgtatttagccccggttgtatggtcatgacgggctgtcataagaaactcagcagtcaggggtggcttttcgaagtaccaggagggcattggatagagggtattagctagtatatcagaaaactagaatgtatgtatactatgtatactagaagtataggagtagattatctttctcttttctttccacttagcttatataatttagtatgagaatgagtagctacagcttgtgtgtcactctacccttggattatcttaactcctgcttaggatatgattatcacaagtaatatataaattattagtcaatttctttctacatgatcttcccacgggataaaataaatatgatactcttagaatactctcgggtgaaatggtacaatggtatatccgtgcgtttgtgggtgaactctataaccataatataacatgagtatttatgcgccattgctgggaattatatttttagtaatgtcgttaagaaataccaacagacaccatgttgccacgatgcactaggtcccacgttgcaacaaaccgtactctcgtgaccgtgcgtatcggctattagattcgtttgtaaatggattactacgaatatattgcaactgaaaaccccctatagccagtaatctatttactactgcctccgtttcaggttatttgactttcctgaaacggaggaagtaacaaacgaacgagacacgtgtcgatctgtaaattagaattgagcagcgtttttgtcacaccctaaaaattcaaattatataaattgttgtttaaatggaatttctagaaaataattttaaaagtcttgaaaagaagatctaattttaattaataaattccaatataaaatggggccagataaaatttcattaaatactttgcttaattctataattccaagatttttctgggatttatttgagctaaggaagtatttttaataaatggaattgcatttaagaaataatttaaattgaaaaaggttttaaaaagttctcttttggctttgggccgaaagtcggcccaaaaccttctctctctctccccggcccaagtcggcccagttcgcagccgcccgcgcgcgcgcgcgcgttcgatcgctgacaggtgggtcccacctgtcaggcccgtcatcttcctcgggccgaaaccctagcgcgccgccgccgagctgccgccgccgttcctttccaaatccggccgttcctttccgtttccggtgaaattgattgaggggaaacaatctccgggatctcctctaccttttgtcctgtggaatcatcggctaaatcggtttggaaatcgagggattcgagttcgaatcggatcgggctctctctctccaagccgagctttccttcgccgttgccgtcgccgtgggccttcgccgccgcctccgagtccctttaaaaggctccccggtgtctcctctacccgccgccaccctcgccttcgcctcttgtcgccggaaaagctctagcaccgtgtgccctagcgccgccgtcgtcaccgtcgctccagccgtgcgccgccgtcgctccagccgtcgccgtcgctcgggaaggccgacgtcgtgttcgccgtcgcgtcgccgtcctcgtcctccccttcgccaccgccgaagaccgccggagcgtcatcgccgtcgtcgacccgaagagcttcgccgcttcctcctcgtcgccgtcgccgtccgttgatcttccgccgtcgttttggtcgccggtgagtccgccgtgtcgtcctggtggtttccgttttcgtcctcgcgccgccgttcgccggcgagcgtgcgccgcccgagccgtctgccccgcctagccgccgccgccgtcggtgacgtcattgccgacgccatcggggtcgtccgccgtgagccgccgtggacccgatcgatctcggccgtccgtttggattggatcgaatctcagccgtccgttcgcgtgaaccgccgccgtgcgcccggtccaccgcaaaccctagcccgctgacgcaataaaccttcttttccttttcaaaaataattcattattgcgtcataattcatttaaaccgatttaagtgttttattccgattaactctttaaaaatcataactaattcatctagctccgatttagtgg

SEQ ID NO: 2376 - DNA, 8541 bp, Oryza sativa
  unsure (1)..(8541): unsure at all n locations
gttgtataaaaggtaatgtcacaactcctttcgagggtcccgtggtggtttgagccacatggtgacataatgtgggttggtgtcttgtgggtacagtggtacacctctgatcagagtaaaactatttgaatagcccgtgcccgcggttatggccgggtctaacaatgtctttcgtgattagtctcacccttctcaccataatagaagatgctataactggtaaaacttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgtttttacaaatgaaaccctattatgccatcctttgttatcctgtgcacttgcatatttgctgcgtggcttgctgagtatgtcatatactcatcttgcaatcattcatcagaggaagagttctacagtgaagctgatggtgtggaggattaggtgtagccctggtcaagctgcctgtggagtggagccgtctgcgctgtttatctttttccgctgcttagatctttattgattgagaggaactatctacctctgtaatgatattttatacgcttaataattagagtaataactgtactctattatcaatttgttattgtgtgcctcggctgattcctggacgagggtttacacacatataagcatttggaattttggatagaaattccgggcgtgacagttttttagagcaggtacaatagcaggctataagccggctgtaaccatatatcgagaagaaaagagaagagagagaagaaagcgggctacagatttgtagccggttgcaacacggactccaagatattatgtgtgtatgagaggtgggaccgtgtattaatggtgcagtatatttttatagttaactattgatgaatgggctattagattggctatagatgttttggagccagtagttggctacactattgaccttgctcttaaagtaatccatttcctatcaacaagcgtgagacacgtgtcaaccaatttattaatcccgattattttgggacagaaccacccagtagtagtccgctagcgatggtttctagaataatgctctttcagtcccctcctttactcatttttgggagacggcggcgacagaccaaatcgggccgatgtagcaacccctgccgctccctgccgacggatccgtgtgaaagactgtcccaggtaattgttgcgctctctatcaacatttctgctattttaaatctcatttcttttttatcccaaagcgaagattggagacaatccccttcttcgttgctgacattactgtccctgccgccggccgccaccccgccagatcaggccggggcggcacggatctagcggtcgccgccgccgccaccggggcgactcccctggccaccggagcaggctggcgagaagccccgccgccgccatccttacggtctttgctggcgaccgctcaggcagcggcgaggtggaggaggaagaaggagcgggaaggggtggccggacttgtcgcctccggagccgtcccgggggtagggcgacgcaagagcgtgacggttgacgctgtgaggtcccttcagcggtgggaacttcatggctgcggatcaatggaggcggtggcgatgaccacggatcctgaggcggggcccccatttgccaccccttatggcggatctggctggtggcggcgcgccaacggtgttgccaggaggccggtggctgggtgagccagcaaggcttcatggtggctggtggcctggcaggaggacggcgcggctgtcagcgacggtgcgacggcagggacctctagggccggcgcgactcgggaaggtggcgacaacgggcagccgaagaaggagaatagatggggaccgacggcagcggggatggagatgatggcggggatggaaggcggcggcgaggatggtgacagcgggccggatccagtcgcgccggagtcgggcagatctggtgtgaggcaagcccgcagtggtggcggcgctgcggagttcgcgggctcatggcgatggtggtggcagcgactggacagcggcgacaacaggtggctggccaacggtagcatcggctgccggctactgtggcaacgacgctagtggctagacggcggcgaggtggctggccgtcagcagcagcgactactgtggctgcgatgggtggaggcacggtggtggtgaccgtgactgctgggggaggcatggtggtctcagacggctagctgggggcttggcagatggctgcacctagccagcgcgacagcgattggagcaagggtcggactccgaccatcggaggccggcttggcgcagagaggcgcagccgatggtaggaggccggactggtgcgagaggcgcgtctggtggcggtgcaggccggcttggtgcgacaggcgcgactgatggcgggaggccggactagcgccagacgcgcgtctggtggttgagtaggccagcggggcgcgatgaggcgcggtcggtagtaaaggaggcgaccacgatgcaaggaggagctactggtgggtgtggcgcggtcttcggcgcaagaaggctggctagcggggggcgccagtgcagtggtcccacatgtcggtagaggttgagcggtgttggatcatcggtgggtcagccgtggactcgcaggtgatgagcggcgggtgaaaacccagccccgccttggccagaccgaaaacaatggttcatcccccctcctaagggcattgtcgtgccgtctcatccctcaagggtagttgcgggcgaaagcccagtcttggctcttttgagtccctgacagatggcggcggtggttttccatcacttctctccttggagatgtcatttaggcatccccttgctgaaaaccactcgaacgattggtgcaagcacgctctaagatagagttgggctttgtattggttgtaagggcgttttttgtgcgatctcgtctatgctcctttgttggcctagcggcggtcggtcatggctagcggcagccggtccggtacagccttctcccggacctatgtgttggcgctatcggtgtgtgggtggtggtatatatttttcctttttcctggttacgaccttccaaggttgtaatcttgtaatttttttctgctctatcagtagaaccgcaccgtctcgtgtgagtcgtaaaaaaaaaaagaagataggagacaatgcggaagaagggacatataagtagaagcatcggttataattaatcgggttaaagtttagcagaactgatcggatgtttatatttttcttttcagccgcaagttgatgaggggcttgctaatgggcgcgggtgcgctagctgcctaactggcgcagccacgcacgtcccaattccacctctcctcaacgctaataacatgattagcattgatgacgttaattagcgctaatgataattgttagtattagtttttttaaataaaataatacataaatagaacttttaactcagatttggaaaactttcaacccggatttgaaactttcaacccagatttaaaaactttcgactcagatttggaaaactttcaatccaaatttgaaaactttcaactcagatttaaaaactttcgactcggatttgaaaacattaagtcaagatttttgaaaaacttttaactcagatttgaaaattttaaagtcaagatttgaatacttttaatccaattttttaaaaaaaattcaacttatattttgaaactttcaaatctcgatttgaaaaaattcaagtcaaatatttgaaaactttcaactcggatttaaaaacttttaactaaagatttgaaaactttcaactcagatataaaaacattcatttgaaaattcgaaacatttaactcaaatttgaaaacttttatcttaaaattcaaaaattcaactcaaatcttaaaaacttttaactcaaattcaaaactttcaactaaaattgaagatgaaagattcaacttctaaaataaaaagatcgcagaaaaaaaggcaaagagaaacgaaaaaggcacgtacgttaggtttaggtttttcgaaaaaaaaaatatggacgtgaacgccgtctgcgtgcgtacgagccagcgctgtgggccttatggcctaaacgcgtgccgctatcacgcacgcgcgaattagctctcgcgagttgatgagaccctgtgtcgtgttaaaacttgaaagccccggccgccagccccaagcccccgaaggcccgaacgtatcagattcctagcacaattcaactgtgcccaaaatcattgtgcctccagcctcccctggaggaggtcgcccgcccgccacctgcgccgatctccctcgatcccgcgagatcgtccgtcctgctccttccgccgcatccttgtgagcatcttgatcatctctctacaatatgcacctgttctcgtatttgcgttacccctagcaagcttctgctgtaggtctggaacgttagatccgctcttggtttattccaatctggatgcaaagagttcgttcctttcccatacgagactaatttcgtctaataatacacctatatcaaaataatccggtatatattctcaccgtattgtggtaccttttcagctaatctatatttctatatatgtattgaccctgtttaattcagaactcgacatttaacttccttgtcctgatatacaagcaacttcgttctgccgtactctcttttttttcggcgaatttgagcttgacaaccatggtgatgatgagctgcaagaggaggaaggtttcaccagccagtggtgctggtgcaccggtagtgctgccagaagagatgatgattgaggtgctccagtggctgcccgtcgaatccgtcctacgttttcgagccgtctgccgatcctgggccacggctctctaggacaaggaataatatacgcacgcatggaatgcctgttgggttatttccggtcgtgacaggagcggcgacaggtggcaggccgatgggcgggctagggtttgggattaggcaaccagctgtggcagaccgtcagcggcggggctaggtttcttctttttgagaattttatttttttcacaatattttgattttcatgcggttggcttaagcgcccgcatgaaaatttttttttttcgcatgtggttgggctgaacgcatgcaaaatcctgattttttgagcgtatgcctatccccatgggccttatgcaaaaatgaaatctgtagtgagcaaagcttattggatgtttagatttttcttttcaagccgcaaaatttgatgaaaccgtgtggtgttacaacttacaagcctcggccaccagcccaaaacgtgtcaaattcatctgtgccgaaaaatattgtgcctctccccctcgagtatctctcctccccgtcggcccgcgagggaacttcgcccgccacctgcgccgatctccatcaatctcgcgagcaggagcatcctggtgagcatctcgatcgatcatctctctacacaacacgcacctgttctcgaatttggtttacctctagggcaagcttctgttctaggtctggaaggttgaagcttttttctgaacctccatgtccacgttagatctgcaatttggatgcaaagaagagttcgttcctttcccgtatgagtctaatttcgtctaataatacacctatatcaaattattatcaatccgttatatattctcaccgtattgtgcattggaccttttcggctaattaatttatatttctatatgtattgaccctgtttaattcagaactcaacatttaccttccttgtcctgatatacaagcaacttcgttctgccgtactttttttttttggcgaatttgagccgatgtatccatggtgatgatgagctgcaagaggaggaaggtttcaccagccagtggtgcaacggtagtgctgccagaagagatgatgattgaggtgctccaatggctacccgtcgaatccgtcctacgttttcgagccgtttgcaggtcctgggccacggctctctcttccgaccaattccgcggtttccacacggccaagaacaagatcaagccgttgccacccaagctgttcttcgtctcgcagaccgcgggattcggctccacatcggtgcacacatcctcgccgctgtcgcggtcagtccccggcggtgacattcatcgtgatctgctacttccatctggacaatgtgcgcggcgatttcatgnccatgacgcctacaccgtgccatggcctcacctatctgcacgatgctatgggactagagtactacgttctcaatgcggcaacagggtcgatcagccgtctgccacctgccaaaccgtgccatctggatctgctggactgggattcgatgcccggacaggggagtacaaggtggttaggctgtttcgagagataatttctggagaaccgcataccaagtgtcagatatacactctagggggcaagcatggtgactcatggaggccagctagtggaggtgtacctttcaaattccgcactgctggaacttattctatttcagcttcacaacaacataaacttcttccagtgtttgtggatgggtttcttcactggcttactggctctttgttctctttcttgaggccacatgctgccatcttatccttctctgtgacagaagagacattcagattggtcaggtcaccgccctttcaggtttcaggagtgcacttggtggatctctctggtaacctgtgcatggtccgggaccttcgtcgcatgtcgtctacgctggagatttggaagctgaatgatctttactccagtgattggtcattggagcatcgcatcgatttgtcgacggagcatgttgcccgagatttaatgaaaccagattttatcagagttattggttctgctggcagtagtggtatgtcagggaagaagaatgtaatcattgctacatccaatcgcaaggcgatcgcctatgatcctacatctgaaacactagaaacaatccttgagatcaagggaactcctttgccttaccaaactgcacgttctgctcttggactgatcagtttgtttgaagacagtcttgctcctgtgtgtaaaaccaatgaagagatagcattgtcatctccccttgccaaggtgataaaggaggccctactacggcttccgggtgattatgccgtgcagttcaaacttgtctctaagcagtggcatagatttattgaaagttggagcttcgctcgtggataccacatgtataacaacagggacaggaggccaaagatcaggcttgtgggcatgggcacaggtggatcatacaggttttagttttgccagcatagaaaaattgcttcaagaatctcctagtaaagatacatggcttgatgcaaaggtggtttgctccaagccttgccatgggatgaatctcataagcactgagctggaggattatctatacaacccttgtacaggttaccgctatgtccgcagtacccgaggggctcttgtctacattccaaatagaatacctagtgatagatttcgtcacgatcatgcttttactaccggtaataagaatgtcggcctggggttcgatccactgatgcaggagcatgtcatttctatcagtggagaaacttcaaaacctgtcgttacaacataacatgctcgctttttacctgtaaatcgcgtcacacgtgtgattttttacagccgcctctgcctgtgaatgacatgcctccggcttacttggctggatttctgtactggatgagtgagccaaggttgagccagagtaagacaagcgccattctctcgttcgagatcgcgaccaagacatttgttgtcatccagtgcccttcgtgtgctctaacaagacacaacagaagcccttgcgaatcatttgtggtagagcttgaaggaatgctttgcgttgttctcgctaatccgtttgaagaggaattggatatttggaagatggagcatggtcaatgggatagagcatacagagtgtgtctgaaaggttggcctggttattcccttggagctaatgtcgtggttccgatggctgttgatccgaaggatggaaggattctgctcaacacagggagtaaattgggtctctatgatccaacgaagcgggttatcgaaaacctgtatgatcttgatgaggtgctgcgtgtcaaacagacagatgagacgctgcatgtcgaagataaagaaaaatcttagcagatccaagtccatgatggttcccagttaaaatgtcagcattctgtcaggaagtttcgcatatggctgtcacctctagaacatgacaggttctcttatgatgcgcctgcacccgcttcatctaggaagaattctgcttgctccaatgacactgagattatgccctttgttcctattttgtatgaggatagtcttgcgggttatcgcc

SEQ ID NO: 2377 - DNA, 2849 bp, Oryza sativa
cttgggccaactgatgggtttgcttggcatagaactggcaagccttgcatcacctgacccagtcctgggcatcctggagtgtagctggccactaaaatccttgacggaaggctttaccgaccaaagtgcgcgaggccgagtgggccccgcattttccctcgcgggcgtcggtgataagctctacgccttgctcccgagagatacatttcaagaggaccccattggcgccgctccggtagagggtcccttctacaagcatgtaccgtttggagatgtgcgcgagcttttcggcttcggcgcgatccttaggaagagtgtgattgtcgaggtatgcccggatgtcggccatccaggcgacctgacatggggggtcggggttgaccccctcgggccccgaggcctgtggctcaccaggcgtcagggtgggggtcgcggcgttaggcaccctcggggggtccgagtgcgccgacggctgtgtgagattttcttcaaaggcccctgggggagtggggctcgtgctgacgccatgcgcgacaactcatcggcgactgcattgtcgcgcctgggaacgtgtcggagctcgagcccatcgaagtggcggtccatgcgtcgaacttcgtggacgtaggcgtccatctgctggttggtgcattggtactccttagatagctagttcacgaccagctaggagtcgcccagaactaggaggcagtggatgcccattcctgccgcggccctcagtcccgctaggagtccttcgtattccgccatattgttcgtggctcagaaatcgagacgaacgacgtacaaggatagtcttgctagttatccccttgccatcaaaccaaggtgcttatttcgataagctatcacacatttaaatgtaatcaagtgagctctgttgcagcctttacatcggcgcagttttgcttttactttctaacatttgtgcttgagtgttagcatatcatgtagtgctgctagctagtgtgcatagaaagttagaaactatatttcttttattttccacaggtattacagaatctggtttgattttgacaaagccatgtatgtcactaacattgtaacaggtacctcacgactcagttacggtctcaaagaggttctttttgcaggtacattttaatgagattttgtctcaatagggcctctccaatctgttcatcacatgaattggaatcaaccttgtagaatttctttagttcttggctacctttagataccaactggtctgacttcagtctcgtatctctcatacattgcagggaaacttgagagcacgacaattttcagatcttccccaaatgcaatgtttgaaatttggtactaatggtgacttcttcagaaaatagacatttattcgtgagacgtttattgggggaccaaaagatgcattgatcttttttccttagaaaataggcatgagagacgttgggagttcttttaattttttcattgctgcagtttctgtcctggctggctgttactactatggtgaattgaggcatagagcgacactgcagacctaaccactatggtgaattgaggcatagagcgacactgctgacctaaccaaattttgctacttactctaacttttaaaatctatctttctaaagatggtcgtctcgagccatcccattaggccacatggcagtgttaaactttgagataaatctaaaaaaactatacataaaaaagtagcaaaaaataaaagacacaacctagagacttcccaattatctatcctttttagataaatatagaatatttataaaaaaatttatctatcctctttgagataaatctagaatactcatacaagaagaaataccgagaagcaaacaaaatatctttcccctttgcatctatctatctcctgttgattggtttcatgccagctgattgacttgagcgacacgtggcgagatacaagcggcggaaagatcgtcgggtaagaaaccatctataaaacagacaatcttaggatggtgaagaagagccgctccatgtgcatctcgcaagttaggatggtgaattgaaaagaaaaaaacaagaagaagagcggaaagatcgtcgggtaagaaaccatcataaaacagacaatgttaggatggtgaagaagagccgctccatgtgcatctcgcaagttaggatggtgaattgaaaagaaaaaaataagaagaagagcctctccatgtagttgggccacatggcaccacaacccaacagtgtgtgatcggaccagtgcaaacatgtaaaagagggaaaaaagaaaaaataaagagacaaaaaattactttttaaaattcttcacaaattatcccagggcaagtattgtgaccacatatcttatgtttcgagaaactaaaaataatagatagaaaactaaatgacagaaatatctgctccttctttctaatattgaatcaaactctataatcctaataactattttttaaatattgtttttttttgcttacattataaaataaataatatctagatctttcaaattttagaaaaggcaacgattatgataaaacaaaatatctaaatttttatgccaaatctaaacacaaggatactcaaaatcgtaaagaagaattgaaatattagtatgttaattatgtggtttttagaaatcatacacacaggctaatcaactgacactggtggagaaaccatctttcgtcggtcggccgatttccacaatagtcccggatgcaataaaaaccggggctaaagatcatctttagtcccggttcgaatgctgtcagggcctgtcaggcccccccgggatctttagtcccggttggtaacaccaa

SEQ ID NO: 2378 - DNA, 2191 bp, Oryza sativa
  unsure (1)..(2191): unsure at all n locations
agtcccggttggtagcaccaaccggggctaaagatcccggtgatctttagccccggttggtgctaccaaccgggactaaagtcccacccctatatatatgtcttcttcctcctccagctgcccgagtaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaagtttttataaaatagttgagaaggaaaactctagtgaaaattaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtttgttggatttgaaggaaatcaaacgggcgaggaggaaatagctgctgatggtaacgacgttgcggatgatcttggtcagatgttgcaggacgccagggaggacagcgaaagtgaaaaggaggcccataaattggacaagatgttggaggaccacagaacttcgttgtacccaagttgcgagcaggggcacaaaaagttggataccactctggagttgttgcaatggaaggcaaaaaatggggttagtgacaaggcatttggcgatttattgaaactcgtcaagaacattcttccggggggaaagaaattgcccgagacaacgtacgaggctaagaagatagtctgcccgttaggactgaaagtttcataagattcacgcatgtccgaacgattgtatcntatatcgcggtgaggagtatgagaacctagaagcatgccctgtttgcaagcactacgatacaagattagacgggacgatccaggagaagttgacgggcagctaacaaagaagagaattcctgctaaggtgatgtggtattttcctataataccacggctaaggcgtttgttcaggaacaaggggaatgctagaatgttgcgatggcacgctgaagagcgtcaacatgacgggatgctgagacactcagccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaa

SEQ ID NO: 2379 - DNA, 3477 bp, Oryza sativa
gttgttatatgagaattccgcgtacggcaaattcttatcccaacttccaccaaaatctagaacacaagctctcaacatatcttctaaaatttggtttactctttccgtctgaccatttgtttgagggtgataagcagtactgaaattcaaacgggtacccatctctacttgtaatttctgccaaaacttcgaagtaaactggctacctctatctgacactatcttcttaggaacaccatgcaaacataccactctggccatatataactctgcaagcttatgccctgtataggttgttttgaccggtatgaagtgagcgacttttgtcaacctatcaaccactacccaaatagaatcatgtcctgccgacgttctgggtagaccggttataaaatccattcctatttcttcccacttccactctggaatcttcaacggttgtaacagaccggctggcttctgatgttctgccttgacccgctgacatacatcacatagagccacatattctgctatctcacgtcgcatactggcccaccagaattgttgcttcaagtcttggtacatcttagtgcttccagggtgaatggaatacaaagtttcatgagcttctttcatgatagtatccttcaactccttattatctgggacgcaaattctttctcctaaccacacagttccttgctcatcttctacaaaaccgatggctttacctctcctcatgttctttttaatttcttgtatgtcaggatcattcacttgagcttctctaatgtcacaccctgattttcgtcttaggatttataaattatttaataaattattaatagaatttatattaaatgttcattaatttacaagtgaagttaaatgtgggaaataaaatttcctaaatataaagcatggatggatttaatttttattaaattctccgtggttaattatactctctggaattttctcggatttttcggagctcaattcctaattttaatcatacaaagagcatttcagtaattacccacatattaaattaatcattaaatggtctaattataattttgttaagtacttttagtgtccaagtattttcaggatttttcttgaaattatttgagcattggaagtatttttaacaattgaaagatcatttaagtgattattttaattggaaaaagtttttaaatccttctctaagccgttgggccgaattcggcccaacatcctctctctctcgcgcggccgagccggcccaatcagcccagccgacgccgcccgctcctctctcctgtggagaccgacaggtgggccccacctgtcgggagctccttcaacctccggccggctgccctagccgagcccgagccgcccctcttccgcctccgattccgcctcaatccgatccgtttttatccgggtttttgaggggttttgatcctctcgttctcctctatcttttcccccaataatcggagcgaatcgttgaggattttatccgaatcgagttcgtttcgaatttatccctaaaaaccgagtttagttcttcttggatcgattcctctcgtttggagttcgatctcttcaatccaatgctataaatagcatcccctagtcgtcctcttccgtttgccccaagtcccgagctccctcgtcgctcgtagcgctgccgcgccgttgccctagccgctagccgtcgccggcgatctccagttgcgccgcgccgtcgcctccgccgtcgccgccgtttgccgtcgccgccgttaggtgcgccgtggtgagaggaatctcggccgcccgttccccttcgccgccgaccaccggagctccgccgtcgccgtcaagccgagccgccgctgccgttctcttcgtcgccggttgtcgtcgtgcgtcgtttgacgttgtggtgagtaccgttgggttcgcctcgtcgtcctctacacgtaggtgtcttccaaatccccggccaaggcccctatctccggcgagcttgctaaccctaatcggccggccgtgggtgacgtcatgctgacgtcatcatcctttctttttccctttttcttttaatagattagatcttctaaaaatcatatctaaataaccgtagatccgtttcaggtggttcaagttgctaaatttttctaaaataaagatctacatattaaaattgtccataaattgaattaaatttatttaattctttttaaatgggctttaattagatttgatcttgtaaaattcataattaattcatatgaagtcagaatgaggccgttcaagtcttataattcatctaaaattatgatctacatgtttgtttactttttatgtactgtttattttgtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcgtaaacacaatcctttgagcatgttgatcctatatttaaattctctatttatttcaactgtgcatttattttcgaatgtcaccgggtggtgtgaacctattcctttgttatggccaatttgcattgaatgtcctattccttgataccttgggtaataaattgattagcttgaaccttatgtattggtttggttcagctaaatgttatatatatataattgcttagcaatgcttagaaacattagctcactaatgggatgaatcatatatactacattattatttatggttatattgaatggtagctcacgatggttaatcgtgttatgataattaattggtaattaaaatatgattattggtgggttgtgagcacatggttttgaaggtcgtgctcatggcaattaaggaccggttcgcgagctactgttgtgaaacatttatcgtgccaaccacaagccagcgtgggcaacggctttatcttttgtatagcgtgattcattattgtgcaccagactgagaagtggcgagaagtccatgggggtcgctggggagtccatgccttgtttataagggggtgattatgatccaagtacggtgcactgtggtgagttgtgttatgcgaggggtattgtcacaactcctttccgaggtaccgcggtggtactgaggcacatggtgacatgatgtggggttgtgtcttgtgggtacagtggtacacctctggccagagtaaaactattcgaatagccgtgcccgcggttatgggcgagttgagcaatgtttttcgtgattagtctcacacctctcataataattatagatgttataactggtaataatttgcttagctcctggtttggagttagatctgtacagccgggtatggttgttcaggatggttgggcctgtacagcatgggtgtgctgttaagtgttgattaaaattttggattaattactccactgttttatttctcttaaatgttttgctaaatgctgcttt

SEQ ID NO: 2380 - DNA, 2001 bp, Oryza sativa
aggagaagacgttggcttataccccagttgagctgcctgtgggagtggagccggagcttcgctagattttattttccgctgcagttttcttcttggtgaggactaagtgcctcttaagtaagtatttatcgatttagttattatgatggatttgtatattaaattgtcagtttgtgtacctcggctgattcctggacgaggattttatgcacaaattagttcggaaattactagtgaatttccgggcgtgacatctaacttgatcaaacagagtaggtttagcttgtaaagcggccacaaaacctttgttgactattcccaagttcaagttttcaaattcttggcataactcccaaggtaaacgtcgaccttctgacatattacagtagcttttcctgctaagggcatcggctacaacatttgctttccccgggtgatagtggatttccatatcatagtctttaatcaattctaaccatcttcgctgacgcatgttcaagtcaggttgagtgaaaatgtacttcaaacttttatgatccgtatacatctctgtacggttaccgaaaagataatgacgccaaatcttcaatgcatgcaccacagctgccaactctaggtcatgcgtaggatagttattctcatgaggacgtaattgcctagatgcataggcaaccacctttccttcttgcatcaacacacaacccaaaccgagtcgggatgcatcacaatacacttggaaacctttcctcgaatcaggcaaaattaacacaggcgcagtcactagccttttcttcagttcttagaaactttgttcacaatcatccgtccacttgtacttcacttccttctgaagcagacgagtcattggtctggcgatctttgaaaagttctcaataaaactgcggtaatacccagcaagtccaaggaaactacgaaattctgaaaccgtcttgggttgcttccaacttaacactgactccacattgcttggatctactgccactcctccagacgagatgacatgacaaagaaacttcacttcggacaaccaaaattcacatttactgaacttggcataaagctgatgctcacgtagtttctctaaagctagacgaagatgctcttcatgttcttccttcgtcttggagtaaataagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcacctttcaattgatcaaacaggtcatcaattctgggtagaggatccttattcttgatagtgacctcattcaacgctcgataatccacgcacattctctaagtatgatctttcttctccacaaagatgactggtgctccccatggcgaagtactgggtctaatgtatcctttctgaagcaaatcatccacctgtctcttcacgtcagctaactcattagctgccattctgtatggtctcttatggatagggtttgttccaggtaccaagtctatccgaaactctatgtctctcttaggtggcatacctggcaaatcctcgggaaacacgtctgggtagtcttgtactataggtatctcttgtagaacaacttggttcaaggtcacaccatgagatttaggagaggacgcaaagaaagaaacagtttccccattgctactggttaaagtcaccttacggttggcacaatctataactcctctgtgacgagataaccagtccatccctaggataacatctagatctttggattctagcaagataagcgaggatgggaaaggaacttcttctatttctatagtaacagaaggacaatactgtgtcgaaaatacttgattacctgggg

SEQ ID NO: 2381 - DNA, 2426 bp, Oryza sativa
gcaggacgagcaaccatgttgcggttgtcattgccacgattaccagtattgttgttgtagaactggcgttggggacggacaactgatgaagatcctacttgagggtacgatggagcttgaggtccagtaacgagtcgcggtctctggttactgccctgttgtgccttgaattgggcagccctgcgcttcttctgctccatccggttatacttgtcttcctgacgaatcgccttgtccaccaactgctggaaatcccggaaatccgtagacatcaaagcataagacaactcatcatttagtccctccaagaacttctcctgacgctcttcatcggtgcgaacatcttccggagcataacgagctaaacggttgaaatcatggaggtactcagtgaccgaacgagatctctggttgagtgctctaaattctctcttctttagagctacgacacccgctggtatgtgcgtcttcttgaaagcggccgtgaactcctgccacgtaataggctctccttcagccctgccttggcgaaaatgatcccaccattcagcagcaggtccatgcaactgatgcgaagcaaaagaaactttctcctgctcagtacactggatcaagtccaacttcttctccaccgcatgcagccaatctcctgcttctactggattggtggtgcttgaaaaggtagggggtctcacacgtaagaaatctgccaacttgttttggggaggtgggggtggattctgattctgattgtttgcctgctgattctgtgcctgctgcactaacagattgatcagttgtgtttgttgggccagaatctgagctagcgtgggatctcctccatcgttagtagctccacttccacttccacttccacttccggtgcgcgtgttcaccatctgacgataagcagaaacaacaggaaagaacgacagagagacacccttagaacgaagttatttaattaatttaaattctatattactcttaactgtgtatgattacatttaagttgcattaacactatctcaccaactatcttacactctgacaagcaaaagaactagactcatgctgttacatcccacccatgatgtaagcaacaactaaaacccacacactcacaagcaaacttaaacaagcaatctaacacaacgaactacggcaacgatctaactaagcgactactcccgccttgcgtcggaacgaagcgatggatcttcttcctctggagtagctggctctctttcttcagggtcttcctcctcttcctcatcacttatgatgtcgatgacaggttcagcacgatcgggcacagcttcacccatcacgcgaatcttcgaagctaactggagacgaggtggcggacaggttctctttcttagtgtgacgcgaagcttgggtgttggcggcggcgtttctcctttaagttcagctaattcgttctgtagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccatcaggacagatataggttccatagtcttgaccatgaggcttgtgaggatgatactggaaagctgatgaatccaactcttcttcaaaacgttgacgcaactctccaatggccaccaaagctacttcttgacaagcatggctgtacgatcttcctccagcttcaaacttaatggacagaaggtcttcacgatcactagccaacgtcacacgaacacgacacttctcttcgtcggggtcatgggaaatttggcgatactcgggagcaacttcatagcctacctcaaaagccatcaacctcagctccctgacgaatcctaacacctcgatcaaatttctcggtgaatgtggcggcatctaaggaaacatagaagagaggaattaatgcatatttttctaagttagctgcaccaacttgatttaactgatttttgaccaaaaaggaagaaaataaaattaaaatacttatgatttaatttgagcacggtacagtgtcaccacaagaaagatgagtagtactagtgctatcatgattgtatcgataccataatagatgtacagtgcggactaatcaataaaatttggtaaagagaaagaaagaaacattttgggaagaacaactttttgcttttaaaagaaaagaaattgaatttcaataaattttgtgcttaccttgcatgtgctgccaacttaattaatttataagagaatagagaagagcagttactattttttttcaaaatattttgaaggctacttaaggtttaccatttggcttatcctaaggtcaaggtggctctgataccaacttgtcacgcccggaatttctatcca

SEQ ID NO: 2382 - DNA, 1267 bp, Oryza sativa
ggatataataaaaacgtctcaaaactcatttctacacatgagatgttccaaaaacgtctcaatattcatctctaaacgatttaattttgtgctaacctgtaaagcgtcttaaactatatcctcaactaataaagcgtctcaaacatcgtccctattttaatttcacttataaaaaagagacgacttatagaatgacttaagtgaaacgtcttaaaacaatggttttgttgtagtgaacatcgagacgaacccgatggtactcaccacaacgtctatcgacgaacggtgatggccggcgacgaggaggaaggcggtggcggagctccggtggtcggcggcgaaggaggacgggcggccgagcttcctcacctccgtgcgcacctaacggcgacaacggcaagcggcggagacggcggacgcggcggcgcgacacggccgaaagatggccggcggcggcggcggctaaatgcacgtggcggcggtgctacggtgcacgggagaggacgagagagggggcaaatggaagaggacgacgaggggaagctttataaagcattggattgaagagatcgaactccaaacgagaggaatcgactcgggaaaaatccaaactcggttttagggataaaatcaaaacgaactcgattcggatgaaatcctcaacgattcgctccgattcttgggggaaaaggaagaggagaacgagaggaacaaaacccctcaaaaacccggaggaatcggagtcggattgaggcggatttgagaggagaaaggcggcggcaaagcggcggctcgggcggctcggccggaggtaggggatggatccgacaggtgggccccacctgtcggcctccacgatagaggggagcgggcggcggcggcagctgggccggcttgggccggttcggccgcgggagaggagggagatgttgggccgaattcggcccaacgaccaaggagggggatttttttgaactttttaaaataaaacaatttgtgaaatgttgtttcaattattaaaaatacttcccttactcaaataattcccagaaaattctagaaaatagaggagcaagcatagtatttaataaaattttatctagctcatttttatgttaaaaattttcctagaaaattagggtttagcttgtaggcttttaaaataatttctaagaaatgatttaaaatatgcatttttaatttagtcatttttagggcgtgacatgctgctaggggctcagttctgcctgcctgtcccgggggttcc

SEQ ID NO: 2383 - DNA, 23362 bp, Oryza sativa
gccgagccatgtacccaagttagtgttttaattcttaaaacctgcttatcaactaaaatgtggaatggttggcctaggttggcttgggacgagctgggacccagggtcgggttgccagttcggtctgaatcatcgtaggccttgggttaaggcaggttcgtgtgggttcacggccttgataaataatatggtatagttctagaatcgtgtttacaaaatagctttgagcaactaagtacctttaaatgctgtttactgcaaaccctaaccctttatagtatgactcctttgtactcccttgcatttattctgcacttgtgggtgtgtcttgttgagtacggtggttgtactcagtcttgctcaatttttcccaaccccagaagaggagccccttgaagatgaaggttttggtgtctagctcgtgcctgccgtcaagcgcctgtggtcgtcgccctagtcttccgttgtttctcgtttgtctctgtgtgtgctgggccttcgctgcccatgtaataagttagctatttacgcttccgcttgttaaactctgaattgtatcaacttttggtgtaccttgcctcctgggacaaggattaatgcacgcacgtaaggaacgcccgttgggttatttccggtcgtgacattagatctttattgattgagaggaactatctacctatgtaatgactttttattcgcttattaattagagtaataattgtactctattatcaatttgttattgtgtgcctcggctgattactggacgagggttcacacacatgtaagcgtttggaattttggatagaaatttcgggcgtgacatatatgcatatgaccgacgctaaggagttgtgggatgcactgaatactaaattcggtgctactgatgctagcaatgatctgtatatcatggagtagccccttgaagtgatgagaaaaagaaaactgcgtcttttccgatctacgtgtagtgctagatgctgggtgccatggatcgagtgatcaaatcagaatttatttacgttcagaactcagttgactgcttctatagataaggcggaatgtccttagttcagcattatagcacatagtctccaacgctacgccatatgtcgcttagacttgaccttttctcccgccccctaaaatcttcggctcctcgtttttattcaattatgaaattactcattttgatggagatttatagcatcattcaagtaaatacaaattgagatcgtagaaacatgagcttgcagtttcatgactacaagatggctgacaaccgttttgtagtcgaacaggctcatgagatacaaaccatagctaaggaactcgaactccttaagtgtgtcttacccgacaaatttgtggccgggtgcattattgcgaaactacctccatcatggagaagtttcggtactgcattcaaacacaagagacaggaatactccattgaggggttgatagcatctcttgatgttgaggagaaagctcgggaaaaagacgccgcgtctaaggatgatggtgggcagtccagtgccaatgttgtgcacaaggcctagaacaagagcaaggggaaatataaagctcaacagaccaccaacttcaagaggcagaagaagaacaacaacaatcctaaccaggatgagaggatttgctttgtgtgtgggcaacctggtcatctggctaggaagtatccacagcgcaaggggatgaaggcacctgcagggcagacttctaagtctgctaatgtgaccattggcaacactggagatggaagcgggtatggtaatttacctactgttttttcagttaatcagtctactaattggtgggttgatactggggccaatgtacttgtttgtgctgacatctcattgttttcttcttatcaggtcgcacggggttccaccttcctaatggcgaatgggtcacatgcttctgttcatggtgttggcacggtagatgtgaagtttacttcgggaaagatcgtgcagctgaggaacgtgcagcatgtcccttctatcaacaggaatcttgttagtggctcccgtctaactagagatggatttaagttggtttttgagtctaataaagtagtcgtgtctaaacatggatattttattagtaaaggttatgagtgcggaggcctgttccgcttttccctttctgatttctgcaataagtctgtgaacaatatttgtggaagtgtggatgatgaggctaatgtttggcactcacgtttatgtcatattaattttggctgatgtctcggctttccagcatgtgtttaatttctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatgaggtgttgacgaagggtggaaaacaatatttcatgacgttaattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgacgaacatgacatcatacatgagaggactcctccctattctcccgagtctaatgggattgctgaaaggaagaaccgcacactgactgacttggtgaatgccatgttggacaccgcgggacaacctaaggcatggtggggggaggcattgttgaccacgaatcatgtgttaaacagagttcctaacagaaataagaacaaaacaccatatgagatatggattgggagaaaaccatcactttcttatttgcgcacatggggtgttgttggtcgctctgaagttaaggtgaattgtatgtttcaattgatctcccgaaggtgatgtcaagatgaaccccacacctgctccttggctattgagcgcgccatcgaacgccattgtccatgtttcattgtcggtttgactgtctaacctattattaggcatagtccaatcggctatgacatcggcgagaacctcggacttgatggctgttcgtggtacaaagtggacgtcaaactggcttagctcgactacccatttcgcaatgcggccgataacgtctttgtttctcatgacttcgccaagagggaaggcggagacaactgtgaccctgtgggcttggaagtggtggtgtagctttcttgacgtcatgattactgcgtagagcagtttttggatctgtgcgtaccttgtcttcgcgtcgtggagagctttgctgacgtaatagactggtctctgtacattttctctttcgacaacaatgacagtactcacagagtagggtgtggcggtaatatagaggaataactcttcattaggttggggagcaacaagtacagggggatttgataggtagcacttgagtgcgatgaacgcttcttaggcttcttgtgtccatacaaatttgtcctgctttttagcagtgcgaagaaatgctgtccttgttctcccatcctaacgacgaacctacttagtgccgccatgcatccggttagcttcagtacctccttgagtcttgtgggcgacttcatgttctcgattgccttgatcttctcggggttcgcttctattcctctgccagagacaaggaacccaagcagtttacccgacggtaccccgaacgtgcacttctcaggattgagcatgaggcgatattgtctgaggttgtcgaaggtttcccgtagatcgtcaatcaatgagtcgcatgtcttggttttgacaacaatgtcatcgacgtaggcctcaacattgttacccagttgatcgctaagtgccccttggaccgtacgctggaaaatatttcctgcggttatcagtccaaacggcatttttacgtagcagaatacaccgaacgatgtgatgaatgttgtcttttcctcgtcctcttttgccatgcttatttggtggtagccggagtaagcgtcaaggaagcttaacagctcacaaccagctgttgagtccactagttggtctattcgagggagagggaagtgatccttggggcacgccttgttgaggtcggtgaagtcgacgcacatcctccacttcccgttggccttccgcaccatgactgggttggctagccactctggatggagtacttctctgatgaaaccagctttgagaagtttatcgagctcttctcgtatggcctgtttctgatctggtgcaaatctccgcagcttttgctttactggcttggcaacgggtcgcaccatgagtttgtactcaatcacctccctagggacccctggcatgtcggacagttgccaagcgaatacgtccgcattatcgcggaggaaggtgatgagcgcgagttcctatttctcgttcagtgatgccccgatcttgactgtcttgtcggggttggcactggagagtggaacgattttaattgcgtcgtctggttttggcatcttagtcgttttgatcattttcttgggtggctcggctgtggcgggtgggctgggcgtgtgctcgaccatgtcgaggctctgcttgtcgcattggaccgccagctttgtgtttccttgaatagagattgttcccttcggctcgggcatcttgagtacctgatacgcgtagtgagatgcggccatgaacttcgcgagtgcagttcttccgatgatggcgttgtatgctgtatcaaactcagcaacatcgaatgttatcttctctgctcgaaagttgctcgcttggccgaaagacacaggaagcgtgatctagcccagtggcttggacgaagactaaggagtgattccatggaagggttgatcggtaggcgtcaactcgtttcgtggaatgcccattgcgtccaaggtgctggcaaagagaaggttgatggagctaccgccatcgacgaagactcgcgctaccttgatattccgaatagtgggttcaaccacgatcggatatcgtcctgggataatagcagttttggggtggttctcatctgagaactcgatgttctgttcagaccacttcatcttgggtgcaaccccctgccatgtcgaacaaacctcacgttccacttttttgtattctcgctttgaagagtacgctgtggaacctccgaagatgtgcgagacatgaagatcggaatctggatacgccgagtccgagtcctgagtggttgcctcagtggccttctcaactacacgtactcgcttgcccttctccaaagccagctgctttgccaacgactttttgaagatgaggcactcctccagagaatgtttgtccgacttgtgtatggggcaccatattctcttcgtatcactgccttgtgggtctgggtgtttgggcgggcgcttgtattcagacacgaggacttccgcttgagctttcctcttcccactcttgccgcttttcttcttgcttgattcgggtgtgtccttggctggcttcttctctcctcccgcctttgactcgtcgttcttgcgtctcactgcgtcgtctgcatgggcgcatcgatcgacaacctcaaacaaacttcgagtcgttgtgattcgccttgttgccaactcctgggtagtatagcgatctctgacaccggttttgaaagcacgaatcacagaagcatcggtgatatcggggatcgtatttctgcactcattaaagcgccgaacaacacgtgtaaatcgtcttcgatcgcgtggcgcttgtaagttccctggaagttagcgacgaattgctaccacaaatctgcccatgaagagatcgagtagggtgggaggtgcatcagccacgaacgcgcagaacctttcaacgccgttggcaaatagtttgctaacgcgttgtcgtctgccccagcagcgtatagtaccgtggagtagacctggaggaattcttcagggtcagtactcccatcgtacttctctattgctccgggtcggaatctctcgggccatcggacatcacgtagagaacggttgaaagctctacacccagtgcagggggcggtgggttgtcggcgattgtgtgtcctccgtggatgtctatcggatgacgaagatgaagatgatgacgatgatgacggtggttcactcggctccggtgtgcgattccgagggcgacgtttaggttctcgagaattctgtcgtcatccaccattgttgtcctagcgccgatccccattatcatcaccgtcatgttgacgccctcgaccagcatcgtctggtgtccgctgttcgcgatcgtcgcggtcgcggcagttgtgacgattatcgtggtcttggtcttcgttcgagcgacctcctcgctgtcacgcccagaagtttcccctttttcttgctttaaaaattggttaaataaattgcccgaagaaattatcttaattaacctagagctaactccataattaataaatgcaattaataatcggaaatagcgtggtggaatttttcttgagttccccatgctccaatgcattaacaagatttttagtggaattttcagagccttggaaataattttaaccaattaaaaatcaccaaagtgcaatatttaatcctaggaaaatccttctcctctttttcttatttcttttccttcctttttctctagatgggccatcggcccatctctctccccgcgctcggcacccctttcctgggccggcccgctcctcctttccactccccgaagtcctccctccctccctttctctttcgggcaccgacaggtggggcccacctgtcggtcgtcccctacctccggtcgttggagccggagctccaaccgcccgcgctgccgccttctccgctccacgtcgcgcctccactccgcgcccgcacctcgcgcccacgtcgccgccctctcccccgcatctcccgcgcgcgcgcgcgcccgcaagtggtgggggatttgaaatctcccaacaccctctctctctcctccacctctccacgtcgccggccaaataggggccatccccggccgtttccgcccctccctcgcccataaaaaccctcactcgagctctctctctcatttcccccattcaccgtcctctcccacgccctctaccgccgtcgcgccgcgctcgccgagctccgcccccgccgcccatctcctgccacgtgccgtcgccactagggccgccgctgtgccaagccgccgccgccgctagctccgccgccgtgtgggccatctcggccaccgcctcgcgtcgccggaaccccaccggaaccccatctccctcgcgagccggtgagctatccattcccctccgtctccggccagccactttggtcgtcgtggtcgccttatccatccctaactcctctcctcccctcctctaagtgtcgccgccgctcgtccgcccctcctcttgtcgggtcgtcgtcgccgcctttgtcttccgctccggccgccgtgtcgccggtgagtccttcctccccctcctttcctcaccttcccgcgagcgccggccacgccgctgctccggccatgcgccgccgcctttcggccgtcgcagccgcttcccgcaccgccggtcaccgccgtcggtggccgtgcctcgccgccgcctcgccttggtcggccggtcggccttgaggccaagctgagcctggccggcgcctccctcgcctcccctttgagccaccgcctggtggggcccacctgccaggcgccacctccctccctttggagccgctgacccgtggggcccacgtgccggtgccccccctttcgctgacgtcagccctgggctttattgcgcaataaaataattaaggctttttctttattagtaaaaacacagtttatcttctaaaattcttaagtaattcatccgagctccgtttaagtccattcaagtctcagtaaatcaagaaaaatgcaaagaatccactaaaaatggttttgtttcctgtttcagtagtcttatagcatgttttgcttgtgtgctttgtttgtcgcgtaggtttcggccgtttcgtcgatccgcggtttctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactagtacacaaatggggatcacattattacatagactctgactattggtatagctttagattggcgccaccgcaagggtgtcagttaattaaaatattctgaatggcgggctgtgagtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggtgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttaggtggaggatcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcgtaatgagctggtgtagttcaggtggttggttgggcctgttgcaacgtggtgtagcgttggacagtaattggttaatattgattaattactacagctattttactgctttcaactactgctttgaaatgcctgctttatgcaaaagaacccctagcttcctttggttatatcctgcatcatacctccttttccggtatgacttgctgagtacagtgggtagtactcagtcttgctctcttttcccccacaccagagttgaagttcttctcagatggagccgtctcagagaggttggtttcgtcgctgccgtcaaggtttgcttgtggagtggagtcgcccgctgctgaagtcaagcttcccggtttagctcgcttttatctttctcgctgcatttgtaatcttttatatttttgtaagacgtgggtctgtatgtcaacaaatgtcgtttgtgtaccctggctggtcctggacagggatttaatgcacattcagcttagaaattctggttcgagaatttctgggtgtgacactcgctcttcgttctcgcgacgttgtgaagaaacacgatgtcgggaatgattctcattgtctcgcgtgcgtcgtgcttctcggcggccattcagatggtcgcggagatcgccggtgctgcgaggtggatgggtagctcatctaggtgacgtccgctgctccggtggttcgccgttggcagcgccagctatcagtcgctcttgttgtgctctggtagcggcttcctcgaacgcgttactgagattggctaccgattcccatagtcgttctatccatcgtgcgagatcatcgttaagaacggggtcatagggagcttctctcagtactgcattgatggtgccgagatgttgggccggcgtgaccgtctggttctccgcccctgcgttagcgtgtgcagacgtgctagtcccaccgatggcaaacatgtcgcgtggtgtactggaagatgatgagccatagtcttcgagcaagtgtaggactgatggctcgtggggatcaatgtcgattactccaacaaatcgatccgaggtcaacgtcgctccttgttccttgtttgtgcccttacgagaggttcctacctgctggaccttaggaagcgtcgttttcatggcgtggagaaagaccttgtagcttgagaagtcgtgattcttcgtcttgtgaataggacaatagacatcatgagttggagaagtacgctggattccacgctctttgcaagcacgaattttagcttgtacgttgagaaaaacccagcaagcttgcaagttgtgcttcctggacttgtggataggataccaggacttttttacctcagaagttgtccttgtcggctcggagttcttgtcggaaggacaaggttcggccacactaggaaccttctcgggctcgtatgacgtcgatgttccattctctgctacggcgggaggatccttagacgcgggatcgtccggggttatagccacggcgttctcgtttccgataattgatggaccagccgagattggcaccgtggtgtaaaccgggaagatgatttcgccaacttgagtccacaccagcattgttcaagtagggactccatgaatggggccggtgctgacgccgttgtcgacgaagcttgatgtcatagtagtagaaccttgagcaccaaagctccctacgtggcgcgccactgtcgacgatgggtacccatagaccggatatagagggtattggggtacactggtacgatgatcaacgtagtacgacatgaaggaaacaagagacaaagattatactggttcaggcccctaaataggtaatagccctaatccagttgatataggattatatggagatgaccacaaattacaaagggaataatagaactggatgataccagcgagatcgtagtcgagttgattcgactagatcacccggcgacttggctcctgtaggctccggcttcgtaggctgtggtcgttgtgttgtgtcacgcccggaatttctatccaaaattccaaacgcttacatgtgtgtaaaccctcgtccaggaatcagccgaggcacacaataacaaattgataatagagtacagttattactctaattattaagcgtataaaatatcattacagaggtagatagttcctctcaatcaataaagatctaagcagcggaaaaagataaacggcgcggacgactccactccacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaagttttaccagttatagcatcttctattatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacctcttatacaacacaatccattgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggctaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcattaaataatgagtcataagttatcccaatagtgagctaatgtttctaagcagggctaagcaattatatctaatatctagttgaaccaatacataaagctcaactagtcaagttataataacccaaggtatcaaggaataaggtaatcaagaacaaaagggctataacaaacaataggttaattccacccaatggcatttgaaaataaatgcaatagttgaatagaaacaatagctttaaataggatcaacatgctcaaagggttgtttgggatctgtgtgacttgccttgctggccttggaactcttcaaattcttctccggcgaaaacggattctccggaaacgacggaatctaagcagaaaagaacaaaatcaccaaaacagcacataaacaagcatgaacagtacatgtggatatttttaacatgtagatctcaattttagaaaaaattagagacttgaaccaactaaatcggagctaagatgaattagttatgaatttttaaagattaaatcggattaaaacacttatatcggttaaaattgaattatgacgcaataatgaattatttttgaaaaggaaaagaaggtttattgcgtcagcgggctagggtttgcggtggaccgggcgcacggcggcggttcacgcgaacggacggccgagatcgaaccgatctaagatggacggccgagatcgatcgggtccacggcggctcacagcggacgacctcgatgacgtcggcaatgacgtcaccgacggcggcggcggctcggcggagcagacggcgcgaggacgcaaacggaaggcaccagcacgtagaggacgacgcggcgaactcaccggtgaccacaacggcggcggaaggtcaacagacggcgacggcgacgaggaggaagtggtgaagctcttcgggtcgacgacggcgatgatgctctggcgatcttcggcggcggcgaaggggcggatgaggacggcgacgcgacggcgaccacgatgacgtccttcccgagcgacggcgacgtctggaacggcggcggagcatggctggagcggcggcgacgacggcggcgctagggcacacggtgctagagctcttccggcgacgagaggcgaaggcgagggtggcgacgggtagaggagaccacggggagccttttaaagggactcggaggcggcggcgaaggcccacggcgacggcaacggcgaaggaaagctcggcttggagagagagagcccgatccgattcgaactcgaatccctcgatttccaaaccgatttagccgatgattccaaaggagaaaaggtagaggagatcccgaggatcatttcccctctattgattcggccggagaagaaaaggaacggccgaatttggaaaggaacggcggtggcggctcggcggcggcgtgctagggtttcggcccgaggaagacgacgggcctgacaggtggaccccacctgtcagcggcagcgaggacgcgcgcgcgcgggcggctgcggactaggccggctgggccgaggagagagagaaagcggttttgggccgactttcggcccaaagccaaaagaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttcttttcaagacttttaaaattattttctagaaattccatttaaacaacaatttatataatttgaatttttagggtgtgacaaacctaccccccttaaacagaatctcgtcctcgagattcggaagaactggcgaacagatacggatgggctgacttcaattcatcttctcgttcccaagttgactcttcttccgagtgattactccattggactttgcaaaaacggataactcgattcctggtccttctctcatttgtttccaagatacggattggtttctcaacataggtcagatcctctggacttctatctgttcaagatagcttcttcggtaggtacccttaaacacttcttcaattgcgacacatggaaaacatcatggactcctgccaaagattgaggtaactctaactgataagcaacctctcctcttctactgacaatcttataaggtcccacaaaacgcggtgccaattttcctttggtatgaaaacgatgaactcctcgaagaggtgtgacacgaatatacacataatctccctcttcaaaactcaaatctctgcggcgattgtcggcataactcttatgacgagactaagccacacgcaatctttcttgaatgattttcaccttttcttctgcttcccttaggatatccgtcccgaaaacctgacgctctcccgtttgatcccacaaaagcggagtgcgacacttccgaccatacagtgcttcgtaaggagccatctgaagactagcttgataactgttattatacgaaaattctgcataaggtagattcttatcccaacttccaccgaaatctaaagcacaagctctcaacatgtcttccaaaatctgattcaccctttcagtttgtctatcagtttgcggatggtaagcagtactaaagttcagcttagaacccatctcttcctgaagtttcttccaaaaatttgaagtaaactgactgcctcgatcagacactattttcttagggacgccatgcaaacacacaatccttgccatatacaattccgctaaccgacttccagaataggttgtctttaccgggatgaaatgagccactttggtaagtctgtcgactatcacccaaatagagtcatggcctgatgacgttctgggtagaccagtgataaaatccataccgatttcttcccatttccattcaggaattttcaaaggctgcagcaaaccggcgggtttctgatgttctgccttgactcgctgacaaacatcacatactgctacgtattctgcgatttcacgcttcatacttgcccaccaaaacctttccttgagatcctggtacatcttagtactaccagggtgtatggagtataaagtatcatgagcttcttttagaattgcatcttttaaatctttgttgtcggggacacagattctctcacccaaccatacagttccatgctcatcctccaagaaaccgatagcttttcctcttctcatattcttcttgatctcttgaatatcaggatcattaatttgggcttctctaacttgatcaatgtcacgccctaaaaatcgactaaattaaaaatgcagattttaaatcatttttagaaattattttaaaagcctaccagctaaaccctaattttctaggaaaattttcaacataaaaatgagctagataaaattttattaaatactatgcttgctcctctattttagagaatttttctgggaattatttgagcaagggaagtatttttaatatttgaaacaacatttcacaaattgttttattcaaaaaagttcaaaaatccccctccctaagccgttgggccgttttcggcccgactctctctttctctctctccccgcgcgcggcccatgccggcccaagccgccgccgcccgcgcccctctctctcgggacactgacatgtggggcccacatgtcaggcccttcttcaacctccggccgccgccgagaccgagcccgagccgccatcttccacctccgattccgcccaaatccgagcccgattcctccgggtttttgaggggttttgttcctctcgatctcctctttctttatacccccaagaatcaagcgaatcgttgagttttctctccgaatcgaattcgttttgattttatccctaaaaccgagtttgaattcttcccgaatacgattcctctcgtttggagctcgatctcttcaatccaatgccatatatagcttcctctcgttgtcctcttccgtttgccccctctcccgagctctcccgtgcctcctagcgccgccgcgacgtgttccaagttcgccgccgccgccggccgtcttcggcgtcgtcgccgcgccgtctccgccgtcgccgtcgcttgccgtcatcgccaagaggtgcgccgtggtgagaggaagctcggccgcccctcctttttcgccgccgatcaccggagccctctcgtcgccgtcgacccgagccgccgccgccttccttctcgtcgccggccgccatcgtgcatcggttgacgacgtggtgagtaccaacgggttcgcctcgttgtcctctacgcgtaggtgtcctccaatcgtccggtcgaccgctctagcgccggcgagctcgcggacccgagccggccgccgttgctgacgtcatgccgacgtcatctccagggctgacgtcatctcctctagggctgacgtcatcgtttccttttctttttctttttcccgattttctaatagattaaaacttcggaaaatcataactaaataaccgtagatccgttttaggtggttcaagtttctaaattcttctaaaatcaagatctacatgttaaaaatatccacatgtactgtttatgcttgtttttgtactgttttgttgattttgtttatttgctttagtttccgacgttccggaggagagcgtttccgttgaggaaggttccgaagcgtttgtggaagcccaaggcaagtcacacagatcccaaacaaccctttgagcatgttgatcccgtttaaagctattattttatttcaactgtgcattgttttcgaatgtcatcgggtggtgaacctttcccagttaattaatggccgaagatgactttattttcctatgggttataatttgattagcatgaaccttatatattggattggttcagctaaatgctatatttaggtttgcttagccctgcatagaaacgttagctaactaaaaggggttaaatataaattatattacataattattattgttaataatggttatatttaatggtagctcacgatggtcaatcgtgtgatgttaattaattgataactaaaacctggataaggtgggttgtgagcatatggttttgatggttgtgctaatgacaattaaggaccggttcgcgagctactgttgtgaaacatttatcgtgccaaccacaagccagcgtgggcaatggctttatcttttgtgtagcatgattcattatagtgcgccagactgagaagtggcgagatgtccatgggggtcgctggggagtccatgctttgttttaaaagggggtgattatgatccaggaaaggtgcgctgtaatgggttatgttgtacaaggggtattgtcacaactcctttccgagataccgtggtggtattgaggcacatggtgacatgatgtggggttgtgtcttgtgggtacagtggtacacctctgatcagagtttaatctattcgaatagccgtacccgcggttatgggtgagttgagcaatgtttttcatgattagtctcacactacttattaatggtattaatgttggaatggttaattcctggtttggaggtttaatttgttcaactggggttggttgttcaaatgtggttgggcctgtgcaacacgggtgtgttgtatggtgtttatttaatattgattaattatacaactgttttactattctcttaaatatttattaaatgttgtttctgcaaatgagctatgttatgccatcctttgttatcctgtgcacttgcatatttgctgtgtggcttgttgagtatgttatatgctcattcttgcaatattcattcatcagaagaggagtatctcagtgaaggtgatgatctggaggaataggcttattctggttaagttgcctgtggagtggagtcgccttagctgttccgtagtttgttatagttttgttttccgctgcgtagtatgttattttctttgagaggaactatctacctctgtaataattttaatttgcgagtattcaatagttaattatttgtactctattatcaatattgtcattgtgtgcctcggttgattcctggacgagggtttaacacacatgtaagcgtttggaattttggatagaaattccgggcgtgacaatcaattagagtgggcttcgcttctaaggctgcaacgaaacctctactgacaattcccaaatttaatctttcaaattccttgcataattccaatggcaactatcgtccttctgtagcattgcaatagcctttcctgctaagagcatctgctacaacattagcctttcccgggtgataatgaattcccatgtcataatccttaattaattccaaccatctcctttgtctcatgttcagatccggctgagtaaagatatactttaaactcttgtgatcggtatatacctctggacgagtaccgaaaagataatgacgccaaatcttcaacgcatgaactactgcagctaactcaagatcatgagtaggatagttcttctcatgcagacgtaactgacgagatgcataggtaaccaccttcccatcttgcatcagaacacaacctaacccaagtttggatgcatcacaatacacttggaaacccttctttggatcaggcaaaatcaaaataggagctgatatcaagcgattcttcaactcttgaaaactctgctcacattcttccgaccacttgtacttcacatctttctgaagcagtcgtgtcatgggcttagcaatcttggaaaaattctctataaacctccggtaatatcctgcgaggcctaggaaactgcgaatctctgaaactgtctttggttgtttccagttggttacggattccacattactagaatcgacggcaactcctccggctgagatgacgtgaccaaggaacttcacttcaaacaaccaaaattcacacttgctaaacttagcatacagttgatgttctcgtagcttctctaatgcaaggcgaagatgttcttcatgctcttctttggttcgggagtagataagaatgtcatcaataaagaccaccacgaacttgtctaggtactccataaacaccttattcatcaagttcatgaagaaagcaggggcattggtaagtccaaaagacataacagtacattcgaacaatccatacttagtggtaaaagctgtcttaggtatatcttcctctttgattctcaactgatgataccctgatcgaagatctatcttggagaaaatggtggcacctttaagctgatcaaacaaatcatcaattctgggtagtggatacttattcttgatagtcacatcatttagtgcacgatagtccacacacatcctctgggtatgatctttcttttccacaaaaataaccggagctccccatggagatgaactcggtctgatgtatcctttctgaagcaaatcatctacttgcctcttaacttctgccaactcattggctgccattctataaggtctcttatggatcggagttgttccaggtaccaaatctattctgaactctatatcccttttaggcggcataccaggtaaatcgtctgggaacacatcaggatactcccgaactataggaatctcttccaaagttatctggttcagtcttgaccttaaagactcagaagacaatgcatgaacagttacaactcgaccatcattactggtgagagttacttttctgttagcacagtctatcacacctttatgtctggctaaccagtccatccctaggatgacatctaggtctttggattctaacaggataagattggccagaaatggtactcctttaatttctattctgaccgaggggctacgttgcaaagaaagtgcttgattacttggggtactaaccatcaaaggacgtctaagatcctctacttccatcccatgatttcccgcaaaactcatagataagaatgaatgtgtagcaccagaatcgaaaagtactgttgcaggaactgagttaacagggaacgtacccaaaatcacatctagagcatcttgagcttctgcagcagcaacatgattgacacgggcctttgatactggtgcggtagagttgctctgggcagggacaaccttcacgcgtcggggcttcggacacttgtcagcataatgtcctgggtctccacagttgaaacacaccacaagcttgctgccttgctccctcttggcaggttgttgctgtgtcgaggctgcaataaggcgtggagcttgattgcggttgttgttgccagcattgttgttgaagaactgacgctgcggacgaacaacagacgaagaacctccatgtggcatagactggtgtcctaaaataagacgcggcttctgattattcccctgttgtatcttgaattgagcaatccggcgtttcttctgctccatgcgattatacttgtcctcctgacgaatagccttatccactaatttctggaaatcagaataatctccagtcatgagtgggtaagaaagctcatcattaagtccttccaagaacttctcctgacgctcttcatcattgcgcacatcttctggagcataacgagccagacgattgaactcgtgcagatactccgtaacagagcgagatccctgggtgagcgacctgaactccttcttcttgagagacaccactcccgatggtatatgcgtcttccgaaaagcagcggtgaattcaagccaagtgataggttcagcagtagtcctattcagacggaagtgatcccaccattcagaggcagggccatgcaactgatgtgatgcaaatgagaccttctcctgatcagtgcactgaagcaaatccaacttcttctctaaggcatgcaaccaatcactagcttcaacaggattagtggtactagagaaaataggcggcctcacacgaagaaattctgctaacttattctgaggaggtgcatggttatttccctggttctgctggttctgaagttgttgcatcatcatgtgcattagctgagtctgttgagcaagaacttgagcaagggttggattctccccattgttattgttattggggttgttggggttgggaccattcccgttgctgcgagtgttcaccatctggcatggacagggcacaagaagagaaaccgggggaaaactacttaggacagggaattactttaacttttattgatcttaactgagtttcattattacaaactgaagactctcacaccactaaactcaccaacttcctaacactcaaaaaaaacaaacaaacgcatgcacttacatcctaccactgatgtaaatcacatgcaagacccacacacaagcaaacttaaaacaagcaaactaacacaacaatctaagacaacgacttaacaagtcactctagttcttccgagcatcggaggtcgattgaaggctcgttcggctcgtcttcatcatcttgggtagctacccactcaatcttggatgagtgtgcttgggttcttcttcttcttcatcacttacgttgacgaccggaggatctgctggggcaacttctttctccaccacacggacctttggcgccaattgatagcgagggacaaatagagctctcttccttgcggtaagacgaatcctgaccttctgaggtggtgcttctcccttcaacgcggctagttccttctccaaacgatccaccttgtcttctagcttgcaaatcttaccacgattccaatcttcacgatcttgggccgctaacacagtttccgcacgactttcatccatagcccatagcatctcaaccaaatgtgttgtggtagcatcattctcaattccttcagtctcaaggtaactgccacggtcacttccctgtggttgacgaggatggtaacgatactcagtgtcagccaactgatcactgtaacgatcacggagctctcctatggcgatccttgccacttcctgacatgaatggatgtagtttcttcctccagcttcgaacatcaccgatgggatatcttcactattactgttcaaggtgactttgactcggcacttctcttcatgacgatcatgaggaatctgggcataaaaaggggcagtcccaaatccaacgacaaaggacattgtacgcaactcctggacaaaaccctcaacaccaaacaagtactcaggcttgtagcgcggcatctaaagacaagtgaaaggagggagttaagacatctatccaattaatagcacaagtttttggattaattttagaaattcaaagtaaaaggtaaataaataaagtaaaccaagtttgcaagataagttggaaaagtcagaaacaatattacaagttttatacttttgaataacaggttccaaaagaaataaaagaaagttataaaatcaacttgctaaatttattttattgcagcaagattaaatgaaacaacattgtaaaacttttgctggaaaatgagccattagtatagtaatagatgtacagtactaataacactggaataaattttaaatgagaaccattaaaagagattatgaaatgcatgtgccattagtttggtttaattaaaagagaaagggaggagaacagttctacttttccaatatttttagagggcttctatgggtaaccatttggcataacctagggtcaagggggctctgataccaacttgtcatgcccggaatttctatccaaaattccaaacgcttacatgtgtgtaaaccctcgtccaggaatcagccgaggcacacaataacaaattgataatagagtatagttattactctaattattaagcgtataaaatatcattacagaggtagatagttcctctcaatcaataaagatctaagcagcggaaaaagataaacagcgcagacggctccacttcacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaactaggagctaatcaagttttaccagttatagcatcttctattatggtgagaagggtgagactaatcacg

SEQ ID NO: 2384 - DNA, 3467 bp, Oryza sativa
tttggacaaaaaaacttgaatatttaatatccagtctcagattaaaaagaagagtatctgctacaggacgcatgtttgaagagttgcaatataaaaaaaaaagtgtatttaccttcaagattgttcacgtcaatgacttggttagtgcctgaactttgcaacccgtaggtgctgtgtgcgagcccggatgaaagcgttaaatattcaatatcaaatatattaagacgtatgtgcctatattaatgcttgtataaaagcgtttctatattttatagatatgcaatttacacgtctctagcaacgtcttatataatgtaggtacgctttaaaaagcgtctccataattttgagacggtgcaaacattgacattcctactatgctttataaaagcgcctcagttatctgtgggagacgaaataaaacgtcacgtctctatcctacaaataaaatgtctccgttgggttgttttgttgtagcgaggctatggacacttggtggctaggtgctatattaactagataaaacctcgcgcatttgctgcgggaattcggtatgataactttaaaaaaataacatgtagatagatagataacatcagattaagtaaattaatgtggtttatgataatttaaatttaattagtatatagattggtgattcaaacgtaaaaagtaagttggtatgactttatggaagaagaaaagtagggagataatttggaccgtataatcatctaaaggctaaaaacaattgatgtgatatgacttaattagaggaaaaaaggaaaaagataatttggaccatagattaatcatttaatcactaagtgaggatgaactatataagtatataggatatcataaaacataaaaagatatacattgaaacattatgtgaatgatgttggatgataatttaacatgtttgtagttgaaaagctgttaaattataaaaactataaagatatagcatgtttgcatgatgtttaaatgtgatgattgttaatggatgatgatgtagcatcttgttaattagtgaatgataatgtggtatcttgttagtagatgatgatatggcatctttgcatgttaagcttaaggagttagtgggagataactttatagtaagataggattgggaggagcgctcatgatcagagctatggagatatatacttcggctgcactttattaacgaatatttcgtgttcctatatcatcatctggtgtatcttgggtgatcattgactgaaatgatagggaagacacaagtcgtcgttccgctatatcggcaaacttgtacaacgtacggactcaggaaaacggaccatgtgaaaccctagttttacattccacttgttcaacgcatgaggatgaagagggaggtaccaccgtagggattcccttgcctggcagtagaggattgaaggatgttgaatctaccttaatgaatggctctaattacaggtaccaccgtaccaggaggtagcaaaggttctcatgactcatggacggttaaaaagctagctcttgcccgttatatggtcgtgtgggaacaatggatttctaatgttagccttgagaacccaacgatttaattattacaaagcaaaaaatatatcggcaaacttgtacagtgtacggactcaggaaaacggaccatgtgaaaccctagttttacattccacttgttcaacgcatgaggacgaagagggaggtaccaccgtagggattcccttgcctagcagtagaggattgacggatgttgaatctaccttaatgaaaggctctaattacaggtaccaccgtaccaggaggtagcaaaggttctcatgactcatggacggttaaaaagctatctcttgcctgttatatggtcgtgtgggaacaatggatttgtaatgttagccttgaaaacctaacgatttaattattacaaagcaaaaatagtttgtgaaacctggtggtacgaatatattgtatgtgtagcttgtctagctccatatattaacaagtgaaaagtgaaatcattgttagattaatgggctaggcccaattaaatcctaataaattccattggcccacattaagttctatgggtaataataccaccttagaaatctaagtgaagaggtctcaacttaaatacggagctagtggagagtctttgttgaccggttgagatggtgcgcggacaaccaggcggggcgaggcgaggcagacagctactgcgctctctcgttttgtaacggacggtaataaacaacggagaattgatttcgtatcaatgaacgcgtcggttacggaattaaacgtcgtgaattgattccgtcggttacggaattaaatgccgtgaattgattccgtattaacgagcgcgtcggttacaaaattaaacaccgcggttgatgactccgaacattaccctcgcgctcgcatatagatactccgcagcaaccagaaggacagagaagttcttcacgactcttgcacttcgagttcctcctccttttttcctgagctgcctacgcgcacaggtgtacaggatgagcaggtgcctccggaactccatccgcttgagaacttgcacgggtaggcgggcgatcaagtttttgggtatcgcttcaaacgcgactgctcttgttcttcgcggctactgctgctgcatcggtgccttcaccaagatgtcaacggagattggagacaagaagatgaacgacatcaacggaggcaatactgcctcaaaatccagcggtgggacgttctcggggtatactttcattctcccgattctattagatgtttctttgttaatactcttcgcaatggcagcattgcgttactttgtaaatgttgatgcttatttcatattaaacatactcaagttgtatatatctagcactgtcactacatctactcatattgcaaatgtcatgtttattgtcttaatattttggattaaaatataccgaattatgaccaaatttccaataatccaaaaacttgaccggtctttttcgatagttgactttgctgcatcactcaaaccagatgctttcgatggttcaaattataaaagatggaaagcacatacacttttgtggttgacggcgatgcattgcttctttgtctcactgggcaaaccgagtgaagcgcctctctctcctgaggaggaggctaagttcgaggcttcggattgcctgttccgtggagcattgtttagtgtactcgctgacaaaatagtggacgtgtacatgcacatgccttcagggaaggacatgtgggattctcttgaggccaagttcggggtttccgacgccaacagcgagcggtatgtcatggagcagttctatgactacaacatggtcgatgaccgttctgtagtggaacaggctcatgaaattcagatgctggcaaaggaacttgggaacaacaactacgagttgccggacaagttttactgatct

SEQ ID NO: 2385 - DNA, 6050 bp, Oryza sativa
cctctggcgagagtaaaactattcgaatagccgtgcccgcggttatgggtgatcaaccagatttaccgtgattagtctcacccctagtttagcgtaatgaactggtgtagttcaggtggttggttgggcttgttgcaacgtggtgtagcgttggacagtgattggttaaaattgattaattactacagctgttttactgctttcaactactggtttgaaatgcctgctttttgcaaaagaacacctagcttcctttggttatatcctgcatcatacctccttttccggtatgacttgctgagtacagtgggtagtactcagtcttgctctcttttcccccacaccagagttgaagttcttctcagatggagccgcctcagagaggttggtttcgtcgctgccgtcaaggtttgcctgtggagtggggtcgcccgctgctgaagtcaagcttcccggtttagctcgcttttatctttctcgctgcatttgtaatcttttatatttttgtaagacgtgggtctgtatgtcaacaaatgtcgtttgtgtaccctggctggtcctggacagggatttaatgcacaatcagcttagaaattctggttcgagaatttctgggtgtgacaagttggtatcagagccgaccttgaccgtaggacaagccaactggaaacctaagagccctctgaacccttttttttcatatgcatatgctcttttgcacttggatttgtttcaggaaaatttggggttttgcctctttggtttgtgggaaaaatcttggtcgttcattcggatcggatttttaaaattagctcagtgtagggttttagaaaaaaaaatctatttgggggttttaaaattagctcagtttaggtttgttgcttgtgggttagtcggcggtcgatatcatgtgtcagtggtatgactgcctcaattaggagttgcgtgcctctttttcagtgttttaatcaagattaagataattacacttaaattcataagcaagattagtttctaagccccctgtttttcttccttttctcatatttctccctatccccttcagatggagacaaggaatggttaacgggactccaacaatgccagtggcagcgaagagccgatcaatggagcacgtgccaacagtgcatctgacaacagtccgtccccatcgcctgagaacccaacaattgctcaggtgttgaacaatcagactcagataatgacaatgatgatgcaacagatgcagcaacagtaccatcaggtgttgcagcaggtgcagcagcaagcacagcagcagcagcagaacctgcagtttggtcctccacctcctcagtccaaactgttagaatttcttcgtgtcaagccgcccaccttctcaagcaccaccaacccaatcgaggcccacgactggcttcatgccattgagaagaagctgaatcttttgcaatgcaacgagcaagagaaggttgcttttgctacataccagctgcaaggccccgcttctgtttggtgggacaactacatggtgacccgtccagctggggcagaggttacttggacagagttttgtcatagtttcaataaagcccaggttcccgagggagttgtggcgcaaaagaagagagagttccattccctgcaacaaggaaccagaacagttatagagtatttgcatgagttcaaccgcctcgcgcgctacgcccctgaggacgtgcgtaccgatgccgagaagcaggagaagtttatgtctggtcttgatgatgaattgaccaaccagttgatctctagagactatgaggactttgagaagcttgtggacaaggctattcgtcaagaggagcagtctaacaaaatgaaccgtaagaggaaggcagcctagttcaggactccccaggggaagtgttagaagcctcgtttcacaatgggatatcagggtggaccttccaccatgattatccgacagcaccgtccctaccacccgggtagcttcaacaagaaccaccatagtggcagtcacaacaacagtgagtagcacagcctcaaccctactccgagttcactaaagattccagcccaatcagttcagccacctttgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggtgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagcccacctcattcttctcgaatccaaggacctagatgtcatacttggaatggattggttgacaaggcacagaggagtgattgattgcgccagccgcaccatcaagttgaccaatgcaaaaggagaggtggtaaccttccagtctctagtgccgcagaagccagggatcagtttaaaccaggctgctggtgaagaacaagaggtagcagtggagaaaaccactaagaagctagaggatattcccatagtcagagagtatccagaggtttttccggacgatctgacaacaatgccaccaaagagggatatcgagttccggattgacttggtacctggaactgcaccgatccacaagaggccttacagaatgggagccaacgagttggcggaagtcaagaagcaagtcgatgaacagttacagaagggatacatccgcccgagcacgtcgccttggggtgctccggttatctttgtggagaagaaagacaaaaccaagaggatgtgcgttgactaccgcgcactcaataaggtcaccatcaagaacaagtatcctttgccaaggattgatgatctgtttgatcagttgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatacacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatccagcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagttgttcatgctttaaagatttggcggcactagcaactacccgacgcatgatctagaattggccgcagttgttcatgctttaaagatttggcggcactatctcatcggtaaccgttgtgaggtatatacagatcacaaaagtctaaagtacatcttcactcaacctgatttgaatctcagacagcgaagatggttggagctgatcaaggattatgatatgggaatacattatcatcccggcaaggctaatgtggttgcagatgccttgagcaggaagagctactgcaatgttgcatgggtagagcaactatgttgtgaggttcaacgcgatttggaacatctgaaccttggtatagttgagcacggattcgtggttgccctagaggcacagcccacactggtggagcaggttcgcatagctcaagcaagtgatcctgaaatagcagagctcaaaaagaacatgagagttggaaaagcccgaggttctgttgaggatgaacaaggaacaatctggatgggagaaagattgtgtgtacccgaaaacaaggaattaaaagacctgatactaaccgaggctcatcaaactcaatatttcattcatcccggtagtacaaagatgtaccaagacctcaaagagaagttttggtgggtcagcatgagaagggaaatagctgaattcgtagcactctatgacgtctgtcaacgagtaaaggcagaacaccaaaggccagcaggtttgctacagccacttcagattccagaatggaagtgggaagaaatcggaatggatttcatcaccggtttgcccagaacgtcatcggggcatgattctgtttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaaaccaatttacttcaaagttctggcagaaattacaagaagaattgggaacccggttgaatttcggcactgcttaccatccacaaacggatggccagaccgagcgagtcaatcaaatactagaggatatgttgagagcctgtgcgcttgactttggtggagcatgggacaaaagcttgccgtatgctgagttctcttacgacaacagttaccaagctagtctacagatggcaccgtttgaagcactgtatggacgaaggtgtcgtactccgctcttctgggatcagacaggggaacgccagttgtttggtacagaagttttaaatgaggcagaagagaacgtcagagctattagggaaagattgagaatcgcgcaatctcggcagaaaagctatgcagacaaccgccgaagggagctcgctttcgaaacaggggattatgtgtatctccgtatcactccgctcaggggagtacatcgcttccagaccaaaggaaagttggcaccacgctttatgggaccatacaggatcttggaacgtagaggtgaagttgcttaccagcttgagcttccctccaacatgcttggcatccacaacgtgttccacgtctctcagttgaagaaatgtttgagagttcctgaggaacaggcaagtccggatcacaccgaaattcaggaagatctgacatatgtggagaagccgactcgtatcctcgaaaccagcgagagaaggaccagaaacaaagtaataagattctgcaaggttcagtggagccaccactcagaggaagaagccacttgggaaagagaagatgagttgaaggccgcccacccgcacctcttcgccagctcttccgaatctcggggtcgagattccgtttaaggggggtaggtttgtcacgcccagaagtttccccctttttcttgctttaaaaattggttaaataaattgcctgaagaaattatcttaattaacctagagctaactccataattaataaatgcaattaataatcggaaatagcgtggtggaatttttcttgagttccccatgctccaatgcattaacaagatttttagtggaattttcagagccttagaaataattttaaccaattaaaaatcaccaaagtgcaatatttaatcccaggaaaatccttctcctctttttctttttcttttccttcctttttcactagatgggccgtcggcccatctctctccc

SEQ ID NO: 2386 - DNA, 1033 bp, Oryza sativa
attcccagcaatagcgcagaaatacttctgttattttatggttacagagttcatccgcaagcgcacggatataccattgtagcatttcacccgagagtattccaagggtatcgtatttattttatcccgtgggaagatcatgtagagagaacttgactaataatttatatattagttgtgataatcatattctaagcaggggttaagataatccaagggtagagtgacacacaagctctagctactcattctcataatatattatctaagctaagcggaaagaaaagagagagaaaatctattcctatacttctaatgtacatagtgtacatacattctagttaaccgatatactagctaatatcctctatccgatgccctcctggtactttgagaagccacccctgactgccgagttccttatgacagcccgttatgaccatacaaccggagctaaatacgggggaataccctccccagggaattaacttaggattatataccggcgtggaggaatacccatactgagctgtcaccatcagcggtccacctctcatccgcagtatataatcccaaataatgatatcccgtaatctatacaccacgcctaaactaccagatactactctaatatcatcgtcatgacatagagtaattgcatatgcaaacattatacccgcaccaaagcatctcccagataagctagctgtatattcagtataacatgaacataatgtaaagtaggtactcatatactcagaaagtatttcaataccataaatgtatatagaagagtattctaataaaagtaaaaagcctacaaaagaggaaaggagagctactagagccatacccgaactcttccgaaggcttccggactcctgatttctattgtattcctattccaccagctagatactactaaactaaatttgagagaaatgagagagctcttgcttgaggtatgtgttgaagtgaagatagtgaactccttaaataggcaggtaatgatggttatggtggttggaaaggt

SEQ ID NO: 2387 - DNA, 711 bp, Oryza sativa
tagaataaaaatgtaataccagtaataaatatgtaaatattctttgccaaatatgtatatttatctatatatattattaagaaacatagaaatctttattattaagacaactcgaaaagaatgtgccatatttattctaaaggatataaattatcacgttaatcgaacaataaattccaagccgttagactgtggtggaaccaaattagaatggtgaagattgataacagaaatatatgtaatataagtgtatctttagaactaaacaatggtatatagaggagtaagtgacagcatttgatgaaacttctaaatattataaaaatgaaacgaaacaagataataaactctaaaaagtataaggtccaatttttaaaggtttgggactttagaaagtaaaaaaaacaatgataataaagttccaatttaaatcacaatgataataaagagaggagggagcatgcgagccatagaatagtacaatggcaaagccgataatggtttggtgggacttatagaaagtaaaaaaatgaactcaaacaataattatgtttgatttttagaatcctaatgacaataaagagaggaggtagcagatgggccgtagaagagttcagtggtagcgtttgatgagactttaaaaatataaaaatgaactcaacgagaaaataaactctgaaaacaaccaggtcctatttttaaagattcgga

SEQ ID NO: 2388 - DNA, 947 bp, Oryza sativa
caactcttgaaaactctgctcacattctactgaccacttgtacttcacatctttctaaagcagtcgtgtcatgggcttagcaatcttggaaaaattctctataaacctccgataatatccagcgaggcctaagaaactgcgaatctctgaaattgtctttggttgtttccagttggttacggattccacattactgggatcaacggcaactcctcctgctgagatgacgtgaccaaggaatttcacttcagacaaccaaaattcatacttgctaaacttagcatgcagttgatgttctcgtagcttctccaatgcaaggcgaagatgttcttcatgctcttctttggttcgagagtagataagaatgtcatcaataaagaccaccacaaacttatctaggtattccataaacaccttattcatcaagttcatgaagaaagcaggggcattggtaagtccaaaagacataacagtacattcaaacaatccatacctagtgataaaagctatcttaggtatatcttcctctttgattctcaactagtgataccctgatcgaagatctatcttggagaaaacagtggcacctttaagctgatcaaacaaatcatcaattctgggtagcggatacttattcttgatagtcacatcatttagtgcacgatagtccacacacatcctctgggtatgatctttcttttccacaaaaataaccggagctccccatagagatgaactcggtctgatgtatcccttctgaagcaaatcatccacttgcctcttgacttctgccaactcattggctgccattctataaggtctattatggatcggagttgttccaggtaccaaatctattctgaactctatatcccttttgggcggcataccaggtaaatcatctgggaacacatcgggatactcccgaactataggaatctcttcca

SEQ ID NO: 2389 - DNA, 475 bp, Oryza sativa
atacatgactattcgaatttttaaaaggtttaaatcatgcatgtggcttttacatatgttaattagagtttttagaatttaatttaatataattcctacggtaagtatatatgatgattacaatttttattaattttaaatcatgcagtatgtacatacatatcttaattagagtttttaccaatataataatattattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctgtaatctttagtcccggttcttaaccctaaccgggtttaaaaataatatcgaaatagcgggacaagatat

SEQ ID NO: 2390 - DNA, 1147 bp, Oryza sativa
cggcgaccttcacccggaaccaaaggagaaaggaagccattacttgagtccagccagctacactcttagcaaggtagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttcaagacaatgtccgggcaacaataacaaagctatgtgcattcatgaacgcaatttcgcagaaggtcatcgatccggatagattagatgcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgctaagggttatggaacagaggaggtcatcgaattttgcgtagaatttatcgaagaccttcgcccaatcggggtacctgaatcacgccatgaagggagactacggggaaagggaactctcagaaggaaagcaattatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtcttggtcgatcgcgacattccagggatatgagatcaatgggtacacattctacacgagagcccaagacatgaagagcacgaaccaaaacagcgctgtttgtgtcgatgccatgggacacgatggaacaactgccacgtattacggtgccatcgaggacatacgggaacttgactatggtcctctcaaggttcctctgttccggtgccaatgggttaggttgactggtgga

SEQ ID NO: 2391 - DNA, 445 bp, Oryza sativa
aaccgggagtaaagatccgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctagggtgagagccgccgccgccagatctccctttatctcgatctctccgatctcgatctctctccgtcgcgccgcccgccacgagacgacgcgccacgacgacgacgcgccacgccgacgccgcgccaagccgccgccggcacgccacgccgccgtcttcgccgccgcgcgcgcaatgccgccgccggcacgccacgccgccgccgccgtcgccacgggctgcagga

SEQ ID NO: 2392 - DNA, 1896 bp, Oryza sativa
tagccgatgattccacaggacaaaaggtagaggagatcccggagattgtttcccctcaatcaatttcaccggaaacggaaaggaacggccggatttggaaaggaacggcggcggcagctcggcggcggcgcgctagggtttcggcccgaggaagacgacggacccacctgtcagcgactgaacgcgcgcgcgcgcgtgggcggctgcgaactgggccgacttgggccggggagagagagagaaggttttgggccgactttcggcccaaagccaaaagagaactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttcttttcaagacttttaaaattattttctagaaattccatttaaacaacaatttatataatttgaatttttagggtgtgacaaacctaccccccttaaacagaatctcgtcctcgagattcggaagaactggcgaacagatacggatgagctgacttcaattcatcttctcgttcccaagttgactcttcttccgagtgattactccactggactttgcaaaaacggataactcgattcctggtccttctctcatttgtttccaagatacggattggtttctccacataagtcagatcctcttggacttctatttgttcaagattagcttcttcggtaggtacccttaaacatttcttcaattgcgacacatggaacacattatggactcctgccaaagattgaggtaactccaactgataagcaacttctcctcttctactgacaatcttataaggtcccacaaaacgcggtgccaattttcctttggtgtgaaaacgatgaactcctcgaagaggcgtgacacgaagatacacataatctcccttaggatacaactcaaatctctgcggtgattgtcggcataactcttatgacgagactgagccacacgcaatctttcttgaatgattttcaccttttcttctgcttcccttaggatatctgtcccgaaaacctgacgttctcccgtttgatcccacaaaagcggagtgcggcacttttgaccatacagtgcttcgtacggagccatctgaagactagcttgataactgttattatacgaaaattctgcatagggtagattcttatcccaacttccaccgaaatctaaagcacaagctctgaacatgtcttccaaaatttgattcaccctttcggtttgtccgtctgtctgcggatgataagcagtactaaagttcagcttagaacccatctcttcctgaagtttcttccaaaaatttgaagtaaactgacttcctcgatcagacactatcttcttagggacgccatgcaaacacacaatccttgccatatacaattccgctaagcgacttccggaataagttgtctttaccggaatgaaatgtgccaccttggtaagtctgtcgactattacccaaatagagtcatggccagatgacgttctgggcaaaccagtgataaaatccataccgatttcttcccatttccattcaggaatcttcaaaggctgcagcaaaccggcaggtttctgatgttctgccttgactcgttgacaaacatcacatagtgctacgtattctgcgatttcacgcttcatacttgcccaccaaaatctttccttgcgatcctggtacatttttgtactaccagggtgaatagagtataaagtatcatgggcttctttcagaattgcatcttttaaatctttgttgtcggggacacaaatctctcacc

SEQ ID NO: 2393 - DNA, 1362 bp, Oryza sativa
gttacttgagtcagtcttgaccttaaagactcagaagacaatgcatgaacagttacaactcgaccatcattgctggagagagttacttttctgttggcacagtctatcatacctttatgtctagctaaccaatccatccctaggatgacatcaaggtctttggattctaacaagataagattggctagaaatggtactcccttaatttctattctgacagaggggctacgttgcaaagagagtgcttgattacttggggtactaaccatcaaaggacgtctaagatcttctacttccatcccatgatttcccgcaaaactcatagatagaaatgaatgtgtagcaccagaatcgaaaagcactgttgcaggaactgagttaacaaggaacgtacccaaaatcacatctggagcatcttgagcctctgcagctgcaacatgattgacacgagcctctgatgctggtgcggtagagttgctctggacagggacaaccttcacgcgtcggggcttcggacacttgtcagcgtaatgtcccgggtctccacagttgaaacacaccacgggcttgctaccttgctccctcttggcaggctgttgttgtgttggagctgcaacaggacgtggaacttgattgcggatgttgttgccaacattgttgttgaagaactgacgctgcggacgaacgacagacgaagaacctccatgtggcatagactggggtcctaaagtaagacgcggcctctgattattcccctgttgcgtcttgaattgagcaatctggcgtttcttctgctccatgcgattatacttgtcctcctgacgaatagccttatccactaatttctggaaatcagaataatctccagtcatgagtgggtaagaaagctcatcattaagtccttccaagaacttctcctgacgctcttcatcattgcgtacattttccggagcataacgggctagacgattgaactcgtgtagatactccgtaacagtgcgagatccctgggtaagcgacctgaactccttcttcttgagagacaccactcccgatggtatatgcgtcttccgaaaagcagcggtgaattcaagccaagtgataggttcagcagtagtcctattcagacggaagtgatcccaccattcagaggcagggccatgcaactgatgcgatgcaaatgagaccttttcctgatcagtgcactgaagcaaatccaacttcttctctatggcatgcagccaatcagcagcttcaacaggattagtggtactagagaaaataggcggcctcacacgaagaaattctgctaacttattctgaggaggtgcatggttatttccctggttctgctggttctga

SEQ ID NO: 2394 - DNA, 875 bp, Oryza sativa
gcgaagacggactctccggacacgacggaatctaagcagaaaagaacaaaatcaccaaaacagcacataaacaagcatgaacagtacatgtggatatttttaacatgtagatctcaattttagaaaaaattagagacttgaaccaactaaatcggagctaagatgaattagttatgaatttttaaagattaaatcggattaaaacacttatatcggttaaaattgaattatgacgcaataatgaattatttttgaaaaggaaaagaaggtttattgcgtcagcgggctagggtttgcggtggaccgggcgcacggcggcggttcacgcgaacggacggccgagatcgaaccgatctaagatggacggccgagatcgatcgggtccacggcggctcacagcggacgacctcgatgacgtcggcaatgacgtcaccgacggcggcggcggctcggcggagcagacggctcgggcggcgcacgctcgctggcgaacgacggcgcgaggacgcaaacggaaggcaccagcacgtagaggacgacgcggcgaactcaccggtgaccacaacggcggcggaaggtcaacggacggcgacggcgacgaggaggaagcggcgaagctcttcgggtcgacgacggcgatgatgctccggcgatcttcggcggcggcgaaggggcggacgaggacggcgacgcaacggcgaccacgatgacgtccttcccgagcgacggcgacgtctggaacggcggcggagcacggctggagcggcggcgacgacggcggcgctagggcacacggcgctagagctcttccggcgacgagaggcgaaggcgagggtggcgacgggtagaggagaccacggggagccttttaaagg

SEQ ID NO: 2395 - DNA, 954 bp, Oryza sativa
gctccgcctagccgccgccgccgtcggtgacgtcattgccgacgccatcggggtcgtccgccgtgagccgccgtggacccgatcgatctcggccgtccgtttggattggatcgaatctcagccgtccgttcgcgtgaaccgccgccgtgcgcccggtccaccgcaaaccctagcccgctgacgcaataaaccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttgttgaatttgttcttttctgcttagattccgtcgtttccggagagtccgttttcgccggagaagaatttgaagagttccaaggccagcaaggcaagtcacacagatcccaaacaaccctttgagcatgttgatcctatttaaagctattgtttctattcaactattgcatttattttcaaatgccattgggtggaattaacctattgtttgttatagcccttttgttcttgattaccttattccttgataccttgggttattataacttgactagttgggctttatttattggttcaactagatattagatataattgctcagccctgcttagaaacattagcacactattgggataacttatgactcactgttatttaatgatggcttaatgatagttcacgatggtcaatcgtgattggttaattaattaacgtgccaactaaaacctgataatggtgggttgtgagcacatggttttgatggtcgtgctcatgacaattaaggaccggttcacgagtttcggttgtgaaacattaaccgtgccaacca

SEQ ID NO: 2396 - DNA, 1166 bp, Oryza sativa
gggatttgtaccaggagttgcgtacaatgtcctttgtcattggatttgggactgcccctttttatgcccagattcctcatgatcgtcatgaagagaggtgccgagtcaaagtcactttgaacagtagtagtgaagatattccatcggtgatgttcgaagctggaggaagaaactatatccacgcatgtcaggaggtggcaaggatcgccataggagagctccgtgatcgctacagtgatcagttggccgacactgagtatcgttaccatccccgccaaccccaggggagtgaccgtggcagttaccttgagactgaaggaattgagaatgatgttaccaccagacatttggttgagatgctgtgggctatggatgaaagtcgtgcggagactgtgttagtagctcaagatcgtgaagattggaatcgtggtaagatttgcaagctagaagacaaggtggatcgtttggagaaggaactagccgcgttgaagggagaagcaccgccgcagaaggccaagattcgtcttaccgcaaggaagagagctttatttgtcccacgctatcaattggcgccaaaggtccgtgtggtggagaaagaagtagccccagcggatcctccggtcgtcaatgtaagtgatgatgaaggagaagaatcgaagcgcacccattccaagatcgagtggggagcaactcaagatgatgaagacgagccgaacgagccttcaatcaactccgatgctcggaagaactagagtgccttgttaagccgttgtcttagatcgttgtgttagtttgcttgttttaaatttgcttgtgtgggtcttgcatgtgatttacatcagtgatgggatgtaagtgcatgcgtttgtttgtttttttttttgagtgttaggaagttggtgagtttagtgttgtgagagtcttcagtttgtaataatgaaactcagttaagatcaataaaagttaaagtaattccctgtcctaagtagtttttccccggttcctcttcttgtgccctgtccatgccagatggtgaacactcgcagcaacgggaatggtcccaacctcaacaaccccaataacaacaacaatggagagaatccaacccttgctcaagttcttgcacaacagactcagttaatgaacatgatgatgcagcaacttca

SEQ ID NO: 2397 - DNA, 4304 bp, Oryza sativa
  unsure (1)..(4304): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctttgattgcgaggatgttctatacatcaggtcagaatatagcatgttttttttcagttctaacattatcaattttgttttgtttatgacgtgcaactaattatatgtgtgcatttggtttgcaggtattcctttcaatgttgcaagaaatccatatttcaggaaggcttttcagtttgcttgcaacaaccaacttggtggttatacccctccaaatttcaacaaattaagaacaacacttcttgttcaagagaggacaaatgttgagcgcttgctgaatgctctcaagtcaacatggtctactaaaggtgtgagtattgtatctgatggatggtctgatgctcaaaggcgaccaatcttgaattttcttgcagtgacagaagatggaccaatgtttttaaaagcaatcaatactgaaggagaaatcaagaggaaggaatatattgctgagaaaatgtttgccatcattgaagaggttggcccaaataatgtcgtgcaagttattactgataatgcatctaattgtagggctgctggattgatggttgaacaaaagtacagccacattttctggacaccatgtgttgtccatactttgaacttagccttgaagagtatatgtgctgccaaaaactctagtggggatgcttttctagaattccaatggattagtgaagtggctacagatgcatctgccataaagaatttcattatgaatcactcaatgaggctctccatgttcaatgattttagtaagctgaaatttcttgccattgctgatactagatttgcatctactattgtgatgcttaagaggtttcgtgctatcaaagagaacttaatcttgatggtggctagtgaaaaatggaatacctatagggaggacaatcaagttcaagcacaacatgtcaaggagaagattttaaatgatttatggtgggataaagtgaaatatatcattgatttctgtgagcctatctactctatgattcgtgctgctgacactgacaaaccatgcctccatttgatctatgagatgtgggattccatgatagataaggtgaaaaaaatcatctatcgtcatgaagggaaagaactagatgagcaatgttcttttttctttcatgtgaatgagatcttacacttccggtgggcaaaaagtactacccccttgcattgcttagcacattcactaaacccaaagtaatgatgttctacctcttttcaatttttatgtgcataatttataattgttgctagcagctcaataatcttttttacaacatgtaggtactactatgagacttggttggaggaggctccaaaccaccaagcccctcatatggatgaggagatttcagatatgagaaataagtgttttagaagatatttctctggggatgaattgagaaagatcaaacaacaatttgcagatttctcattgtttggcagtgggtttaattcctttgactcaattgaggatagagcccatatgaatgcaaagcaatggtggggaatctatggtaactctgcacctgagcttaaaaagttggcactaaaattacttggacagccaacatcatcttcttgtgccgaaagaaactggagcacttatggtttcatccatagttcaatgagaaacaagtttagttccttctcttacttatttagtttcctgtatgttagtaatgcatgaaattaacacaattgcattttttttagtcttaggcctgcacgtgctgaggatttggtgtttgtgcaccaaaatatgcgtcttctttctaggagatctgaagaatactacagtggcccatcaataatgtgggatgttgcaggagatagatatgagttgtttgatggtggtgctgattttcttcaacaagctgaactgacacttgatgagcctgaccttgagagactactggaagatcttggtgcattggacatacaaggcgataacgggccttcatccacttcggttccaatggatgaaatcaacaatcaatttatctagtcttgcaatctagttattgagttgaatttgaagtcatggacaagttaattaattctaattagtttagcgctgtggtgatgctctactgttgatttatctactatgtgaacaattttatctaccatctatttgaagaacacatgtgttgtgattcctattttttaagtccatatttcacacttagtttttttgtatttttaaattgtatatatgtatatattcgcgtatccccgtatccatgtttttaggaagacggtgtatcccggtatcaccgtatcgcgtatccgtatccgtatcagcgtatcggggtaacgcagtagaagagtcggcggcttcttccagaatccacagacttctcgtctgcaagcagtcatagttcaaatttaaacttcaacaaacttaaattttaaagttcttttggttttttaatcatagttgattttttacgttaactttaataccagttaaatatagaaatataaaaaatttactgcaaacttttttcttcgtttatgggtgtgtttagttgaggaaaaggaaatttttgggtgtcacattaaacgtttgaccggatgtcggaaggggtttttagacacgaatgaaaaaactaatttcagaactcgtctggaaaccgcgagacgaatcttttgagactaattaagccgccattagcacatgtgggttactatagcacttatggctaatcataaactaattaggcttaaaagattcgtcccgcgatttcctccataactgtgcaattagtttttctttttatctatatttaatgctttatacatgtgtccaaagattcgatgtgatgttttttgggaaaaaattttggggaactaaacaggccctatttctcaacgataactctatctcaaacgattggggtatggtgacaaaatttgaagagaaagaaaaaaaataatttaaaaagacacttctaatattcgaaattgtttgtgacttggaatatggccaaaatttgtcagcgttgggagatttattatacaattgattaggtctataaaatgtcccatatctctctcaaaattcaaaatccatccatttgctccatcgttatattatttgacaaaattaaccatctccattcttttacctcccatcaactttcataactactctcaatcttaaaccagaaggacaagaattactctcatcatagtgattactacagttttattgtgccaacccttgtaaaccttcacaaattttttttttagagttgtcactcacacgttcatcaactatcaactagcaagcgcaggatagcccgccacaatcacctaaaaagactagagcccaaaaatactatatttcttcgtcccggaaaacttgtcgttttatggttgagtgaacaaattaactacaagtaaaaattaccatattacccttatttaatcattgcatttgtcacttcagataatcacttctagtagaccatctatcgcattgtacacacatagatagcactagtagtggcacggttgtatagggaaatagtatgccaaataaatcgatggaatagactaggctcagctcgttggtcaagatgctgtcaagatgctagaacgataaattttgtgggacattttttgaatagcggaatgacaggctttccgggacggaggaagtattccacttactaaataccaatatacctaaatctgagaaaaatataaacccatactagtcgaataaaaactacattttaaccctacattttatctgtttatcttactttttcatcacatcaaaactttcctacacacatgaactttcaacttttccgtcacatcgttccaatttcaaccaaacttctattttttgtgtgaactaaacacaccctagttcgaagatagaacacacaagctcatgggtgtgt

SEQ ID NO: 2398 - DNA, 19762 bp, Oryza sativa
caacccatatcatcagtacttgagtcggtctcactgcttataaaaaaacatgcaaatcttccccgacctctcattcaagagttgcctttatgcaataatgttggctgccataatcaattttagttttttttttgtctcctctcttaagagctatcactcatttcatataggttgctttattgtttctgattgcgttttataccacttctcttatactatactcagatatgaaatagggaagatggataaatttgataggtttcgtgatagcgatgtcagtaatttgacgagttttgtgataatgatatatatgtagaatgatgtgttttttttactaagacaattcattagtactccatccaatgtaagtcattctagcattttccacgttcataatgatgataatgaaactatatagatatatatgtctagatttattaacatcaatatgaatatggcaaatgctagaatgacttacattgtgaaccggaggaagtagttgattaattaaatgccaaattcatagtaagccatatgatagaagattgaaaatttgtgaaaaagggaagcaatttcgcctcgtttttggatgcccacaatcttaaccaagaacttcaactcgtgcgcccccaaaaaacccccacctttctcttatcccctctatccgccgctcgccggccatctccctcccccaccaccaccaccaccgccgcctcctctccggcgagatgctgacctgcggccgcttcctctcctcctccgccgccgcctccaccccctccctctcccccttccggaacctaaccctctccctcctccgccgtccccatttccgcctcctctcctcctccgccaccgcctccgccgccgccgccgccgtcgagcccgacaccaagggtaaatatcctgaaccttcaaactcgagggaacacctcgcggtttgacagcgagagccgttctgagctgtgggtgtatgggtggtcgcaggtggcgcgggtggcggcgccgcgaagccgcagtggaaggcggcgatagacttcaagtggatccgggagaacacggacgccgtcgccgccaacatccgcgaccgcaactccgccgccaacctcgacctcgtcctccagctctacgacgagtacctcgccttgcagaaggtacaggagcctgttaattaattgtcatttgctactgctgctgtttgtagtttctgagatgctgctcttgcgtgactgcctgcaatacaagttggatggataagatttaagcttgcgctgtaaaattataatgcaaagctcgtgattcgcaagacttttaaactgttggataagacttttatggagcttgtcattgactcattgctgctgctgctgtttgtagtttctgattctgctcttgcgtgactgcctgcaatagaagttggatgaattaagattaagcttgcactgtgaaattatattgctttagtttgtgatttccaagagttcaataactgttcgagatgattgatagaaaaatttgcaactttcgtgtgaacttagacatgaactggttcttaactggcctattcatatggttaattcattggcatgtgttatgttactttctgactattagtgagttgtgcctattgcaaccttgtaattttgggggtagcaaaatattaggaagaaccaaaaattgaaactagaaactactctttttggccagtagtcatggctattaattggttatttcgttgattatattggatcactgattgattctgctttactgatcttgtgaactcaaaattactcatggcttcatggacttatccttgcctggacgacacttttgtttatggcgtaaatatgatactgtgttactgcgatttaacctattttggcatcaatgtctcattgttctaccgaagacacgtgtgtatctgcttgtgtgtatgcttgcagtgattgaacatagttggttatttaattctggactgagatatggtggcaacaattcctaattatgacagatggcaggaagttgaacggctccgagctgaaagaaatgcagttgctaataagatgaaagggaaattagaaccatctgtgcgtcaagcccttgttgaagaaggtagaatgtttatgaatttattttctaaaaaaaatgaaacagcgataccaacatagtaatttttttttataaaaaaattggattgttgcaggcaagaacctgaaagaagggcttattgccctagaagaggaccttgttcagctgactgataagcttcaactagaagcacaaagcattcctaacaccacacatccagatgctcctgtagggggtgaggaaagttctgtcgtcagaaaagaggtagtgggatttctgtgtatctaactctgtcttttcagtttgtccaactgctaattttcttttacttgaataatgcaggttggtagtcagagaaacttcaatttcaccattagagatcaccttcagctgggaaaagaacttgatttgtttgattttgatgcagctgctgaggtataactgccacaaatcaatgttaaacataactttgcagtaagttgttcaatagcacagttatatttgaactggacagaagccattacctgaacactaactcaaagatgatctacaattgtagctcctatatgagcagttgtacttcttttcacttgttcattttaccaaggttgtatactgtcattttcaggttagtggctcgaagttctactacttaaagaatgaagctgttctgttggagatggcccttgttaattgggccatcactgaggtctcaaagaaaggtttcacaccactaataactccggagattgtaaggtcatctgttgttgagaaatgtggcttccagccaagggcccaaaatactcaggtatattgatccaagatacctttacatcctggttaatagatgaattcagcttttagagctggttgtgttaggaggatcttatgcccataatttcaagaaaaaggtgagtaactttctctaggatatgcttttgtgctgtatgatgtggcatgttaaagtcgtagttggctcctaatttatgaattctctcctaattacacaggatcagatcagctattttgtcatctttattttcattacatgatttggaaatttcatcgatctttcatcgtgtgaaagtaaacatttatttcactagttaaccttctattgtgtttctgtaggtttattcgatcgataacagtgatcagtgcctcataggaactgcagagattcctgttggcggcatccatatggactctatactccctgattctgatttgcctcgaaaatatgtagcctattcacattgttttcgcacagaagctggtgccgcaggtgctgccactaggtatgcatattttcttgttctgttaagattatgcattggaaattgctctccactgatttatgtaatttgatcacagtatgttgattacatattgtatagatgtgtgaagatttgttcattggttattcaaaactttgagatactccctcttttttttatttgatgttggttagttcatttttgaactaacgaacattatgtaaaagagaatggagggcgtagtttacaattcttgtatgaagttgctaagttttggtcactgcatcctgaacaggggcctctaccgtgtacatcagtttagcaaggttgagatgtttgtattttgccggccagaggagagcgacaagtgccatgaagaacttatcactattgaagaggaactttatgcatcacttggacttcatttcaagtattccctgatcttctgaatttgcatgtcattataatttagaggcaacaatatcatgctctttcttgcagaactttggatatggcgactggggatctgggagcaccggcctacagaaagtttgacattgaggcatggatgccaggcctagataggtacggtgaggtaagaaacattactcaagccctctgcttttgaacttatattcaatttgaagcaattgccctaacttttcctaatcgaaacgaacagatctcgagcgcgtcaaactgcacagactatcagagcaggcggctgggcatccggtttcgcccatcacctgcagatcctccaccggcgaacgccaagaaaggaaagggcagctcaggcccaacacagtttgtccacacgctcaacgcgacagcggttgctgttcctcgcttgatcatatgcatcctggagaactttcagcaagaagatggaacggttgtgatcccagagccactgaggcccttcatgggcggacttgaagtgctctccccgaaaaccaaatgatcagcttgaaggtcaccacgtttacttcgaatcttgttttttttatagatttacagtctttttttcccccgaggatattggcaagtgaatgtgcagaatttcaaagaaatctgtggtcgattccaaatgttccatgcgaaattcgtggctgttagttggccaccgattgtcgattgttgttttggcaacatatccaggttaactatttcctccttgtcaaaatatagcaaacttggaatggatatatagtccaatgattatggacaaggggctagccagattctttggactagtatgctttccatcagttttaatagtttgctatattttgggatggagggagtagttgaacaaactcagtattacacttgtagttaactggtaactccacatatgcccattgtattggatatcccttgcgaaatatttcctccgtcccaaagtatatggtttttaggtggatgagacatcttaatactatgaatctgaacagatttagtactaggatgtatttcattcacccaaaatatgttatactttgggatggtgggagtatttgtccacgggagaactataccggagtagtttgtgctagaacaatagtactagtgctttgtcagtttaatatctgttcgtttacggctgtgtttagttcagcacaaagtttggattttggttgaaattggagatgatgtgattgaaaagttgtgtgtgtatgataggttgatgtgatgaaaaaggactaaagatctagacacagtctacatgatgcgaggcatgcggctagagcagccagcattttgaaatcatcaaccatgctggcagttttgctagcgattgattgggccacgtggtgtgccaaaatttgagataattatgcaaattacggtggtaaaaaaaaaatcttttccaacgcgctcgccttctcggcccttcgaggctgtcgagagcccttctctcatccatcgtctttgttaaagtatggaattctcacccagggctgcggaactcacgactctattagaaagtagaataaccaacttttacacgaattttcaagtggatgagatcggtcgagtggtctcagttggagatgctgcgaggccatggaaacttaaaataacaaaataaaaaataaaaaaataacaattagtagtagttaagttccagatttcacactgcaaacttaaaagaatacaaatggatcgataggaatttcatggtaaacagagaaaaagaacaacaaaaacaaaatctaattttaaatgaataaaataagaagcacaaagagaaacttagaaaatattgaaaaaaaaacaaaattgtacgtttaaatactaagctatatattatcatcacttaatctaaagctgatcgtctccgcgtcagctgattggttaataattcacccgtcaaattcgtacacttatcccttactgtgctgtggagcaagctcagcaagctatcagagcattttactttgcaaaattataatggcatggttccaatttacccttttagttttgaagaccatagtggtaacggtgcataggtgagtacaaacactctctctcactgcttaaaaaataattttcgcatactagggtcatttatttttctagacgaatataacatttggtaccatttccctgcatgcaaaatcagggacgggggacgatatggtcgtccgcttgcgaagatccatcttcacaggcggacgacataaggtgacatcatgcatcttcccaggtggagccttaagacatccgcttgggaaaatgtaggattatctcaggcggacatcttaagagctccgcctatacagtatatttatcacgatcatgcgtcgagtcccccgctatatctttgatcggttccccatgtgtacgtttacatcgcttgcacacacattgtcacttatactactcccgtacaatttcagctacaatttgttgatttctttgtgttgcaatcctggatctctattgattttatatgaatagattagattttgttgacaggttaaagttattaatttatcggttactctgttgtgtgaatttcgatagatactcctcagttctaactgaacttcagcctagagcatcagactaaccaaaggcagacatcattaaggcctcgtttggcacagctctagctctcaactccagcttacctagagctggagctgtgccaaacggtatagaatctctattttttagagcggagttgggtgagctgctccacaaatttgtactacgggggtggagctgggtttttactgctccacagctccactccaccccaaaagatccactaccttttaattttttagcctaattacaccaaaatgccactcaacaacccctcataccctctctctcttcctgttctctctcctccccatcctcctcataacagccggcgttggcggcggccggcggctcgatggtgtcggaaggcatgcagtcagcggcggcggcgacgcacgggcggcggctgtaggcgcgtaggcaacggctgtgcgtgggcggcggcggcagcagcggccgggcgcgggaggcggggcggcgcgtgtgcggcggcggcatttcgtcgaacacttgggttgaccgccggctgtggggtcgggggcgagcgacggcggcgcgcggtctaagcgccggcggcagcggcggtagggcgataccaaccaagtgttcaacgaaatgccaaccaggaatatggtggcgtggagctcctataggagctagctctcactggagttggaggttggagccttactaaatggggcctgagttctgactctgatcttcagcttagatagtcagactagccaaatattttttttcatttttttactccagttagttcatttatgggatgaggaaatgttggcatgtttgtgtaagatctcactgaccccaaaatgtgcctggttttctgtttcttttttcttttttaaaaaaactatgcgcctaccaatcttccagttcccaacctgaaagaagcaggctagctctagaagaggaccctgttcaactgaccataggcttcaattcaactagaagcacaaaagtatttattcataataccacgtatcctttaatttatcaaagattacaagtaatagattaacacatatcttccacacggaaaacggagctgattaattaagtattatctataaaaaaacttaaaaaatgtattaatatgattttttaaagcaactttcgtgtataaactttttgcaaaacccgtaccatttagcaatttgaaaagcttgtacgaggaaaacgaaggagatgagcgaagtgatgggaaagaacacagccttgcgtaattcgtgtcgaattcgtgtcaagttttggcctactaccacttgtcgcttgctgttttcggcagtgcataatccaagttaaaactatccgattcgaacccccgccttggatgattccgattccgattgcgagtctggaacaacacgaacccgcctcaaactcggtcgatctttcttctcctcttcttcttttcgacgaaacaaatcctccaaaatcttcacgcgaggcgcaggttgagagatccacccatggccagcggcgacgaggagggctcgggctcgcgctcgcccagcaaggcggctccggctccagctccggcgaaaaagaagaagacgaagacgacgacgacgacctcggcgatggccccgctgccactagcggaggtgaagtggatcctcgcgcagaagcgagagccctacaccaacccggacgacatcgagggcttcaagatcagcagcaaccccaacaacgacaacgacgacgggttcccggaggaactcaaggcgagctgcagggactccatccgcagatcgaacatcctccgcaaggtcgcggacgaccgcttcttcgagtaccagagcgaggtcagggccgccatggagtccagcggccgcttcttggtcgacgccggcttcttcgagcgcagggcgaggggtcgcgccaagcttaacgaggcatgggcgaagttgcgcgatggcctcccgctctccgactctgacagcgatgcggatgaggaggatgacgaagacatggcattgctggctgcgatgggtttagaattcgattgagaagagaaatcgatttaattgttattattattattaccaacaaggaaggtagtccgcatattcgcgcgggcttgtacagtagattgcgttgcttaaataattgtttaatctatttgatagatttataccgtataatatttaattcatccctataagcagcagatatctatagtcttcttcatcatctaagataatgtagacttagtctatttagaaaacatatataataaattaaatgtaaattaaaaaaaggtgtttttggaaaaaaataaatgtttaggggctaactttttttttatcaaatctgtttattttctactaacacttgtgttttatttggcataaacctagcccattttacattgatgcaatttgtcacttacagataagacagagcatatttctgacttagaaattactccctctattccaatttgatcatcacttaagcaaaggatgctgagaccaaaaacaacaaaacctccatggttctaaaattattttcatcaatcaaggtgttgattgcattacgctgtaaatatttcgtggagttacaccaagataatttttttaggttacaccaatagaaattaattttggctagttgcatgcatgagcttattcaacgatgcccatttactctttacacaaaagtcatttgttatatgatgattatttaagggagatataaaaaccttggatgagatcaaactggcatggaggaacgatggtgggagtagtaaatatcaagttgtacatgtaggggttgtttggttgcatgccacaagttgccacgccaaaagttagtcattgccacagttttttagctattgtttggttcatgacacaactgtggctagccacatattttctctatatggccccacatgtcatacactagtattttttgctaactttggctaagttgtggctagcaccacacattttgtggcagccacaccttgcctaatatggggtttggcaaagttagcaagcaaccagatatcctagttatgacctgaacaattaatgtatctggagtcatcttagcatggagttataatttttagatttttttctaatgataaaataattcataaatttaaaattcaaaaagtatgtgctctacttggagttacaattttaatttttcatgattttatagtttgggaagtacaacatataaaaataaaattgtactcatctgtaactctcaattgtaatattttattaacttgagaacttattttaaaattaaccattagtaagttattatgatttggtgtcacttaaatatatgcaaacttcaaaattagtaataataagaaagtgtcacaatttattacttatatacaagtagtgcaaatttgttaggttactgaatgaccacgatgtcgatcgtttcataccattaacatggaaagaaacaatttggaagttcatgatgtcgtttcatatcagaaacatgaaaagaaacaaaacttggatgttggaacggaaattttctttgaaaaaaacagcaacaatagtttgcaaatttcagtttggatcaaatcttaattgataaaatagtgccggagtggtagaagttgggggacgcgagagtctggtcgacatcaacggactcatggttatggctgcccttgtagccgatcatctagggcaactgggcaggccgatcgccggtgaaagagattgacgtacctagtcaacgtttcatggtgcgtgcagaaccctactgcctggaggagtgcgttggtttgtgattaactcatgccccatcgcgcgtaagaattgtggagtgtgttaattttttttatagatttaaagtgattagcaggcaaggaggatcacaaatggattaacttttttttttctcacaaatctaatctaacagtgtaaaataacgggttcaccggtttaagtgaaatccaaggggctagatgttttgcttttttcttagaatttctaagaatttatctaatttattagagcgccacttggcgtcttaggagcgtttataggacgcttaatggacttttagtatataatagatagatagatagataatagatgccatcgagtatatattatgtttgtcagtgttctatctatctattatatttatatatggctatcctagaacatgaacatgatgggaagtgaaattaccaatgttttattaactctgctatatatgactgttgtttagttgatgcccatctgtgttatcagtccaacaaggaagctctgcaacatttttcttgcgcttcagttaatcttgtttcttgtttaggtgtatttcttcacaaaattgtttgtcctgtatagagttattgcctatgaattagactggagtatgtccaaccaatctttagagaaccttgttgtatgcatgctatagaattctggataaatctaagaccctctcctgcactaattcaaacacttttgctggtttgttctcgtgatctcgtcagtcacactagttcatggagtggactactgatgtttgatcatggtatgttggatggttggtagtagattattttcctcttgaatcagtcagtccttactaatttgatactacttcaatggcatataccgcatatgtgttggtagcatgtcaaagttattaatttatcggttactctgttgtgtgaatctcgatacatattcctcagttctgactgaccctgtttagatgggactaagacttttaactccctatcacatcggatgttggacactagttataaatattaaacgtagactattaataaaacccatccataatcttggactaattcgcgagacgaatctattgagcctaattaattcatgattagcttatgtgatgctacagtaaacattctctaattataattaattagccttaaaaattttgtctcgcaaattagctttcatttatgtaattagttttgtaagtagtctatatttaacactctaaattagtgtctaaatacagagactaaagttaagtctctggatccaaacactaccttaagcctagagtatcagactaaccgaaggcagaattattgagttctgacttcagttagttgatttatgggatgaggtatgttggtatgtttgtgtaagatctcattgacccccaaaatgtgcctggttttatgtttcttttttctttaaaaaaaactatgcgcccaccaatcttccagttaccaacctgaaagaagcaggctagctctagaagaggaccctgttcaactgactataggcttcaattcaactagaagcacaaaagtatttattcataataccacatatcctttattaacgattacaagtaatatgaatataagataagtaaaagacattaaacttggacccctatgcgggtctccgcgtggactggaaatgaaggatcaccccgcccccgcgaaaatcgacggggacatatctccttccatttattttcttatggagaaccaattcaaaccattcccgtctcgtaacaggtgaattcaccgcgcggaaacagaaaacgggccccttgcccatctctactcttatgaagttgctaagtttttttgtcactacacgctgaatagatgtttttgtgcttttccagcctgaggagagcgactagtgccatgaagaactagttcatcactgttcaagtggaactttatgcatcagttggatttcatttcaatatttcctgatcttctggattgacatgcaagtcatgccacaactcaaaataataaacaagattaacgcaagcatacaagatgattatatatcagtaatcttattatattcaagactaatgatgcgctcgatgcactcaataggaaaacaagattgatggaaagcaaacaagatcattaacttttggaccaatcaaaattaatactaacaaatgatgagatcttaagacatattactagtgcatgtaaaagaaacaatcatcaatcttatactacctccttacctaatataaggatgttcactattttattataacgtttgaccactcgtcttattcaaaaaatttgtgcaaatataaaaaataaaaagttgtggttaaagtactttggataataataaagtaagtcacaaatataataaataataattataaaatagttttaataagataaatggctaaacagtgctagtaaaatgtcaaaatttcttatattaagggacggagggagtagtatatgtctcaatttggtatttgatttcatcagagacccatgaacgaatccaggtaatacgggaacaaattatcccaatccatttcttggtggtcgccgtcgtagtcgtagtcgtcgtcttcctcgtactccacgctcgcaccaacatcaacaagaaatccacggtgattctcccatgcccagaacctcctctcctcgacgaagtcctcgtcggccatgacgcggccgcatgaatccatggccctcccagcggtcgcgccttctcgtcggcttcgtcgtcgtcctcctcccggtgtcctccactcctcccaggcgaggatccgcgccacctccgccagcgacagcaccaccttcttcttcgccgtcgactacgtcttcttcgtcatcaccgccgacgtcggatcctccgtctcgccgccggcttccttgtggcaggtgactgacaccgccggcgatcgcctccgacgagccctcctcggtggaaccggcgaggacgcgagactacgaagatatataggcaggttagtttgtttttttgacatttctcagttttttttggtaaggtgggtatgggtgcaagtttgactgatttgttaccctgtgttaagctttttgtgaaaaggaagtttataaaatgccaaattaagttgaaaattccgtttggataatcgttctgttaaattttggttgaagataatatctaagagttttggttagagggctcctgaagttctttttgctcctgctattttggatgatgagtttatcttttgtttctttcttgttggctgtgtgcactctttaggtgcagaagctggaggtgttctcagaataattgtatcacctgatagtgctgagattaataaagcttccattatataagaaaacttctaactctctccatcctaaattgatcattatatataatttgcagttttgcagtgcacgcctctcctctcctctcatccccaccccgtcgagccgccgttgtactgagcgctacctcttcgccaacgccaccgcacatcggctcgccagccgccacaacaatgcggtgctcgatcatgatgaaggcagcggttaatttgctctgggccgttagccggagctcgcagtggcgccagggtttaatcattcggtttggacgtttctgtcggagggtgctgatataccgaaatttccgtaattttaaataaattttagtcaaatttaaataaaatattgtcaaatttacaacaaagataaaatttcggtcaaaaaataatactatcatataggtaggggggagtggttgtccgatatggccgtcatttccgaacgttctcaggtacgttctgggtctcatcggtgatatataaccgccgtgctgttcatctgcctccgcgtattccagaacgtttgctgctaccacactccggggcaaccggttcgcaattagttatgtttgctcacattagctgttcgaggaaatgcctcagtgatgcttagtaggcagtgcttatttttttgtcagtgttcgcacgtcagtacgtatattcacaatttatattaaaatcacggtttcagctctgtatcctgtgcgggcaagcagctacgagggccctatttggttccataggctaattattagccaccaccttttaaccctgaattatctctcaaggatccaaacaggtgggctaatttgaggctaaagtgaattagcctccctcaaaacattagcctctctaaggggtgctaatggggctaattttgtgtggggaccatcaaaaagtagctctctctccctctctctctcctctctttctactctctctctctccacattttagccttgaattagcctatggatccaaacataccaccctaggctaatgtttagcctaccaattcatgactaaacattagctctcaaaattagtcctgggctaatcttccaaacagggccaaggttttgtacgcacatcaacgcatggcgaatgcggttcctgttatcttgcattctgattcttgcctttaagctcataatgcactttaggctgcgttcgttaggagtagttcccaactcctcctcgtttttcacgcgcacgcttttcaaactgctaaacggtgcgtttttttataaaaagtttatatacgaaagttgctttaaaaatcatattaatctatctttgaaaaaaaattagctaaagcttaattaatcatgctattaattaccttccatctcctactacgtggggctaattttcataaagaagcttgcaaaaaggattttttttcttttgttggcaagagtgctaataatgaacatgagaagcattccagcgtggctaaaacaatagactagagggaagttcacttaaaaaacgtagaaatctctatttctgttatttagtgtctgttactctgtgtctttgtgttattgtgaaggattttgtagctgaaatgctttctgtacgtagcaacagagcaaggagatgctatataaatcggttgacagtaactgaagtaacaattgcatcattgcttattccgcaccagaggccccttcacaatttctacgcatttgactcttcacatatactcccttcgtccctaaaaaaccaacccagtactggatgtgacacatcctaatattatgaatctggacatacatctttctaaattcattggagtagaatgtgtcacatccaattctaaatttgttttttatgggacggagagagtatttacttctttctgcacttgcttgtagcgacccttgtattccacttccgaggtagaataccggtctatggctcattccttagtaagaactaacttaccaagaaatgtgcacaccagagtaacataactgaaacaattgtagcgaaacccattaaataaaaaccatagaaagtagcttttatcaacaaaataactaaatttacctcaacaacaatttccagtaatgatctttatcttgacttgatactgaccatgctttacttcgtatacaactcccaaatttttctccttgctgttcatcttccaagagaactttttcgacgcctaaagagttagctcaaacatctacaaaggataatatatatgggatgagtacgaatggtactcaacaagtccaactatagcaatccaataaatatatgcccataatgcacctgcataatacatatatctccaaatcccataatccaacaaggaaatttttatgcatgttcataaacacagtgtagtaaaagctcatattaagtaattataaaatctactgcatataaggcaccacagggattagaacctccgataggttcctttcctgccgcgttcgcagtttctacccgaaacagggagtgacatatcacaattcatacactctatagaggtgtgttgctgtacccatagacgccttaaaacttttaacgcccgcgctacaccgccaccacaccagggcctaagtgtagacccccgattttggaaatcggaaatcttctgtgtttatccgtaccaatccctggatcagtagttggtacacacatacatagttggatcacaacatatcacgaatgaatttagactaaaagagttaaatacttacattagggccaggtaggccaacaactatcagagaacaacagcggaagacaaaataatataagggcccggttaacatgccacaggcagtcgactggggaacgagacctagaacaagaccgcactccgatcatcttgtgggatacgcaagcgtaccgacaagagcttctcttcaacactctcctaaaagatatataaatagcaagggtgagtaccaaccgtactcagcaagccaccacaataacaatgcatatgatagagggtatttcaaggaatggcttcaggtccttttgcataaagctaattttacaattcttttcacaagcctaaaacctagcatagactgatcaaattttagtaccagtgttcactttaaacaacgacggttctgtctaccatccattgtgataccaaggatagcttcccgccattgaatcgtcatggttttctgaggatgtccaccttccctcctctcgggatgtggctccatcagcataaaattcatcatccaatatcccattccctacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctagcgctcccgggaaagagaagtctcacacgcatattaaattatggttcaagttaagttctctctctcacacactcatggcagtcctaccaatggcgacaccgatgtagggcacgcctctcggccctacctcaacggctgtcccattgtagcgcacctgcctcactcaggggtgaaccatctatacagggatactgcctccgctcggctatctaatccgctaggtctatactcattcgagaaatacggttgtacgggggtcgtttcatgcttaacttcatggctcggtccttaattgaccggggacggtactagccttttccagataccacccaaatcatccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaatcatggttacaaggattttaagggtaaacaataatcaaggcatggcataatcacaagtaggatgttcatcattgcatgcaattttatttgtaaataaaacaatttcgcaattaggatcaacatgttcaaggaatagtgatgacttgccttgctcaggatagtccttattcttgatataattcttgatcaaccttcacctcctggaagttgctgacgttgccttacgactaaccgatacataaattctataatacgcaagaaaaaccaatattcaaataacaaccaaatatgcacaacaaaatatactattcatgtctgctaatggattccaatcatgctaggggctaaggtttcttaacctttctattgtcaacgtggcctatttaggagttaaccaacatagcatttatgggatacatatatatttggctaatcggtggtttagtctatcaaatggcttatggaaggattatggctaagcatgcatctatctaaataggacggttatatactagaggttctgttgttagatggatttaggatcaatcaaataattacagtgaatcatttgtattatttattttattgatggaagctttactttagttatgaacatattttacttgccattataaattataaaagggctaataattatccatgctctatatgttaaattcggaaagtttataatattatagttacagattatctcttaatgaacaatctggagttacaattgaactatgaacatatgaggtcaagatttataattagtacttatcaactattcatgtttgttatatactccccagtttgatatatgaaaaagataaattaattgtgtaactataatgggatgtacaatatatgtgtgcaacaacgtataaggttttggtcgtctactgtacatgagcttatttagaaagtgtactacccaatgttccaagtgattcctgaatatattgtagtttaattatacattagctagtttctatgagtgatattgtatatgtgatgcgacaagtttaagcactggttctattgggttactaataagtggtaatcaatttaggcatatatatgctattctatatggtattgcatcgattaatttacttagtgattccttcacatctagctctattattattctcctaaacaggttaaagattcatctatgtgtgtttatattgtagttacataatcataaggctacacttgatttaaatatcctataagccatggccatcgaatattaaataagtactagtattttcctatacatccattcatttgatacatcacataaaattagtttgtgtggttgttacagtggcaagacatgctagagacaaatattattacatctactctactgtacaatactaattttatttattaacatatttttaagttgactattatgcatcatcttgatattaattatttaatatttataaatatattttatcaaatagtgaattatatatcattggaaagcttatgattttagatgaatttaggttcaagtttcactcaaatcggagctaaaatgaataagttatgctagtgtaaagattcaaatttgaataaatccgagaaattgtaaaaaggcactgttcctaattcatttatttatactacaaccttatccacaagctatagtgattgacaggtggggcccactctaccctctcttctccttcctctctctcttttcttttcctttctctctctcttctttttctcttttctcttttcttttcttccttttccttctctctctcttctttttctcttttctcttttcttttcttccttttccttctctctctccctcccggcttctcccttcctctctctctcggctcaggctacccggggcggcgacggcggcggaacgagggaaggggcggcggcttaccgatggcggcggcggcgacggcggcgcaaggcgaggcgacgctcggcacggcacacggcgcggtgcggcggcaccgagggcggcgacgcggcggcgcgtggagagggggaagagggagaggagggggaagatggagtgaggagaggggaaaaggaggggaggtggtgagggtggtgtggaaagcaatggacggccggggagggggggg

SEQ ID NO: 2399 - DNA, 18070 bp, Oryza sativa
gggagcgacggcgacagcgcgcgcggaggggaggggctcgagacgagcggtgacacaacgacgttgcgcggcgacgcgatgcaacggcgacaagacgcgacgcgcggggctcgagagcgacgcgacggcgtggcgacacgacggcgcggcggcgcggggctacgcgcggcgggcgagcggcgcatggtgacggcgcgcggcgcgatagcggcgatgggacgggcgcgcggcggcttggggcgcgaggccgacggtgacaggcgagcggcgcagcagcgacggggcggcgggcgcgacgacaagtgatgggaaagagggaagagaagggagggggtgacgcgacggcggcgcggggctcggggcggcgcggggctcggcgcgcggtgagggcgacgggcgacgcggcgacgggacggcgtggcgcggcacggggctcggcgcgcggcgatggcgacagggcggcgcggggctcgagacgacggcaacacgacggacgcggcgcgcggcgtggggtgcgtggcagcggcggcgcgcggcgcgaggcagagacggcgacggcgcgcggcgcggcagcggcaacgcgacgcgacggcaggcggcagagagagggagaaagaggagggctgggttaggggaccatgtcgagcacctagagtgcaatgaacagtgccattttctatttaacccgattttagtttatcccttgtataatctcattctataaatcctaatttttacataaatgaggtttacccaatatatgttttaatttagatgaaagtttaccaaattttaatattacccatattttattcttatatatatttttctattgtattatttaaatgaggtctaattctaaaattagcccagataattttggaggctttgagggttctaaaatatcctagtgtggcccttattattacaatagcacattgaacttatagcaatatattttaacctgttgaatctatttattctataaatagtatattaagactcggtacaacattaatctaattttaaacactcacatattcttgtttatatataaggattaatttatttatatgaccattattttatatgagtgattttcctgtcatgagtaactcggcgacatgttgcaagtatcaatctatatattctggtggattacttatttataaacacgatcactatagtggtgatcatcatttcatgtgttcttatatttcatgtgagattcgattcaaatgaattagatttaatcttactatttctttagctaattgtgacatcaagctatcaatcatggttcgaatatttaatacctgatttgtaatttgtaatagaaattaatatttgacttaactatcttgtgcataattatttgtaggattaacaatattatattctcgtaaatttatctattacttaaattttagatccttactttactttctttgtaatcatttacggtttggcgagcaatagcaatcataacaaccagcatgatgcaaatgttttaaaaaaaattcaaaattttagtgatttttattgtcttgaattttcaggatgttacactaagcacacttcatggtgtatgccggcaaggctaaggtcacaagcttttcatcaatcccatctggcaattacctttgcgggtgattcccgcaacaacggcgaatcatcggatcccgcaacaacggcgatccacatcatctaatcggattccgcaacaacagcaaccctcatcgctagcccacgctcacaggattcgcggaagtccttaagcccgtaggataaagccattaagaaagaactactaagccagcctgtcccattccaggtcatatggtcgacacgatcgctacggcgcttgaatgccatataacagttgttgtttaaccttatgatgataaatatatgcaactgaatccccaccacatggcaagttcagaatacatctatagtatgatcgactgctccaccagtcaatccaatccatcagcatatttattttcattatagaaagtataatttaatgcaaagtgatacatatagattgcaattacaaaaatataacaagagatggtcaaagatgctggacttgcctgagatacccgaaatcgaagaacaaataaatcaatgaagaactccaagaattccaagataaatacccaactgtaaaaatatggcgaattagaactaaaaccaagaatgtagatattagtatgctgcacatgatatgcctaaccttaatattatagttgatctacaatgactataggttatcgacactcacctcaagactcgactagatgacccctatgtatgtatttttaagtagaatatggttaaatatatttgtatattttgatttggtaaagatctatgatttatataacagaatttagttttggactaaaatatctgctgttaaaacaaacatcactacacttttatttttaagagagtataattattttaattgaaagaagtttttactttacttgagagagatttatattcaataatcttaaaattcaataataccataaacagcccacatgaccaagcccaaaagaaaagcccacctagaccccgttcttcctcttctctccatttctcgttcttctcctctgccgcacgctctctcccagcgccgtcgctcacaccgccgctccccctcacgccagccgctgctccctgcctccggcagccgccccgcagctgctgcctgcctgaatcggttccgtggctcctcatgagtctatccccaaattaaccctagccatcaacccctctccaatcgatgctgctgctggctactgctctcaacgactgagattggaatttccccagccccagcgcccctgattcgagcatggctcagaccagccgtgtctccccaagctcctcttctctaatcccttctctcttttcttctgtgatgtgatctaattggtgttctcttgtgtggtaacctactgtgaatttttatgcttgtgaactagtcctaatgaccaacgtgatgatgctatactcaggattatcctgctgtctgtagggttccagattgattgatttgctatagatggatgatgactatatgctatggatgaatgaatgaatgcttacataatatatcctatgaaaatgcagtactgaaattaaaagcacactaacatgattttgtccttataaatgtgcttgcatatagaataaccgaatttctgaaattagtggcatattagcaggattaaatccctaaattaggtttattgaatgatgcagcaacttacatgttctataatttgataattatggcaagatctgtactatatatagttgaattataacctatgaaatctaacattgaatataaagagatggtgactgatttcttaaataatttactgctattgactatatgtcctgactcttgcctctgtataatttacttgattcgacttattcctgcagggagaaattagacttattgatgacctaactatactatggtttttattcagatattatacgctattgtttcctgagaattttataaactatgatagcatacacttaaactcaagatatatttgtgcacactaaaagatgtcattcttttctctaaatatgttctactcttccaactgacctacaattgatacctattattctgctaatggatcctatatcctctatttagtttctaaactaagaatagatcattgcctacccatttatgctctgtctatttaacttgaaatactagcacaatattgatcttaccttaagctcttgaggttaaatagaacagtgattatttctaactatgcatgtagtcaaaattcatcctatgatagctttactgaacattgatttatagaactatatacagatataatccttagctcaattgcacttgtagatcattagaaataaatcttgctgttaaatatgtactgagatggctggtctgtacttgaattttccttctaagactccactgaatttaggatgatattatcctgtccaactactcataaaaactttgcctagcttattgaactaaggatgcacattcagtaatataccccaacacctagtactagtatatccacagatcaacatggctgccatctactgagttcatttttcaggtttaatggatataactaagggcatgcacacaactcctaaacatactattgaagatgttcctgtagtgcgagattatcctgatgtttttcccgcagaattgccacggatgccacctgagcgtgatgtagagttccgtattgatcttgttcttggtacacaacctatctccagagccccgtaccagttagctcgtcctttccaagaagagttgaagaaacaattagatgatctattatccaagaagttaatccgacggagtgtgtcgccatggggcgcacctgttatttttactgagaagaaggatggaagttggcgtatgtgtgtggactatcgggccttaaatgctgcgacaatcaagaacaagtacccattgcctcgtattgaggatttgtttgatcagttaaagggagcgaaggtgttttctaaaattgacttgcaatctggttataaccaaattcgagtgcgagaagaggatattgagaagaccgcattttccacgaggtatgggcattatgagtatagagtaatgtcttttgggctgaccaatgctccggcctattttatagaggcgatgaatagcatgttgcatagctttctagataattttgtggtggtgtttattgatgatattctgatttactccaaagatgtagaggagcatgagcgtcatctgaggatggtactagggaccctacgagaaaacaagttctaatgtaaactgaagaagtgtgagttctggcttcctgaagtggctttcctagggcatgtaattaatcagcaaggtatctcggttgatccaagcaaagtttcaagtgttgtcggatgggaaaggccgactaatgttaaggatgtgaggagttttttgggtatggcggggtactaccgacgctttgtgaaggatttctcgattatcgctaaacctatgacgatgctcacacataaggatgtgaagtttcagtggacggaccaatgcgagcgtagtttccaacaattgaagcagaggctggtaactgctccggtgcttactttgccccaacctggcaaatgtttcactgtctattccgatgcttcatgagtaggccttggttgtgttcttatgcaagacggcaatgttatagcttatgcgtctaggcagttaaagaagcatgagcagaattaccccactcatgatcttgagcttgcaacagtggtctttgctctcaaaatatgaaggcactacctgtatggagaatcttgtgatattttcactgatcataagagtctgaagtacatcttcactcagaaggatttgaactttaggcagaggaggtggctagaattaataaaagattatgatctcaacattcagtataccctgggtaaggcgaatgtcgttgcagatgctctaagccgtaaggttgttcctctaaatgtgagttgtttgataactgattttgaacggatggatatctcctattgttatgttggagtggcgagtaccgagtcacgagtcattcttgagtccgccataccccaacgagtgctagaggcccaacaacacgatcggttgctgcaacaagttaagaaacgtgtaaaggaaggaaaaactggagatttcactttggattcctcgggagctgtgcgattccatgggcgtttatgtgttccacagaaagctgaagtcaaggaagagattttgcgagaagcacactgaacaccatatactgtgcatcctggggagaacaagatgtatcatgatctgaagaagatctattggtggaagaggatgaaagtggatgtggccaagtacgtggcatcatgtggggtatgtcagcgagtaaaggctgaacataagagttctgctggaaagttacaatcattggaagttcctgtatggccttgggatgatattgctatggatttcgtggttgggctacctcgaactccacgagggaaggacgccatctaggtggttgtagatcgtctgagtaaggtggcacatttcattcctatccgcaccacttattctgcgagtgacttggcaccgatctatacacgcgaggtagtgaggttacatggtgtgcctcgctcgattgtttctgatagggatgctaagttttcttctaagttttgggaatctgtgcaagaggcatttgatactcaattgaaattcagtacggcttttcaccctcagactgatggtcaatctgagcggatgtcacgccctgaagtacccctccctcgctctaaattcataaaataaatcgtccgaagaaattgtttaatttaacctagagagaaaccctaatttaataaatgcaaataataatcggaatcggcatgtggaatttttcttgggttctacatgtcaaaatacgctaacaggatttttagtggaattttcagagccttggaaataattttaatcaattaaaataagcaaagtgcaatattaaatccctgggaaaatcctttttcctttttatcttttcttttccctcctttttcctttttcttgggccgtcggcccagtccattcacctcccgcgccggccttccctcggctgggccggcccaagccggttcctccctccctcctctccccgggtcaccgacaggtggggcccacctgtcggccccttcttcctcctccagccgacggcaccgccgccgccaaaaccgccaccgacgccgccgcttgctccgcatccgcgccccactccgcgccccgcgcccacgtcgccacccaccatccccactcctcccactcgcgcgtgcaccccgcaacggagggatttgaattcgaatctctctctctctctctctccatcccccacgtcggcgagaaatccggccgcctcccggcctcgtccgcccctcccgagcccatataaaccatccccgcgttctcctcctcctttttcctttttccatcggccgctcccgagctctccaccgcgcccgcaccgtgcgcctacctgccgccgccatctccaccgctccggccgcctctagcagccgctagagccgtcgccgcactgcgccgtcgacgccgccgggttcgcaagcttgtgcgccaccccgtccgccgtttccccggtcaatctcgccgccggagcttgcttctcctcgcgctccggtgagcttccacccattgccgccgccttcgatcggttatgtcgtgcgccatggaccacctccctctctctaacccctcccaaccttctctctaggtcctcccggagcccgtcgccgtcgtcctcccgtctctcatcgttgctgttcgccgtcgctcctccctcgcgccggccgagcccctcggtgagaatcggtctccctctcttcctctctctccctttgccgcgccgcccgccgcgtagcgccaccgctagggtcgctcgcgccgccgcttcggccgccgccgccgtctttgcgccgtccgccgccgcctcccgtcgccggttgccgtcgctggcaaccgtgcgcgcgcgccgccgccctcgccttaaccggccggccggcttgaagccgagccgagccaccagccgcgcccctcccgccttgtgccgctgccagtggggcccgcttgccagccgcccctctctctccttgagtcactgacccgcgggtcccgcgtatcggcgccacccctccttgtgctgacgtcagccctgggatgaattattgcgcaataaattgattaagggtttttcttttatagtaataaacacatataatcttctaaaaatcataactaattcatccgagctccgattaagtccattcaagtctcagtaaattcataaaaatgtgtagaatccattaaaaatggttttgcttcctgtttcagtagtcttatagcatgttttgcttgtgtgatttgtttgtcgcgtagatttcggccgtttcgtcgattcgtggtttctcgaagacgttgctgtggttccatcagtgcgagagcaaggcaagtcatgcaatacaattgatcatattgtacccaatttacaaatatcccgaatttctattaaatattgcattgttttacaatatcatgtgggatgggtcctattactcggccatattttgcttaccttatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctagttaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagtgtaatcttttggaactggttagttcaggtggtggtttgggcctgttgcaacgtggtgtaacgttggacagtgattggttaatatggattaattactacaactgttttactgctttcaactgctgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttcccagttgaagatgactcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacagcggaccattcaaactctagaggatatgttgagatcatgtataatttcatggaaaggcagttgggaggatcatttgccgctcgtagaatttgcttacaacaatagttaccatgctagcattcgaatggcaccatatgaggcactgtatgggagaaaatgtcgatccccattgtgttgggattccataggggagagagctattttaggacccgattgggttcaacagaccacagaacggatagcagagatacggtgtagacccccgtttttataacaggaatcgttcgtgtaagcagtaccatttccctggatcaagtagtctggtacacatgagttcatagctgatataccaaatgcacatacatgagagtctagtgcgaattattacatcataagcccgcaggcatagtcttagaacatcagaccgagcggtccggaatacattccaaaagcagagtagataaggcagcggcacgccattgccacaggcaacgaccgtaactaagacctactgagcgctgtcctcttcatcaccctcttggtagtacgcgtagggatccttcgaaacttcatctccggcctcttattaagtttgtatattgcaagggtgagtaccaaccgtactcagcaagccatcacagcaacaatgcacatgataggggtattcaaaggatggctatggtttctttgcgcaaagccagttttgtaattcttttcacaagcctaagacctagcatagatcgatcatattttagtgccagggttcacatttaagcaacgacggttctgtccaccatccattgtgatcccaaggatagcttcccgccattgagtcgtcatgattttctgaggacatccccttcccgcctctcaggaagtggctccaacagcataaaaatcattatgcaatatcccatcccacacaagttaagaatttaaagtctagccaagtgtaatacatgtcccggtgctcaataaccgcgagcacggctattcgaatagatttggttcactcacactgcagtggatgtacactttacccgcactctgcgactgcccaacatatgagcctcgtcccaacacatgagacgtgtcacggcaaagcttttcgataacctcgcattggcagtacccgctccatgaacttttcatcctcatgcactctaggcgtacacagtttctagcagtgagaggagttctggcgcacccgggaagggaagactcacatatgcgttaagttataattatgtttaaattatcacatggcagtcctaccgatggcgacaccactgtagacacccgcctcgcggttctaccaatggctaccccaccgtagagcccctgcctcacacatcaagaaaccactatgcatggatactgcctccgctcagctatttactccgctaggtctatccccatactagaagtgcggttgtacgggggtcgtttcatgcttaacttcatggctcggtccttaattgaccggggacggtactagcctttcccagataccacccaaatcctccgtccgccccagtctaaaataagtgtttaatttcattcctactttcacaaatcatgtcatcattatcatggcaatgtggcgctcatgtctccacatgccgcatctcaattaccttcccaaaggtaattgcccaagcatatagcatttgataaagtatgagcatgcatgaatctaaagtagcatttctaagcatgtgtcatagttgactaaggacttatacgtaattatggttacaaggatttaaaggtaagcaataatcaaggcatggcataatttacaagtaggatgttcatcattgtatgcaatcttatttgtaaacaaaataaattttgcaattgggatcaatatgttcaaagaatagtgatgacttgccttgctcgtagtcctgcgggtcttgaccctcgctcggatccgcaactccctcgggctctacaagtacgtgcgaagaattgatttgaattccattagaattcaaataaaatccaataaagaccaaatcgaaaagtgagcgcgagaggcgaattctatatcaactacattattcgcgaaataagactatcccttatccttagatattttgtttttcctaagtaaattcctaagaattcaacacatttatttatctcttaaataaatctaaattcttaccgcaaattgattactcgtaaagtttaccaaaatagtctataatcacattaaattttgcaattctacgactataattaatccataattaaattctaattattttatattttctaaacttcttaattttactcaaatgcctatttattttctttctctttctttctttttctttctttttctttccctctttcttttctttcttttctctcccttttctccttttcttttttttttctttctctccctaccggcttctcccttcctctctctctcggctcttgtctcctcggggcggcgacggtgaccgagcaaagggagggagggggggctgcttaccgacggcggcggcggcgacggtggcggcggcggctgcgacgcacggcgcggcacacggcgcggcgcggcggcactgagggcggcggcacgaaggcggcgacgcggtggagaggaaagaggggaggaagaggggaatgggggggaaatggtgtgaggtggaaagggggtggccggggaaaatttatagggcgcggggagggggtggctggccctaatggcgacgcgacggcgcgaacggggcttgggacgacgacgacgcgtggcgatgcgacggcgcggggctcggggcggcgacgtgacgcgcgcggcggcactgggctcgaggcgcggcgacggctcctggcttggcgacggcgcgtggcggggcaggggcgtggggcgcgaggcgacaggcacgcgacacggcgacgggacggtggcgtggcgacaggcgacgcgacggcgacgcggtgcggggcgcgaggcggcgagcgcgcggcgcgaggcgacgggacaacggcgcggcgatgcgacggcgacaggcgacgcgacggcgatgcggagcggcagcggcgcggggcgcgaggcggcgagcgcgtggcgcgaggcgacgggacggcggtgcggcgacgggacggtcgcgcggcggtaggcggcgatggcgatggcgcgcggcagcaggcggcgatggcgacggcgcgcggcggctcggggcgcgaggcgcgtgctgcagggggaggggcagggcttagggaacctcgtcgagcacttacagcgcaatgaacagtgacttttttctatttttcctatttggttgtttttgctattcaaatcttgtcccaatatttctaattttcgcacaaatgaggttcccccaatgtttgagttattctaatcagagggttcacccgagattaatattattcctatttatttttatataatttgcttgaatttaattagagtaaattcttatcccattgcacctaaatttaattgttaccaatatggtcgcgataatattttatttatttccaacctcacctaatctttattttaaattatattttaatcagttattttgccaatttaattttagggtttattcctaattaattattccttattcacgatcagtaaactttgaaaccaaattccaataaaataggcaaataaaatcagcatgatgcaatttattaaaaagtttttgaaggcccatatttttagagttttgattttcgttggtcgaattttcagggtgttacatacggcaacacatgcttgcggctcaaagtagacagaagagctacgccgatgtcagaagacgggaattagagtttgaagtgggtgatcaggtacttctaaaggtatctcctaccaaaggtgttgtgagatttggaacgaaagacaaactcagccccaggtatattggtccattcttgatagtggaaagagttggaatcctagcgtatcgccttgagttaccagagtccatgaaaggtgtacatgatgtgttccatatttccatgctgagaaaatatttaagagaccctgaacatcatattaccgtagagtcggtgacaattgggcaagacttgacatttgagtctcgtcctgtaagaatattggaggaatctgagagggtgctcaggcatagaactatcaagtatgtcaaggttctctggacgcaccagaccgagcgagaagccacatgggaacttgagtcacagatgcgggagaagtatccagagttattcacgtctggtgagttatataagtcctacctatgagttcctttccatacttgtccaaggtataactggacgaattcgagggcgaattcgattgaaggagggaggaatgtaatatcccgtgttctagagtatgattgggcgaattcgagggcgaattcgattgaagaggggaagaatgtaatgccctagggaatattagcacaaacgcgcaaaagttcaatttttaaaccgttatttgaataggcgatcaggaaccgtagatgcgtagagctcgcagagtagtgcaaaatagactataagtttataagtttatagtaatcggagtccgatcgaagttccggggattaaaacaatgtgggtcgttagatcttttcagtctctttatataaccaaccaaaagaaaaaaaaaaggaaaaaaagggatcgagagatcgatcctgtagccctagccgccaggctcctgcgccctgccgctcctgccgcgtttctaccaccaccggcgccgtctctacgccgccgccgttggtgcagtgtcgccggtcgccaccaccaccgtcgccgctgtgctgctgctccgttttctgctgctgttcggtggattgatttgcagagcagcaggtttggttctgcttcttgatttgtgtttgtctccagcgtggtgaagtcccaatttctcctactgctgtgtgtcctgaccagctacttcgtgagttgctgcagtagccaacaactagggggcagggcaggaagagcagagaagtcaaggaattgggaggaagagaggcaaggttggggattttattttccaagatttcacaaattgatctcaaagttgatttttctccacagtaaggctgtaagggtaactccttttagtcctagaaattcaatttgcacgtgggaatcgattaaatcgccggttgagagtgttcatagtcgctatttatgggctggaaaccgtattttcaaaactggcgttaaaccatcaggattctggttagttgtcctaaatatagattgtagtcagcgtcgatatctttccaacggtgctagtttcactcgattccgataaacggtttaggagaaacagcaaaaacagtactgctgaccaggtccagaaatcaggacagcagttcgtttttcttaatctgggatttccagaggcataatctgattttgtgctcaacatgaaagttgtagacaattttgtctagatgtctgaagttgtattatttgctagtttccgttagacggtttgtgagttacgcataaaacagtaatggaacaactataggttatttaatacaaatcggtaaaaggtttatatgttctaggtttcgattttagtaaatatcccttgtaaccatcgttagttgaatatagtggtttatgcgtagttttgctccacaagtgtggagggttccaacgttggaggagttgagtcggagtatcgaaggagttaaggcaagtacaaaacggacttatgtaatggacaaactgagttgttttgtttggcttaacttgcataattattattcaattgcttgaaattactgattgtatgactctgacgttatgctacttattcgtgtttcgacccatattcaaattcatgacgttattcatgtttcattattccggatgttctgtttacattattcaagaaccatgcgtagacatgggagtgcaatttgggtctttattcatgatccttgagaagcgctgatcacgcttgctcggcttaccggtaatgctaagaggatattcacacctgcccgagagggaactactatattttgacttttttgatttaaagtaaagtaaatccaacccttcatattggtttcttaatgcatatatcatgtgtatgttttactagttcaagattgtacttgctgagtattctttacttactcttgtgtttaatttggtttttaggtacctaatgacatcgatcaacatggggcgggagtagcacccttggactacacattattattgcacacaactgaaatttagttttagattatactttgctcagcataagttttgcatagaagttgtaagggtcattaaggttctgattcttatttttcacgtgggatttgtggagctaggatggtttggattgtgtggattatatcggtattgacttttcttataactgcctgtcgtggatgtccatatttttaggggagactggcgaaatttctaataattttaggattagtttttgagtgtattttggtatggcattctaggtacgtggttactgggggtgttacagcgtcaaccaagaatcatgccatgatgtgatttcagttccattttaatcttctaattacctgccatgattttaggtgactgatatctggttcccttctctagttctcttgttctgcagctgctcctctggattctgattcaaggattctcccgatggaactctaatttctcctctttaaactcgggcacctccagattgatttgtactatggcatactaatcctggaactaaaactcctttctttacttgaaactcaggtacttcttcttggctcttgctctactggtactgcttcctgccatctttcttgatctgctgactgctactggtgattctcttcctcctcttgaagccgtccccttgctgatctttgctccatcttgcttcttgacttgagtttcttgctccttctaaatctgaaacccttgttcatccaagaactgcacacccctgcttctccttttactcctctgacctccctctctctcttactgattgcttttactatggatgctatgcagctatggttaattgatgtattgatttgtgctggatttcactgagctactacagctgttgttgctcttctaagcggagccatactactctactactgttgcaactgctgctaatgctgttcctcgaggttgtctcccagccaaaacaacatgatggctagtctactagctaggctaatatttgtatgtaatttgtgagggcatggtgatgcagctgcttgcatgtcggtttggaaaaggatttgctgccacatttttcacctaatcaatttggggtgaaaaaggtaatttcctctttgatgtcattttggtgattacatggaaactaaagtcagtaaattataattactgcaggaaattggttttatacgtatacctatggaattcttacattctagtccttaaggtttcataatatttaagattttactagagctcgagggctgattggtaattgctctagttttattttcattttcacaattcctctattgatttgtatataatagctatgagttgagtatgttacagaacatttgcaaagcataatatggatgtatgcatgcatgcatgtatgcagatatacactgatcatttgtgaataaagtgtcgtaacttctattgtgatttttattgtgcatatgtgtatctctcggtgactactaatgtgcgctataattcatgggtagcaacgcgacaatgaacaaaaactaaattatcccactcctcaccagattagtctaactaacaataaatcaatgatgcatatggatatgacttgataaatagatgacaaggaaacgatcgaaaaaaaatcatttaagatccataatagaacaacaatcaacatatttataggtcctagccagcatcgtggctcaatcgacaccgctctcagccagtgtgaccaagtcattagcgtgactaagactatagctaaaacccgggatgttacatcctacccccttaaattaagtgaataattttattttcaatacatcctaccccttaaattaagtgaataattttattttcaattgttgaagtaatttttttttcacacagtagtatgtattccttagtcctatattgtttgctaatcaactatgacttattaaggatattctgtaacagtctattacagaagtaaattctaagaattggtaagatcactatggttcagcaccctacaatctggcgtatttgtttagaattctagtatgtcaaaactgatagtatttccaatgatttttaacacttttgacaaccttcctggaatttattcttttctctttttttttaccagtcaatctacccaaacaatcttaccccaacagtataatctctaatatggtttcggattgaagtaagcatggtataagtagttattgttaattgaattaagaaaaaagatcaatattccataagacatgatatatgttggacaccttaatattacaatgtgatgcagaagtttttttttaactagggtccttagattaatttgcaaggcaatgatgaaaaatgttcaatcaaaatatgtccttagattaatttgcaaggcaatgatgaaaaatgttcaatcaaaatatgc

SEQ ID NO: 2400 - DNA, 3883 bp, Oryza sativa
ctgcagccctgggtctttcgttctttttaaggatattagtgttgctataccattactaatttgtctatttgcatgcagttcatcgagccttcaacatttgagattggcgacaattaccactcctcgattactgaaataaatgaaatgaataagagtcggttggatagtatgctgccgtagcagcgtacagagagctaattcgcgatatgggtggtttccgtgcagcataggatgctcgcagttatggtctctaagtacaaacatggagtcacagtaagagggatgctcggttggtaacctgttcatataccgagccactcttactcaaagatcggtctgtacaagcattgacactatggataatacaggcagaagcatgagggtcgatagagatagtacaaaccagagatagtagatgcagaaagttaaccagagacagtacatacataagtatgaagtatgggcggtaggtccgaaacatatgcggaaaaataaagagttagcactgtattggtttttagttgaacatctgttgtggttctactaatatggagacaagtactcccaccgtcccataaaaaaaattaaatcctagggatgtaaacatagtgtatgtctagattcatctatagtgtatgtctagattcatctataggatttgatttttttaggagtagttaagtagcgttgtgattcttttgtgctgtgattaatagcgccactgtgtagagataagttttaatagcagttgtgattcttttgcggtgtggttgatgcgccactgtgtagtagtttggcgattgtgtgatgctactacttactaattttgttggtaattttgttctgaatctgagctgattcagttttagctcaaactgatactcaataaaattgcgattcacatgatacaattttgctctttgtctgaactaaaattgagatttacatgatatggtttgttctgctgagtttcagctgagttggttgaagttttcttgttttttatacgtaaacgtataattggtttgttctgctgagtttcagctgatttggttgaattttttttattttttatacgtaaatgtagaattttcattttagttgtcgttcctggagaatcgttatgcctaggtcttggacgatttgcagctaactgacggagatgcaattttagttgcatgtctattacatccttgagcgaacaatgatcataaagaggagtttttagccaaatttgttagaaacagtctcatcagccaatagtgttgggatgactaaacataattagaaaaagaaatgagaaaaaaaaagaagagatgttacaataaatggagttttctattcaatgcaattattaatcaaaataattagagggagttgagtatgtgtgttaggaaattcatctggtgtaataatcagctgaatacaatgtttgagaggataaaatcttggtctcttaacagctagtaggggaagtatcctgttaaagtctgaaaaggatttattctaatcatgttcctattttgttgatacagattagttacaaaaaaaaaatcaaaatttaagtttaaaaatagttggatgttgagggaagatgtacatgatatggtgagaaagcctaggggaacactaaggagggtctctcaagtatagaaaaatggcaaagaaatctcagaaatttaaagaaagctgggttgaaatatgaattgggaaggaaaatataacagagaaaaggacaaatggtgtgaaaatcataatgtatgtgtgaggagaagagaagagcgagggagattggagaatcaactaaggtttactacgagagaggagaggctaaaatggttacaaaggtgcagggagagagatgtgttagagggtgataataacactaagtactatcatgccaaagctaatgggagaaggaggaaaggtaggattttttctttgcgataagagaatgtgttgatagttgggcaagagtagttgctgagttttataacagatttttataaagatatgtttaggccacctgaaagatctaatataagattacaaaatttggagatgggacaattgtctgaagatcaaaagaaagaattgttgaaaccctttactctggaagatggaaagtaacaaggcacctaggcctaatagttttcctactgatttttataaacacttttaggaggtgataaaaaatgatttgaaagctatgattgatgattttcataagggaattttggatatcaaaagattgaattatggggttatctccttaattcctaaatgaaaagacgcagcacaaattcaaaagtttaggccaatatgtctccttaatgttagtttcaaaatcataacaagaaccctgatgaagaggctaacctatgtcataggtgacgtaattgagaaaacacaaactgcttttcttaaagaaagaaacatcatggagggagtagtgataatgcatgaagttttaaatagtgttcatatgaaaaagcaatcaggagttctgtttaattaaggtggacttcgagaaggcctatgataaaataaattggccatttctatgtcagatgcgggaagtaaaaggcttccctagtgtttggtgtgatttgatcatgagatgtgttggagggggtaaagtggcagttaagataaatgatgagagaggggatttttttttccaaacctataaagacttgagacaaggacaccctttgtctccgctgctttttgatattgcagcggatgctctacctcttttaatgaatagagcaatggaacagggaatgattaaatggctagggcaggaatatacagaggatgaaatagtgattttgtagtatgctgatgacactatcttcatgctggaggataacctagagtatgcaaaaaaaaacttgaagtatatcttgtgtctctttgaacaaatgtcaggtttgaaggtaaatttcaataaaagtgaggtcttttgcttaggagggggccaagaaaaagaagagatgtattgtcatattttaacttgtagaaggggtacattggccatgaaatatttggggatcccaattgataagaagagaattcacaatgtggactggagccccactaaaaacaaaattgagaaaaaactgggatgttggcaggggaaacttttggctattggtgggagattgaccctgataaatgcaagtcttgcctttatacatgatgtccttttatgagttgccaaaaggagtaaggaaaagaatagattttttttcagatctagatttctgtggcaagaggatcaaggggtcaagaaatatcacctagtcaattggcaaattgtttgcactcctaaggaacaagggggtttggggttattagatttgggttgtatgaatgttgccttgctgggaaaatggctttggcgcctggaaaatgagagaggcatttggcaagatttgttatcagctaagtatctaggtcaaaaaaaaaactttatctcaaaaaaaaaaccaagacctggggattcacatttttggaggggtctaatgaaggtcaaaaagagtttctaactttttttgtgagaaggtggggaatggtaaaaaatagccttgttttgggaggacagctggtttggaagaagacctttggctgaacaattccctaatttgtataatgtttctcttcgcaaaaatgtgctggtggccaaagtaataggagaagggttaggtagtctaagattcaggaggtctcttgtggataggaaacattgaattgactggggaggaggataaagtggttttgaaactgactaaaaatggaattttcactgttaaatctttctataaagcaatgatgattcaaaacactggctttcaattcaagaatatttggaaattta

SEQ ID NO: 2401 - DNA, 19586 bp, Oryza sativa
gctgagaaggggatggaaggggaagaaggcaaaaagttagttttattctgaaaatgaaactgtggagcatcttttcttaaaatgtccaattgctagacttatttggaacatagtgagttgtgtgtttgattcgaaaccaatccagaatatacatcacttgtttgggaggtggcttcaggattttcaaaaaaagataaaaactttgtggtggtggaaattgcagctattgtttggactatatggaagttcagaaatgctgcatgtttcaaaaataaaagaacacatgatcctttagagttgatatatgttgtttgctcctggatcaatctttggtccattttgtagagatcgggggacgcacaagaaaggcttcagtgggggcagctctgttaaagacggtggtcgctgacttctacaacactagatttggatggaattcatatgtgatgcggttacagggggtaggatgaaggggttgttggggttcctctgtctttttgtgtttctgaagatgtatgcctactggtggctacagttccgtgtctttttttttctctctgctgaatcttgctcccttttgctgtaagactattaaagactctgtagttttctcatttcattaatgaaatgggagaggtttatcctctccttctaaaaaaaggggtgataatgggtgataaaaagaattgatcgcgctgcaggtgcccaaatgggtgataaaaagaattgatcgcttttggagatccttcctttggaaaggagaagaccctgacaaaaccaacccgggcagcagtttagttaattggcaaacggtgtgtaaaccaaaaactttgggtggtctgggcattccggatttagagaggttttcaagagccctccgtcttcgttggctttggcttggttggaaggacgaaaacaaaccgtgggctagtatgaacgttccctgtgatgatactgacaagaggctgtttcaggtagcgacgacaatcgagctaggtaatgccactaaaataagattttggcatgataattggctccaaaacagctgcccaaaagacatcgcacccttgtgcttcaggctggcaaaaagaaagcaaaaaagtgtccaacatgagctccataacaataactagcttgtctctttccggcaaataacatcaatagaagaaatccatgagcttgtacgccttgggagcatgcttcagggagacatgcttactccgtgccctgatgacatctcatggaattggaatgattctaaggtttacacaagtaaaagtgcttatctctttcaatttcagggatcttttgtttccatagatttctcttcaccttggaaggcgccggctgaaccaaaagttaaattttttggttggctagttctccaccagaaaactcttactacttaaaacttgcttcgaagacactggccgtgcaattggatttgttgtttatgcacaagcgcctttgaagacactaattatctgtttagcgaatgccctttcgtcaagaaagtttggtccctagtcagttcctagcaacatttacctacaagcaatgctggccttcctgtcggaacttcagattggtggtctcaaattgattgtgtgggttcaaaggagcaaaagaagacaatgagaggagccctacttaccacttggtggaatgtttagttagaaagaaatagaagaattctcaccaaattttcaatcttagagagagcagtggagcaagatcttgatctccgtagttcggctttttaggccccctaaattttttgtttgtgctgtgttctgttgtatcgtttttattttccatttctggactgaactgttttgtattgttttctacttgtaattaaattccagcagatctcctgttgtcgttctctaaaaaaaatccttaagcaaacaaagcccccgaacattcagttagttatccattgatcaacattcagctaagagtgcatcataaatgcgtatagtttaggtagttaatatttttcctcaatagttttagctaggcaatgcatattgagactaccatgtccttcaatagtatggaagagaaacgaggacccctgttagttccattaaacagatctcaattattttagatgaaaatcatgcttcaacagtccccctaatcaacatccaaaatttgaggaaaaaaacgtcgttctcaagcaacacccaatttgtggatcgtgcggaggcgcggagaagagggcaagcgccgatctcgtagggagttcaaggtgggcctacctaaaacatgtttcagaagttaatgacttaggacatgtttggatcatttagtccctggactaaaattaatctctggactaaaactttagtctcctattgtttagatccagggactaaaagagactaaaggcacgtggaccaagaaagagataagacagaggctatcactttagtccctataattacccaaacgatccaagggggcggaaagagagggattcgaaccctcagtaaaaaaaaaattgtacaacgcattagcaatccgccgctttagtccactcagctatctctccctgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaagacctccaagagggactaatgaattttagtcttaatatgtatttttagtctcttttagtcatccctgtttggattcttagggactaatggattagtcccatgaaccaaacagggccttaattttagaaaatctgttggataagtttttttagaatctaaatccagattagagatttctaaaggaatttttggatttagaatttaattaggggaactgttggtgatactcttagatagttaacacatagtatcaagcaagatgttaaaatactaccatctcctatgtccttcattaatgcggagaaaatacaaggacatgaagaaaataaggtgagagtactattgattcagtggctaaaatcgagaataaaacgatgtaaattagggataacttcttagcctaacaatacattcttttacggacggagggaaattcttatgctaataaaatacactcttttgagggatggagcatgataaagcgtatacacaccactctaacggaaaatgaatttaatgaattttatcccagcggcaagagacaaataagatttgaccatgatcacaaccattcagtttcccgagtagttaatagttgtggaaatcatttatcagcatattctttcaaggcagtattgcgccatatctatgaacaacctaatcaaaaccacaaggacatgatgggttttaagttccacatataaaagccccctgattcctcgcaagctaccccatatgccttttgcgtagcggatctttggaaacctccttccttgcttcttgattctgcatttcccaaatcccgcacgaacaaggtaataatggcaaaacatgacggctcaacttggtaagttgtgtgtcaactgctccctccatcccaaaatgtttcacgccattgatttttttaaatatgtttgactgtttgtcttattcaaaaaatttaagtgattattaattctttttctatcatttgatttattgttaaatatacttttatatatacatatagttttacatattttataaaagtttttgaataagacgaacggtcaaacatgtttaaaaaagtcaacggcgtcaaacatttagggaatgagggagtataatttctacgatagcatccttccgaggtgacatcagttcttgttatcctacggcagtgaaggccattgggtcactacaaatcgaaataaactaggcgaaaataggtgaaaacaggattttgggggaagttagaagataaattgactcgtaaaggggtttgtgtatgaaattgagttgtaggggggaaaatagaaacactaatgagttatagggggcatttggattttccccagttatatatgatggttggatgagctatttctttttttttttctgttagcacttttctcaagttgttaaattatgtatttttaaaaaaatattaaaaagtttatttaaaaacctaataaatcagtttttaagttagggtagttaagtctttctacaggtaatgcttaattaattatgcacccatgagttatcctattttacatgccactgccagttcaaccaaaagctctagataaaacggagccttagcaattagatctatctatctgttatgaaaaagaaaatagtgagataacctctcttgaaaggattcaaattcaggtcggtgcacagtgcagtgttgtggaagacggtatacggatatcggacggagagagtaccgctaaacggttaatcggaatgcggacgattaatcggaatttggcggaaatataacgttttgaaagtatatgtacatagttgataatagttttccctttttgataaacaaatgcatataacttaatatattccttctatatatatccttaaatagaataaccatatatgatatttaaataagttcataatggatagctgttactgtatatctcaattctgacgtagtgatgggttttgttcataatgcatgaaatgaattatcaagagaatgtagtacatagcataaatgaccgtaatcaaggtcccaaataacatatgtatcggcttcatcaaatacaaactccaataacctgatcatcgtcaaaatcaaggaactcatgttcaaactttagaggaagtcagttccttgtcattttacatcttgctgccttgtgagaatttcggaagagcaaacttctagtcaatagtagtaaagggcacagctaatgagctggattgtggaatcgactttgtcatcacgccgattatacggctgattagacggagacggacgatttaatcggtaatgatcggatttatgcgtttgttaccgactaatgatgaccgcatcggcgtgacgtgatggactgatctccgtatccgtattatcggacgtattaacggccgttaacaccgttttccacaacactggcacagtgcactgccctgggccctggcatatctccctgccagccgagctagcagccgttctccacagatggaaacataaaactttacactgaagagtcaggacatacaaatacatatctgcagcaagaagcgaaacgcacaaatcgcacacagttgcaatagtacagcagggtgctcatataaagcacgctgatttttttatttaaagggagaaaattcatttttgtattatattcttaaacgtttctcaaaatcaagtttcactccgaattaaaaaagcacttactttttatctaacttttaaaccggacaaataacactctatttcctttttatttttgtttaaaatgatgctggtttttcctagtgcaaacttttattagacatgaatgtttttatgacgtatatgccaatatatatatgtcaattaataactaggtccacacaaataaaatttacctgataataatttgcatttacaaaaccactattatataaatgaaaatcattgtgaaaaattattgaatgtgctatttgtccggttttgaaagttaaaggtaaaaaataactcctttttagttcaaggtgaaacatgaatttagagaaaagtttaagggtctaaatagactttaccctttatttagtgatgtaggagagaaatgaaaaccccaattaacaatcttcagcttcccttgatatcaatgtccaaataagtgtaatggggatggttggaatgctctgcaattgctttcttcacaatgtgctcctcacatagattcccaataaactcgagctctttcaggcttgggaggtgctggattccatgaagagaagccacccttgggactttgaaagcaaccctctcgagcttaggagctgtgccattatcaaatatgactgtgctgaggtagctgccttcaaatgaaagatcaactagtttcttgaattcgctgtcacggaatataattgtcccctccgtcaacgcttttcgcaggaatctgagacactgcaggccacgtaggctacccagcatgcgcagagcgtcttctgttaggtaagtctcacgcagggtgatcttggcgagttgatggagttctgtcatccaacgaggaagcccacctctggcacctcttatgtttaaggtttgaagcaacctcggaggtgacagcatatgtgaatcaatcaaactgtacccactgccactgttctcggcctcactccctgtcgcgccttctattatcctgattgacaacgagcgcagacagctttctagcatctgaatctggctaagcaaaaacttcatcagatcgacccttcctctattgaaaaccacacccagcttcctcaacctcctgagtcggccaagatcaatgagcccgtcatcttggctggagatctcaacatggtatagcacttccatatctgtcataaaactgatatcaggcatttttaccgtggaaaatgattcaccggatggtgcctcttttccagccagcagatacttaagcctagggaacacaacgtttaacaccctcacgttggtttggcgtatgtccagcgtctgcagattgtggagttcttggatttgcttgggcagatgataaataccagtgtcccggaggctcaaatatgtgagatgacgcgccctggtgcaaatgaccttcaggtctttagcttgaaaaccgctgcaaccctctagatcaagcacattaattagatgaagaccagggtgcgtggccagtgattcgaccaggctacgatctctgcatgcatgcaggaattcattttgaatggaaatacgtttggccatgtcagggaacaaatcttcgtccactacaccttcatcttccattatcgtggaaaggaagtcacggactatgccatgtactgtacagctcttgaatctgccccagaaactagtaccagtgaagtccccagccggaagaagaaatctgtggttgcaaagtgcatcgaagcagcggttggcaacatctgatggttcttctgaagcagacgttacatctgttctactgattagaccctcggcaagccatcttgttgttaaacttgtccttcgaaaggtgtgatttctaggggaaatagcaagatatgccaagcaatgcctgtaatgactgggcaagctacggtagcagaagttgagcattgaattagcattcagcgccgaagaaggttgcaaactgttgttcaggtccctcagctcttcgatgttcctgttagggttgacaaacagacaacgaaggagcatcttcatggtaaagatagatggggcgcacctagttaggatggactttaggacctccagcagatcattttgctggctgttggcaaccagggaaactgctctctccaagaagaagttgatcagagattctttatgctgctcagggaagtcattgaaatcgaaaatattctgcgggttgcaggaggtggccgccacttgaggtatacttgtgaccaacaatatggcactaccagcgtaacagttacagcggacaatatctcctatgtcgctcatgagtgactcggaacgaacatcatcaaagacgagcaagaacctcgtatcgttgagacgccttatgatcatgcccaggattgagccttgttcccagctgctgacgttctcaaccccaggaacattaggagcgatgctcaccagtatggactcgagcacctttttgctagactggtcgtcgccaagagagatccagtaggccgtgcggctgcaatcgggatcgtactgtccgtacatatcatgcactttccgtgcaagaatggtcttccccgtaccacgtagccctaggatggagatgacattcggctctcggtgttggaggaaatggacatattggtccatcaacggaatccggtcgaggagctccttcgatacttccgttaataggtcggagtcgtcgtcggccaatatgcgccgcctctcgaggtcttcatgctcggatgcggcacgctgatgctgctgctcgcgtgcaggcacaggctcgccggggatggcggcctcaggctgatccagctctccaaatggtcggctgtcaatggctcgtgggcgatgctggtcggggatggcgtccagctcctgctccggacgtcgttcgggctggctgattggaatgatcatctgccgagcagggccagggcgccacatccacatgtcgataacgccatacctcatccgccgctcgcccacgtctcgtgcccgggccgtgaggtcccggatatgggtagcgagccggtggcgggccaggatagtggccagcaaccgagcgaaatgcctcaaaggcccgcaacaacctgcgtcgtgggtgccgtcgaggcagtacacgtaccggtcgacgaagaactcagatctcacggccacgtccctgacctgattcagccaggcgcggacctgggggtcgttgtcttcgttggcatcggcgatcttgaagaggaaggcgttcatgctctccatttcgtccctcatgaactgcacgtcacggcgaacgccacccagcagtctcgtctcatcgacaagaacattgccgagtcggcccaatagagagttgacggcgccctgggcggagcctaagctgtccatgcgatatctcttgcagcaatatagaggaaattaaatcagctactccacctagacacctagcttagcttcgcttgcgggttgtggttgtggttgtggctgtggttgtggtcgacgcttgcaggagcttagccggcctgcacgatcgagcactgataagtgaaagattatatatatactcgttgcgacgaccatctgcagtagggctaacttgcacattatgatatgtgagctaggaatctatctatctatctattatataattaattaaaggaatagaaaaaggagcctccacgttcgctctcatggcctagaaattctcacattaatcggagaaaaagaaaaaacagagtccatatagaaatacaatttacaaatagctgaaattcggaattaaaaaataaggaatattagaagaggggactagagtccatataaaaatacaattaggaaataactgaaattcggaattaaaaataaggaatattagaagtagactatagagtccatatagaaatacaattaggaaaaaatagaaattcggaattaaatatataatttaaggaatagaaaaatgagcctccacgttcgctctcatggcctagaaattctcacattaatcagagaaaaagaaaaagcagagtccatatagaaatacaatttacaaatagctgaaattcggaattaaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataggaaatattagaagtagagtatagactccatatagaaatacaattaggaaataactgaaattcggaattaaaaataagtaatattagaagtagactatatagtccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttagaaagaaatttggaattaaatatataattaaaggaatagaaaaaggaacctccaagttcgctctcatggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtctgtctatatagaaatacaattaggaaataactgaaattcggaatgaaaaaaaggaatattagaagaggagactagagtccatatagaaatacaattaggaaataactgaaattcagaattaaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaagtagagtatagagtccatataggaatttaaaactaactaaaatttagaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaataaataatattggaagaagagcatagactctatataaaaatacaatttacagaaaattcggaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatgctattatatgagagaaaatataatgatgctagccgcgcaatctgcgcgggccactatgcttgttaatattaatgtggacaagagtagactgtttgccacattgcatcaagcaaacagctagcaccaccgggccgggggccggtggtatgccaattttcaacgggttttaaacagatcaacacggccgccaacaagaaaaacacaccggagcggtatatagccgataatctttcctctgacttcatatctattatattattaaaggaatagaaaaaggagcctccacgttcgctctcatggcctagaaattctcacgttaatcggagaaaaagaaaaagcagagtccatatagaaatacatttagaaatagctgaaatttggaattaaaaattaaggaacattagaagaggagactagagtccatatagaaatacaatttagaaatagttgaaattcggaattaaaaaataagaaatattagaagaggagactagagtccatatagaaatacaattaggaaataactgaaagtcggaattaaaaataaggaatattagaagtagagtatagagttcatatagaaatacaattaggaaatagctgaaattcggaattaaaaaataaggaatattaaaagaggatactagagtccatatagaaatacaattaggaaatagctgtaattcggaattaaaaaataaggaatattaaaagagaagactagagtccatatagaaatacaattagaaaataactgaaattcggaattaaaaaataaggaatattagaagtaaagtatagagtccatatagaaatacaatgaagaaaaaaaggaaatttggaattaaaaaataaggaatattagaagtagagtatagagtccatacatgaatttgaaactaactaaaattcggaataaatgtgataaaattaaaagtagagtttagagtccgtataaaaatataatttacaaataactaaaattcgaaattaagaaaaacatgggaagaagagtttaaagtcaatataggaatacaatttagaagtaactgaaatttgaaattaaaaattaaagaatattgaaagatgagtttagagtccacatagaaatacaattagaaataataaaaatttagaattaaaaaaaaataaaagacgagtctagagtccataaaggaatatatataatttatagataactaaaatttgatagtaaaaataattaataactaacacgtatataaaatacaatatgaatattacacattagtagtttcgtaaagttattgcaaaatttaaaattatgttgtcattgtaatatattttaataatataatgagaaaacatatatgctattatatgagagaaaatataatgatgctagccgcgcaatctgcgcgggcctccatgctagtttgattaatgcccactcagttcttaaatacatgacgttctagagatctttcagttaaatctatttaaaccattaattaatgtcgtcattagtatacatgttactccatccattatcgaattactaatgtgttatataacggtcatcccacttttacgacgaattacatttcaatgattataatatgattaattacatagttatatttaatatggtaataatcgataatctgatatattttcaagtatttataaatttaccaaaaaagaaaaggtcaaaccttaaaagtaaactccctccatgtggtgtccaactacgtttgtttgttggcttggttgtcaagccgggtaatgaaaattttacctgcttttaaaaaaaagaaaaaagaaaagaacttatagtgttcatgtcaattattcaagaatggagagtatacacaatgttctagttctcagtcatacaaaatatttaagttttgatgtgtgaaaattgtatttaaatattcagtccgaataacaattccatatagctatatatatattttatatttttataactatattagtaaataatgatccaacatgtgcatgaatgtccatatgtgtcaagtaaaaaataacatagatactctctctgttctaaaataaatttatttttcattcatctcccacatattaattaagaaaagaatatccctaatttatcaatgcacaatgcaattatttctcactttatttactcacaatgcatttatcatctacttttacaaactctaatgtcatgattgcttaaaaaaataaacttatttgagacacacagaaggggtaaaaaaatgattttattatgggacctaggtagtgtccagccaaactacggtacaaggattatgtgagatgtcatatagtcaggtttgcaatttatatctatcatgtattaaaagtcgatgacatgcctatccatataccaaaatataatcttgtaccatataccaaaatataatattagtacaaggtatttattcatttgatttaattaagagctcctatgccctcccccgtgtgggcgatcgactcgagcgatggagaaccagggttcacgattccgacgcgccccttcctcccttgtcctccgagtcgccactacggcactaccggaaagccatatggtgtgcggcgaggtaggatggtggtgaagggggaaaatcctcatcagtggcacaccagaaatctgggcaatggatgcacagaggagggcgaggcggcgttcggtgtgagcacatctggcatggtgaggccctcccttgtcttctcttggggcagctcaggcagcaatgaggttgttaattagacgaccgtcgtggatgcagggttggaaatttcggtcgagacaatattatttcggccgaaattttttaattttttatatttttcgtgattttttggtaatatttgttcaaattcaactaaattttgtttaaaatttcaggaatttcggatcaaaattttgaaatttcagtatttcggtgaggtccgatcaaatcgactaaaccgaaaggtttaaccctgcgtggatgtggcagcccacggctagattcagtgagactggacccgacgagaccagatttggcactcagattgtgggcgacttcggtgagacaactacggtgcgtggatgtgacggcgcgagtagacgatgggaggcaacgggatggctagggcaggttggcgagaccagatcctgccgctcaagcttgtggggatcgtcctgcgtggtggagacagtgcggggcaccttatactttctccgtcccaaaaaaacttaatttctgggttttcatgtctaacgtttgaccattcgtcttatttgaaaaaattatgaaaaaatttaaaaagataagtcatgcataaagtattgtttatgttttatcatctaacaataatgaaaatactaatctaaaaaaattccatataagacggacggttaaacgttgtacacgaaaatctaagaattgagttcttttggaaaggggagtatgccgcaaggcggtggtgacatggcaaaatgacctgagacagcaggggtcagtgatgcaagaaaacagcagcatggctcacggccttgctgtgcctccagcaatcgacgtgtggggagatggtgggagtttgggagcaagttgggcaccggtgggaggttggtggtggggcgctagaacggtggtcgcgtgcagtgaagttcttcggatggtggcagctgatggtaataacgaggatgcaacgatatgagggctggatcgatgttttttgagcggaagcccagctcaattctagaccgacagtggccacacttttaggtgccacaaccccccggaggcgttgctctacggcttcctcctctccatctgttgaaatttgtcgtgtgaaaatcttatcctggtttctctggacgtacgacagcgatgtcctcgacgtcctgacctccctagggcatcgttgtgaaggtccatttcctatcattctcttcttcaaacgatttgtcctcttacaacagtgtttttgaccaccaaattaaagaaggccacaccggctgatatgtgcgttgtttttatatgagtaaaatgcaccagcggtccttgaacttgtcagtaggtttcacttaggtccacgaagttgcaaagtgcacatcgaggtccctaaacttggtttattgtatcatcccggtccaaaaccgcgtttgaccgtggtcttgcctacgtggcacgccacgtgaacgatgacatgtattttttttaattttttctccctttcctttctttttcaccactgcgacaacccctcccctcgtgccgcctctcaccaccgagaaaaaagaaggaagaaagagaaaaaagaaggaagaagggagaaaaaaaattccatgtcattgtccacgtggcgtgccacataggcaagaccacagtcaaacacggctttggaccggaatgatacaataaaccaagtttagagacctcgatgtgcactttgcaagtttgtggacctaagtgaaacctcctgacaagtttaaggaccactagtgtattttactctttttatatagtcctactaggagttggatttgaaattaaaataggtataggatagagttagagtcggactttgtcataagttctctcttaaatagagaggggtactataatgtaatcatgacgactacaatatagtgtaggcatgtagggaggacaatagcggtgaagccatggactcgtagtggctagttgctatattgattagggaggagcatccatatcagagccctggagatgtaggctttggctgaacttcattaattaaactagctgggtggcccacgcaattgcgcggctagcatccatataaaattatatatttttttaatatgattttacttaaaatttattaaatagttatctcgttgtcttaagattttaaaagaccaaaccttatcatccttgtgtttctaattttatagtttttaaaagtcacaccagttgctaccccttacttctgtcatattattctttattagcttgcttgatctaccactatttctattcattcttctttgaacctttaaaaattggatgttaagacttatagtttttagagtttattgtcctgttggtcttcttttgtataatttctagaaatcccgtcaagcgctgtcattatactcctctacgatcgtccactgcatcttctctttattgtcattgctattttaaaaatcgaacataattattgtttaggttcatttttctactttccaaaagtttcaccaaaacgtcaacgactttgtcactgtactcctctatggctccccgttgctgctcttctttattgtcattgagatttttaaatcaaacatggttatcattagggtttatttttttactttttagaagcccgaacctttaaaaatttgaccttatagttcttagagtttattgtctcattgggttttatgtttttttatatttttttagaaatcccgtcaaatgctgccactatactcctatacgacccgtccgccgcatactctttattatcattgggattgtaaaaatcgaacataactatcattgaaattcattttttaatttctagaagacccatcaaccatcggcggctctgccattgtagtcttatatgacccacccattgcctctcatttttattgtaattgagattttaaaaattaaatatgattaccattgaggtttatttttttactttctagaagtccccgccaacccccatgaccgattgcttcacgacctgtccgtcgtacttccttttaatcgtcattaggattctatttggtgttttattaatagtttttagatgtctcattaaccaccaccactctattcctctataggcatattacttaattaatctcgtcatgtgttttagatactcttttctttcaatactcaatagtcttaatttttttatcaccaatcttagttatttataaattgtattcctagttaaaatcttatttttcttttttctaatttcagaatttattttattttttgtattgtgttcttttcatatttttatttttttattttcaattttagctgtttcaaaattgtatgcctactttaactctctttttaatttgcctaatttcggatttttattttatttttttattctgaattttaattaatctactattcggttcttatatgtactcttatttctatattacttatatttaattcgaaattttagttaattttaaattgtattcctccttgaactcttattttattttcttttttctatttcctatgttttttatttttattctgaattttaattaatctcgtaatggattcttgtatggactcttctttcaatattccttgtttttaattctgaattttagttatttttaaattttattcctacttggactctcttttttttgctaattttggattttattttatttttattccgatttttgattaatttcgtattgggtttctatatgtactcttcaatattgcttactccgtttgaatcttcagaacatgtcaatatattttgccaatcactttgcattgcttaatatatttatcatattttattcagtcatagatggacggggaattctgtaattagttttgtattctaattacctattcagctccaacacatactatatgcaggcaacgtgcatgtccgattcctcgtcaattaaaatattgtaattacttctcagtttcctattatgatagaataggcttagcttagagcagtagtttctattcatattcatattcttcaaattaatctacaccgttaaaatctagtcagtttgtgatctaaaggtttaatattttttgttttttctccgattaatgtgggaatttttagccccaacaacgaacgtggtaccttcttttaagactgttttaataatataacttgttgggtggcccacgcaattgcgcggctagcacctaaacaaaatcatatatttttcatatatttttcagtatgattttacttaaaatttattaaataactatttcgttgtcttaatactttgaaatatcaaaccttagcatccccatatttctaattatgtagtttttaaaagtcacaccagctgctacctttgtcatatcgttctttatttgcttgctcgatctactactatttatattcattttctttgaaaccttaaaaaattgtatcttatagtttttagagtttattatttcgttgggtttcgtttttataatttatagaagtcccgtcaaacgctgccattatactcctctacagcctgttcactgtcttttctctttattgtcattgggattttcaaaatcgaacataagtatcattcggggttcattttttactttctataagtcccatcaaaccgtcagtggctttgccattgtattcctttatggctcacccgctgcctccattatttattgtcattgagattttaaaatcgaacatgattatcattggggttttttttactttgcagaagttccaaatctttaaaaattggaccttgtagtttttagagtttattgtcttgttgggtttcattttttataatatttagaagtcccgtcaaacaatgccactatactcctctacggtccatccaccgcctacattttattgtcattgggattctaaaaatgaaacataactatcgttggaattcattttttgttttgtagaagtctcgcgaatcgtcggcggctctgcaactatactcctatataccccgctcgctgcttctcatttttgttgtcattgatattttaaaaataaaatatgattatcaatggggtttattttttactttttagaagtcccggcaaccgccttgcccgtttgcttcacggcccgcctgccgtccctccttttaatcgtcattaggattctatttggtgttttattaacaatttttatatatcgtatcaaccgtcgccattctactccttttataggcatgttacttaatttatctcgtcatgtgttttagatggccttttcttttaacaatctttattttttatcaccaattttagttatttataaattgtactcctaattgaaatctttttttcttttctaattttaggggaaaaaatgaaattttaattaataccgtatagtgttttttgatatttttattttttttttttgaatttaagttgtttcaaaattgtattcctacttgaactttcttttagtttttctaattttagatattattttataatttattacaaattttaattaatctcgtattgagttcttatatggattcttctttcaatattgcttattttcaattacgaattttagttaattttaaattgtattcctacttgaactcttattttctttttctaatttcagactttatttttatttttattccgaatattaattaatctcgtattgattcttatatggactcttctctcaatattccttattttaattccaaatttcaattatttt

SEQ ID NO: 2402 - DNA, 3900 bp, Oryza sativa
actctctttttctttttctccgattaatgtgagaatttctagcctccacagcgaacgtggtgccttctttcaaaactgttttaataatataatagatagatagatagatagatagatatcgtttgttcctatgtcattatctagcatgttttgagggatcaatgattaaaacgatggagaatgttagtcatcgttctgctacatcgactaatttttgtaatagaatgaacccttctccacttttataatagaatgaacccttctcttctcttacgtaccctcttcctcttcaatctaaatgtgtggattgagttgagtgtggtcaggacgtcacactcctgtttgttcctcaatagtttttatgttgtagacacgtggtatgtttttttccatgttatagcctcataaagattatggttttgtaaactttttctactgtatcaatataaaccttgtaccatcttgtgcggttttgtaaaaatatttattcattgtacaacaggacgaaaaaatatttattcattgtacaacaggacgaatttggattacagcgtagagtggaaaattctgcatattgatgattatcaattgtacctgttgcaatgccgtgtcggcatgggttatagcaagaccgactaataataaagctggccaatggaaaagataaactccctctatcctatgatacaaggcatattaaacttgacacggtctctacaacttatctttgatctataatttctcatatattataaggtttgtaataacaaaattataagcatatgaaaataaattcaaattgccaatccaatggtataatttttagcaagtaaaattcaattcatattatactaaatgtagatcaaaatgttttgaaggtagaatcttaaaatgcgtggacgctttatattatgggatggagggagtaatagattagttacacacacacacacatatatatatatatatatatatatatatatatatatatatatatatatatatatatataccatgtcaattgtcgcatcttcccttggataatagtagagctcactttctactattagctcatcttaaagccaacatatataatagattagtttataaggttggttataattttcttcttctctctccatctctcacgtatttgtttttaaacttgtgataagattagctcttacatgagagtcaacactcttaattttttactacctctatcttctatctaaacttataaacttataggaggtttatagctccctactaagtagacagcaagtggccgtataaaaagtccaacttgagttcgtcgcgattccagtagtttgaccgggcctatttggttttccctgacgccgatgcaaccttgacagattaaaattaaagttgtggtctagcagtctatggtattacataattgtttccaacattgctcactctattacacaagtgggataagagttgtaattgtgtacactaatcgatttattttatgaacaaatcatgcattagcaacttgcagattcgaaactgaaagcatatttatggatatgtacggctgataagttcttaaccgtcccggtgggggaacccttgaacaccaatccaatataagatatcttaatctttcaactattaaaatcggtgcattttagctttctcggtggttttgagggtgccttcggtgacgtgacgtctacatgacggtgtgacctagtctttatcccacatagtgcttacgtgacattagaatttaaaaaataagcaagagaattgtcgatagaattaaaaaaatacatggaacttatttgtcattaaaaaaatattataagacccactgacatatgggcccccatgtcatcacttctcttcctcctccctctctacgtatatgaagacttgattcacctaccacaaaagctaaactaggatgagagcggctgcttctttccactccccggcgaccacccataccgcttcttctttgcctggtcgtccaacgaccctgagctgccgccaatcatatcggcgccggacatggacgcaatcctcggtggcgcgctcatcatcttgtgactggtgttggtgctgtagtgctgcatgtaaggccggatgcggcgcgcgcctgcttggctcggctcggtttagctcgttaggataacgagccgaacgctaagttgttagctcggctcgtcttgttggtaagctcgagccagctcgttggtaaaattgcaaggctgcacttcagtaagcagctagcacatatcaagccagccagcaagatggcagaaacgcataaagcaaatgcatatccataatacgatgttccaatccatagcctatcagcaattcacccaagaagtacaaaaatatcaaatagtaactatgcaaaattgcaaatgtaacaagccaataaagcaaaaagaaaaaagcaacaacagatcaagtcctcagtattgacgccaatgaaagaaggaacaaaacagcaggaatacaggcttgctcgacgttgacggtctcagtactgacgccgacggcagcgaggaaattaaggaggcttagggtcttcgatcaaccatttgccgatgcaccttgattagaaacttggtggcgccgatcccaatacctccaggatgctagggatgttcgctcgtcgcgcggtgcaatgggcattatcaccaccaaagcagtctattcctcttcccaaaattcgccggctctgtgccacaatggcaagtttatttgggacaacagagctccgcctcgagtttaattctttgcctggcttattgccaaggatcgcctccccacgaaggttaatctccataaaaagaacattgtgcaatcccccaaatgcaagctttgcagcgatgaagacgaaacggtgagtcatctttttcttcactgtccgttcgctgatgaattctagagatctctcaacattcaccccggcatctcacgcgtgcaagatctctcaggtctagtcgctcctaggcagctccccgctaaacacttccaagttttatatctactctgtttctggggtttatgaattcatagacatgatgttgtttttcgtgatctgcctaaatcactcctaagaatggtagcaaaatgtatggaagacgctaatctttgggctgagtgttttcgtagagaagacagggtagttgtgtcaatttggaaggatcttctctcttcctccgtacacgtcactcgtcatgctaaggtggttgatgatggcgctagctgcgcgtgtgtcgcagttgcgcaggcatggtgcgcatggctggtgtagaccgggagtggttacacagcatggcacatgcgctggcactggacacatggacgtggccaagagaggacgttcctggcctagggttgatcgacgggggcgtcgatctctcttaaggggggacgtggccaagagaggacgttcctggcctagggttgatcgacgggggcgtcgatctctcttaagggggtgagggtgtaacatcccggtctagggcttaataggattaatagaatactcatatcaacaagttgcaacttcttttccggaagccaatctccaaagaacttcagggttaagcgtgcttggcctggagcaatttgggatgggtgaccgactgggaaattcttcccgggtgcacacgagtgaggacaaagtgtgcagaaaagacatgtgttggtttgtgagggcagtctatgacctatgaaagctatcagaagacgggacgttacaaaatggatagatggtgacgggcgacagccaacagcgagatgcggagggcctggatttttcacattttggtctttttaaaaaacttattttgcaaatagacccctaaaaaaacttatcccggaaatggtcctttttggggcgccaga

SEQ ID NO: 2403 - DNA, 16199 bp, Oryza sativa
gctctcctccctagggcggtgccaaccattttggcgccctcctcctgccacgtcggttcgcgtgtaccacggtggcaagaggacggcgccagagaggctggcgccgtcccgttggacgacggcaccagccactctggcggcccaaaaaggaccatttctgggataagtttttttaggggtctatttgcgaaataagttttttaaaaggaccaaaatgtgaaaaatccagtgcggagggcagccaacggccggcgatgaccctgctggcggcggcacgaggcgtgatgggggaggtcgagacggcgttgggagcgtcggaggctcgatgcgagatgggggggagcgagagtgcaacactgggatcgagataacggggggatagggatctaaggttaatttgtttgcatttatacctggtgcctagttgggctgagcctctaaatatttttgttggactgccttttgacttgacctcgtttagctagtgagctggctcgttatgacaagggataagttcacattgggtccctctatttgtcgcccagtccgattttcgtcccttggtcgcaaaaccgggtacaactggtcccccaacttacgaaaccgtttaaatgaggtggcgtcgacgtggcttctttgactaggtcttcgtcatacgtggtattgacgtggcgcttacgtggtaatttgatccctgaaaaataattaaaacagtgggacccacatgtcagcttcatatccataatctatccggttatccgctctctctctctttttgtcagcgaagaaggacaagcggctgagccggagcggacgacgccgatgaccggagcaagctggcgacaagaacggcggcgccaagggccgggagccactctcctcctccttgtcggccgtgggcggggagatatcggcggcggcctcgacggggagccgctctcgctaacggtggccgcggaaggggagatgtcggcggcggcctcggcggggagccactctcgctgatggtggtcgcgggcggggagatgtcggcggcggcctccgcggttcgggtcttccctcgccggattcttccgtgacagtggtggcggcagcatatgtcgtcacggaggaggcaacgatggagatgaggagcacggcgggcatagagggcggcgctaggatggagatgtgtcgcgcgccattcctctcccgtcggtggccgcatgccgttcctctcccgccggtccactcccgccgcccgccgctcctctcccgccaacgcccgtcggcgggcgcaccccgctcctctcccgccgcctaccgcccaccgcacctcgctcctctcccgccgtcagccgcccgccgcacccctcctcctctcccgccgtcagccgcccgccgcaccctgcttctctcccaccggcgtcgttgaagcatacagagccacagaggtagatgaggttgaaaaagtgggacccgctgacatgtgggtcccttttttattttttttactggcatgtgggtcccacaaattttgtataatttttttattttgaattttgatgtttttttttcggatctaattgccacgtaagcgccacttcaatgacacgtgagacaaagacctaatcaaaggagccacgtaggcgccacgtcagcaaaaaccgggcacaataccgccgagcgacctcacttgcatggtttcgcaagttgggggacctatcttacccagttttgcgaccaagggacgaaaatcggactgggcgagaaatagagggacccaaagtgaacttattccttatgacaaatgaactaaagcattgcctcagctcgttaggaattcattacaagccaagcccagtctagtcaagctagagacgagctgagcgagctaacgagctagagtttttcgtccagccaattcaaatgaaataactgacccagcgaacaaagacccatttagttcgcgaaaagaaaatttttagatatcacatcagatgtttgaccggatatcgaaaatgtttttcggacacgaatgaaaaaaataatttataacttgcatggaaaccgcgagacgaatcttatgagcctaattaatccgtcattagtaaatgtgggttactgtagcacttatggctaatcatggactaattatgctcaaaagattcgtctcgcgatttcctccctaactgtgcaattagttttttcatttatctatatttaatgttccatgcatgtgtttaaagattcgatgtgaagtttttggaaaaaaattttggggaactaagcggggccaaaataactgacacaatctctcacattctcactgacccggcgaaacaaaaaaaaaagattaagggcttgttcactttgatatcattttcaaccttaccaaattttggtaaagttgccaaagaaaaatggttacatttaaggcctgttcactttaatgccattttcaaccttaccaaattttggtaaagttaccaaaaagtggctacatttagtttactaccaaattttggtaattatataagaaatcctgccaaaattttggcaagttactaaaattttggcaactttgccaaaattttagcaatgacaaaatttggtaaggtttttttggcatcaaagtgaacatgtccttagtttgctgccaaattttggtaactatataagaaatcctgccaaaattttggcaagttactaaaaatttagtatttctaaaatttggtaaggttttttttagcattaaagtgaacatgccctaaacaatcccctatacctctcacagtctcaatgccccgtgtcttgttagcgcggtactccatggacctcgtactccacgctgaagacagttgtgatgcaagacaacctcttggggttattgtggggtgtgtttagttcacaccaaactttccccaactcccaatttttcatcacatcacatccaaaatttttctacacgtaaactcctaacttttttttcaaactaccaactttccatatacttctctccaatttcagaaactaaacacagccgtagtcatttgggaggcggacacaactatgcgcttcgttcttcgtaggtctgtcacctagtattcattaaaaatccttatattcatgtccatattatttgggtaagatatactacgtagataaaaaagctatcatttaaattggtatgggtagaaaagttatcattccaagtttggatatggggaggttattacatatttgaagaactttgttcatacccgtttataatgggtaaaaatctgacataaaatttttaaactcacattcacattataaaatcttatcaattttgcttgaaatttacagagatgatttattatataaaagagcaattttctacaaattttggtccatttctacatatgggactcacatgtctcttctcttacccattaggttacccctacccattgaataatatccacttaatttgggtatagatatttttttagatgtgaatggttaaaattgggtatagatatgggttacacaataccctccctagtggcaccctggtctggtactgcatggatcagtcctactccctcttgaactgggcagcatcctctgagaacgctaataggcgatcggtcgcgcgcctcctctcccacgtgactggacacgtgtcgcgcgcggagaaggggcgcaggcggcggtgcggttttctttttttttcggtttccttttttctcgcacgttcgtttttttggtttgttctgttttttctgcggttttttttcgcacggtttttttctatccgtatatattttttcagttttttgggttttttaatatatacatatgcaaagtttgtatacacatatacaaactttgtatatgtgttttctaatatgtacatatataaactttgtatatatacgtatataaagttggtatattttgtatacatatatatacaaactttatatatgatgtatacaaactttgtatttgtatacatcgtatacaaattttttatttgtgtatatattttttatacatatacacaaaaagagagcaactagaggacggtataccgttttgacggtatacctctctatacacccacgagcacaagtacgattccccatgactcgaagccccgcgtgtctgatcctggcacgatgctcacaagcacctcgctgtcaggctctcagtgcagcacgcagccaacccttggacatatcacgtgctcctgtctctgttggcatcgattgtagacttgtttctattgttttaaaattttgcagtgcacatgtttaactaataaagtgctaactatttctttccgtctaaagctacgtactttagttagacgattatgtgctagatggttgtgctaatatataagatgacaataaaatctctgtgatatttttacggtacacatctagtaatgttgagatattatccgatacccttgagctagctatcattcgacactctcaaggtatcattcaatagatattatctggtactctcaaggtatcaccggtaccaatgaggtatcacccggacccgatacaatcaagttatcatcatatatcaggtaccctcgaagtatcatcgggcctggtaccgttaaggtatcatcatatatccggtaccttagagtgataccttaaaagtatcagatatataatgataccgtaacagtatcgagggcctagatgatacctcgatggtaccggatgatacctcgagagtaccagatatacgatgataccttaaaagtacctcaagagtaccgagtgataccttaagaataccggatatacgatgataccttaacaacaccgagtgcctaggtgatacctcgatggtaccgggtgatgtctcgagggtattatctggtacctatactcttgagatatgatgatacatatggtgtattaggatggtactgtgaaagtatcatgtgtatcacatacatccggtatccttttttaaaattgtatagaaatactgaatttttcagtttgttactgtgatttcacattagtactacaaagctatcttaaagtatatttggtctggtcaaatgaacaaggccatacgtggccgaatgaacatgcacatgcactctgctaggcaggttaggagcagaaatgtgatacgcttggaagatgggcgacaagcgcgtgactcgaggagggcccacacaacaccacggagtgggcgctggctgtagaaagaaatcgtaatctatactgtcgggagaacggaataccgtcctttagtttttctctatttacatatgtatgaactgtagaggagggagactaaaagaggctagaactgaccgcgcgccgcgcgctgctgatcgccaatcagccaggcctggcatcctccgctgccgtgagtgaccatggcagcggcttcctctcccgtgtcaggatctccctgataacctcctcctccatgtacactggccctcttggaccggtgcactcctctacctccaccgtcgccgccgccttggccggggaaacgatgctcgacttgtgatgatcggagcagactgtctcttctctgtcgccactgtcgccgcattattcgtcacggcgctcgcctttgacgacgacgcactgttcatgcctatcaactccgatctaaaacactggtcgctagcaagattgtaagtattgcgatccatatatatcgtagtatcttcctaccaagatgaaacaatatcaatcccacttagtatcctaatttttataatatcccgatcctactattgattaccatatgattttacgaaatcttaggtaatatcccgattctacgatcatataaaatgttatttaaaataagatggtttgaaaataaattaaataaatatgcactagtttatataaaaatcagttaaatatatcaaacataatgtattttcttataaatgtctctatttacataacatatattattactatatttttatatagaatagctatacataattaatataaatattaattaaacttaaaaaaaataaaatctcatagtatcctgatactgcgatacgatactattttaagcaaaacgatactacctagtatcccgataactaataagcttggtcgctagtgggcggtggattaacgggagaagcaacgtgacggtttaatgcagttaatttttaaatcatgtttgaccatttattttatttaaaaagttatatattcatcatttcatttattatgatttattttatcattagagttgcttttaacaagagtaaagtccatcgccggtccctaaacttgtaccgcagtgtcatcccggtccctaaactcacaaatcgaccgttcaggtcctcaaacttgttcaactgtgtcatcccggtccctaaacttgcagatcactcgtttaggtcctccaacttgttcagttgtgtcaccccggtctctaaatttggatttgaatatcatctagatccaataggacggtttaaagactttatatttaaaaataattcataactttttcatgtgaactctaataaagacaaactttatatcaaacttgtagtcctcgacgcgatctacaactttgtagttgaatttttttattttaagtcattttttgtcccaaaatgtaattttaaaattaaaatttcaaaatctataaacatgcaccaatattttgggactctaaacagttttaattcaaaaacttttcaactaaaatgttataggtcgcgttgagggctacaattttgatataaagcttgtcttcattagagttcacatgaaaaagttataagttattttttaatataaagtttttagaccgtcctgtttaggtaccggggtgacacaactgaacaagttggaggaactaaactagtaatctacaagtttagggaccgggatgatacagtcgaacaagcttgaggacctgaacggtcgatttgcgagtttagggaccgtgatgacacaacggtacaagtttagggaccgatgatggactttactctatagtttaaacaattaaatgtgacgatttattaagcatataatactatgtttagaaaaaagtcaacatcgtcgaactagaaaaactgagtttgcaccctaaaaggaaaaaaaaaactgagttcggttccgtgtcgaactcggtctcttcccgcaatagcgccgacccacctgatcggactccgatcgcccccgcccacccataaccctaaacccgccgccgccgccaccgccaccgccactgccgtcgaaacctacgcttcgaaaccatgtcggccacgacgcgcgacgacgaggcgtgcccgtcgacgaccaccaccaccaaatccacaacggacgacgagccggcggcgccggccgcgacgacgccagcggtgacaacaacaacaacagtcatccacgacgacggcgcccctgccccgccgtcgccgaagaggcgcaaggtggcggcggcggcggctccggctccggcggtggtcgacgagagggcgcggctgaagcggaggatcgcgtgggtggcggacaagatcgcgacgcaccgggacgaggtggagacgccctacggcttcccggacacctgctacggctacgccgggtacggcttcgtcgggtgggtgcgggcggacttcgccggcgaggagcgcgccgccgagagggcggcgctggaggcgtggatgcagatcgagtgggagaggcggctcctccggtggcgccgcagcgagcagcagcagccgggcgtcgacggcggcggcgactcctccttcggcgtctgggatgatgatgatcaagaggacagcgagaagaaaacggaatacaaaataatagcaggatgattcatggttttttttgtctatccatctaatcaaatttgatcgaaatcacgctaatgatccatcaatgtgcctgatgtttatacattttttgcctgctgctactgcaatctgatatgtgttcagagtcatctactcctagcaatgggaaatttaactatttgccactcttgtgacatggcaattaacgatttgccacaccgtgtctatgacatgtgggcccttatgtgtctatgacatatgggcctagtggcaaatcgttaagcaccactcgtaagagtggcaaatagttaaaagcccccctagcaattgaatgcgcatctatagatgcaaatgttatgtattcgattctttcttcagtgtcaaatttatgccttcgtgcccccaactttcgttcttgattaatgaaaacatccttggcaaatgctttcgtagttgttcgtctttcataaatccaagaatttcacctctgactatgaaatacgaatgcccccgactgtccctattaatcattactccgatcccgaataccaacacaatagaaagaaaaattgaataagacgaatggtaaaaagttaacactgtcgtaaatacggaaggagtacgtcgaactagcttatgtaatttacatttgaaaattgaaaataaaaattacaaacaaatctactcaaagttacattataactataatgcaactacactgtaactataacataataactatgctgtaattttttaggtaggcgggccgatgctataatgtaattttctctttcggtgttgctcaagtattggtttgttgggtagcgaaaaaccttcactgcgattgtggtatagtagagaatacaatgctcctgttgtagtatgtattactcagatggaggtagagcttaatgattgccgtgtgaaaaagactccgtttgtgttttgggctttctccaaaagccgggtcaatatatttgatctgatttcaaaaaaaaaaaaatgccgtgtgaaacgtgatcgaggagttaaacttctgtacatatagagagagagcaaacaaatgcacggcacgtacaacgtcgtatactcgtatctaagtaatctaaggaacgtgaaaaacaacagattcgtcaaatttctagcagatccgaaaaaaagaaccacgaaacaatcgagccgtgtcccttccgactccaactcttccccggctatacgtacggctccgcgttcgcctccgccttcataaaccaccgtctctttccccccatcgaaagctacgatcgattccaggtcaatttccaacttccaactcgcgtcatcgcggcgaaatctaccggcgatcgatatatggccggcaacgagtactccaccaaggcggcggcggtggaggcgatcgacggcggcgaggaggtcgtggtcctggcggggaagctgctgctgccgagggaggtggtcgacaagatcctggccatcaagaggaggcccttctccttcggcgacgacgacatcggctcggacgacgacgagctcagggagctggccgtgcagcacgaggccttgcaggacaagttcgccgcgtgccaggccatgatccgggagcatcgccacgagaacaagggctacgccattgtcgacgacgagttgcaggtcaggatggccgtgaccagggccctgcaccccttcgttgagcgctaccactgggtcggggaggaagacgaggaggaggagcaggtggctgacgtcgttggtggtgaggaaaagctgatctgagacgcaactgagaattgcagagctttgcctatcttaatagcattacaattaatacgtactgtctcatcggatggcctaatcagtcaaagaaaaaaccaaattttgaattttcaaatctaattttgagtttgattttgagatattttcaacgtagtttcttttacaacattggcttttaagtcacaagaacacatttataaaaatttcacctataaattcatttttatttcctaataagccgttttggcttattaggaaataagccaaacgatggggacctcactttcctatgctgagcttattcagtactccgtatctatcgatctacatactccacatgtctatgtgatggctatttatgtatgcaactaccccatctgtttcatgttatattcagaccgtgtttagttccacgctaaaattagaagtttaaagaaattgaaacgatgtgatggaaaaattagaagtttgtgtgtgtagaaaagttcgatgtgacggaaaaattgaaagtttgaagaaaaaagttggaatctaaacagggcctcaatagtagtatctaactatctacatcattcaaataaaatattgttgcaaggtaaataaatgaacaaccatgtgccataatacaactattatattgacagattctttgacatgcttttcaaacttattatcaaaatatattcaatgtttcatttaatgaaactaatttggtgtataatgttaccaaatttttttataaacttgatcaaaaaaaaatcctaattagggcatcttcagggaaggctgaaacaaaataattatcatctatattgcctctatgttacaatgcttctccaagtgaccagcataaatgtcataaacaaacattacagtacatgacataaggaaaaggataaaaaaaattcaataaatatcacagcaagattaaaacatcacaaatcaactatatgcatcagcatcagaccatcagcatgcatggttaaatcttgatgataatttaacaaatgaacatcacatgcatcgtcgatcgttgcgctaactgaagataaatcattatactatttgacaaaaagttttttataatactagatattgatccaatttcttcaacacaagcttcatcttcaccttgtcgaacacagcgatcgtcctggttccttcctccaattccttgggtctcacctcgaacgccctcgtctcttgattatagacgctgacatactcggcgaactcgccttcctccggtggatcatcggcgaagattttctcccagacatgtgcccgccacagcctccgctcctcctgcagccgctgcgtctcctcgaactcgtcgacgtcgtactccacctcgacgaagccgttgctgccgtactcgacgcggaacttggcccaggatttgcccaggtggccttgaggatgccgttgacgtgcaccagcagcgcctccggctcgtcgtcgtagtagatctccgggaggtggtcctcgtcggcgtcggcgtcggggacgaatgggaatatgggatgtatctctcgatgtccggggcgtcgtcggtgcagagctctgtacggtcgaggacccactcgatcggcgttctcctgcgatagccgcatcgtcgccaccctcctcctcaccgccgccgccgccgtaccgtcggagttagggcacgcctcctgctggccatgctgctcgaccgccgccgccgccgcggccgccatgatttccccggctcgccgcggcgatacatttctgaacgaactcttagagccgtggcttatgtaaaataaaatgggccggtccgtacggttttcgggttaccggaaaccgaactagagttatcgctgcggccccctatccgtgtcactgcacgagcacgacgggggaactattctaatccctcgaggggatattccctcgtttactcaaaaaccatctaaacagttatgaaaaattctagaaaaatttgacaacatttatacaacacatatatataactccacaaaatcttaagtccaaactcaactcacacgtcgagatataaaaaaaagacaaattcagcgtatgaatagtaacgtactgtttatatataaatttgtcttttttgtttctcgatgtgtagatcgaatttgaacatgaattttggtggactagtaggtataattatactctacattgtcaattttttttagaatttttgacaactatttgcatcgaatttagaagaaaaaggtatatgaggggatatcccctcgagggattagaatccactcccgcacgacggcctcacgttggcatcttaaccgtcctcggccgatcggacggctccgcacacagggtcgctggataagaaaatagccgaaattttgacaaatgaccctttcaagaaacttaattaaagataaatcgtaccaaaaactaatttagaaaatgataaaccgtgacctcgacgtgctttaacgtctcgacgctgctataacgttcatgctgagatcttgttcgacgaggcacaaattcgtcggaggagctcgcattcaccttctgtacaatctgaaatcacgcccagtagcgttcccggtcgtaggcaagcgagggcgcaaaactgatcgccctgagagagcgagggcgatcgctcgcccagtagcattcccggtcgtaggcaagtcactcagtatcattccatcgtatcctctttttttttcttttttttttactttaatgcatataaaaccaaatgagaccaataaatacatgcagcttggtgattgcagcacacagcaatatggaatggacgcagcagtggtatgcgccactatacgccattggcaacactgtgcctccaccgtatctattcatccttaccaatgatccccactagattgagccatctcacctaggtctgagctttagcataaggcaaagttcaaaggcaatatatagcacttgagagttgggagattggtattatagggggctgctataggcaaatgaacacaagaaagtttgcaatttttcatggtacgaattgaacagcattgaaacctaacaagtgcatgcactgttaacaagagatgaaaaaatatgcaaaactttgtaatttcacagcgttcaggcactacataatttcacctatctttccttcaattaaatagctaaacttgtgatttttaaagagaaaaaaaaaacagaaaggactaaagaaagttcacttataattagctaattaaaacatctcatattgcatagatgggccagcagtactcaagattgatcgccgattaagatccaaaaagataatcccacaataacaagaaaacaatgacatacgcttgcataaggaaagagatttgcagaatgcattgaattatcattaatcttctaaaccatcattatctaacttataacaagtgacaagtaccaacatcgcaatacataagtctgcttcagcaaatgggaaacctattaggcactcgttgattcagttcttcttcacgaagacaaaacgcttcttctccttatcgaacacaggaaccccaatattaccttccacttccttcatgacaaacttcctcctcttctcatcgtacacttcgatgtaatcgccgaactcgccgtcctcgatcgtgggaagaatatcagccatctcctccgcgagcatctccgcccacaacgccctccgctcctccctcctatgctgcctctgctcgaagtggttgtggtcgtactccacctcgacgaaccccttctcctcgtgcttggcgcgcacccacttctcgaagtccctgaacttgtcgaactcgtccatgaggagactgtcgatgtaccgcatcagggccttggggttatcgtagtaggactccggcaggggatcctccgcgccggggacgccggaggggctctggaggaggaaggggatgtacctcgagatgtcgggcgcgtcgtcgccgcacagctccttccgggcgaggatccagtcgacgttttcctgcgacagccgcagcttcgccgtcgccgtcgccggaacctcctcgtgggaaccagttgccgccgcagccatatatacttgttctgactcgccggcggcacgcagagggaagtttcgatgcttggattgccacaaaagggaatctcgtcgtctcgttaacctaagcaagccctctcgattttggagattgtgggggggaggaggcggtgcggcgtgcaggtttatactggtggaccgctccgcccgcgtccgactcgaagttcatcgttgaaaccgaaccggatactgaaaaccgatcgataggtgaagtccgcgtccgtcaggtcatgggcctcacgggtttaacagaccaaacggagcgcataccattttccggacaacgaaacaaatacgatcggacacaaataggaaaatattttttttttcggaacgtaaaaaccaactcaacttttaaaaacaaatatcatcatatataattagctcattttatataaaatataatataatatataactttttaaaagtttaaatattattaatagtgtggactagcgttaacagatggactactattaaaatctaaaaaggtatattgaaggtcatatagttataaagaaatacggtatgtcttatggcttttttgatatccgaattattattcatatctaaggaaaccccgatatcttattcgtattgtatatgggagaaaatatatgtttttttatcagtatccgaactatccgagaattatccgtttcgaaagatatatgtattcgtttttattcggaacggacaaaactatccactccactttcatccctagctattgacaatgtacagtggcatgcctaaaactaacggtgatattgacaatgtacagtggcttgctatatttctacatctctatctctaactctactttttatcttccatcttctatcttctactattataaaaattaaaaatgtttttgctagtattttgatacgtcatcattgtttgagtcaactttttaagttctacaaatccatgtttgagttcgtttttaagttcgttcgcttttaaaaatacaaaagtagtcgtacaagaaatttctttaaaaaaaactcgcatgctaacttgagacgaaagttggactcctaactgcagctaatgattttctaaaaaaattatccaagtgaattctcatagtgaatttcaccctaactaaaccgtataacaataataaaattaaaatagccttcaccgttgcaacgcacatgtatttttttctatttaaaaaaatgacaacatttcatggcaactcgcatatatccttttggtccctaaagtttggccttaaggtcaatatggtcctcgatattttattttgtccgatcagatccttaaactttgtcatatggtccaatatgaaccttaggctcaccagaaatgccatgtagacatgctatgtcatcattttattaaaagtggattgtgaaatttttaatctgtatatttgtatttgtatgtgataataaatactataactaattaatcttatataattagataatttaatctaatcccaggaattgatatatacactaggtcttgttcgtttctccaacaagatggagatgaaattttggatactcgtgatatgcttttcaaactactaaacgttacgtttcgtgcgaaaacttcctatatgaaagttgctctaaaatgtcagattaatccattttccaagtttttaataattaaaactcaattaatcacacgttattatcacatcgttttacgtgaaacacttaatctttatctccatcttcatcttcaggagattcaaacaccaaatagattatgttacaagatggcatggcaacgtgattttttttttccaaggaccatagtagactgaaagataaactctgaggactagttcgaacaaaatgaaatatcaaggatcatattgacctcaaagcgaaagtttaacgactaaattggcgccccccccccaaaaaaaaaaataataataaaggggagggggatgagcgggtgtttgtacgtacctacatatgtacgtttgatggtgtatgtacataagtaaatgtggcccatgaccttatttattagaatgccagatggtaatttaggagtgtttataggaattacacaaggcagcacagggatgatttggctctgcccgtttcatccttctcaccgcattatccgattattggttatttagggaatatatgtcacgccccgaaatagtcccgaccggaactagcccgtgacgtttcaaattaacctgttaatcgataccagtcccaggaaacagtgctggtatcacagggagacagaatatcacagcaacagaggtctctttattatagagtaggagtacagtcatgttgggctacggacagatcccgagctcacaactgcattacaaaaggaaagcggaagccaggacttggaccaatcatcacaggcgcgacttgggaactaggccgaaaccctaaaactcatcgtagccggcttgctcctggaagaactcctcatcagcaagaatcgcttcatcttcttcagcaactgggggggattatttatacagagcaagggtgagtacgggggtactca

SEQ ID NO: 2404 - DNA, 16591 bp, Oryza sativa
  unsure (1)..(16591): unsure at all n locations
acggcgcccgggaagcggctttgcgagcggggagctcgcgcaaggggagggggcgctcagcgcgggcgactcccgcgcacgcgcgagcagcgtgcgggcgaggctgagcgggggaaaggaaagagcgcgccggggggggagagagagagagagagagagagagagagcgcccgggagagagatgggccgagctggattcggcccatcgaacccgggggaggcaaactagacttttgcggaggaaattgatttggagggatttggattcggaattgaactcgacgattgatcggggattgagatcttgagatggcacggacactagacaacaaacaaagaaacaaatttcgcaattagggtttttaagagataattttcccgctaggcgccacgacggaacgggcgctacagaccaacccccctaacaagaatctcgaccccgagattcagcacctaagggagcagctccggaaactcggcgcggagaagatcttctcgttccctggttgcctcatcttcagaatgattgctccattggactttgtagaacttgatggtcttccttcgagtctgacgttctgcctcttcaagaaccttgatcggtctttccttgtaggtcagattcttttccagctcgatactacccaggggaacttgctcttctggaactcgaagacatttctttaactgggatacgtggaacacgttgtgcacatctgcgagaccttcaggtagctcaagctgataagccacttcgccacgtctggcggctatgaggtaggggccgatgtagcggggtgctaacttgccggacatcccaaaccttctcatacctcggaggggtgacacccgcaggtacacatgatctccttttttgaactcaaggtcacgtctccgattgtcagcgtaatttttctgacggttctgcgctgtcttcaagcgttctcggatcagcttaacttgttcttctgctgacttgagtatgtcaggaccgaataccagggcttcgcccacctcattccagcacaagggggtgcggcactttcttccgaacattgcctcatttggcgacatctgaatactagcctggtaactgttgttgtatgagaactcagcatacggcaaacaacgatcccaagtgccttcgaaatccaaggcacacgcacgcagcatgtcttctaggatttggtttaccctttctgtctgaccatcggtctgtggatggtaggccgtactaaaatttagatcagttccgagagtttcatgcaactgcttccagaaccttgaggtgaactgagtgcctcggtccgacacaattttcttgggacagccaaatctacatacgacatgagtcatgtagagttctgccagtttctttccatcataggtggttttcactggcacgaaatgagctgatttcgtgagtcggtccacgattacccaaatggagtcatacccgcagggggttcttggcaaaccggtgatgaaatccattccgatctcttcccatttccactcgggaattggtaggggttgtagcagaccagctggcctctggtgctctgccttgactctttggcaaatgtcacacaaggctacgtattctgcgacgtctcgcttcattccagcccaccagaagtatgccttgatatcttggtacatcttcgtacttcctggatgaatggagtaggcggactcatgagcttcctttaggatgagatctcttaactccttcttggccggtacacagatgcgtggaccgcaccaaactgtgccttgttcgtctatggagaaattggtgtctttcttctcccgtattctttttattaactcttttatcccttcgtcatctttctgggcctcccggatttgtgattctagggtaggctgtactgtcaagctggcagggacacctgactgtaccacggtcagccttaacttctccaattctctgcacaggtgatcttggttaggccgtgtttgggctacattgcaataggccttgcgacttagcgcatcagcgaccacgttagctttaccgggatgataatgaattcccagatcgtaatccttgattagttccaaccatcttctctgtctcatatttaactcggtctgtgtgaagatatacttaagacttttgtgatcggtgtatacttcacatctgttcccgattaaataatgcctccagatcttaagagcatgaaccatggctgccaactcgagatcatgggtgggataattgacttcatgaggcctgagctgcctggatgcgtaggccacaacctttcgttcttgcattaggacacatcctaagccttgtcttgatgcgtcacagaagatctcgaaatcttttcggatatctggcaaggtgagaactggtgcagtggtcaaccttttcttcatttcttgaaagctgtcttcacaggctgcagaccattgaaatttcttttctttctttaacagctcggtcataggtctggctagcttagagaatccttcaatgaatcttcgataatatcccgctaagccaaggaagctgcggatctctgacacgttcttgggcgggttccaagcaagtacagcttcaaccttgctgggatctacttcgacaccgttggaggaaatcacgtgtccaagaaatgctactcggtccaaccagaattcgcatttctagaatttagcgaatagttgatgatctctgagcttttccattatcagcctcaggtgttcagcatgttcttcctcgttcttggagtatatcaggatgtcatcgatgaacaccacgacaaactggtccaggtattccatgaagattttgttcattaagttcatgaagaacgctggagcattggtgagtccgaaggacattactgtgaactcgtatagaccataacgcgttgagaaagcggtcttcggaatatcttcagatctgattttcaattggtggtaacctgacctcaagtcaatttttgagaagactcttgctcctttaagttgatcgaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactctccaactcttcgatttgtcttttgacttctgctaactcattagctgccattcggtagggtatttatgcaattggagttgtgcctggtaccagttctatggcgaactcaatctctcggtctggtggcatactcgttaattcttctggaaatacgtcaggatattcactgactatgggcaccgactccaaggaggtgacttgcaaacaggttaggatagaccgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgaattgcccttatattcctcccaggggaatgtactatcattggtacacgcaaattttgggttttccaaccgtttcttttcacaaaagcttgtgatatgaaagaatgggaagctcctgaatcaaatagaactattgcgggtacggagttgacagagaacatacccatcacaacgtctggagcatcctgagcggtttcagcttgaatgtgattcacacgtcctcgaccaaagtggttggaagcacgagaaccttgtccacttgcctgagagctaggacgagactgagctgccgctggagtaggagttctggcggtgctgccattagcatgccctgagttggtgttggcaggattctgaggacactgtctagcatagtgacccatctggttgcaccggaaacactgaactgctgacggtccctgtggtgacttgaaagaggtaacactgtttggcgcagtattgccactaggggcacgctgctgtggcggaggtgccggacggtttatctgaggacgaggggcgtagcctggctggcggttagtttgagtgatcgactggtggtattgcatgggttgaccgtagcgagggcgaggtgcgcctcgggaagaatttccctgatggttagacttgcgtttcttgtattcttcggtagcctcttttctggcatcctcaagcagaagtgccttgttgatcatatgttgaaaagtggggaagtcatgagcaagcaactggagtctcattccaactgcgattcccttcaagaatttcctgatcttcttcttatcggtgtctacttcctcaggggcgtaccgagccaacttgttgaactgacttaggtactcattgacactgttgttgccttgcttaagtctgttgaattcttctttcttcatgtcaatagtgctttcaggcacatgagctgcacggaaagccgtagcaaactcatcccaagcaatgttattgggttcaggatgtgcattgcagtaattttcccaccaatctgcggcaggtcctcttagctggtgagaggcgtagagcgtcttctcaacaggagtacactgcactaagttgagttttctatcaacatctttcaaccaatcgtcagcctcgacgggctcgacggtctgagagaactctggcggacgtgacctcagaaagtctgtcagcttggatctattgttgcccacgtgagggtggccatgcacattatgctgaaaactggctatggctgtggttagtccttgcaagatttgtgtctgaactgccattatgtgttgcatgttgttttccacatgaggtggggaagggaggcgttcttctccagaattgtgactgacagtgcagtgagagaggtgagactgctccatctctgcatcacgggaaactgtgcgatgcgagcggctgctgcggcggggttgctcaacctctgcgttgcgggaaacagtacggtgcgaacggttgctgcggtgagactgctcattagctgattcatgatttgcttctgcttcaactctaccatcttcaaaaccaaagcgggctggtgcacgagctgcacggcgggggcggctagccatctaaactcccagaaaagggcggggtaagagtcagataagcacttaggagggcaaggagcaaagcaaatagcaactcagatagcacacactaggcacaactggatttttcaaatcataaaaacacctgatacaacgggtgtggacaagtcacagagctacgccgagcttgactgtgcgcacaccacctaggagaaccagactaccaaacaacacccacaacaaacacacgcacgcgctacctcgccacgactccaaaagagttggcggcggaacaaaagggcctaacacacggacggctgctgaagactgcctcctctactcctcgtcggcctggctgccccctgtagtcggctcctcagtcgaagaaacgtcgatcggctggcgcgaagggaccggcggaacctgtcgagggccggcagcagcacgggccgctggcggtgggggagctgggtggcggaaacggaacacggtggaagaaccaacaacacgcttccgtgcagtgcggataaagcgtgggccacggcgggaggaagcaactggagtgtgtccgggggtgtaggaagggctaactgggtgtgggtagggggagtacactggtgagtacggcgcacgcgagctgggggagcgcgggccactgggagtgcgagcagagccgcgggagctatgggaggacaggtggctggcgtggcagaggcggcctgagtcccaagagatagtgtcaactgaggtgacaccctcctcggccagacgggcctccaaagtggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagaaggaaggcgtggaagctgccggaaggcggaacctccgagacggtggctgtagtcgtgggccaggcgacgaagcgcattccaggagaggtcctggtacgcgatctggagagtgggcctggccacagtgaagtggtgggggcgaaggccagctccgtgtatacctccacgagggtaaaggtacacagagagctcacagtgagggggaacacggtccacggagtaccccgtgtactcgggacacgagaagccaaggaaacgggcgaggtcacgaagctgggcgacgtggtgaccctcaccaaaaccgtgggaactgaagctggcgttcacttccatctacaattttgaaagagggagaaagatcagtaaccattttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaaatagtcccgaccggaactagcccgtgacgtttcaaattaacctgttaatcgataccagtcctaggaaacagtgctggtatcacagggagacagaatatcacagcaacagaggtctctttattatagagtaggagtacagtcatgttgggctacggacagatcccgagctcacaactgcattacaaaaggaaagcggaagccaggacttggaccaatcatcacaggcgcgacttgggaactaggccgaaaccctaaaactcatcgtagccggcttgctcctggaagaactcctcatcagcaggatccgcttcatcttcttcagcaactgggggggattatttatacagagcaagggtgagtatgggggtactcagcaagccaggggaaataagtgtttaatgcaggcttcaaggagaggctgttgtttttgcaattgattttatttgaactccttttttctaaaaacgactaagtgagtgcttctcaaacgacacggatgagacagtgcgtcttgtccggtcggagtatgtgcaatgtatcagtctttagatttgaaacaagattggcacccggccaacagcttttcaaacggccacccgggccaacaacttttcaaacggccacccgggcctagctgatcccgtcagctgctgatttttcaaacatcgaacccattttctcaacagcaaattcacaagcggtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatggcaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaatccatttagttcacaagcaccgacccaggtgtcgggttttccaagtcttttgtaaaactccagttttacctaggttgttactcagattttaagtttgaaggcgaccgtcgatactcgcacagagtgcacgaatatcgaggcgcaactgggtggttacaaggggacatggtatggcaattaacaatggaaggatcaaatgcaacaagtcaggtaggtccaccaatctgccttgcagatgggacaaaagattaagtgcggtcctatcaatgcataatatttttcaagcaatataattaaatttcaatgataggctcaagatgttcaaaggtggcttgccttgctcgagatctggagcttgatcctcgaaatcctcgcactgcgggtcttcgggctctgaatctacacgcgaaacggaacgactcaacaaacggcgaaaataaagccctattaatgacctctaagcgtgccattagatagatctcgagatttgatgaattttggaagttgaacggagtcaaacggagtcacggttgggaagatattgaatttctaagattattggatttttggtctaaaggaaaaaggatttaattaaatcctttttggaaaagaaaaagaaaagaagggagggagggaatatagacttttctcgggcggctagggtgcggcccaagagatttggggcggctcggccgagcttaacgggccggccggcccaagacggcccaagcgcgcgcgcgcgcgggagggaggagagagagtccggtggaccgggctcaccacgcgtggccccgggtgggacccgcttgtcagcggctcggctcaccgtgcggagggagcacgcggcgcacgtgcgcgggcggggaggaacgcggtgcacgcgcgcggtccgcggcggacgcaggtgcggcgggcccatgcgcagcctcacggcttgcggtggaacgcgcgcacgcggagggaccgaccggggtcggcccgacccggtctgggctgagctggcgccgacgtggcgcctacatggccgccacgcgggccggcgggaggtagacgacgatccggccgcgaatggacggcgggcggcggcggcgagcggcggagcgaaccacggtgatacgggcaaaagcgagcacaccgggcggttacacgagacgaggggagacgaaccaacggctcggatttgccgggggttgctcgacggcggcggattgcggcggtggcaaccggcggcgggagaagagggaaacggcgacgaggccacgagaggtcgattcccggcggtgagagcatctacgcggcttcgggaactcgatgctagcgtcggattgggcggaactacgccgagcgaggccggcgacgagcgggtgatacggagctcgggcggcgacggcggcgagcacgcagcgagcgacggcaacggtcggggcggcgccggctaactacgggaaggctactcaagctactaccgaaagctaggggaaggagatggagcgatgaggaagaacggagagagacatcaccgagaagaggaggggcgctgtgatgagaggccgacggcgcgggagtaatctctccggcctcgggccggggaagaggaaggagagggtgcggccggagtcctcttccgcgtccttgctcgtgccggcagagggaggaggggcgcggctccgtcccttggcggcttgcgcgcggagtggcgggggccgggcgatgacgacggtgatgacgggggggcggcttggagcggggcggcgacaccggcgactggcgcgcgcagaggctgacggcggcggcgaccgggcggtcggccactcggctcgcgcgcgcggcttgcaatgggcggcgtccgcgcgggcgcgcgcacgcgaacacggcgcgcgggaagcggctttgcgagcggggagctcgcgcgaggggagggggcgctcggcgcgggcgactcccgcgcatgcgcgagcagcgtgcgggcgaggctgagcgggggaaaggaaagagcgcgccggggggggagagagagagagagagagagagagagagcgcccgggagagagatgggccgagctggattcggcccatcgaacccgggggaggcaaactagacttttgcggaggaaattgatttggagggatttggattcggaattgaactcgacgattgatcggggattgagatcttgagatggcacggacactagacaacaaacaaagaaacaaatttcgcaattagggtttttaagagataattttcccgctaggcgccacgacggaacgggcgctacaatatatgattataaaaaataataagctgaaaatttgtttttttagataatggaatgaaacatcccggcctttactccaaagagctacagccaattattacaaaaagtaacacacttataaaatcttaattcgagatgaaactatcaaaccaaccaaaattaaaagaaagacctaacatgacaaggaaaacattattccagcctattagaaaatctccatccatggttggcaaaaagttgcataaccgttgactcaagagtacgacatgcaacattcaggaaaactccatcttcctcacacttttgtagttgagcccacaaccgaagccaatatgttgccctgaaaattacttgcatataggaaatagatggtgatttgtcaaaaaccctatcatttctacacaaccacagagcccaacataaagcagaggcaccaacaagtatcaactttctcttgtccttgtccacaccctgaagccaaccattaaacatatgaggtatgcttctaggaaaatgtaatccaaaagaaaattgaacagctctccaaataaactttgcataatgacaatccataaacaaatgctggatcgtctcatttttcatgcaaaaacaacatattaaacccccattccaattccgtcgtgcaagattatcctttgttaagatgactcccttaagcaaataccacataaagatcttgatcttaagcggcatcttaagcttccaaatgaacttatttctatcaatgtaaccattgctaattaaggctaagtacattcactttactgaaaaatgtctattttgatgataattccatctaaagcaatcagcagaatcatccaactggatatgagcaatggaagcacacaaattataccaaagtgttagattatgtccaactaaagctctcctaaaagaaacatttagtggaacagaacccataacactagcaatagaggcactcttccttctaacaatagcatataaagatggatacttgtctttaaaggctatataagctgaaaatttgtaaagcagatcaagtgatcaactgaatgtctgaatcccatcgtttgcccttttggttatccatcgcaatcaaaattaaattttaatttttttttgaatttatttcaagcttttttagttacagtgtttttttcatcgttgacttttaaattatttgaatggtcgttgaccatagtttttttttttaccaacctcgatcattccgaacatgtccctgtgataacgtcggaaacttgtgcgacggatcagcatgcatgagccggtttccgtcgcacttgtgctcacctcatcactggtcgcgtggatcaaggagttcggagttttattctccgaatccctttcaccgcctcatcgaggcctcgccggagcgccgccgcatcgtgcgtctcctggttaggagccctcgtctccggcggatgcgtgcgcacacgaggagcagccaccgccacaccggcgtgagcactgcggcaggatctcgacacagccatgagctgatcgcagcgctcgcaggtgaggtcagaagaatgcatcaggaatatctcatcgtgatctgatcatagcagattaaaacatgtcgatgtcaaagatttttttttgggtgctcgtgtatttcagccccgtggccttgtgttggtgcggtttttcggctcatctaagccgcacaggacggatctaacggccgcgagacatctcaaatcaaatgggttcggagttttgttctccgagccccgtctcgcccccgcgcctcatgcacacctcgccctgggcgcgcacgcagtacgtcccagcggcatgagcaggcaggcagccgcggcgcgagtgatctcgatcgcgtcgtggccgccttcgttggtccaaatgcgacggggaacgtgcgctgcgatccacgccacgacgcacgccgcgccgctcgcgggcgagggatctatgctatgccgggcgtcagtgcaagcgaagcgatcgaaggtcttccggcctaaacaccagcgatgacgagcatgatggcgtcaatgcttgctcgctgcttgatctgggccgcctgtgctgccgtcccatcgtggtcacgtcggaaacttgtgccacggaatgatcgatgatcagcatgagccgggcttccgtcgcgtggatccaaaggtgttcggagttttttgttttttctacgaacccaccttcaaccgcctcatcaaggcctcgtccgagcgccgccgctgcatcgtgcatctcttggttcggaaccctcgtctctggcggacgcgtacgcacacgaggtgtaggatcggacacaagtaaccaagcctattaagggggggtgaatggtagggaaaaccaaatacctaaaaacttttagcggaaataaaagttaccctcaaatcgatggaaatctcgacgtagtcctgtcgccgccgcgggttgaaccgcttgcacgccgccggtcgaaccgcttgcacgccgccggtcgaaccgccgaacccgatgaaacacaaatcaaagaactcttaaagtagatgacaactttattacttctctgtatttacaaagtgcacgaacagcactccttacaaaaatctcgactaaactcgaaaccctaactaaactagcaactcaattgctctcaaaagcgataccgggaagcctcacgctccccctctatttatacataaaaaacctcctactcaaagtaggtgtagaactcctattcacaatagaactcaataactcaatttcctttttctcgaaaactacagccgcgccgcaccgaagtcggactcctcctgccgtcgcagcgaaactccagccgccaaccgagccggactcggtctctgtgttgtgcctcccaggccaactgccaatcggacatgcaagcccacgtgctgacgtgcatagccttccatccaatctcagcacacagccacacatgcatgtactaaacacacgtgtacagcacacagccacacatgcatgatcaacatacatgcatcgataccatccatatgcatgctacagtaccacgtgtactgtagcaccatatacccttttctcgatttctcactccaatctccttcgcgaacaccggcacttgcacgcacacctcgtgaagcccgttgtaaagatctctcccacatggtgtccatccaccgtgtgccatctcatatccaacttcgtcacccggtattcttgaccgtctggacctcaactcctccctgagtttagttccgatccccaccgttgaccgaagttgacctccaagaatccagactctagtcaccttctcacatggtatcccgaccgcactagacctctgctcctccctgagcatagtcccggtcctcaccattgaccaaggctgacctcaagtcacctgcacacaatcagacaaaacaaccgtttctgggcacagatatcacaacctgacccacattagtcacacgcactcacaccaacatccacacatctctcaaaccaattctttgataaaatcatttgcacagccaattgttcatcataaatattaattatgacaatgatttaacacgaggatcgagcaggaaacccaagccggcgtaccgaaagaggcactctagcatggcaatcccgtcagcgagcgatacacgccgcggcgccacgcgcgcgcgcgcgcgacagcccggttcgcgccctgagcgcgcacgcagtacgtcgcagcggcatgatcgccgtggtgcagctcgccgtggcacagcccaaccgcccaaataaaccagacggccagatcgacgaggaacgcacgccgcgacgacggacgaacgccacagtaagcatagtagcaaccaatcaagaattgcagctaactggtagtaacaacattcacatggatgactatatgcgacccaagatttgcctctgctcatttcatccttctcactgccgattagtatattggccgttcctctatttagggaatatacatgattaaaagaagaagctgcaaatggaggaaacaattttgatccctcgagagaatgtcgctcgtttgtttaaagccatccaaacaattactatgaaaaattctaaaaaaaaattgatagcactcatacaatataagtatgagccggtttctgcaatcgcacactgtgctcatctgggccgtggcagatcaatggacgcagtgggttccgagagacgcatcgtgcgttccctgcttcgatcggaaccctcatctccggcgggcgctggtacgcgaggagccacccacgcgcgcggccaccgacacgcgccggcatacaggaagaagcaccaaccctgctggctgctgccgtcatggtgatcctgtcagcgagtgatgtgaacctgattctcgccacgccacgtcaagccgcgcacgcccatgacagccggattcgcgaccatgctcaggcaggctcgcgccatgatcccatgagcacgcagccgcgcaacgtgcaagatcgcacaccctgacaaggaacgctacgacgaaccgccacgcgccgacgacgacgacgcacgccgcggtactggcgtccagaacaacgctcttctcgacccacacaaacgagaacgatggcgtcaatgcctctgcccgtacgttttactcagtaagaacaccacagccatgcctctgcccgtgccaccgtctccatcgtggcctcgccctgcgacggttcaacatgagccggtttcccctcgcattttgtgctcagctcatcactggtggcgtagatccaagggcgttaggagttttgttcgccgaacccctttcaccgcctcatcaaggcctcgccggagcacctccgcgtcgtgcgtctcctggttcagaaaccctcgtctcccgcagacgggcgtacacatgcacacgaggagcacccacgcccacgcagccacggccacaccggcgtacaggaagaaagcacactagcatggcgtacgacagtcgacagccggttcaaccgcacaaatagaccagacggccagacgaggaacgcacgctgcgacgacggacgaatgcaacaatgaactattagtactagcaaccaatcaagaattgcggctaactgcttcttgaacaccagagacaacgagcttaatctgatgccgtcaatgaccgccgcttgatcagctgcgcacaaaagcctgatcgagccccaaggggggttcgtagctagtttaaaacgccgaaccccatgttttccttttttactaggcaagaacgccaccaccggcctctgaccgtgccacgccggtgcacccgagtgctgccgtcgcatctgttaagaattggttggattgccacgtttccaatcaaacccaagccagcacaagaagcatcacatatcagcaggagcagcagaagctagcacttggagacgatcgaacagaagaaagctaacgcaacggacggagaagctatgccgggcgccatcacaaacaaggtccgcgtcacggtcacggtaacaccggtatacaggaagaaagcacactggcacgtgcacgcatgcacgatgcatgatcacgcggcatctcccacataaccatgaactgattactcctatatccgttccaaaaaccctggaaagggacagatcgcaggcatagttattagaccggaccggtgatcaaaccggtaaggcactcgggtcattggtttattgctcggaccggtcaaaccgccggtttaaacgggttcaaatagatgtttgttatattggtttcacaacaagccgcatagactagtggtggaggctctccatggaagcatggaggttttgggttcgaatcacaagttctgcagctttttccgtatttctctccaacttcacgtgatgcgacgcgttccagcggtcgaaccacaccggtttttgtccggttctgcagtaaaccgcccggttcaaccggtttctcgccggtttgattgcagaccgatcttttagctggaccggaccggccggcgccctggttctagttttttctggtcggaccgctggtccagtccagttctaataactatgatcgcaagtcagaatgcatattagaacattaaaaagatctcgtcctgatctgatgataagttcataactgattctggtaagagtttccatattagaacatcaaagatttttggtgcttgtgcgttcactgttcagacgacggggaagggcgatacggagatgaggggtgtagaggaagtggggcaggcggccggacaaggtgaggaaggcggtgacggaggagtttccctgccgtggaacccgccgaagctccatcgccggtagtgccgccttgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2405 - DNA, 664 bp, Oryza sativa
caccaccaggaatcaattaacctgtgcaaggggttagtcaaactcaaacagcttgggcgggtcatgatgagatcatgcatccttggtccatggaaatttggccatgcatgcatgtgcaggcttgtaatattctagacacatgcatgcagggatggtcaatgtttttgatagcatatgcagccgaaatgccgaaattaatactatatactctagctagccgagatgggtttttttatgtgctagtattagtagatccacacaaaatatgcatgtaaatcctaaccagatgctcggctaaccacgcagaaagaaaaaaaaaaaaggtagtaactatattaaaaacatgatcctatgtctgcttgttagccgcaatggacacgacgattaaggtaattaattaattccataattcgatgcatgtacaggacgacgacacactacaggggttcaaccgatgaacaaccaaaccatgcgtacttaagcgtcactggtacggggactacgggttactgatcaaatatcatccctagctagcgctacgattcacatgcacaacttaattaatttttttaggaggttttaccatcggttataatacggagctagctagctaataattaaccttcaaatggactgaagcttgctgctgctgctgtcatctgtt

SEQ ID NO: 2406 - DNA, 694 bp, Oryza sativa
gatatggaagaaaaggaatcaacgaatctttcagcacaaggaggctacatcatctttcctcttcgccaagatcaaggaagaggcgcggacttggacgatggcaggagcaaaacgtttgcgggaccttctgcccctccatatataatatataaagagtacaaagtttttcatttctgatccttaagagttgttttttcttccactatattcaatgaaaagtcatgatctagtgccgttttgcttaaaaaacaacatgattgtagttaatagttattactccataaagtgcactttttttaagtgtaaataagtaaataactgatggatataattggaatatcgtcgaacaacgattggccctttttttcttttcattggcgtttagatcgtttgacgtagcgacgtccggggtcgttgcgccattcgatttgcatcggacggaaaagagggagtacagcgatagaaggggctattgctcggtccgcaacaacaaaaatcaagccacgaagattgtcctgggcccatggaaacaatacgacggtagcattgattccgaggagttcctctacatccattctacaagtgcaaccgtatatatcatgtctaacctgaccgtccgtcttatttaaaaaaattatatacttttattattaaaaaatagtcacacataaagaaccattcatgttttatcatg

SEQ ID NO: 2407 - DNA, 977 bp, Oryza sativa
cccccctcccccaccacccctcgcctccattcctgtttctctatattgcaacctttttatttttgttttatttttttggatgttttttcgcacttaggatacgatacaaccagccacaaaaaaaaattaaacttgaacggaatataccacttagctagatatccgaaaatagcataccacttagcctattttacaccttcatcagaattagaccataacttctttagtaaaacctttgatcagcatgttaaatataatacactctaccactatatgaaattacttaatctctaattcaaaatataaccacatgaaatgatagccataagttaaatagtacagagagatgcagtttttttatttttattttattttttgatatttttttcacacttaggagaatacaggaaccaaccatagaaaaaataaacttaaaacggacaaaatatgtgacttgtaaaattttccaaagctctaccgaaatggacaaaatatgtcatttattaaaataggcgtaactttctcatacagactcggaatcaggcaaataatatatccacggacatctacagaaaaagttacatccaattctccctgctttgccgggttcggcgatattagaacctccaaattccgcttgcaagattgtgttttcgaggagagaagtttttcggtagagctttggaaaatttcacaggccacatatttcgtccgtttgagtttattttttatatggttagttcttgtgagttcctaagtgtgaaaaaaatatcaaaaaataaaataaaaataaaaaagttgcacatctctctcctctgcactagttcggagagagagaggagaggagaggaaaaattctacaggtcacatattacgtccatttgagttcattttttctatggttggttcttgtgtgtctctaagcgtgaaaaaaatatcaaacaaataaaacaaaaataaaaaatttcccggggggg

SEQ ID NO: 2408 - DNA, 437 bp, Oryza sativa
ggcggtggccgcgtacaggagcggcggatccggcatcaaggatcttggctcggcggatcaggcgctagcgagctcggcgatggtgggtgtggtggtaggtgatgaggacatcactagcttagatatggtcatggctaccttaaatatttatcaagcaaaggtacatgctttctatgtaagatttacatgtcatatatttgaacaaacactattatactatgagtcttgcatgtgctcgtttgtagaggaacttgcttgggtgaaggaaaggggagcggacatacggagtgattgaatgatctatgaagttaattggggactaaccaatatccttcccaaagtttatccccatgttaccacgtcacttttagttcatagaagggaatagatgaaattctacatgttttagattcagattcgggcctcctgacagcatc

SEQ ID NO: 2409 - DNA, 516 bp, Oryza sativa
cttactatgtaataggaaaaattgacatgtcagctctgagcatcactgaattttataggtagatgtggagacctcttggattttctcagtgtatagaaagttgtcccaaaacataaccttcttccctatttcctaagtgtgtttgttcgttcgttgggggtgggtgtggggaagcatttttttttttgttttttgagacggagtttcactctgttgcccaggctggagtgcagtggtgcaatcttggctcactgcaacctctgcctcccaggttcaagtgattctcctgcctcagcctccgagtaactgggactacagtcacgtgccaccacacctggctaattttttgtacttttttagtagagacgaggtttcaccgtgttagccaggatggtcttgatctcctgacctcgtgatctgcccgcctcagcctcccaaagggctgggattacagagccaccgcgcctggttgagccttttttttttttttttaaatagtgcttactctttttttca

SEQ ID NO: 2410 - DNA, 187 bp, Oryza sativa
ccaacgctcgcgcaccaccgctcctctccctccctcccatcagccggcgtgcgctgcctcatctcccaccggccgccccgacgagctcgcctcctccctcgcggcgacgacagcgcatggctggcggcgggcgacggcacgcgaggcgcctggggtggcggcagccatatctctcttgcgcacgctc

SEQ ID NO: 2411 - DNA, 680 bp, Oryza sativa
ttgtcttcattagagttcacatgaaaaagttataaattatttttaaatataaagtcttttagaccgtcctatttggtccagatgatatacaaatccaagtttagaaactggtgtgacacaactgaataagttggaggacctaaacgagtgatctgcaagtttagggattgggatgacacagtcgaacaagtttgagatctgaacggtcgatttgcgagtttagagactgggataacacaacggtaaaagtttagggaccggtgatggactttactctaagaagtttttctagaggtttattagtaaaatatttttctaaaaaaaataaaaatcctgatggatcgatctctcacctgacgatcaaccacacgtatcatatccccgccgattcaggaactgaacatgagaacttgggcgtccatgaccatgatgcatgtaatgatgtagtacatgcgacattggggaataacaaaactacaaatgggataacaagatatcccaaaacaaagggaagaacaaaatcctggcaccggaaactcaacgcccagcaagaaatccgggaatgatatcagggcatcaggcaggcaggcatcccgtcccgcgcatcccatgccgggcggtgcacctaatctcttcccgagacaaaggccacgggctcgaccaggcccgatccctttgtt

SEQ ID NO: 2412 - DNA, 165 bp, Oryza sativa
taacattccaaatatgccctaaaaaataataaaattgtattttaccaatcttggagattttaatcttctatagttttcaatataaaaagatttgataactattgatatttatataaaaaaaatatagagcacagtacaaaatcgccctcccccagggcggcaagg

SEQ ID NO: 2413 - DNA, 929 bp, Oryza sativa
ctatgttgaaaaaatattaaaatcaaattcaaaaataagttttaaaattcaaattttggctttggcttctaatgaggcccttgctcttgcacggcacgcacaagtatcagtatgtatagtactagtatcagagcaagtacaataatgagctaatagcctgcttacataagattttaacatacgtggcagagagagaaagagcggagagataaaagcgaacgactatattatcaccggctcaggcgcgagtgcctagaaactttctctgagggcacccacaatggttatctataggctctctacaagagatccatgtcagcatattttcctacttggaatgtattaaatgaagagagagagcaaagctatctactaacttagagatagtctatagagaaaaacgagacaatgcatgagagagctatagatacaaatgtagacatactattaaggtggtttactattaatcgagtctattgctgagatgtacatgttttatagatagcaccttactttaccattgcgggtgctctgacgcagccctgtgcaagggaagagatacctgcgaacagccaatagaaagatagaaccttacgttgggtaaagcaaatgttatagccgattactgtatttagcgtggtttaattagctgttagatgacgtggtaaatttttagcgcttacaggtgactgtactatttaacttactcttagttcgagtgtccgttccatatcactacatttacagtgactggggtttcccagaaggaataagttcactttaggtccctctatttgtcggtcagttcgattttggtcccttgacaacaaatccgggtacgacccgtcccccaacttacgaaaccgggcaaacaaagtccctcgccagtatggaggacggttttggccgatgtggcatttatgtggcgc

SEQ ID NO: 2414 - DNA, 1178 bp, Oryza sativa
tggtaagtatcatccgatatctcgtaagtatcacgcgatacatagcagaaatcgtctgatacctgacatgatacctcgcgagtatcacgcgatacgaggtagaaatcgtctgatacctgacaggtatcacatgaaacctcgcgagtatcacacgatacgtggtagaaatcgcatgattcctgataagtatcacatgatactttgcaagtatcacctgaaacgtgtgtagaatcgtctgatacctgataggtatcacacctgatacctactcgggatcatcccgttcgaaaacgggattccgtcgtatccccttttaaaaaagaactaaaataaaaatatttcccctggatccattctcccgtcagttcgtgatgattgtttcgccacactttaccacacagccagttccattgttccaatatagccattcgtctacagcttgcggttaattttgttgcagtgtaggagtctgacaagcaaccaccgcccgggtcggaggacggcgaatcgggaacccgtacatgttacctgaaagggacatcagaattcagtgcccgtgatgggctgctgctgatggacgcggaatgacaagcacgcatgacatcgaggacgaggtggatgccttgccttcccactcccacagtcccactccctcggccctcgctcgcgtcgttgccgcctgcgcgcgccaaccacccaccgccgatccacccgcatgcgtacgtgcaagcccgcgcgtcggggcccctccaactcgcgcgcccgtatcgtccgtgactccggcccccgaaccggccggtcctaaccttcgtacgccgttgccgctttgcccccgtccttctcttttcggcttcatgatttgtaccagtaaccagtgtaccacacacaccgcaagataaatgacacgagacaaaatgcgaggacgcgcgaaagcacagagacgcacgcacggtgtcaccggactaatctccaatttgatatcgagtagcagtacttgtgtattgccccggagtaacccacatcgcgggtgattacacagcgcgcgtgcgagcgttgcacgtacgcgttacgattacacgcgccatgcccgtggtgaagggtggcggtggcgcggaggcgtcctcggcgcgggcgaccttgccgccggagccaccggctcgcggcgtgaggaggggggc

SEQ ID NO: 2415 - DNA, 2163 bp, Oryza sativa
ctgagctcgcgcagaaggccggagaagctctccggcccgcagcccccgccgccgtcgtggtcgaactccaccacggagtgctcccagaggaaggacgacgacgcggacgtcatggtaagagtgtccgtcgtcgtcgaccccgacgggttcgtcccggcgctcctgcgccgcgtcgccgttgtcgacggcgtccccgccgccgatgccgagacggacacgctcttcgcgtccttgcagccgcagccgagcgtgaaccccgcgccggcgtggcgcttcttggccgaaacgccaggactcatcatgccctgtgatctcgtcactcgctagctaagctgcggatgcaaactgtgcgtgcgttgcaacctcaaaagagacttccggtttctctcgttggctcgcgcgctgcaagcttataaagcaacggagatggcaagcgtgcaccgcaagtgcgtggtcctcccaaattgcacacggttaaaatccaggggaaaaaagggatcaatgccgggattgtctcgttgcacagaacacaacccgggccgtcaaatgattcctcacccaatataaaacaaaaggcagtcaaaacaggctgtcgcatgcacaagattttctcttgttgcaaagctactgatctgtatctgtatgactgtatggttgtataatgtattgtcctgtctgcaaaatgtatactgcttagtacagtgtttacaattaactacgtgttggatagtacagtagcaccattaacttctcgcgatgggctgatggtccattggtccctggctccttgcaactgcaatttcggggtataccgttttggcgtttggcgtagctggtcagctcggggcatcgctgatgcatttccgtttggtgtttgccgtgcacggcagggtgatttccggacgcgcgtcttctgttaggctgttaattgctgtgcatgcattctgctggaattctgccgtcgttttcggaagtttgtaggtagtctctgagatttgataagttaagggcagcgcgaaaatgtggcgtactttcaagtccacgactggccatgatttgacttggtaaatgctctgttctgttgtgcagcagcagagccaataacatggttgagtcgaacggctaataacgtttctttgattatcaactatttttcgaacatcaatggtaattcttagtgaaagttacagtggcggagcctgatctgcgcgggagtttccttcgctgcggtcgtttctgtttgcatgaatgaacacgggcatgtgtagagtaaatggaggagcttcttaagttaggcaacaaaatgtgagaaactagtacagtagtgttccaagtacatgcataatgcgttcccgaaaatgacaaagttaaggatcgcatggtgaggtcgatggcgggcgcgtgtggataattgtacggggccgagagcccgagacagctgggctctgctctgaatgacggtattgatcgtgagagcctaactccacaccccacgggcacacacgattcagttttttggtagagaaaaagaggtagttgattcaatccaaaacagaaaaggaccagagccaacagcttcaacatgggctgtttgagtgtttgggacaaaaagatcgtcacacgtactattattgttttggtggattgaagatacgcacccatgttgtacatttacgtagcaggaagcttccaaggcatatcagctagatcgtaccaagattgctaacaatattcttgagggtccacttggctgttggttgattgaaacgttcatcgttagaagtctaaactagaattggaagggaaagaaaagaatttcgctagtgcaatctgtttcaagctaatcatgcccatcatctcctaagactgaaggaacgctggtttgtatgagtatcacatctcaaactgcatttaattttggaaaaaagtacgaattaccgcccaactatcgcggtcgtccgaattacccccctaaaccataaaaccggacattcttcacccccaactatacaaacaggatgaattaccctctcgatccaatccacggtggttttggtctacgtggcatatacctgcagtccagtcagcattctaattataaaaaaaaagttagacccccctgtcatattcaattccactattcctttttctcactcttcctct

SEQ ID NO: 2416 - DNA, 7315 bp, Oryza sativa
gtgagaattgttttggcttcaaaagttgcgaggaaaaaaagagttacaggacatgacataatccctgcggatttgggttttcccatgcgccgagacaaacaaacaaacgggcgccggtctggtcactggtcaggtggcgcgcgcggtgccgtgggcgaggaggacgctggtgggggagaagacgatgccaccgccgccgccgttgttcgccggggtggcggccgcggaggcttccacaggctttcttgaacggccgcgtccgcggtggacgtgccgctcgcagtacttgtgccccggcaccacgtcgcgcgagcaccgccacttcttgccgtccgtgcgcctgcaccgccctgggtccggctccatgctgctccggtagtcgaagcacaggttccccaaccccatcactgccactcaaatgtcaaaaacggcgtccacattatcgaatgatcggaaagctcgacaccaatcaggccaaacgcaatgagaagaaaaagaaaaatatcttgttggcacgtacgggaagggaagcggtgcgggccgaaggaggaggacgcgacgctcttccagatggggagcacgaggtgcaccggcacgggcgcgcccgcggcgaagtagcggtagatgagcacctggtgctccagctcctgctgctgcatgaacgtcagcgccgtcgccttgtgcgccgccgccgccgacgcttccacgtcacgctcgccgcggctgtcgccgccgagtccaagccccagcccaagacccaccggcggcgggggtgctgccatggtcaccactcctacgaaaacacacacgccagacttatcaacacgacttgcacacaaacacgattacatgttcgctcaaaaaaaaaaaaagaacacgcttacacaaacacataccggcattcgggtcagcgccggagaggcgaggcagcttggacggtggctgcggcgagtcggcttccttctcctcatccattctgacaactcggcttgtaactcctcgctcctcggtttcgaactcaatggaggtaaggtttggggttcttggtgggaagaggaatgaagaaagaagatggggggcagtgagttgtcagaggaagggtgaaggagtgggcatatatttatgcgtgcgacggctccccgtcgtctggtcgcccggtaacttgtgcgcagaggtaataacggaagctgaggggatgtgtgggctgtacattgcttgcggtgggcgcgcgcggaggtgtcgcggcgtcggcccctggcgccgggagatgacacgaatgaaaatactttcgacattttctgggcgttggacggacgggcttgacagcctttttatcgcttctgctcgtttactacttttcgcgttggatggacgcagcaacgtgtttttgtgaaaaacggatgctcggatcacgtgttactatggttgataaaccaacgtgttattactactattgtcgctctctcatcgccaattctataccgggaaaaagtgcaccatgcatttacctatataagttttggtaggccgacctccattgattctaattctgcaatattcccatcttacgaaaagaaaaacagtgtatatagaatgtcgttttgtgctaggttggcaatgggatatgacgagagtgggttggacaagaatggccctgccccaaaggccctaatccttgattccatcttccacaaccaaccgtgctagcttctttaggcagaaacttgatggggcccaaatacctgatcgggccattgcacggtcgttggtgtgcaactgagacacaccaaatggtaagatgcaacggtggaggagatggagatagcagggtgagagctggtgaggtgccacgctagtagaggtggatgtgggcgcatagaagccaatgcatgcgagacacgatggtaaagacgtgaactcgtttatgagcagcaagcggtggaaggtggagcacgaacctcacgcaggacatgatcgcgactcatgacttgtaccgtaggcgacgttgatgccactggagtcacaagcaagaagtcaacggtgggttggtgtaggtagcggggtgacacaaatcgagtggttaaaagaggaattggggggggggggggggttggtggatctggcaacgtaggttgccaaagatggtggacgcttggtggcgtggaggaagcttgacactggagttatagaagaagatatctactcaaccatgcagtccatctagatagtaaagaggaggtggccaaccgtggtgtcgtcaaggctatggtggcgatgacgggcgcatctagatgtctagtgaaagctagaggaattagaacggatagaggggataaggttttggttcatgaatcttggtgagatctcaaccattggaatttgagtgattctttccacaagacgttcatatgacactagacaaccccggtttgtattcgagcctactaaatgggttttcttaagaattatgagttgtttctattggccttatcgttttcgaggcctcatggtaggaatggatccctggccttggttatgcacaatggaacatcccccctcctcgcgcatgtggaacccatggggcaaaatctactccgtcccaagcctcataggggcagagacataccccaatgggatttggccacccttaatatatatgcgtatgcaagtatgcaaggaaaaagaactcgtgatttctaggcctaccaggctagttgatctacaatttgtctagactcatgtcaaaatatgcacatgttaatatatgtatgtgtttggtgggaccgtacgttcctcgtgcactaaaggctagacttccgatctctttttagtttagcttttcctagtatgtttggagtttggatacgcgcgtgtcccctgaaatgtacccttaaatgaatatagcaacccatcttcaatatttttcccaatttagaaataggtgctatttccacagctttcacaagcttgcctcgttttgcttgatgcatttgtttttagatattgaatagttttctttccttgacttgctcacatgactaaagatttgtagtagcgatctcgtccaagcgagcaattagggttcccggtgaccatagcttcttgcaagtaggattgtccaaaaaaggctcgaaggctcccaagcaacacaaagctttgtcggcatcagatttgtgttatagtgatgaagggtgttttggaaaactccttgtaggatcataatcctatattatcatttgaaataaagttttggacaccactgaattctataaaattcctatcaaataccttaatccatacaagttttagaaaaatttaacatgtgatcgaatctcacggagagtttctttgagtatctacctttcctaaaattcttcttttttttatcaaatggtaatttttgtatttttacatgttttacaattctctactttatatttatgttgttgtaaaaaaaagtctactccctccaccccaaaatataacaacttctcccccaaaattctcttttcgaccaatcacaacccttcaccattcaatttttccacctacctccacttctcctccaatcacaacaactccccatttaattctaccaactttcttaataaccgtgtccaactataaaaatgtttatattctggaatgaatggagtaatgtattttatattccatttttgtcaatcctatgtttcaaagaaattttagggcccatttgatttggaggaaaaacataggaattttggatgatttcaatcgtataggaaaaaaaatccattgaatgcatttgaaacaaagaattgaatcctatcttatcatgtgaaattcctatggaatggacaatcctatagagattttggaggaaatttagtaagagctttaacctcttgaaaaattttctgtgaatctatctctcttatccgattcttgtgtttttcctgtgatacaatcaaacggtcaaatcctatgtgtttgcaatcttttgttttgcactttcattcctgtcagaagcctttgttttttctatttctatgttttttcattccgttagtgaaactagtacgtaggctttgtttagttccaaactttttcttcaaactttcaacttttccatcatatcaaaactttcctacacacataaacttccaactttttcatcacattgttccaatttcaacaaaatttccaattttaacgtgaactaaacacacccgtagtactagcatttctttggatggatgtcggatggagtgagaacgttccatggacattgagtgagaaagctcctccttttccgcgcacacgcttcctaaactactaaatggtgtgattttttacaagaattttctataggaaaattgctttaaaaaattatattaatccatttttgcaagttaaaatagttaatacttaattaatcatgcgctaatgacttacctcgttttccttatcttcccaatcttctcgatcttcttctcctcaaactcaccctaagtacggacaaagttatttctctccaaaaacatgaagagaaaactattttacaattgctgtgtgtgagtagtttcaggctttgtttagttcacgttaaaattgaaagtttgattgaaattggaatgatgtgacagaaaaattggaagtttatatgtgtagaaaagttttaatgtgatggaaaagttaaaagtttaaagaaaaagtttgtaactaaaccaggtctgagttaagcccgcttggatctactcgcctgtcacgtgaacattggactcctcctctgacttctgacaacatgtcagccttttgtttcgttccgcgttttctattgcctcggccataccgtgatgaacttcgagagagaacagaagaaacgcacactgacgctaacccgcattacaaatacggactcatttgtaaacaccgatcgttaacagaacagagagaacgaagaagaatgagaaactaccgccacaggcaagtggcaacctgcgcgtgcggcgagccggggaggacgtacggtaaaacccagagaggggctgcaaaggaggctggttacatccggtctccaccaaatttttttcccagcgcaaggccttgcgtgattgcgtgaacgtttttggccacggaagatttcgcggtggggatagctagcgagcgacggaaaagcggaggcgatctgcttcgcttccttcctttttctactaggtcccccctactggcggttgcgcatgcagcttgcagcagcagggttgggctgggctcgccgcgcgctgatctccgatccagagcggggcggggcccgtggatcggcgcgtgctacggatactggagcgagggcatggcgtgccgttgctcccgccgaccgcggccgcgtccaccgtttctgtccgcgtctacgcacgtcagggcgtgattgtgctgctacgcgtacgtattctccgtgctcgcgatcatggtgtcacggacagcgaggctgatcgcggtggggggcgccgtctttggagttgcgttgctgcaggggttaccccacggcccagctgtccaactcgtgtcgctacctgccagagctggcctgcatgccgctaggcgtcgacgtcgtcgcgtgctgttcgggaaggacggggaccgagtcaccgagaacgtggcgtcggaaggtatcctatctccggccggggatagctatgatcatcggagtctgataatctgtccatggcaaatgcttggtgctggagcctggcggcctctcaatctactccaacagcatctactcagaggaccgggaagcagataccctatctcgatagctttgcagcatgcgaaccgttcatacagccacatagaccagtacattaacaatttacagcccggcggctcaatcagtcaagatgtcagtccgcccgaattgtcgtttgccgcgctttgctctgttggccgccggtaggcggtggtagagggagtagagagcgagaagccgagaaccgtcgttccacgagcttcttctgcacaggagcagttggaagatgcgtggccatgcaccgcagtgcccatccgcggcgcggagaggcagccggcagccaaaggcgtagaaggccaacaaggcaacaacccgcccatctactgatctacagcggtctaatttgactgacaaaatcacaaaatatagagtttaaaaaactaaagactgacaaaatacatggactttgttgaaaacactggatcattacaaatgtttacgatccaaaacaaggacttaacagaaaattgataggatagttagggatgtaaatgcattgataacagttcaaaataaagggtctggttgcagaaaataggatcaggcattgataacagtttgaaataaagggtctggttgtagaaaataggatcgctccaatggtaggatagcctaggcatcgggcgccgaaggaggagtggaaaaattggacactgacgcatgcgtgcaaaaccactataaattatttttatcttaaattatttatccaaatcatgatctgattgcaccattacattcgttgcaattaaatctttaaaacaagaccacacatggatatattccaacgaaatttttttagcttattattgaattatttttaaatgttgcataatgttccatcaagtatatcggaattgtttcactaagtagatcgaaaatgtttcagttgtttaaatcagacgttgtttcaccttatataaaaacaatgtttcagcaaatagtgaaagaatgtttcagttcactgcaacatttgatctatacataatggaacattacgagtacactaggtgaaacacttttggtggaaaaaaaatgaaacgaattcccttaatagatggtttccaaaatatgtgggtgatttgttgcaaaagaatgtttcagttcactgtatgtttcagttcactgtaacattaaatctatacatagtgaaacattatgagtacactaggtgaaacatttttagtggaacaaaaaataaaacgaattcccttattagagggtttctaaaatatgtgagtgatttgttgcaaaaaagaatgtttcagttcaactgattgtaaggattctcgcgatggcagcggtctgaaacagggacgtaagtgtaaaatagggctaattagatgggccgcataaaacagagaagtgttgtaggttttatttgggccgtggtgcgctaggcgttctgggctcatccgtattgaatgcttccgcgaattttttttatttataatttttcttattaaaagttttacaaaaacaattttccattttgaaaattgacggaaatagtcgcctacgggctgcagg

SEQ ID NO: 2417 - DNA, 320 bp, Oryza sativa
gctttctgtccattctgtaatgaaatctgacatgttttgatacatattagattggaaatgctcaatgaaaaacggacagcatctgtgcagatgctgaagttggctgagaaggaaagagataacttagaggtgacggtctgagggtgatgaattgattcttctggttgaatgacactactgattgatatattttcctgtagagtgcgaaaaatgaggctgaaacatttatgctgaaggaactcttacttttgaaatggcaagagaaggcgaccacattggcttctgatgatgctacctcacacgttgctccgctgcaagag

SEQ ID NO: 2418 - DNA, 1753 bp, Oryza sativa
  unsure (1)..(1753): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatgagaaatggtgagtctctcataagaggtctttagctcctcatacaagacctccaaagaagcatgatccttctttagagccttgaacttgacaatctccttctcactataagcatggagctcctcaaacatactcacaagctcatcataggaaacatcatcacaatcatcatcactctcactatcactaagagatgttaccttagaggaaccctttgccatgagacaaagtggagcgaagagtgatggagcctccttgatggcaacaacggtcatcttcttcttcttggagcttgcatcatcaccaccttcttcctcggacccggatgaggcggagctctcctcatttgagtcccattccccgatgaatgcctcaatcttcttgcattccttcttgagcttcttcatgagcttgtagcctccactcttcttcttggatgacttgtctccatcatcatccttgaaagggcacttggaaacaaagtgtcccttctcaccacactcaaaacacctcaagttggagagagtcttgttgggtcttctatttctactcctatttgagttggagccccttcctctctcctttctccttcccaagagatcattgaaccttctagcaagaagggcaatctcttcctccaagtcctcattgacttcattcaccttgcccttgctcttatcttcaacttcggcttggagagcaatgcacttcttgaaaggtgatcaatcaagtgccacactagctctacaaatggaagcaatgcacttgactcttggctaattaaccctctaacacactagatggatgaacacaaagctcaagtgggtgtgagagaggtgcaaggggtgtatgcaattgaattgggtgtcaagagagaccccttgctgctggagggagagtatttatactcccaccaaccaaaactagccgttgggggcgaaatcccctaactttgtgctctgccggtctaaccgaaggtatgcggtcggtcagaccgtgctactctgcaacggctagaaaactagccgttgtagtgctgtcagagggcccccatcggctgccggttagacgggcgtggagtgggcggtcagaccgaccttggctcggtcagaccgccatcgcctcggtctgaccgaatacggctccgtcggctctgtatcggccaccccgagtagcaccatcccggcctccagggggacggtctgaccacgcatgtccgccagtcagaccggccttattcgccggtcagaccgccgtcttgcggccggtcagaccggccagggcacgccggtcaaaccgccactatgtggccggtctgaccgcccctgatcaggccgaaaccagtgaaatcccaagtgattgtgtgtgtgatgaaaagcgagcacaagtctaaatgcataatgacctaatgtggcaattaaaatcatctctttgctaggtcattacccctcttaatagtacggcaaaactaaaaaataaactagcaaatttgatcgccctatacc

SEQ ID NO: 2419 - DNA, 6092 bp, Oryza sativa
  unsure (1)..(6092): unsure at all n locations
aggcgttgttttcttttcttttctttttttgataatttgtggttgactgagatgtataattttgtgattcattgtacggatctaagatgtataatctgtgatgtatttgatttgtgtgtaatttttttaggatttgtgatgtatttgatttgtatgtataagtaactttaagatttgtgatgtggatttgggatgttactttgattttgtgatgtggatttgggatgctattttgatttggtgatttggggtttgatttagggatatgcatgccactcgatacgagagaaaattagaaagagaaaaaaggaaaaggggaccatttggactgccgctaccctctctgtagttccggtttttattaccaaccgggactaaagatttagtcccagatttctactcccggttagaaactcggaactaaaggggttaccaaccggagtaaaaaaggtttctccaccggtgttggtacgagtaaaatgtgatttttatcactaaaatacctatattacctttactacctcttggttttattataaccataaataatcctagcctatatatactttactcatcccgagaaaacgatcaatctttttatctctccttgatagttgatacccacaccaaacactaaaacttgctatattcggggatgaagggtgcaataaatttcttttttgtgtttttgattgtcacatagtttgcaaaaggcatttcatgttagtaggggtggatttgctgccagcgatccctagtgaccgcccgagctcggcgacagacgcacaatgggatttgtttttttaatgaattgaaaaatattttcacaccaaatgtttgatatactaatattttactaggcttcttttatttttcatgagatggtacacattttttactagacttcttgtcaagctgttaatagtcaaatcggcagcgacggcttttgtatttaggttttcgatttgcctgatgacatcggtttgctattatgttgaatgaagatgatggttgatatttgttcatttgttctgcatatgctggnangtntggtcaaagcgtcgtggatacgttcgtcgctcgcatatattgtaacattttaagatgtggaggctctttattctattttttataacccttttatatcatacctcgcttagtattaggctcgttccaattgcagctgcaaatcaacagccgaacatgcccatttaatataatctaccttgttcaaggaaaaaaaatccctacaactacgataaaaaatcaaacatcataactcaatatcttataatctaaagctgaccagcgaggacaggtaatggacggtagatattccgacttcacaacaattatttaatatcgcaaacaaataaactaaatataaatataaaagttggaaatgaattaaaagaaatatggatgaagaaagtgttttttttaaacaaaacacgttgtttagcaccttgataagcacatccacgatgatctaactttagaacaaaacgtcccactcaaaaatttcaggccaattttgatgtaccagtaggaagactgtagtaggatagatacgaaactgtaggatattcacggactcaccgataaacaggacgacgcaaacgccttagaaaattttcgccccaaatttttgtttacccggtcgtgtctcacgaacagccgcgagcgcgcggggagccacatattgagaaatgagtaaccaaaaaaaaagctagcgagcgagcaagcgaaggagcgggccgagatcgcgagcgcgacgcgcgtgagagggacgggacgggaggcaagtgggcgggggcacagcacagcggtggtcagtggtaagtggtggtctagtctagtggctggctggcgctctgccgcccgcgcagccacaagcccccccagcgcacgccgtccccttccccgttcccaatctctccgcctcccctccccaaccaaaccaaacgcacggccacaccgccgntgcgccaccacccacacactcccacccaccatcacgccacgcctgcagagccagagactttgagccgccgtgccgacgccgacgcttacgccgagcgcccgcacgctccgctcccatggtctccgccaaccagccgccgcccgacgcggccgcggcagcggcgggctcggctggggaggacgccagcaagaaggtgcggaagccgtacaccatcaccaagtcgcgcgagagctggacggagcaggagcacgacaagttccttgaggccctccagctgtaagcaaaatcgcggaattgccgtgcctttttccttaatttcaccccgtcttttgccacccaactcgatgcgtggttttgctcggaattttgcaatcgtgcggtctttgaggtgaagattgaatgtttttctagctcttgtgatgcgttagttaggttccgatgtttttttgctgtcttgtgtattattgatataaaacagtagcaaaatagcttacttaacttgttttacgtaaaaaaaacaaaacttgtttgtttgttcatttgtttttaaatttggtcttggagtagcatatggagagttttttagtcaggggatcttttaaagatttcttgtctgtactgagatgaagccgtgtttcagaatttcataagctgctgttgtgcacaaggacaataatcagtagtactggtacaacctttgggcaaagaggaaatctaaggatccaatttgcagattatatttttttgactaaaatttgcagattatatgaattgaaataatagcacaaatttacaaactgaggtgctttgtgttcatctagtgatgccatttgtccgggtatagcacccccactggatattttaaggcctcaaagcatttgctctcgtaattagccaaaagtcacaaattcacaactcacaaattagtacagcagtatcctgcagttctctgcttcgtagttttggacttttggtgctataatacttgatatttctttgacctggttgagcacacctgaattattggacattttagtaatcataattactatgaaatgcttccaacgtattggtccccctatttgcatatgattgccaataatgtgttttggcgcaccaaaaacactgcatttgttgctgttgaattcaagtatctgtacaaaaggtttgatattcaattgtaggactgtccttttacatctgatattcatgtgtaataccttgcttcttttcagctttgatcgtgattggaaaaagatagaagcttttgttggatcgaagactgttattcaggtgggcaaattataaatggaaaaggggatatcctctggcaaatgaataaagggaattgtggcatcaaatttcgtcacaaacctagcagaactgaatccctgatttgttgatatatgtcatatatgttgacctataataaacaactaatacacaatgcctttttttgtggtgtaatacacagtgcgttggtgcttgtgtccatgggttcaaatcccttttctccacttctcacaataaaatatttgcagacattgcacacgatcaactctccagtgaaataatttttgtttaccatctcaacttgattttgcagattaggagccatgcacagaagtattttttgaaggttcaaaagaatggaacaagtgagcatgtcccacctccacgaccaaagcgtaaagctgctcatccataccctcaaaaggcctccaaaaatggtagatcctcatatgctcataagttcagcacgcacccaacacatatatctttgatactaacagtacccccctctgcacaaaacatttacttcaatatatattctcatcttgcagagccaggatataccataaaggcagattcatcttccatgcttagagaactcaggcatgaatgccactgtttcgtcatggacacacaattctatcccaccaattgtagcctcatccatggtgaaaggtttgttgtccgtggtacctcttccttataaaaattcaaatgcaatatccatcagttaatccttatcttctttcactcagaagatttaatccttatcttctttcactcaaaagatttaagtgctggagcaatggcccccaacaatttttgctctaacagtactgaaggccctgcgagggcatggcaacctggtgaaactaatgatcagataaatcaagttccgtcactccgccgttagtacctcttaagatttttctttatatagttatctttctgcagtttgagtcatattgcccatttttattgtttctgtggcttctgttttgatcttcctctctgtgcacttgttttgtttcaatctttataacacttggttacttgtttagaataacaattaccaccaacaaattactgattctgcttgaggtgttttagaactgaaaagtagtgttacacgacagcacagtccattcccaggtcctggcaccttacagatattttttttttcatagatttgatcagtaacaatattgaggtttctgtcttcaaccaatgctttatttacatgattcaaaatttcagactggcattgttaacttttaatcttttaatgtagttatgccagattttgcacaagtatacagcttcttgggcagcgttttcgatccaagcacaagtggccatttacagaaactaaaggagatgaatccaattgatgttgagacggtatgtgaatcatggataagctttgttctgctcagttaaagtataattgtacgtgacaagtcaagacaactgaaacataagcataaagaatgttctttgtggtacttcactcaagcaatatgtatgcttttagtcagcattttagattgttttgttatctttgttgaaaccaacaaaaggcatatttaattcataatttccttagcatgcaattttcaaactcgacatttcaactgacgtgtgtccatttttctcccctttaggcattgttgttaatgagaaatctctccatcaatttgactagtcctgattttgaagatcaggtacgcagctctccagcatgcctctagaattcagtttggctgtgtactgccattacttccttcaaaagaaagaaaaatgcctttagaatttggatcatgcttgtgtatggttcactgctgtttgttttacagaaaatgttccatgcaacagaattcaagcattttctgtctgctgcattttccatacttgcctttttctctgtgatattttgttgacttcttgaaacatatgaaaggtaatgttagcaccacattgtgcatgtgctgtagtacgctaacagttattgtttactgtggtttggaggtaactagttctgaaaatcccataaatgcatgtatgatgagtattcgtttctgatttttaacaccttcattttatcaatatcataatttatttctttcatatggataaactaaacatgattttagaagcaagttcatgccttattggacttaggtgtctgtgttcacattctgtgcttctagcagggttgcccatttgccatggtttctggtactgtctgtgcagaatggctggaatgtatgggcagctatcagaaaatgtgtgcaaagtcaccaaattttagcaaacttttgaaactatcagaaatttttggtatgtaccaatatcaaattttctccagtacagcaggtcttaagttctagcccttctcttgtaacacacaattgagatgatgtatataagccataacattatgaagcatgagggcatccaaaataataataataataataataaaaggttgataccatattgaattttcttttcaaaagagttactcaccactgaaaaaaatagctttctttagtatgttggacatgctgtgcatcatagcaatttgaaataggatgtcatttacaaggctacacaattatggcattcagtatgcttccattacccaattagagcatatgtctgttcttctgaaaaaaggaactaacctgtgtcctatgaaatttattatagaagaagttgctatcttcatacagtaccccgtctgatgggcttgagctaggaagcaccagaagctcagttctagctgatagaccattaagtgctccattcatgt

SEQ ID NO: 2420 - DNA, 1513 bp, Oryza sativa
aggtctcttccctggccaaactggctaaaaggtgctgagaagtctctccaccgataatttcagctcgtcagtcattcggagcttggtgaagcactaggaaggcactttgcaacattgtatctctagctaagcttcaagccttcaactgcagaatgtgtaagggtgcaaccgtgtacagtaggcttgcacaggtgagatctgtctatagcggtataatagcctaattgtgtatatatgttagccctgaagcgtgtagttttcctcacccaatacctcggtcgccttggcgcgcaaatctttctctagttaaaaggctgttcttagtaatgggaaatggaaaggaaattttgagtgatgctggattgctggttgctccctttttcctccattgagttcagctggtgatggcattctcgtttctgtcatctggcagagaaggcactactgccccaagtgacccatggcatagccagaaacagaatgctccatcagtccatctgatgagatatgtgtgaagaggtttcagctgagctgattatagtgctgtaaagcggcttagcactatgtaaatcatgtgttatgcaccatgtatcatgtatgatccttggaagttctggatgcaaaagtgagttgtgcacttgccatgtaagttctctatgatgaaaaaggccaagtgtactattgtctatgtatatcatttcagtttttgcataactgcaatcggtaaggagtgaaagcctccggatacctaccgggatttgaatatttgatcatgctagactaccccaatgtgaatgctacattttgtttgggttaagggaattagttatttaaccttgtttggcaactaatctagttagtctagtaatgcgtttggccgtttgcctatcttcataaaaatcgatgagtttgttcatctcacgctgttgactttctctttttttttcggggagtagggttactaatcttggactacaagggtgtgctttaagtaagtttatgataattatttgaggccgtaaagtaaaaagtgtggagtatttcaggaaatgctgatgaataaagttttttaaaaaacaaaaatcgcttagtaagcacgcctatgataatggtgcaccgattgctttttcatcggttgagctacgacttgtaaaagaaaaaataaagcaacaaaaatagtaaaacttttatatatgtattatttgtgaatttaaattcaagacggaaaaaaactgctttaaaaaaccctcacatcaactatataataaaattttagctgttgctgataagttaaaagaaaagtattaaattgtaaaataagtactacattcaccttttcaatatataatatcgttaactttttaatcattcgtcttattaaaaaatttaagtaaatattttttatttgttactaaagggactttaagtattatttatatttctaaattttgtaaaaaaaattaaataaaatgaatggtagttacttcctctgtttcacaatgtaagtcattct

SEQ ID NO: 2421 - DNA, 10852 bp, Oryza sativa
tatctcgcctcgcgacgacgccatggccaccgcctcctcactcttcctcgcctcccccgtcgccaccgcgccgacagcccgcgcccggtccacaccctcggcttcccctgcccggccgtccctgcgcctccggcggccgtcgacgttggccgcggccgcggtccaggccgagcaccagcccgcggtcgccgcggcgccgaagccgccggcactcccgttccgcgtcggccacggcttcgacctccaccgcctcgagccgggcctccccctcatcatcgggggcatcgacatcccccacgaccgcggctgcgacgcccactccgacggtacgggcgcggtggtggtggtggtggtggtggctattgttgctgcttggttctcttctctatgtgcttccgcttccgctccttgactcgttccgtcgctggcctttctttgtgcgcgcaggggacgtgctgctgcactgcgtggtggacgcgattctcggcgcgctcgggctgcctgacatcgggcagatcttcccggactccgacccccgttggaagggcgccgattcgtcggtgttcatgagggaagctgtgagtttctcgagctctggaaccacttttcagttcattgttttaaggcaattcgattttgtttctgcaagcatgttagactatttgtgtgctattaggactgtttagacttttaggagtccatggaatgcttcacctaaacaaatttgctgaataaatttgcagtttcagatattattgaattcttatgtctagttaactagtttgcctacttgaattagagataggaaatcaagtttgaagtctagactccaaacatccaaagtgtctgtactcgcactctcgcaatgcggtgtgttgcattggtcaaaactaacgcaagtcctccccggaaaaggaagaatttccccttaatgttgttgttgtgggtggaggacagacagttcatttttaccattttatttgttgcatctgaaagaatgaaacaccataaacatcggcggctgcttctgtcttgattatgttagctcctgattgcataaggtgcacgtgagtctgactttcaaattaggtcttggactttttgtactctaccagggcaaaaggtattccacgttttagaatttgagcaaggtgcttatcatgtgcttggaatgctgactgcatgtttccccttggacttttggatggaaagtatccccatgctttagaatttcaactcaacatgtgatcatttctctacatgacctcatggaacattgagaactgaaattagcttatttcctctttgattttgcattaaacagcatttggtcctgtcttagtcatcaggcaattgtatagtgtattatccaactggcctgatatttcgtgtgcactttctctttggtgctatatcattaaagtcaaaacatatgctagttgatgcagctttaggtggcttcatctgtctctgatcatagtgcaaatgtgcaatttcaggtgaaactgatgcatgaagctggctatgagctggggaacctagacgctacattgatcttgcagaaacccaaaattagcccattcaaggagacaatacggtctaacttgtgtgacttgctgggggcggatccatccgtcgtcaatctgaaggccaagacgcacgagaaagtcgacagtcttggtgaaaacaggagcatagctgctcacactgtagttcttctgatgcggaaataggaaaatggaagtgtactacatattacaggaattgaattgtaacatagtgaacaaattgtccttatgtaagtggtttatcactgaaattttagggcaaaaacaataaaaccgagtgcaatgtaaaattttatgtgtccagattgtgtcttgactgtttcacaatgaacattagaattttatggcagcaagattttcagcaacaattctggtggcatacgggatcatcattcatcagaagaaataaaagttactgttaaacatagtaaaagttttttacatcccagattacagcacaggtccgaaactgaaaccaaaatgcaaataattataccaagaacacacacaaacaaagttttaacaggaagagcaaaatagtacaacaaagcagcgtcctcacctcagatgccattttgctttcaatttatactgtttgtatgcccaaatcgatatatcgcatgtcactttaagttagtactttcacacattagtaaattactaaattaaaagagagaatcagtgtatatgagtatattgagacatcaactaattacactcactagactcgattgatgtacatcaccagctacatctgccatgtgtttgttcatactgcgcaatactgcatatatttgctcagagtcgccgtgccttgtatctgctgccacaaacttaaaaccttcgacccctcctacatctacaaaactccaccccgcttcctttttcaagccaactctcttcatttcagtcctaatctttgcagagtccttccatctcccaacaacggcatagacatttgacaaggagactctccatatgtcactctccggttccaagattgacaattctatagcagctttttctgcaagatcaatgttcccgtaaagagagcaagcagccagaagaggtccccaaatggatgaattgggatgaacaggcatgtttctgataaattgttctgcctcagcaaacctcccagatcttccaagtagatcaactacagaagcataatgatccatgctaggctcaattctgtagtcgtttttcatgctttgaaagcatctgtagccttctgaaaccaaaccagaatgactgcaagccgatatcagactcacaaatgtgatagcattgggtgaacatgttccatcatcctgcagctcattaaaaatccttagagatgatagcccatctccatgaataccataagcattgatcattgagttccacgaaacaatgtccttaatatccatctgctcaaatatctgctcagagaaatcaattcttcccaacttagcatacatacttatcagggcattgcagattgagacatcatacaaagatccagactttataatgtatccatggagcatctgcccttgctgcagtaatccagcattagaacatgcctgcactacgctcaagacagtgacaaagtcaggcacaagtccatcaccaccatgaagaatactaaaaagctccaaggcttcatccacatgatcactctttgccaggcatgagatcatggtgttccacgaaacaatatccttaatttgcatacctttgaacaccacatatgctgcatcaacttgctcaaatctagcatacatgcccatcagggagttttcgatgctaatgcttggcaaatcattcattttaatcaagtgcgcatggattccctttccatacttcaaggatcctgaaacagtgcagccaaaaagaagcgcagaaagaacatcagaattagggcatacatctcctctcctcaggtacaaatcctcaaaaagacctgtggcctcctcaacaaatccattcttagcatacattatgatgagagaattcaccactgaaacatcattctcgagccccaagcgaacaacaagcgcatgcaatgaactgaacaatcctgactctcccatcaaagagcacgcctgaataacactcaacattgtaacgttgttgggaaggacgttatcctccagcatcatgacgaacactttgagagcttctgctagcatcccattaagcacgcaccctgaaagcagggcagtccaagaaaccacatccctggaatccattccaagaagcagcttttctgcgctcaccacatccccaaccttggcgtacgtattgaccaacgagccaacaacaaacgggtcacagcaaaacccacttgtcacgaggtggccatgcaccatcctccctagcctcgcgaccttggctagcccacaagcctgaaggagagcggccgccgtgaactcgttggggcggaggccaccgtcctcgtcgtcggcatcctgggtcagcatgtccatgtaggcgcggatggcgtccaggggcgcgccgaggcggcagagagcggagacgagggaggcgcaggtggcggcgtcgcggcggggcatttcgtcgagcaggcggagcgcgtcggagaggaggccgcattggaggtaggcgtgcaggagagagttcgacgcggtgagaggctgggtacggtcgagcgcgccggacttgaggagggcagcgtggagcgcggaggtgagcggcgcatcccgccggtcagctgccccgcggaggaggctgacgggggtgggagcggtggtggcgcggcgaggaggaagaggaggcggaggcgacgacggagtggagagggagagcatcggagcttggagtgagactgagagcgagagcggcccagcaaatggattagaagttgaaccgttctataccttgctaatttctttgcatacgtacctacgtgcaccggctacggagaaagcaaagaaatgcaactttgggtgtaccgtgtacaagatacatcagtgcatctgtgggactccgccgtgctgcgtgtgcatctgaacatttcaatagctgattcacttctatttcttgtcgaaagtagtaggagaatacactgacatgtacttcctccgttttacaatgcaagtcattctagcatttcccacattcatattaatacatcaatatgaatgtggaaaatgctagaataacttacattgtgaaatggaaggagtatatgtcaatatctgtaagccaattaatggaaggcaaactatcttaatcgagagctacatagttgccaacgttcccctgtatgataaatgtttgaacgcttacagtacttctcatgtactcacacattccattaacatcccgaacattgaaacgattccatgacaccgtaaggtaacccatggaagagtaaagacttcggtgtttcaggtggatcaactttccgttagttttcctttttgctgtctgcgtcttcaagagcagagagcctttcaacaaggggtggatgggagtagtggtaggctgaataccacggatctgtgttcattgcagataagttctcttcctgaaatttgaaagcaaattccaaattaggctatgcaaatttgcaagcagtttgtgcaggtgaccaagggcaatacgaacaacgagaaccgacagtacgataagagaacgctaatgcggatgttcagttcaagtgaataatgagcgtgaaagtactttgggtaacagaacaagaatcagacagaccttgcggttcaggtgtctagcaattagagtgagaataaatcaaaaggatctttcgatggttacctgtagtttaacaagggctgcacggagctgaggagcatacccaaggttcttggcaaaagcatcagcctagaaattatatcaaggtaagtgcaactgaaagttataaagcagcagtagcagaaactttgaagggaaatagaaaaatgaacctgaaattcaaatgcccgactgacaaggttcagacaaaaactcagaaggtgctggacaggtattatagtgtgctacaatcaagcaacggacatgtcaatcaagttgtaacttgtaatagagcaatactagaaatccaccaaaaaatgcaagccactgcaaacttaaatgaaaaattacaatacctgtagtactattttcacagtacaagcaggtagttgtgctagggaaagactttgtatatctaaggaagaaaatattcttcacaaatatgagtaaacatacctgaaatatgatcagcccaattattacaggctgatcctcgaaaccaaaactttcaaaaaggtctttggagttccttactagcgtatatcctccaaattgtaggaacataaggagctgcataaaaaggagacgaagtgaaaaaactctcaacacacaaaagaagatttatctgttttttttccttctttgtactaaaaagcagcagtactctccagcaacagatgcaaagggactgtatcacagattcaatttcgaaaaagaaccattaatcctacttacatgctaaacactgtttatttgctctggatattgaatagtaactttttctgctaaccttatgccaaggtttgttttgttaaatagtcatccatctaaggaaatggcatgcttagcataacctagtagccactcatcagtcatcacacatcatatccatcatagaagcaggcatgtcaaacacagtacaaaaaaaggggccaggcgggtccaactggaaaaacccaggaccagatcctagtttggttcggtcagaaaaaaagaaagttatggtaaaaataggggaaatagttttttgagtcaaaccaaacttgggtcccatctcacaagtatgttgggcttctagccaaatggattgagctaaatattattctttggcgatattatgcatatttgaaaaaaagtgtattagttgcgggatcagacttaaaatacgtttgaatataatatttttgacaattcaccaattggaccgggtagaccagtaaaaccaagtaccagcagagtgaccagttaagcaccagtcaggattttcatgctatggtcatgcagtatttactttgaacaaacagggaagtcacttttcttaatagtaaattctttaccagaaacaatattgaaattagctaccctgtcctagtgatcaaatgcttgcatttatgcacttttcttatctgtaaccaaaacaatagttctcattcatgcattacatgatacaatgataaagttggggggaggggcacaaaaatgctgcatgtccttttaggagaaccaacgggacatttcggattacatacacattttttatcccagaagtacacaaatactatatcaacaaaatagatgaacaattgttatgcaaagtttatcatggcatcaaagagaatacctggacagctacaaaggaatacacagtgtggttgagtttccagtgcccaagttcatgtgcaataacagaaactatttcatcctcactactacactgaaaccgacaaaaggatccaggtgagtttcatgcatgtaattcaaaattataatgaaactaaacaacttagcatataacctgctgaatcaacgtgtcatagagaacaatgcgcttgttcttgaaaaacccatacatgtaagcctgaaagaaaattgtcagttcaaagcacacagaaaattacaaactatcagttatcaatgaaccacaaccctgaaggtagagtaatcaacatacattactgtggcttgatctggtagacccatccaccacgaaaagctttttcaatggaaaactgagtgaagctgctaatttctctattttctctctgagtactccttctggaagctgttaaaatatgtgcaaccatatctagttatacctcaaaagagcttttgccatccgtacggcttattaataggtcaacgtagttcaataacatgggacacgaattagaagatgcacaatggatgcatgtacctttctcacacaaaaaacagacaagtgaactaattacagcatactaggtatgctctacaacagaaaaagatactaaccggagtgaatttgttgaacagaggtgctatcacgatggggtatattgtcatcatcacaagagataatgcaaacataaaaccccatagatatattgccaggtagggccctccattctgaagcacagagaaataaactaatcagttcacacacttctacgagtttgtggtattcgggcccagatcccgcaaaaaacaggtaagcctgttctccagatactagccaacaatgaagaagtgtgtggtagaaagacaggagatacctgtactatgatgataatagcagccacaataggaggtccaagtaagatggatagcaaaatccctttgatcatgtccctaatgaagagccaaatagtttgctgaaaaaagtccaaagctagaggttcagaataaatatgttggggattagaacatagcaaattcataagccaagatacttttgtacttcactaatcttgcaggtgaacaccattcaaatgttaaaacatataataactgaggtgctaaaattgagaacacaaacataccttgttaaaaccatgtttagcttcaataacaaatgttgaataaagagagaatggtaagtctgtgatctgcattgcatgaagtatgtatcagtgtttcacatcaaatagtggagttggcatgttttagctgatggcttgcaaaagaagttgattcaccataagagaacactatgccaaagttctagtagatgtagacctaaacaatcaatatcagtatgcaactatgaacataggtgtagattaacatgtaaaagtcactggatgtactcaacagaaaagggcaaaaggatgattactcttatccaaggtaataaatagtgtatagcgggttgttagcggattagtgtctgtgtagcggattgcggatagcgggcgctattgcggacgctaagttccaatagcaaatataagaaaataaccataaatatatcaatattaacatcaaattcatacatttttaattactcctatatttcataacataaaaagtatgaaataacatatagatatataagataaataagataaacaatgtaaagttctacaatccataaatgaagaacaacatttaagcgttataatggtccaacaaagtcaatagcgggctgttatagcggtcgcgaagcgctatatttgagataagactcttatctcaaatatcctgatcttgatacatgcaaatttaagaaaatacaggcaacttttgccactatttttcaagttgaaaaatggtccagtcagagaagaactagagtggctgttcatgtctgtcagggccaaaagcagaatagggaaatgcatgtcaatagtttcataggtgtcactatgctatgcgcttcagtcctgactaataataacttttgatgcagtaactaacgacatagacaatccagcaaccaccatttgtgttaaactaaagctagcgattgtcaatcatggaaagctaaggcttcagtttatacgtaactcaatgtgctggaagacaactggaagctaatttaattttgaatgcaatgaaggtaaaaatatatgtgcaataaacatataagatgcttggcaggtacaagtaattattctatacctgtgaccaaatcatgacacctgctaagaatgcaagagtgtgtagtatctcattttcagcatttaggccagcattggttgctagctctccagatttctacaaaagaaggctaatcacaacaaaatacttgcataaagagtttacagaggcaagctgattgattttgttttaccttccaaacccagggaagaactctatagtacagaattgtggtatccattaatatagttacagcttcatggataaaatggaatttgctgtaacatgagcataaatgtcaacacacaaaatccaaaaaattggcagtctgaattactttagaacgattgcagtaaaatgaataatgtaaggttgcaaaaggtgagagcagtattacacataccttttatcaaggctataagctctggagcgctcaaacttttcaccactaattactcctaccaggggttttggcagtgttggcaacttaagggctctatgctgacggatgtcaagatatgtctcaaatatatacatgagaatcataaagcctgcaaaacgaatacaaatttttaaaaaattatttcatcatatacaatatccagtgttgaatgtaaatatataccatgacctgacttcactcgagaggcatgagtcttagctaacatatgcaagtcacagatcctattacaagtaacttcttttcagaatagatattgccatcttaaactcataaatcaccacaaactctacaaatattgcatcctactgcatgatagagagtgttgcaacacaacaaaaatacagaaattcaaccctcatgatcaattaagccaagatgacttcgcagctctatcgcacatctccactctaactacactcaatcacagacggtcttcactgtatttattaagaacaaaagcgtctgtgccatacattttcacttcaccggttcctataatcacatcattgaatgatgggcactcagcaaatcatcaacacaaaagcaaaccagtatactaggaacagctaatcacgaacaacataaaacatggcatcgataccgacattcagcaacttcattgcatcagcgccaaggcccttctcccccagcgccaacgccatcgccaatcgcattaagctccctcgactcaacttagattaatccaccctacccgctaccaccaagccgccacgcccaatcgccaccacagcacgagcaaatcgagccggagattaaaaacccaagcgcccacccaaaaaccctagggtttacgcacggatcccccgttccaaccgaaacccgacgccatccccacacagatcagcgatcaaggcgagcgtaccaccgcaccaaacgagagatgggggaggcgaggaaatcttacacagcacggcctccaggtaaggaagcgccattggagcaggatgggtggcggaggaggcgctccgggaatcgctaggcggcgggagacgggggagaggaggactgggggaggcacgggccgggccggggacagaaggaccagaagagggggagggagggaataacagaggggctgctgagcgtgatgatgcggaaagggtcgggagtggggatactttgctcgattccgttgctcggacctccgagagccggactggggaggaaggtataggaaaaa

SEQ ID NO: 2422 - DNA, 4061 bp, Oryza sativa
  unsure (1)..(4061): unsure at all n locations
ctgcagccccgtggcgagccgccgcctatgcaaggaagccgtcgaggttggagggcggtgcaaaggacagcggagacagggtgcggaggacggcgacagcgaatgtggtgagggacggcggcgcgaagatggaggagacgaggaagaggaagaagtggtgcgcgtcctcctcctcctcctcctcctagaacctatcaccatcgtcatcgccgtccgccatcaccccgttccgcgccgccgacttcgcacgttgctgctccgcccaccattgccccacttcgcctgcctgctctgcctgacgccgccccgctggctttgcgcgtcatcgtcccactcctcctcctcgaacttgtcgctatcgccatcctcatccgccatcaccccgctccgcgccgctggcttcgcgcgttgtcgctccgccaccatcgccccactttgcctgcctactctgtccgctgccgccccgctgacttcgcatgtcatcgtcccactcctcctgcctgctccgctcgcggccacccaacttcgccccacctgtcttctctgcacatacaaaactatattaaggacaaatctcctaacctcacaccaatcccaaaatgcaaaaacaaaacccctaatttatagtgtattaatgcttattaatgcgataggagctataggttttaaaaacacctcgtaaaactgtctatttgacattagggcagccacaataagccaataaaaaggattataaggctgaaaagatttctttggttggctatatatatattatggcaatagaccataaataataaatataaaaagtaaccataagcttatggcccaaacacaagcaataaaataatacagtatacacacactgaaaaatagaaccaaacaagaggagagaagcagtcagtgcttgatacaaattatttttttacgttgcaccagctataaacattgtgaaatgttctagaccattttttcaagcaagtgaatcctagcttaagagcgtgttaatcttatacaaattaagaatgctcttaacttttttttttcaaaattttgactatcagctttctattagatccaaatggtactttctccgtttcacaatgtaagtcattctagcatttcctacattcatattgatgttaatgaatctagctagatatatatgtctagattcattaacattaatacgaatgtgggaaatgctaaaatgacttacattgtgaaacggatggagtactatctaacaaaattattatatcgttaaaataattataatgaaaaaaacactcatataattcttatgccttaaaaggagctattgatggttaaagtttaaaaattttgaatgaataaagtctaacagtgtcatgtttaaatacaaagagaatatttgtttggacttagactaagttataagtcaattgataagtccaagaaagacggatttaacgtggggcttaaaaatccaaatacatatttattatctaaaaaagaccaaacaaacttcttgtagatatttgtaggttgaaacatgggctattccttttcttttgtttaagaccttgttatcttctagttggctttctccaaaattccaggcaatgagaattaccttccattctcaaaaacaaaaacgtgggctattggaccgcacctggagttcaatgggcaagggctcaatgggctgcgagttcatctagcccacgtcgaacaagttcggcactaataggcctatacgtcgaaaccaaagnnttttcccggggcaataagttcactttgggtccctctattgccccatctgattttcttccctgaccacaaaaccactacgacccgtcccccaacttacaaaaaccggacaaacagtctctcacagtttggctgaatggcacctacgggcttgttaactaagtctctgtccacgtggcattacggtgtgcttacgtggcaattcaacccgaaaaataaataaaacttgtgagacccacatgtcagtgtcacccaagaattataaaaaaagtggggcccacgtgggccccacatatcagtttcacgcagtctttagggcacatctggtgggccccacgttggccttcatggacaggcacctcctagttgttaaggacatcgccgcggtgttcttcccggccaccgagcgcgtcctcggcagggccgacgacctcgtcctcctcgtcgagtccttgcccgccaagctcacggcgcgatcgacggcctcgagctctttcgtcgccggcgccgtggggcacccgctggggcacggggcacggcggtggtggcggccgagcacgggggagctccccatcccatccactgtctttcgcttcgcctagctcgccctccgctgctctgcccgcggccgcgctcgcccgccgcccctccgccgccgcgctcgccctccgctgctttgcccactgttgcgcttgcccgccgccgctcctctgccgcgctcgcatattgtgtgttagtggctggttgcaggaagcaggtaaattagctagctaacaacgctaatgtgctaagcaagctaatgaattaaatatgactcatgcatgagtcatgcacgaaatggcatatacacacacacacacatacatgtgagtgtgctcagccatatacacatgcttggctaatatatacgtctgcatgttgttggcggcaaaccaacaagaagctagctagaggctatagctggtcgtctccatgcatgcatatatatgctcgcacgaagacgcatatgcatgcggccgtctgtacccggcgttatagatggccatctgggccgcccggcacggcacggcccaagcccggccgtgcctgggccgaggcttgtcgggccggcacggcccgaccgatgcaccgggccgtgccgtgccagcccacgggcggcatacacggcccaggcacggtccaatactagtcgggccgtgccgggccggcccgaaggcacgatgggctattgtgctgcctcacagaaagagtctatttttgatccctcaactctgtgggctgtgtttaaatggctggaaataagtctatttttgatccctcaactctgtgggttgtgtttaaatggctggaaataagtctatttttggtccctcaactctgtgggttgtgtttaaatggctggaaaataagtctattttgtatacctattttcttgggccatgccttatacgattatataagtctattttttgtccctatattttttttatttgatcgggccgtgccgggccggccccccgtgcccagggtgcagcccaggcacggcccggctgtcgggccgggccggcacgggcacgaccctagtcgggccgggccgtgcttgggccgggccaaaattgcgggcttcgtgccgggccgtgggcctcgggccatatggccatctatacccggcgtatatgcgtatgagctactcctatgggctcggaaggaactcgagaacttggaggtcgtcacgggcgggaacgacggcggcggtggcggtggcggtggcaacaacgtgcatggcgacaaggctcccgttgacggcaaaggagaggcagcgactccggcgaaacgcgccgacgtatcaggtggccaagaatgcggcgtggtccgcgtggaggatgtacagcgggtggagacgccagctggagagatcacgaatgccatgaaggacacggagatcatgaagaataaggaccaggagagaggaggcagcgagagggaagaagaggagaccgttgccatggccggcacggggagcagggaggaagcattgctggttatcttcgatacagcatggcaacaggggaacctccttatctggcgggagcggcgggacggcgggtgcgcttgcactaactcgtggccatggcgggtcagggaggcaggcgacgccgctggtcgctgggctgtggcggcggatggagtcacgtcgtcggtaaccgtcggcgggcgcgggcggcgaagggcggtggaagaaaaggggatagaatgacatgtggggcccacgtgggccctaccttttttataatttctatgtgaaactgaca

SEQ ID NO: 2423 - DNA, 25241 bp, Oryza sativa
agaaggttatttttgggacctaatggccatgcacagtactgctgcttggagatggtatgtggaaatggtttttgaacggtcatggcccctcgttatatttgtgtcggtacaagagaaagatacaaatgtttcaatgcaaacggaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggatgacgcatcatccgatgaggaaggtgatgtaatggccactgattgggcaaatgaggacttctctggtcttgttatatcatagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtggtgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcattttgaccaccaatttggcagaggtgtacaactgggtaatgcgaggagtccgggtacttacattggctgctattggtgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtattgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagacatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaacttttctttgttttatacttatgtttgaagtttgctctatacaggttgcgtgcggcaggccttctaccactttgtaggcttgttgaggcggcgggggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtacataagttgttattatcatacgtgcttatttgcgaccggatcagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgatgtggggttagtgcaacttcgctgcgttataagtttatcagtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatgatccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttctatagttttcaatataaaaagatttgataactattgatatttatataaaaaaaatatagagcacagtacaaaatcgccctcccccagggcggcaagggggccgcctgcaaaattccatgcccccttgccgcccatttgcaggcgggcccccgcacagtgcaaaatcgcccttgcggagggcggcaagggggccgcctgcaaatttcgttgacggccgtcgcccgagagcgaacggccgtctgccacgtcattttcgccgcccttgggagggcgatttttaaaaatcgccctcccagagggcggtaggcgactatttccgtcaattttcaaaatggaaaattatttttgtaaaacttttaataaaaaaaattataaataaaaaaaattctgcttccgccaggagcgagcaacagcaaccgagtcgccgacattgagctggtatgatctacaaaatcattttgattcctctaaacaaatactccctccatttttaaatatttgacaccgttgactttttagcatatatttaaccgttcgtcttattcaatatttttttaaaatatgtaaaactgtatgtatatatagaagtatatttaacgatgaatcaaatgataggaaaataattaataattacttaaattttttgaataagacaaacggttacatattttaaaaagtcaactgcgtcaaatatttagaaatagatggagtatgtatttccacggagtagttgatgaggtatacattttcttctctgatgaattattggcttgatttatgctattcatgatggttttccctctcccggtccccggcacaaaatctaacgatggaaagaaattaagaaatcaaagctaatatgctataccttgtgacaattcaccctccttcaaaaacaaaattggaaattcagatgtcttagtcctgctcttttcttcaacaagagttggacgaaaattaagatttttgtgacacgcttttcaaacttctaaacggtgcgtttcatacggaaactttctatatgaaagttgctctaagatatcatattaatttaattttcaagtttgtagtaattaaaactcaatcaatcatatgttaataccagctcgttttgcgtaaaaaaacttaatcttcatctttgagaaaataacatcacctaagtcgatactatcaaatatcaatatattagctgagaattcaatgtattacattacatgttacatgaaggaaagtccaaagccatttcctattgaacaacacgcagtgcaactgactgtattccaattgtaagatacaaacagaggaatctccacccttacccatttcccacggtattcatacgatccagaagacatacaaaagttgaactatatggcaccttgccttgttctatgtaatcaatatgacgggacggggtatgacttcctatgagaaacctatctgcttcaaaaacaatgcacacacagggaaagagtcatcatgcatgcttattgattgtcaccagggagagaaatgtcaatttatatggaataaataacaacaacattgtgtgcagaccgttccatttgtcaagccttggacgtcttctgatttggcttgaaaacataccttaccagagaatccttgattgacaaaagttctggaaattccgccttcagcttggtacaatcaagctcattattgcttctcggtgcaactatgaccttggcttgctcctccagggtaaagttcttccaagaaaaattcggatcaatgtaatccctatacatttccaatatttcattgtggctcaccacgccaggattagtgaaattccagatcccagtgaggtttctctttgccatttcgattgagataggaagaagctcatccaatattgtcattgaatttggtatatcaaccactttatcataccgggcgattttagtgatgaagttgcgaggattggatagatcggatgaaataggcatccttacacgaagtgtacatacattctcgtagttttttagcagttcctcaacctgttaaaaacaatgctaagattaactgtgaaatacaagtcaggaaaaataatctgatttaaaaatagaaactatcatgaacatacaggacaacaagatagcatggtaacacaacaaactactctaaccaaattcagacaagtgattctgctagtgagaggatctctctctgtgagactagacaccattttgttcgataaataaacaactgtttgcaaagattcaagatcatggcatataggggattcaaaataactcaaaaaacatacttgtgaaagtaaacgcatatttggtgcttctcatctaactcaaccacctataggttgaaacttcgaaacaaattgtggaaaacaaataatgtggctatgaacaataaacttgacacttaattggaactcgcaaagtattcttttctctagtattacaaaatttcatccaattgcgctacatattcagcatattcatttcatatcggtatgttttcaacctacagaagttaatgatttattttttttctacccagaacatccagcagaaaacctaccaagtgtcagaacacaatagttttggtcacactatacttacaatgcatgtcaggagtttatttctttaaaactaatgcatgcactccaagaaacaatgatctgataatgccagcaaggaaacaatcctaaaacaagatgaaatgcctctgtaaccttggcagcaatcacatacatgaagggtaaaacatatacaattctagtaaagtatatggtagcacattttaagtcgttaattagctaaacctatagaaactccagattcaaatagcacaactttctgtcaaagtaaaggctaagcctatagctagcataaagttaacactcccagaacttcaagatgttgacaggatttctagtgtcaatcttagctatttgattcaaggaaacttgctaccctttatttattaaaattggccaagatcatggagaatgttacacaaaatcaaagcatgatactatgaaaagtttaaaacttagaactagtgtgcaaatgtgcatggaccaataacagatcagaatgctcgacagaccaaaatgaatactgtgttttgattccagaaggcagaaggaaacatgttcctgcaagctttactcaatagtctgccatcattacaactaggagtaagtcaacccaagctgtcaacattgtcaaccataaggatctgcatcagcacgctgaccaagatattggggatattgtacagaccgccatgcaaagtcatgggcatgcagttccatcctatccactatccgttctcatctgacggtgcacactcgttgccccaattcctttcttctccttgctcgcttcactcggtagtttcttggcccgccgcggctgccatcatcggctcaaaaactccttccatcttgtaatcggcgatacaaaacacagaaatggactaaccgttggcaaatcttccggcctcgcacctcatcccggtatctaccttcttggcatccgaatccagaggtgcagccgtgtgcacagagatgattcatctcgacgaagagatggccggaacatttgattatggttgagtaccagtgagagtccattagttggaagaaaatgctcgtattgcagaaggtgatgttcacattcagtgctttgggtagaggtcatgcaaagggagaagcttttaccggatctagcaaccacctatcaccattttaattgttacaacgacaatctgactaaaatagcctacagctttccagcagctgaaattgcgatctggttaggagtgacggacatggcgaccggccttgaaggtgcagactctgaaggggtgagaatggatggtggattgagcagaagaaaggaattgagaaaacaagtggtgtgcaccgtctgatgagaatggatggtggattgagcagaactgcacgcctgtgactttgctaatcacagtcaggggatccgcttcctgtacagaccacgccagatctaatcaaacgagaactaatcaatactagtactggcatgaaactaactaatcatacgtccctcaaggcctcaaccaaagtgtcacctttcactccatgatcacacaaaaccatagttccaactttccaacgtgcaattacacatcgtcatcgtaaactaagcaaaatggagccggccggttagcttgctcagatgtgcacatagtccattcattgtggataagaaaatatatggccgtatatatccggttggatgtgtggccaggtaaaagaaacccttctcttaaaaaaaagaaagaaaagataggtgtcataccatggccttggttttggagtagaatgatccgacgaagttgggcgtgtcctcctccttgaacccgatccctgtgccgagctggtggccggcgtcgtactcgaagatgcagcccgtggcgtagttgatgagcacgaggccgcgggcgcggcagacgtcggcgagcgtaagcgtgccgcagacgttggcgcggatggtctcggtgcggtgggtctcgcaccagtcgacgttggggcggccggtgacccccgcggcattgaacacgtgggtgggcgcgacctcgtcgatgtcggtctcgagctgggcgcggttctcgaggcgcccggcgccgtaggcgaaggggatgccccgcgcggcgcagagctggccgagcaggcccccgatccacccggtccggccgtagatgaggaacttgtacgcctgcgactgcgcggtctccgccgactccgaggtggaggaggaggagccgttggtggcgacgcccatgcccgacgacgcggcgcggaaaagggtggcgcggcgcggcgcggcgagatccggatgggaggtgggaggccaggaggggagagtggaaaatggagcctgtctgggagggaggagaggtgaggtggagaagggggatggattttaatagctaccgaggtgagctgatgctgtcaccgatgtgcgcgcgggtggcggggcggcgtgtgctgcaccgacggtgacgctgcagcggtgtggtgcggccctgcagcacctggcgtgatccaccatgatccatcgccgattcgtctgtgcatccgcgtcgcgattttgcgagagaaatgccatccaccgacaggcgcaagcgcaagacataccactacgtactgacatactgtgcgcgcgagctactagactgcacgtctgtaccagtatagaaaagtctggctcccacagcgtggagtcgtgaacggtgcgtttttattttagagggcggaatttgcgaggggtggtagccggcgggatgatcgggggaagcgagcatgcagcaggggccatgtgatttggtggttggggaggagcgttgagacgaggcctccacgcctctggcgacgcgcacgcgctgctgctagcgcgctagcgacaaccgggcgcggtagatccaccgatcccaccacacataccgcgagtccgcgacaagtaataagttgcatcgcggtctcctgatctatccgatctcttccctttggttctcaaggaaaacgaacccttgtaaattcttacttttcgtaccaccttgtgtaatttttttttagataacgaccaccttgtgtaattctttttttagataatgaccaccttgtgtaatttcgtggccacttcattgttctttgaatatcacggtcactcgctactgctatctttctcagcaacttgctggtattagctttaggattttgctaatggaggtgatttcttttttaataatggattaagaatccggtctctacacaatgtacacaaccaaaaaacgaaactgaataaccgatgctctgttcgtcttttctttttaaggtaaagagagaactttattaatgtgtgaataagggattacattcttggttcattaagtctaggattcttgtgggagtacacagccttcactccgcatgcacaagatcattaccatttgggctaaaacatgtgctaccatatttgcttctctctttatcttatgcacttgcacttgttgaaaacactgcattattcctttaatctcttcaatcgtcatcgccaagccgatttcaaggaacctgctgttttaagtctttggctatttctacattatccatctccatcacaattggaatgtggatcagttcaaccgtcgctcgaagtcattcagcctgggcagcagagccatagtgatgcaaggctttgtggtcggcaagtagcaccaagcccctccagtccttgaagataaacccgacacttgcatccccagtttctttccctatagccagcatcaacattcagttttcattctggtggagcacaccatttctctacctgtctgtcaatacttgtagagagaatttctggtttggttctatacacaaagggcccttccctttgtggtcatcttccctttgtcagattggcaatagttgacttcatagcttactaggaagctaaccgagtcaactattgatgcatttcctttaccatggatcacaacatttcgcaggtgctaggctcttcaaagtaaatacagaacatgtgccttcaccaatctgttcaaactatccagcatcactagcaaccaatcaggccctgtccatttgaaactcctttcttccggcaatacccagtgtgctctcattgtctcctgtaaacctctagccacagtacactccaccgtagcatggacaccatttgcttctgtcagaccatagatcgggcaaatgccactctgttatatcttttgttttctcttgtttccccaagtgagcagtctgtcttgggctagcttccaggcgaaaattcacacttttcgttggacatttgtttgtcatatattcttctagatcttcgtctctccatctgttgccgagctagatgaatattcaatgcatatctttccggctagattctacgctaacttgtaagcactcctgacagtgaatattcctatcttctcaaggtgccatgctgggaaatcaggcatctccctttcgggtattttgatcttttaggatttcagatgcatcattttccttgactacatgtctaattcaaggttcattccatgttttggtgtcaggattcatgagcttgtgtacatatataagacgattccaggtcttcttctgcaagatctttggtttttccccatgtgcaatccattggctcctccagattttggtttggcgcccatctcctactctccatatcaaacccttgttcagcaattctagcccatattcaataccttttcaggttggcgatgcatcagaagagtaagtaccgtaagttgtatcagttaatgatccatttggataatatttctccttcagtacccgagcacacaagttttctggagtatcgatcaatctccatgtctgctaagtaagtagggcttgattaaaacatctaatatctcgaaaacctagtcctccgaataacttgggactcgttaacttttcctagccaatccaatgctctgttcgtctgtttgaagtactggaagttgcacttcggggatccgatgataataggaagcaagcagataaaaagatcaactcaaaatttttgccgggtcggcgaaagaatgccgaccaaatttcattaagattgggagtaaaatacatgtatcccgacattaaattgtcgagtcaaggcaaaagccttgaaacaaagtgagaaaaagaaaaggggagaactatttacagaagcagcaactcaaaggtctactcctcactaaactgaaaaataccggcagctctccagaccatcacatcttctttaatgtctgcaacgagcgactccacagctttctccttttgatcgaaggctcgagcattctgttctttccaaatccgctagcaaaccaacatgaagaaggagtcaaaagcatctctgtagctgggctgacaacagctgcgcgcacgctgccaccaaaccgccagttcttctccactttggccaggcagatcaaagccaatacccagccaagttctcaaaagtgaccaaaccctgttggtgtaggtgcaactggtgaaaaggtgtttgcaatcttcaggtgccgacaagcaaagaagaccgtccggaatattccggcccccccttttggctaaattaatccgcagccaaccttttgcctttggttgccacccaaagaaaaaatctgactctcgccggcgctttggtcttccaaattgcttccccaaaagggcacttagttgaggtaagaaagaagagatcataggctgaggacacagagaaaactccattagcagcaaacctccaaaccaccgaatctctcacaccctcctggacagccactgattgaagttcatcccaaagagaaaggtattcagccagagctctgctggaaagagaaccctgaaggtccctgaagatcaactcaaaattaaaaccaaaaagaaagaaaagcaagacggtacctgcaccggcattaataaagacagcgaaaccgtgtacaaagatgacagactacctacacatcttataaaggcttaaaaacaaaccttacatgcaaagagtaactgatttcagagtgattggaggcttcaatctgacaatatgtagagcatgttcagacattatgacgctaccattaccacacaaaatacgtaacgagtacagcacatgaatacagaatacttgcttgtacagtacatcggcgttggcttgattgaacccgttacaataaaaaaaaaagaagggaagtatcaaatagtttgagtgaaaattgtcagttcaaatcaaggttctcacacgtcagtacaaactgacggttcgttgtttgaccgtttaagatcgaccccaatcaccctgatcgccagtgtccagtgaccgttaattttgcagataagtactcgcttagtgtggcatatcaagcactcagtttatgcataatggcaaactaggttataattaaggtttggaatgcactcgttactccaggacatggaaccatgaaagtatcacggcatatcataattctagaacaaaaaagtttctggcgtcagtaaatttagtgacaaacaccacatcattctttataggtagcatagcattcacaatcgtgcaaattagttaataatgtaatttcaacgattacaattagcatttccgatctataggatgatcactaaagataatccagagagaaattagcaaatgcagcgcgctcgtgtatcatgcagagaagcagactatggttctattcctgatccttcagctatcatcctctccttttggatcttgactcccatgtacctgtcagatttttgcagacacgaaggatacatcaggttgaccactgaactatgcaaagaacattcctggcacgaaatcaaccaatgaacagttgaacacagagagataggagtatacctgccaagcatcatgacggtggcctgcgggttagtccccggcgaggcgttgaacgtggaaccatcgatgacgcgcagcgcctcgatgccgagcacacggtagtcgcggtcgacgaccctgccgacctggcagccgccgtggtagtgccagatggtcatgacggtgtcccggcagaactgctccagcgccctggggtcgctgccgccgcgcatgcgcatcaggttcgccgggaactcggccgtgacgttgatcgtcgccgggaaggcgaagttcgggtacgcgaaccgcgagaaggccctggaccggatgacccgctcgatggtcgcgatgcccgcggcgcagcggcggaggtcgtcggggtggctgaagtagttgaagctgacggtggggttgtcgtcggggtccaggttgcggagcgcgaggcggccggtggactgcgggccgagcaccttctccaggatgaagccgccgcggagcgccgcgtcggggacctggctcatggcctccacggcgcgcgcgatggcctcgggcgtgcgctgcttcggtggcaccgtcgcgagctggcccgtctgcggcgagaacatgccgaagctccgcacctgcgcggcggcggcgcccgaggtgcggctgttccagtcggacccgcttgcgccctcgatgtagctgccgaacctggtgatgccgaccacctggatgagcgacagctccaccggcgacggcgacggcacgtagatggcgttcatggggttgtcggacatgccctgcccgacgcctgggtggtcgaggacgaggctgatgccaaactcctcgaggtggtcggcggggccgacgccgctgagcatcagcagctgcgggctgcccagcgcccccgctgacaggatgatctcgtttctagcgccatggttgaggtacgccatgtgcgatccaccccgctcgtcgtggtacagcacgccacgcgccacgggcttggtccctgcaaatctcgcgcgttttcagtgcgcgcgaactactatggcagtacagcgcagcggcaccaagtgcgtgccagtgccacaacaattacttgccgtctgataattaacaaacttaccggtaagttggtaacacgagcttttgaacaagaaaaatgtggtttttctaaattatgcgtgacatggcctcacctttgcgagagaacacgatcctggccactctagcacggagaaacacgtcgatgccgtcggggcgcgagtaaccagcaagtccgccgccgtgtgccgccgtccctgcgcgtcaaagatggagccaccgaccttggtaccgaggatgtggtcgtacgtgaagccgttgtccggcacgacgccgatctcgagcaaccccctccgcagcgccgcctgccacgggcccagctccggctggaacgccaccacgtcctccacccactggtacgcgctcaccacctccttggggtcccacccgagggccctcacgtagccgggccccgcgcgcgtgaagaagccggcgttgatgcagctgccgccgcccagcacccgcggccgcgcgttgatcacgccgtcctccgacacgaaccgctgcgacggggacgccccggacgtgtccgcgagcacgtccgcgaagtgcgccatgttgaggacgcgcgcgtcgtcgtacggcgagcccccgcgctcgagcaggagcacgcggtaccgctccgacagcgtcgccgccagcgggcaccccgccgtgcccccgcctatgatgatgtagtcgtagtacgccatcaccggcgcctccaccgcctccctcatgaacgtgtagttcacacctcgcactgtcacacacacacacaccatgattacaagaatcagtaaaaatcagacggaccaagaaatcaaaaaacaagactgatcaccttgttgagagaagcacagcagtagctgcccaaacagaaacagggtcgtggcaacgaggaatgccatcgtctgcgtctgtgctgacgagatcaggaatgtgcgtcgtgtttgatgtgtttggcgtacaggatcaggtgtgcttatatactggcgagagatgaatggtttgctaaagaaaccgttgttgcatgggccgttagtctggtttggtacggtttggtgcaagtggaaccggcctccggccttcatgctccgcagcctttgtgtcagctcaagtgttcgacagattcggatatgttaatcacctctgctccgtgcttgtctgcttattttgtaggcgaatgagaggagatgtgggaaacgtaagattgaaatacgccatcctcggtttatggcgtaattatccagagcgtatctgttgtcagaatgcatttctgaagatgatatgtcgtagcatcataaaacaacaaactacaggcacatgtcagattaaaaactgttctttctcgattacacacacatacaccacaaaccacaagcgcacactacgtgcaacatataccgttttagtcagatatatatgaacacaggtgtttgttggagtattatcatagaacagtataatgtctgaattctgatcactggcgaccatgtagacaattttcagcaccagatgcatgctctaataattcgctccgcagaagtatttctctactatagtctatgcacacttgactgagtcgtcctatgttgagcatgccatgagtgtgacgaaagaaaggactcagaattaagaaaccaaaacggcaaaaaccaccggtgatcacctcacttcactctgatccgcaccaattaacctttgcttggccgctgagcctacattttttttatgctcttgccgttgccctggaactcgctggtccggtgcaagcaggattgtccaagaggcttttggagcatttgatcagtagagtttattgaacatgctcttacatcatctgttaacttagtaactgctactacaaacataacctaatcttccacagatgacaattagagaccagcattagctgcatcggcctaacattttacaggccacccaagtggccaggaactgtgtcaactgcttcttgtacatacagacggagagaacagattctcagtacagggagttataggtgcaaaatgtcgcgacgatggaagctacgcagatcacgaaggacggaagcagggttacattcaggaggctgttctggccaaggtaacccgccgccgtgatcgtcatgtccgccgcgacgcgagccaaagtgccggcttccgtcgagaggagcccgccgttgtaggttccgcgcgagagcctcgacgacatcacccgggaaaggagggacaggttcactcctgcatcgttttgttcacagggtcagaagtgaaatggtggtttcagaaaattcagacacgcctcacttctgtttcagtctcttgtttactgtcacttaccttcgagcacctcagcgaagacgaacgtgatgagagccgaggagacgtattgcgggacggagtagtgagaggtgaaacggaagctcatggctatgccgatcaggaccatgatttccgatgccactaaaatttgcctaaagaaaacaaaagagaaacgagtggaaattaaacactgaggattatagtggaaaaggaaacaaaacttaatgtgctagtgctagtatgtatgcttacctgtcttggaacaagttggtgacatagctcccaacgatgacatttacaggaagaactgtcaacccaagaactgctagaaacatggccacggtgcttgtagaccagttgaagtagaacgtagtgaccacgctcgactcggacagtagaatttccattgcaaacttgagcataaagtagatcaatagctgaactttcacagatggtgtcagcaatctgtatgctgcagcaagtgatgttgctggtttatgtgagtcttcagggtcttcttcattttcgtcattatcctctccattttcatccagactctcctttgcatctatgagaaaaggctgtgctagaccatcttccaaattactatttcttcgatggcctgctatgcaaagcaaattacttaattactattttcagagcatttaccatcatgtccttggcataacttctcaaactatgttttaaactatgcaacggagaaattttacctgaatcagatgacggtgtgttgactgaattctctctaacaatgtggtctggctctttaaatgaaatccacaaccaaaataagtacgtaatccaagccaagcacatgatccacccgggcaacgtgttctgatcaaatgtaaaaccgtagatcttaaaatttgtctgcagcaaaccggcaagagcaggaccacaggccattccaagagcactagcactaacaaatcctgcagatgcctgcagcctggttttgagaggcacacagtcgctgatgtacctgcggttcactgctctggcagaacccaacctacacaacatatatcagtgtgatcactagaacagctttatattgcaatgattaaacgagcacaacaaacattacaaagtttcaggaagctaacaaaaaaaaagcataagtactagatcaaaaagaacaagacattccatacccgcagagcagccggccaactataagaacagttaaggaattcacatcatatgccaaagcatacagcaggttacccaaaaacagcataatgctgctgaacacgaggggcctgaaatatgacttatttgaccaggcactgaagtaaactgaagagaacacttgagcaacagccatcgatccgatgatcacgccgcaaacggtagctgctgctccgaggctgactgagtagtcatctgcagtcggcacgatgatgtatgtgttcaccatgtaaagaaatgtgttagctaggttcagaagcagcgacatgaaatggtagctctggtcatcgacaagatcttctgagccactatgcatatcttctggaatgataagtgcatgttgccctatgaattgcagtaagtttgttgcgtgtgtgagtttctgcaccgaatgatttatttggtctatgatagggtcctgaggcatcagaaggaaagttagttcactccattttacagcataaatgtctgatcttgtcatgtgaacatttaacaagaaatggagtacctttaaggtaattgatggatgatcatagatggatggaaagtttccttgatgatcttggagaaatgcaaggttgcgcgacaaagcaccaactacagccacaataccctgcacccataaactgcatcataagtacatgaggtgtcaagtgcaaagttataaggaacaatataacctcacagcgcaaattatgttttcgaagatgcaagaaagagaatttaccacttgcttgaagatctgctgaagctgggaacagggatggtttgcacgagtggagacgtaatagtccgtgaatttgtagccaaaacgcttatcgaatttcttgagtatttttcggatgccggtagcattcatatcaacaaatctaagagcttcataagatcaattccaacctccctatatgcctctctagctcagaaatttgggatgcatctgcttgttccatgagcaatgcacgctcttctcccaatttctcgattctgctagcaagatggccttgttgttgcagaagaaagagcacaatcttctcaatctacacaaaagaaacttgatgttaagtggtaaaacaagaacgacattttttatcaacaactcaggtcttttctttctttcatattttgaaggaaattcagtctgttttacctgatcatcaagcatccttgagaactctttaagaacctgttcacgatttcttccaccattctgcgtctgctgaacatactgttttacctttttcttcatcattttgtaattgatgtagtacctacaatagcaaaaataaataattagtaacaatatttagaagatcagaagtatggcttctgtacaggattcagtctcctttcactacctgtttccgtatattacaattcacaaatttcattcataacttcaaggaaaaggaaagggtgggcaatcaagcaacatccacattatgctcttttttttctttcaaaaagacatatacatctaatttatgcatatcaatcggtgtaagtgggccaacccgcaagcccacttataggccaaataagtgggttcgcgggtcgacccacttataccctattcagatcagtgcatccacatggcaaaatgttaaggaactttcagagttcaaaatcaacatactctttccactcctccaattggtccgccatcagtctcttcccgaaattaaccatcttggcgttttactgagggaacctgaaactgcaatggaacaattagcatgccgctagaaacgaatcgatcaagtctagtggtatagcatttacagttcaattcagaacgacaaccagtactgtttgttcagagttcaggaaatacaacttttctgttgaagcaaaacatgaagaaagcgacatagtgatgatctaaatctttcagcaaatgacctagaagcttaatgtactatacatatggttagtgccaaagtacagatcaagcctcaacatgaataaaggcataaaatctcatggtccaacatgtcagtgacagagagtacatggaaaaggacagaactttaacacaagaaccacaaagataatgttaacatgtctgcaaaagcttaaaatattcgcgacagatccagaacgacaggacacttagcaaggtgacacagaatcatctagtcacactttcagataaatctctggcctccttttagcgatgcccaactccaggatgcagaacaacatagattagatggctcaatggtgttccaagagccaagtaagcatctttcgacactatggtttgttacgtcccttgttcccacgcttccctagcaaagaaatactcaagtgcagctgcaggctgcagctagcactgtactttgaaactttttttgaaagaagacagtactaggaaaccattttaatggcacgaatccaattagcccttctcgacagtactaggaaactaaaggtgcatgcttttcctcctattgttttggactctgaagatactactccctccgttttattttaagtgcagtcgtgagtttccgtatccaacttttatcgtccgtcttatttatttttttttaaaaaaaataaaaaacataagtcacgcataaagtattattcatattttatcataaagtattattcatattttatcatctaataacaataaaagtactaatcataaaaaaaataaataagacgaatgattaaaattagatataaaaacttatggttgcgtttaaatgggacggagggagtactccctccgtttcataatgtaagactttctattattgctcatatttatataaatgttaacgaatctagacatatataaaaatatgagtaatgctagaaagacttacattatgaaaaggataaagtagtaaactagccattacgctcggagagtgaaccatcagctgaaattctgaagtaggtctattgatcaaatcacgagcgagtgtttcttttgtaaatacccaatgtaagtatactcatcaaccactcaagacatgactcccatgtcctcgcaagaagaaagacaagaaaaacagaacacggctgcatgctagcgttagcctttaggtgcaccacctgaagtcagtgacgatggcatatcaccattattgggatgcgcattgcaagtgactcatgtttgtcacttcttcccgttaattcaccatcgccagtatggagagacaggaaagggctagaaaggcaacttaggttggcattgccaatcagaaagcaagaaaatggtaagaaagaagagagcaaagattgaacttcgggcctaaggcatatagattatcacaatcacaagcaattgaagcaaaaacgagcccctaatccttatgcaaatcgtatttttggcaattcggcatagcagaaattagaaaatattagttatctctcatcttaccgcgcgttcttcggtgattccctgatttcgtcctcctcccggcgaaacgatctctcctcctgttagatgaccatcaacaaatccaccgaatcgtaccaagcgctgaggccagaattatcgcgggaatccgtttctctcctccggttccagctgcggcaccaacgaatcattgtatgcacacccaagaacacgatcgaatcagaaaaccacacacaacccaaacggaaagagagaaccacacgcgcctgcatgcatgcagcgggtgcggagatcgcttacgaggggatcccgtcgcaattcagaggacgcgcccgagtgctgcaacggctaatgtcgacactgtctgtgtgtgtgctgggctccgctcaggggagatgaggaggagagggccggggggcaatatttatagcggcgactgcgggagagagaagacatggaggagggggcctcctcgccggggctgtggccgggacagccataggtatgcgtgtgtggaggcctggccgtcggtcgtatcgcgcgcggaggccgacgtggagggggggatctcgaccgggacggttccgttttggcgtttgcgtggccaaaaacgcctcgccatccccctccaccacctaggcccctttggttcttggctggctggcctcttgtgtagtcgtgtgtacgtgcttacgcacgttgctaccgcgcgcatgcggtgtgtgacttggcttggcttggatcaacttggctgcctcagggttcacaatcttggaaccaaatttatgagattttggatctatcggtggatcccaataggaatataggacacggccaaatatattgtgcaaatacatgaaaaatatttaaattcaactaaaatttgttcaagttgcaaaacttttgtcctctcacccaaccaacacacggagagagagagagagagataaaatactaactttgatacagataattcgagtcgggtaattaaaaccgctcaatccttgattcaataggttaaaaagtgtcttcaacctaccgggaagcatgatagtcggggagagatggcaacccagactcattgacatagttattaggaccggaccgaacattgagctggtcatagcctcggttcatggtttgattggttcaaccggttgaaccgccagctcaacacaattcatatggtctgagatatgcactattatcacacaacccaacatagctcagtgatggggttgctcgtatgaaatgaggaggttgaggattcgaatcccaccacacaaccttttatcatatattttcttctctctatcccacctgcgccccatctcctcaggtccccaccaacgcggcgatttaattgacctcatcgactagtccttgatgggaaatatcgacaggggatacccgtataccgggtagtgtgagtattaaagtacgttggtacgaggatctacatgattcgacatcaagcagacaaagaggtaatgattatactggttcaggccccttgcaaggtactaacttaataggttaatagctaccggatagtatgagtattgaagtacgttggtacgaggatctacatgattcgacatcaagcat

SEQ ID NO: 2424 - DNA, 2092 bp, Oryza sativa
agaggcaaggattatactggttcaggctccttgcaaggtaatagccctaatccagattatatgagatatggcaaggattatactggttcaggcccctcgcaaggtaatagccctaatccaatttatatgagatatggaaatccacagaatacaatagagaacaactgattccgaggttaccggcgagatccttgttgagagagtctcgacgagatctaccggcaagtaggcttcaagtaattcggattgcttttgtagtggcggattggctggtgctatgattcgataccctagattcctcagggggtatgtatttatacagtgaatccccttagtctccaagtagaactcggatacctcggaccctgcacgatatagtatgatcctaaccttctccgagtagaactctgttatgtacttgcctgtggggattatttctataatctcttgttgatttccttatcgtatacagaaatctatcacacatacgaaagtatgtcgtatgcgtatatttcataagtcgtaggatagaaggtatgtcttatccgtaacgatgacaggaaatacctgcctaatagtgatgagagggatgggtggtggtgagatgaactgggtaggggtcactgagggcgggtttagagggaagacccagaagaccagtggtgggcaccgtagacgagcaaacaacgaggcaatgatgtgctaccaaagtcgcatgagtgaatgacggcaatgggggtaaagaataggtcatgaggttaggcgacggtggcaacagtaatagatattggtggcacgaaccatcagagacaggggaggagtggtggagcagggaattccactggacttgacaaagagaggtaatggtagcaagacaagagagtatgatgaggaggaagagagggagggaggagttgcacagagtaggcattgcctcgtcgccaatgagtaggatagaggcaacaagcgcaatatgaaataaggtgaggcccttgtctcgccatcagttcaagcgctataggtaatggactgaatcaggaggagggagaaggggaaatggttatttgttatatagtgtgcacatatcttggcgtactatatgcctttaaaaagtgattgatgtattagaaaattttaggcaactgatgaacaaatagtccaaaaactcatgttcatgctctacccctccaggttgttttttaaggcaataaatagatacagcctcatatcataatcaggttgcttttgtttgatgactttaaattggcgttattcccatccacatccaaattaaattaaaagtcagaaatctaattataagatgatttatagcgttctttttttatttttttgattgagtatatatatttttatataagaaagattaatcacaaccaaattctatgcacgagattagcacattccagtaaaattactagacgaaatttgcctgtgggcatcacattcaaatcgatattttttgacagaacgaagaaaataaaaggagccataagggcactaaaaatgatggcaatggcactcgtcttcattgacgccattttgtagaacaaaatatttgtcagtagtacgtaaaacatagaatttctcagtataaattggtcaattctgcagcagtatcaactccgtcaatcctgtgatcaaagctgcaaactttttagtgcttgggagtattctcatgcacgaattgtgttaggacgtctgttccaacttgcttcaaatttccatcatttgctcgtttccaccacaacttcaaacagtagttcacaggtgatgtacctttcggatagaaatgcaaggtactcccttcgtcccataatatagcaatctaggaccgtacgagacattttataggacaataaatctggacaaatttgtcctatgaaatgttttgtccgatcctaggttaaaatattatgggacgaagggagtaatgtttaggtgtcacactgtcactcggtcagttcttacggaataaaccagagaatattcaagatacctactcaaaagtctcgtcggctttcggtaatggagaatccaaacgatcacatcgagaccgcgacctcttccattt

SEQ ID NO: 2425 - DNA, 3878 bp, Oryza sativa
  unsure (1)..(3878): unsure at all n locations
gaaatagtaggggtggttgaacaaactacacaaaaatgccgcccatgtttttatgaatatatgcagaaaaatttggagacttgatggggactctcatagtctcacactgggtactactggagaaatgatctttgctgggtcggctgattttcacaatagtctcattctaataaaaaccaagactaaagattgtttttagtcccggttggtactacaaaccaggactaaaatgtttttttagtcccagttggtaactccaactgggagtaaatatttctctcccatctctgatagattaagtctcagacgaaatatttagagataagatcgtccctctccaacccccctcggatatcgctgttgatgaaaaaatcgaacacaccgacctgggagatctgcttagctcctgtgcaggtccaaagattaatgagatacgggcgtgccagtcagtttaatcctgcaactgacaagatatgcaaatagtagatcaaaacagcaaatcggctgacaagccgatggtgtagttccagccgatagccgataatagccgatgctaataccagccgatagcgatagggttaagcaatcggctatatgtccaatgtagataatgatataaaggcaatcggctgatgaccatgtaatgaaataacaatatattccagtataaaccaatcagcaaataatgatatgataaataagcatcgatccgaaggtcaaagcacacatcggctggaggtctgatgtcatgaaatccacaagattagattaaacagtgaagcctttgttgtcatcggctaaatccaacttatatgtatatgcaatccttatgagccgatgcaacgtccagataactcaccggctaaaaccccgatgaaacccttattggcaatcaagaagcaggctagagattatggttctaagcacgacttagtagatcaaacttaactgatgcagcactaagtatgaaaagaaacataatatctagacaatcaagccattgactgagttttcagggtggtagatgtctaagctaatctaatctagcaacgcgatttaaccgataccgacagaaaccctaaaacgagaagcagccaatagagctaaattgatatgctaagattagattaacagagacatatgataaataggtaggcaagtatatcatccaaaccagagcaatccaagaggtcgaatgtactgatgtagccttgaacgacgccgacgtaaacgatacaattgcctgggccggcggaacattagacttatcccttcgccggagatcgaagacgatgcagccccgcgtcgggtgccaagttctgccggaacgtaaaataaagtagaaaaggtaaaaggtggcgatgcaccgaattgtattgatcgtggagatagattacatagaccccgggtgtacatatttatacccatgggttgatacaagtccttgtcggataagaaagaaactaacctaaagataaaaggaaactaacaaactattcctaattaatagataaactgccatgccacattctctttaaactcggtcacttagggataagcttcctttagtagattgatttccttaaccgaatatagtaggaacccgactattggcgacttgataactcccattggctgatttcgagatgctgcagccgataatgattctaagccgatgacgtctttgccgattaccaaattttactgttatcaatcgcccctctctaactccctcagatccgatccaagcctcctcctcccctctactccccctcctcccctcccatccggcggccgacaggtggccagcgccgagcaggtggcctgtggccgggggggcgggcccggtggcggcgggcaggcgggcggtggtcgtgccaggcggcgccgagcaggcggctctgtaggcccgcgcggcgggggggggcgtgcccgacggcggtgagcagacagacggtggccgtgccgggcggcgccgagcaggcggcctggggccgaggtggccgcgcgtggcggcggctggaagggccgcgcccagcggcggcgggcaggcggccggcggccaacggggccgtaggcgtcggccgtggcgagcggaggcagccggctttgttttctttttatgtatataatatgtgattcattgagatgtataatttgattattcattgtacatttgtatagatctgaaatgtataatctgtgatatattagatttgtttggtattttttttaggatttgtgatgtatttgatttgtgtgtatgagtaactttaagatttgtgatgttactttgatttggggtttgatttcaggatgtgcatgccacttgattaaggagaaaaaaaaagggactatctggactgcccgctaccctctatttagtcccggttgataacaacaaccgggactaattgttgttatcaaccgggactaaagatggatctttagtcccggttatttcaaccggattaaagatggatatctttagtcccagattcctacttccggttggaaatccgggactaaggagggttaccaatcgggagtaaaaaggtttctccaccagtgagggtctcgagcccctaccgctcccatggcagatccgttaccattgtccagatcaatatactgtcatttgtgttgcatacgttaagtgaataacatcactaccgctctagatattttttagataaaggctactgtggtagatatgagtgatctgaaatattttcaccataattatttcatctgttcacaaatataagcatttatagagcctttttaaaaataagattttttctaaaaaagactataataacaaccctctccccaccccagttcaaatgaggttttatctcatagctaactctgaatgcaaatctatcacagactttaaatcgatcaacatgatatcggtagacaaatgacgaattcttcttagaagtgttgttacgaggagtgcttcatagactttgagattcttcctagatagttgtagtggtgtaacctgtcacaaggcaatataatatggtcgtgttatctagttttttagcttgatgtaaaggttgaatgttttcattgttaaatgaaattttccactatctttttgaaaaaagtattataaaatatggtgtatgatgagaatatgtgtaggctactacaaatatagataggtgtggttcgatctcataatctttatagtggtagagctaaaatgaaatggatgaagtattactggtttgctttactttgcattggatcgagtttaggctatgcgagtgcttgagtttagactaaggagatacatatatgataaaaataaacgatatgtagctagaaaaaaaaactctaggccaagttactaaacaccctcctaaaaatatgtagctgaacccctaaatccttggtctataatagttcacccagattaatttaactttacatttaaataaataaaataaaagttaatagttagttctctcaattgaagtaggcaagggggacgaggctcctttaacgtaagttagagggaagtgtgtcgctgacttgtgagcctataagtgtaggtccacctgttagggactcacgtctctctgactttatgttaaagaagctgttttcggaccaagggttacaggttaccaggggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2426 - DNA, 625 bp, Oryza sativa
tcctgcagccccggttcgtgtcggaggacggcgtgatcaacgcgcggccgcgggtgctgggcggcggcagctgcatcaacgccggcttcttcacgcgcgcggggcccggctacgtgagggccctcgggtgggaccccaaggaggtggtgagcgcgtaccagtgggtggaggacgtggtggcgttccagccggagctgggcccgtggcaggcggcgctgcggagggggttgctcgagatcggcgtcgtgccggacaacggcttcacgtacgaccacatcctcggtaccaaggtcggtggctccatctttgacgcgcagggacggcggcacacggcggcggacttgctgcgttactcgcgccccgacggcatcgacgtgtttctccgtgctagagtggccaggatcgtgttctctcgcaaaggtgaggccatgtcacccataatttataaaaaccacatttttcttgttcaaaagctcgtgttaccaacataccggtaagtttgttaattatcgacggcaagttaattgttgtggcacttgcacccacttggtgccgctgccctgtactgccatagtagttcgcgcgcactgaaaacccgcgagatttgcagggaccaagcccgtgg

SEQ ID NO: 2427 - DNA, 7670 bp, Oryza sativa
ttccaaattttgccccaacaattatttggcaactttaattttttttagataatggaatataacatcccggtttttactcaaaagagttacagccaattattacatagaagcgtttgacgaacatagtgtaaatctaattgaatagaacacaccgcaaggaacaataaagaatctagcctaacataaggagattacaattattgaagtctatttgtaaatctccaaccataattggcaaaaagttgtataaccatagtctccaactttcgatatgcaactttcagaaactcttcatcatcttcacacatttgtagttgtgcccaaaaccgaagccaatgggttgctccgaaaattattttggcaactttaatagtgtatataaaagtcatttggattgataccaatttttgccaagatcaatatagttgataacttgatattactcttccctacccaaaaaagccaaaacttgtccaaggtttggcacgaaccaaacatgccctgaaaaactgagcaacgtttgattagacatctgccctgctatcttcgggccgtattgaattgaagtctaccaaattctgcccgtactaaaacccaatgaaatgttaccctaccaaaattttgttattgcttggcatttgtcttgtgggcacattttggtttcagaccagaccatttttgatagtgctaaatattttggtaggggctcaaatcaaaatgatactagcttcaaaccaagatgatagcgcttaccagcaccacaaaactggagtactgaagatgatggcgttttgtacctgtcccattcaaatcacttgcacagcaattgattggaaaggggctaaggctactcttgatttctgttagtaacaagtataactaacaaccgaaagtaatgatggcatcgtacaagttgattggtcagaaatgaatagttgaaatatacaggcaggaactcgacatcagtagttcagtactactaccaccaaattggctaataccttctacagttctactcacgaaatctaggacaatggttgatgaaatgttaagtaaacatgcctctaaaaataatggaaactatcaactacaccctatcgtgtcattacttcatacacaggcttgtcccgcttcacctgattttttcatggacctactcaactgaaaaacagggtgtctgcacagcctccctactcctttccgaaatttaaatctgtcaaataaaccttccacattgtcattactgaatttgcttgcagaattgctggcttggctacttgaatcactatctatgggagaaaattccctgctgctgttgtcatggtccttattgtcgcgtttcttgggtcgtccagcactaccttgtgcgtcattatgacgcaatggttctgctctaaagaggaagtgatcaagagtagccccactaatcattggaaaatcattattttgctgagttgaacaaatggtgggcttgtccaaatgctctaatgcctgaggttcatctttgtcacttggggaaccagagcttgatgggaatgcacttgatggcatagctgtttcttcccgtcccttcacagtcttcaagataagtgtcttgagaaaattcatcacttgaactgcatgtatcaaagcagtcaagggatcggccatctataaaagagatggtatgttacatgattagtctgtgaaatagcaaattctgtagatagcaagaaaaaataaataaagccaaatagattttgagaataacctgagtcatgtttggtgcaaaaaccatagcaatgttgcgagcgttcatcttattgtagttttcatgttccacaacatctgccatcagattgatggcccaatcaagtagtgctgcttccactggaggtagagtactcgcaaggagagcgcattcttcttcagtgttgcagtgcatcacttgttctggagtcaatgagtccaatactccacttggaagttcacgaaaccatgcctaccatcagcatcacaccggtcatggaatggtgtagaagagaacaaacagataaaaagtaacaatacaaaaactcatttttctgtagacttcttaaaaatataatttagtctatgtatgcgctagatactctagagtctagtctatctattgattactgtctgaaatcttatatctaaatctctgtactgcataaacaatgtctgcattatcatatttgaaggctttgtacatgttcaatttccatagagaaagatttccataaggttgggttttatgcatttaaaacatatggtaaataaatcaaaggttaattaaaagcacaagaaataattgtcaccacacctttatgaggcccgtcagacagtgcatgtcaacaccatccggaacaacacccatgtttagttgctccctgacatgtagttcctgactattgtctgcatttattctgaagattccttcagcctgggaaaacaagaagcagaatttcagaacttttttccattttttgctgagtagtgtaaatgctagtattattaaggttccaaaatttgttggccatttggccttacctgaagccccccaagttgatataacttcttttgcatggtcaatagtattgttggcacactgtttcctctgttatcgtatgagcattgcatggacgttggtgaaactccaaatacactcacactgtgtaaggaaatagattaaacataaactaagttagggtctgagctttgctagaaattcactaataaaggtaggctgcaaagttcttttaaggaaaagaacttataacaattgaacttaagaaacagaaatgatccttagttcccctctacaactgaaaggttatgtatcatacatacaacaataccaggataggaatcagtaaggggtaacaactaactacaaaagatgaaacatatggagcgcccttgcctgttcggaaaaaagactttggtgccccaacggatggttgagagtaagatagtaaaattaaaacagtgatagatgggacaagcagtattctaaatagtgctaaaattaattatattttggcataaatttcaaatgctaaaagtgcttatattttgggactgaggaatatatcacaacatcccaatgcctgacaaggacaaagagagtcatctccacaaaaggaatgtgctttacaagattccccagtagtcgaacttggcagtgccatccttggaaatggcaacagttctggcttcctgtaagagtttgcaaacgtaacagtcctattggctcgtcgctcgtgggtaaccaattccgaatcggtaataagggctcggcgaggcaactattctgtgtgcacttttgcttagttacgcggcaatgtggcactatatttagcatcatgccatgaacttaattcggaaacgaacagcagtgcagggtgaaaatgggcttaatccacacaggtagtagcaccgcagatgctgatctccggagcggaactccaattccagagcccccgcctcaaatccacggagcatggagaaggcgaagcaaggcaatggcgcggcactgacctggcgctaggcgcggggcggggcacgtcgggctcgaggtcggcggggaggccgaggaaccccacgaagcggtcgaaggtgacgtgcgagacgtgccgcacgtcggtgggccggccaatctgcatccccgcagcagccgccgccgccgccgcggccccttcgtcctccgcggcgcgcacgctgctgcacagcagcagcgacctccgcagcgccgccgccaccgtctccacgacggacacccctcctcctcctcctcccctcgccgccggcagcatcagcggcgatgacaccggcacctcgccctccatctcctcctcctccccttcgtactcctcttcctcctcctcctcctcctcctcctccacctcctcgtcctcgtcgtcctcctcttcctcctcgtcggagtcggggcgggagaaggggatctggtggccgaagcggatctgggacggcgccatggaaggagtatgtatctaggatgccaacttcctcgcgagaagcaaagaccggagagagggaggaaggaaagaataggcggcggtctcggtggtgggagagaagtgggtttggaggcgtgacgagaggtggcttaagcttaagcccgcttcgctgcctcgctggtttgcttgactgcctctttaaacttcgctgtcttcggctctaaaaaaacaagcccaccgtttaatccccatctgccggcgtcctaatcatgcgatcgatcatttttgggccctctcgtctgccttaggtgaccaatcgaagatacatttgaaaaaaaaaacagagtaatggaataaacaacagaagccactgtagtaagatggagaagaaaatgaactcttttttttcatgaaatggtgcagttgttacagccaatggcaggtgtgaatacattccgtaatgctcgtaccatcggggtgacaataattgcacggcttatgattagatgcaaaccagtttttcaatcaatcggatgatggtgctcgtcgaattttcgtgaggaacactgcacatcgtcctggaaggtcggacttgcagattagtacatgtcgatatttttctgttcttgcaagtcaataatacacgttgattcttggtgccgtgatgaactaccggttaaaagtgtattggttaaccagctttttaaatccgttggtccgtagacgccaaacggacagccccttaaacttttgacttgagtgtgtgcattagccattgtacatgtacgtacaggcgtacactcgcgcgtgaagctgtcttgagctcatactcaaaccatcaaatttgatgtagcaaatcttcctttacttgacaaatgtttcctgagagtctgaaactagtactaatactacttcaaagatcgtcaggaatgagctccagacaaatttccgaacctgataagcatggatactgatttgctgttggacccgtgcagcgagcttccaatccctggtctgttctcttgatcaagcaagcaatttctttatctaaagaaagaaaccaaattctgtctgtttattcctagttattactagcattcaggtacgggcattcacaccagtagctggtttccccggaacaaacctgctctcggtttttcattcgtctaatctttacatcagatgtacctctcatcacccacatgcttgtactcgctcatgtttctactttggcactttgccatggaattattgggtgtcaattggtgtcagtgaccgtgaggatgtgaccacccgcgaggacgagatccttgcgcttagagccggtacaataaaataactcaacaggcttcaaaaagttacatatcatcgtatttctacgtggaggaaagataaaccagaaaaaggaagggaacggacgactaatctagcgccgacgatagcacggctccatatgcgcatgcaactagtactagcgattaaaaatacattttttgggccccacaccaccccatccgatcccgtgtggtttgctctccttctccttccgcccaagtagtatttcccattgccgagcagtgcaactgcgcaacacaggttcagatcaagcacgcggaatcgctctcctcttcctcctccatatcttctccgatgcagcgacgcttcttcctagcatcgccgtcggtgccaccgttcgccgcggcgtgcagatgaaggccatctgaaagcgtcggcactctcttccgttcattaaaagactgatcccagtttccagcctccgggcgacaccactgtgtgctagatctgcgccggtcgcttgatcgacgcccaccgcatgaagctggcgttgtctccatgctaagaccctgtttctttcaacttgagattattataatccagattatgagagtaaactgaaagaaacagacaacttattgaagtagcttattataatctggaacccagcttattataatctgataagctcatttaggtgagctttttccaaattattgggtaaaaaattacccatcatgccaccccacttcctctttagacttgcaaacccaataatctaggaaataaacaactaaccgcttattttactacagattataacaatctagcttatagtaatctgactcaataatctagattataataatcctaagctgaaagaaacagagcctaaatcttgctgtcttgtgggtgatttcgttgattaaaacaaacaatcggctagggagtggttcagtagttctgatgtcctccgtaccagtggatttggttttcttttcttggttttttctctatttctgcctgatctcagatgtatgcgtatcttgtttacaaaaagcggattttgtttccgtgtattttttcgccgctgagtgtattcttttttacctcgctccatctgattttcgatagcttccattcaattctattcatgtagacataagaactcatgtttcagaacatgaatggccacaaacatgaagttcacttttgatcatacactgtaagtactcataaagtatgtgcatgtataattaaatatttctttcatgagatgtagtaagcacaatagctagtctattgtattagttaactgtaatattagctataaaatgatatggagataatggagccagcagcagactatactattgaccttgctcttaaagcacactactactagaatctacggagtatatataagatccagacatttttctgtcctttccgtgggacacacttgatgttctttttcatgtcttgtggcctgaggtcctcttgattggataacggacacattgctttagtcaaaagactttattctgaaacctgtagacatgatgagtactagtatatatctaaacctggttcgttagtgcatgcaaatgtcattatcgaattttggtatgcttgcttcaaaaatagattttggagcatggatgcaatggaccataatcatccagcatcgctcgtcagtcatcacagattcgcagttcactggaaaaagtgcaccggaggtccctgaacttgtcaccgagatccgaaaacgtcctcaaaccgcaaaaccagatacatgaggtccctcaactatagaaaaccgatcacccgagatccttcggtggttttaactctggttttggtctatgtggcagctgagtcaccatggactcacctgtcagcatgccacgtcgtcactccctctctctctttcccttcctctccctttctcctctttctctctcttcacttttctccagcgggcatgggcggcgggggcggccgcagcggcgacgctctgggagcagcggggaaggtggaaggggaggaggggtctacccggaggtgctgcggtcgctgctggtcacggtgtacagccacagcatggcggcggcggcggcggcggtgaagaagaaggacgacagcatcgagtgcgcggtgtgcctcgcggagctcgaggagggcgacgaggccaggttcctcccccggtgcggccacggcttccacgccgagtgcgtcgacatgtggctcggttcccactccacctgcccgcgttgccgcctcaccgtcatcgtgtcgtcgccgcttcttctttctcccgtcccgcagacgccgccgtgatgcgcgacgacgacgtacgggcccgcccgccatggccgcgctcacctccca

SEQ ID NO: 2428 - DNA, 2353 bp, Oryza sativa
gtcgcagccgccgccgccgccttgtcgcccgccgcctactctctcgcctctccccggcatcgtctgcctcagccgccggccggcttgccgcctcgtcgccccagccgccgccccagaagagaagagaagagaagagaagagtgagagagagaggagggagagaatagggaaagagagaggctgatgtggattgtctgacatgtggggcccacgtggttcccacgctgactcagctgccacgtcggacaaaaccggtgtcaaaaccaccgagggaacggttttgttagttgagggatgccggtatctggttttgcgattgggggacgattttgtatctcgatgacaagttgagggaccttgggtgtactttttcccagttcacttgacagctcgcaaggatccatatgacaagaaggccacgttttgccatggcgggttcatctcgtttggagatgggcctctgggcctcataggccgatacccgataggccgtagcatctccgggctgtgaattattcggcccataccatgcgatacggcaatgcacactgcacgtttgttccttccacgaaccgatcccctcttcctggcaagtcgcaacgccgccgaacggcacgaagctctccaatgccgccgctgccccgcccaccgccgacaccgacctcggccgcaccagctccgtgccctcgccagatcgccgccgtcgtgctgaaccacccttcgtccgccctcacgccggcctcgacgcgctccctctcggcgtccctcctcgccgtcgcgccgtcgctcccgacccccgtggccgactccgtcctcaagctcctctggcaccacgcgccgcgcgcgctcctcttcttccactcgctcctccacctcccgccgcgcgcgcacgccgtgggtccctccacgctcgacctcgcgctcgacctctccgcgcgcctccgccgcccgcgccagctcaccaactccatcctcggcctcttcccgcgccaccgcctcgccttcaccccgcgcaccttccccatcctcttcgagcgcctcgccgtgtcgcagcgccgccccgacctcgccgtccgcctcttcctctcgctccaccgctcccaccgcgtcgcgcaggacctccccctgttcaactccctcctcgacgctctgtccaagtcgcgccacgccggcaaggccgcctccctcgtccgcgctcttgagcagcgcttcacccccgacgtggtgacgtacaacacgctcgccgacggatggtgccgcgtcaaggacacctcccgcgcgctcgacgtgctgcggctgatggtcgagtccggtattgcccccacgaagaccacctataacatcatccttaaaggcttcttccgtgctggacagctacggcacgcatgggacttcttcctccagatgaagaagagggggagtaaagacgagagctgtaagcccgacgtcgtctcgtacactaccatggttcatgggctgggtgttgccgggcagctggagaaagctcgcaaggtgtttgatgaaatggctaaagaagggtgtgctccatcggttgctacctacaatgcgcttattcaggtgatctgcaagaagggtaatgtggaggatgcagtaacggtgtttgatggtatgcgtgttaagggctatgtccctaacgtggttacatacactgtgttgatccgaggcctctgccatgctgggaagattgaccgaggtttgaagctgttggagaggatgaagaatggaggctgcgaacccatcgttcagacatacaatgttcttataaggtatttatttgaggaaggggagatggaaaagggtttggatttgtttgagaagatgagtaaaggagaggagtgcctgcccaaccaagacacatacaacatcataataagtgctatgtttatgcgcaagagggctgaggacatggtactggctgcaaggatggtggaagaaatggtggatagaggttatctgcctagaaggttcatgttcaaccgtgtgttgaacgggttgatgctgacagggaatcaggagctttcacggaaactcttgagaatgcaagagaaatatagacgtttgcaacgagaaataagactgtaattgacatttgatgttctcgaaacatttgagattatgttcatcctgaggcttagttacagaagtgaattcttgccttcagagcaccatatcagttttaaaagtactcataggtggtcctatgatgagtccaactgcaaatatcacttgattattggtatgtattctgagtctgaacatgaaattcactcaattgtttgagtataacagttagtgttcttggttttatcttttgtttcagtctttgagcggg

SEQ ID NO: 2429 - DNA, 1356 bp, Oryza sativa
gaaaagcacgatggcccatcgtgcttcgggccggcccggcacggcccgaggcgtggtgggccgtgcctgggctgtgagtgcggcacgtgggctggcacggcacggcccggtgcgtcggtcgggccgtgccggcccgacaagcctcggcccaggcacggccgggcctgggccgtgccgtgccgggcggcccacatggccatctatagctggaattcagatagaagagatcaatagattagcaaacaattgcaagatgtgttttcaccctggaggagaaaacataaaacatactttttttaaaaacattactgcataatttcacatgagaatgcttggaagccatgccctcttatgcaccaatgcctgaacattagaagcattgatgtcctgcggatgagaaaaggttcaatgcttgaaacctcaagtatgctaaatcaggaaagtactggccacagtgtcaagaaaatctcaatctaccgccactgcaccatgcctggccattagcctgaaggtcggtgtatttggagtgcgagtattgcaaggccacagagctccagtagtcattgatttggccaagtcaatattgatattcccaggagccgatcatgttgatgcgctgctaaagaagacagatagggcatctgagcatctctacatctgcacaggtagagggacgataaaagaaatccaacaatctgcaaagtttgcaactgcaaatgatcaaactggctaggtatgctgatcttagcctaatgtggtgggattttttttattttttaattttattaatagaccattccaaaaatattgcgttgtttagccacgccaaccatggtggcgtggccaaaaggttcagatttggaaatactttttggaatggtctattcataaaatttaaaaataaaagtctaaaaaataattaaaaaaatcatgtgctagtgagttgttagtttccaataatagggtatagatggcaaacccaattcctcaaacaaagcaaaaagaaaaagaaaagatgtccatcattatattatggaggttgcatattggcatatgtatcttgctttttgctagtagagactgttggttttaatgactgagtttttttttttggtgtgtgtgttgggggggggggggggtgatcaataactgctttttcctgtgattttgtggtgtactgaagtcgtctcttttcttggtatggttttctttgtataaggagctgagtgttggtttttgttaagcatatcattggttttgattaaaagaaacatgtgattggttgcaaacggcgaatgggaacacaaatgctgccagggacattggcaggttcattctaaggtttgcagggtaatt

SEQ ID NO: 2430 - DNA, 1093 bp, Oryza sativa
ttggggggtcgtgccagtcgccctaaccggactgccgtgccattgagtgagcgaacaatacccccaaacgatatgccacacgactatgcttctagacgtcgattcccacaatgccacaccaccatgctcctagccggcgagctcctatcaacatgctagatccaggcgacttccgaagaaaagagcatcagatccacaggagctccgtcatcaccgtgttaagccttggatggatgagaaagggacccgccacgccaccgtccttgcacccacgcggaactccggcggtatgctcgggcggcagagaggtcgaggaggggtcgatgagttcggggtaaaacaactgcacgatatccctatgatctgcctgccaaccgttctctggagtagaatgttcacatggtttggaaggtgaaaaaaaatgtagagaaaacgcctgatcaatcagcgttgcattgcagtttgcaaatcaaagccggcattgtcgcgataggcgtcatgctcagcgaagtggagtacaacgatgcacccgatcaccgtttccatgcgtcaagtgagcagcacagcagcagcagcagcgttgcctgcgacccagcgagtcatgcagtgcgagtcgggacttgtcgctgggccactgcaccacgcccagacagagagcagcatccaatgcctcactctgcccgagccactgactgacaaggtcagtgcatgcaggctgcagctgctgcagagcgctctctttctctctccccccgcgcggccccaggacacgcccctcgccggggcccccccgtcgcccatgccaccaccaccgcggccaccgccaccgaggcaggcgcgctccccacaacccaaccaaagaaaattatcgccgcacctgccgcctgcgtcgtgtgtcgccggccatcacgcgacgcacgcacgcacgcacgtctacaggcgacaaccgctcaaactcaacaagtactctacctctactccaactacaagcatcgcgtgccatcgaacacggtgagaattgttttggcttcaaaagttgcgaggaaaaaaagagttacaggacatgacataatccctgcggatttgggttttc

SEQ ID NO: 2431 - DNA, 27670 bp, Oryza sativa
  unsure (1)..(27670): unsure at all n locations
nnnnnnnnnnnnnnnnnnnnnnnnnnnnnnnnnntgattagcagcaaattcaagtcattcattatccatcatcacatcggtttcagagagaagtgtacaacaagattattttctgtgaagaaaatagttaccattcgtggaagcctagaaggcaatgttcataataggattataccagaaggctaaaaaggaatattaagtgagaacttgttgactcatatttgacagactaaaaagaaaatgcatactttcagagcagacacctatgcaggaccaactattttatatataaaaaagaacatgccaatagaaggtctaaaaaaaaccactgcattggctcctcgaaaaacactaaagtaactatgtctgcataattatcgggagtgaatctgacaatgtgtgtatcaggatctatcaagcatctctaatagcaatatgattttcatgtgcactgttcatagtgtaattgaggggccattttgcaattaacaactacaattaacagcagtgggcttaaaaggaatcttaagtgaaaacttgtcgactcatttgacagattgaataagcacacttctacattcaaagcaggcacctatgcaggaccaactattatagaaggtgtaaaaagactacccctgcattggctccctcgaaaaacactgaagtaactatgcctgcaaacctattgggagtgaatgtgacaatgtgcgtatcaggatctatcaagcatctctaatagcaatatgcttttctaagtggaaattgcactgttcatagtgttattgaggggcaagttttgcacctaataactacagttaacaacagagcacaggcattcatagttcaaaacgggggaaagaaaataaaaggactctgatctactctactatgcagtgatccttacggttttggaggaggagcagaggaaagactcttaagaacagaagatggaatagtaaattatatgatatgtcatagagcctaagagagagatcggcaacaatttggtgccacaagcttagttaaggcaatggaacagtgtaagactgatggcagccatagaggtcaggatatagcaataaagacatcagaaactcatattctgacatcacagttcataaccaagaaaaacacggactcttccagtgcactgaaggaaacatgacgaacaggtacccagtacagacgaaggcagcaaacgtgacacaactgataacgccatagggagatcttggctagacgatgccatttgcctattgtcatcgagagcttggcatttccatggaacttacgcaggtgcacgggcagcagactggctgtggagctcgcacgggcgcctaagcatggtaagatcattgcgatcctggatgtcaggccagcactaacaagccccaagcacacgatagagttgaccgtcgtcgcgcacgattcaggagagaaggacggcgaactgagtacagagctgaaaccgagatgagcagggctgccggttcagatgccgcaggcggctccggcatgataataagctttggcacgcggcggtccaccctggatgccgctccccgcacttgccgtcacgagcacggcgcctcgtcggagccgcgcgacacgacgaaagcatgcatgctacggcaagatcccatgcctcggcggcgatggaagcgggacgaggcggcgcggcaaccgccagtgctgccagctcgccgaacgagaacaactcacagggaccgaccgaccgcgccggcacatgagccgacacgaaaccacgaaagatcccaccgctcgtacgcagcagcaggagcgctcacgccgacgcgtacgaacaaagcagccgccggctgggccaggcaccttcccacgacgtccgctcgctacgccaggcaccttccgacggcgggccccctccgccaccccgccaaaccagtggtaccacgcagggagggaggcggcgcgatgacgacgccaaatcgtgacggaggccagaggaagcccaggcccagaaaaatggaaaagggtggggggaaaggggtcaaagagagcagangggaagttccacggcttacttactcgtccatgtcgccgtcgctctccgaagacgggctgtcgcggtcttcgtcggcccctccaccaccaccgccgccgccggcctcctcctcctcttcctccgcatcagaatctgccaagcccaccaaacacagaacccactcagcgacacccgaaccgaaacagagaacgcgatgcgcgcgcatcgcggagtcgtcggcgccccgctcccgccgcaaccgggggcccgcccgggacgacgtcgtcgttgggaactcaccagcgtcccgccgctccttctccttctccggcccgccaccgttcatcaccttcggggagcgctccccgccgcggtgggcgtcctcgtccgcgccaccaccaccaccagcacctcctccttccacgtgcccgtctccccccgctggagccgacgccgcctccggtgccggccgcttctgcgcgggcattccggcctcctccccgcctccccgctcgccgcgcgcgcgcccccttctccgcgacgtcgtggagcaagcacgaggagggggaagggaggtgaggtgggtggaagcgactcgactcgcagtcgggggcaataagaggaggaggaggcggagagcgagaggaaaagaaaagcaaaggcaacgcaaacgcaatgccgcgatggtggtgctggtggtggggcgccctccctgccctttgcctgcctgcctctgtgtcgtgcaattctcgggacggcttgcggcgcggcctatgtacgcgcgtgcctgcgtgcgtgcgtgcatccgtccgtccaccgccgccgccgcggtctcctcacgcggatgtgcggccccgatttcatcccggcgccgccgctcgtaaccgcgggggtgtgtttggtttggtttggttcacactccccacgagattttcaacccagatctaatccaacgtggagctggggatccacatcgagatgggctcgaaattgcgttcaacggatgaatgtttgaatcctccgagcgaattttgcagggtttccttgtaatttgaaagttgaaactcttcacatgaggcaggagcggttggttgtgtgatgtccactatccagcttggcaaaagtagagaagcatttatgggatgtatttacatttggctgggctgtacctggccgagtaagataattggactttcaggcctaatggttaaacgggctaggcccaatagtttttttccagctccaaactttattttataccaagaaaaacaggagtatcattgcttctctgaatattgtcgattcagctgttttccataaggaaagttgagatgataaagattattcaaattttcttctgccttattcaaattttgttagtagttgacaatggtggcagcagaaacttcgattggcagagctcaggcttcagagtctgaagagtgaagatcagcaaaaggaccacaagaaaatgaattccgccgaatagtgaaacagcgattctgctacttgcatagatcaaacaggaaacatcattgttgtaaattgcaagggcgtaaccaacatcttcataatgacggccaaatgtagatgtgcttatgaaaactgaggctcgtagctctcgcttcagaaatatgcagatccatggtgaaagatggaagagtcagacagtcagttgatactcatcaagttagcgagatctttagggctttgcttggaatgaaggaaaatcaagtgctccctccgtttcacaatataagtcattctaccatttctatattcatattgatgttaatgaatctagacatatatatctatctagattcattaacttcaatatgaatgtagaaaatgctagacatatacatcgtgaaacggagaaagtaggaattgtgaaaaacacatcaatgtcacatgaatatgtatggaagactcgagaatgtaacaaacccgtaaaagataattggatcgaaggcatatgaatgcatgtcttaaatgctatatacgcgtcaaagagagatgggtttgtattggagctttcagagtaagagcaagtttaataggacagctaactactagaggcttcaccatttggcttttttcttattagggaataaaaatgattttggagttaaaacttttatatatgtgttcttggtgatttaaaagccaatgctaaaaaagaaaccacgttgaaaatatctcaaattaagtttgaaaatttaaaatttggctttttctttggggcttattaggccatccgatgggagcctaggttcaaatcacctatagtcaacttaatagccaattcataacaattaactataaacatatacttacatgatctcacctatcatacacacattgtatcttggagtctgtgctacagctggctacaaatctgtagcctgctgctcttctctcgcctcttttatcttctcgatacgtgtttatagctggcttatagtctgctattgtacctgctataacagacccatcgtttcatttattcacggaataagccaaacggcatatttacaaacggaaagtaatttgtgaataaaacttttatatacgtattcttagcgatctaaaagcaaatgttgaaaaataaacttcgatgaaaaaacctcaaaatcaactccaaatttaaggttgaaaattcaaaatttggctgataagcatgagcataagcaaaaatatgaggccctaaaattttgtcgaactattgtctcgtttctctctctctcccgaaaccataagaggatgatttagatttacaatggacagccaatgaaccaattctccgttccaaaaaccctaatggcaatttcttagacttccgttggaatgtaggattttcaccggaaactcaactccctttttttttttgtttcctttgattcagataggatctatagtgaattttaggggctttatggctgagattcgacatagaaagtcggagttgcttttcttgtgccgaacttatgacaacacgcatcaggtactaggtaccagtcttttagttcacacggtgatatgtcgtctataattattttctttttgttctccacattggttttcacttgtgtttcttgagttaaccgagttataaagtttccgggttcggttttccttataatttttgacaatcctcttcttcaacacaagagcggtttggcctaaaaaataatttggcgtatgaaataaaagagctcttactcttttttcatttgagtcctgtaccaccgtctatcctacattagcttgattattggcttggatttgtctattacttgcaaaattaataatcgataacttctcacgttacttagtatttttgtgcttttaaatatagctcattatccaccattatggttaaaagtccatcgcgctagtcctatagttaaaaaagccctaactatcttgcaacagaacaatgctctatggttgagcctagttgaaagctattatatgttcccctagagttagctagtgttgatgtcgaaaaggaaacaccaaaagaatctatgctttcaatccaataatgcaactaatgtgaagagttaacaataaacataaaaatcacagaacaatatataaagttaccttcacattaaatgatcaccaagtcattaataaggtacgagtaattgtatatagtactgtagttacattatttaatattaaaaccagtagtgtcgtttcaactcccagtaagtttggtacataggaacttccttcttagtcgctagctacacaagtaacatcatagcacaagttttatcattcttaacgggtcaatcaatagctacccttttactagcggttctactttgcgctagtgagtaaccgtttattcaacccttgcccacaatctccacaggcaataatatcgtatgctacatagactattttatgcttacaccctccccttcagtagcaccggatatcttaaaacatgtatatatatactattttccccatatattcatatttgattgtaacatgcttatatctcaatattcgtctttaacttgtatttggaaatattttatttcgaaacatgttgcataacgaaaaattattcaaaagttatggagatggtacttgtcgagagtactccacaattcactcctatgtatttttactacaacattgttacattggcaataaatgggcccctctatataacagccgatggatccgagtgggagaggcgacatcatcgccgccgtggcaaaaaaagcccaaggaagcagcgaaagtaacgtgtggaaaggggagcgtctccgagagcgagagcgagaagagcgagggagagaactgaagcggacggcgaggtttttgctcccaatcccctcctccccaaacacctcgccgccgccgcatcgggtcgccgcccctccatccacccgagccctttctcgccgccgcggcgtcgtcggccgcggccgcggctgggaagcatccggatggcgggcggcgggcggggcgccgggctgccggcggcgggcgaggccgcgaaggccgggcgggtgggcgtggggacgacgaagagggccagggacccgtcgcccaactccaaggatcccaacggtataccgccgtgatcgccctccgcacgcacgcttcaatcggttcatctgctgttgatttttttggttggattgctgtgtgattatccagaatgctagatttgtgcatgcatggtgcggggtaggagatgcggattggggatgcgcgctcttcgcttagtatctcgtccggatgatgtgttctgctaatgcttgttttgtttttgtggaaggggatgaaggggagatgatggtaatgcttgttttgttttgtggaagggggtgaaggggagttgatgctaatgcttgttttgtttttgtggaagggggtgaaggggagatgatgctaatgcttgttttgtttttgtggaaggggtgaaggggagatgatttggggacatgttggttgatagctgtgggttataagaggagggagggggggggggctagtacttcggcgtcctgttatttaggacaataaaattgagccttttggtgtgtatccatgcttctgggtttgctatgctgctctagatagatggatgaagtcctgctgctgagtacaattagcttggcttgttacagatgctttgcatatgatatcctcggtactatttacggatattcgcaaatagcgattagatggtagctgggtgtaatagtagcccggaagcatgcattgtgcaatgaagcagaatggcatgatctttgaggcatttagttgcagttgtaattatgctcaagatcatggttgttaaggtgttgttgctaacttgctatggcgtcgctatagtggtaaggtggtagcagaggtcaaggcatccattctgccttatgttgcctccaccttagaggcgaagcaagtggagaaagggaaagaagaaggccttacaggcaaaactagtagagaaagggaaagaagaaaagggggtaaggtcatcctagaaggctagaaccctagttggcttgcagtcaccttcttcctcgctgcagctggcttgctgttgcaaattccatgccactgccttcagattttgttgcagcttgctgcagcctttgaatctctggcgacaccatcagcggtggacaacgaggcgagcaaaggcatcaagctctaatggcggtggtagcaggcagagatgttgaggtcatgtggaggtggccagcggctagtgcctcatctgctcatcatggcggctggtgcctggtggagtacgatgcctttagggcatagaacacgtgggtatgaagacctatgatgggctttatttggctggctgcctggcttagtgggccttttaccaatttccccttttctcttccaaatttctctaccatattctccactaatcaggcggtcacgcctcaaccatctcatatggtgtcccaacgccttacgcctcagcactatagtgctaaggcagtggtgggtcgccttaaacggccatgccaccttaacaacactgctcaagattacaccagtttatttcaccatgtcgcaagctgcagtcaatccaggagacagtgcacagatttctttgtatgtctctcttccaaaagtgtcctgacataagcatcctcaatctgtgtttgtttggaggaactttatcaaagatgcatctgttttctttgtagccaaatattccaacatcccaaggtaacaactccttgctagcttagtgaagaatccaacattgtttgtttattgaaggtgcataataatttattatggttgatttagagttgactaacactgcaaatagaacaaatgtgtaccctcatgcctcatcgctgcaatacattcccttatgttaatcaagtaattactgttcaagtggtgtaatggaatggttaactgttgtgcaaccttgtgctcaacagaaaacttggaagttcccctagactagtgtactgaggtttagtagaattgcatggcaagtttctgtataatagtttcatcacaagaagtttgctggtttatgtttgaatagcttgtggttcacaaaagatgatgtggacaaatctaataacttgacctatattacagtctctttgggattatgggagttgtagatgtatagtcccacttgaatagtgctattgtgctataccaaatttaacccatattccaattatttatattttatagttcatcggatttcttccttcatgcgatcttcctccatcttcaattatatccatctttgtttttttttaatctgttgccattatagcgatgctcctctgcattgaaccccaaccccccccctcatatgtccattattatttgtgtatcgtccactccatttttatttgtgtaacacccactccatttttatttgtgtaacacacacacgtccatttttttatttgtgtaacacacacacacacacacacgtccatttatttatttgtgtaacacacacacatccattttttttatttgtgtaacacacacgcgcgcacgcacacacatgtccatttttatttgtgtaacacacatgcacacacatctcatacttaccactcatcatctaggttttgttggagtgattgctgctgagaagaaaccagcactgcagcttcatggcgatgaaaaatatcagaagaaagctgggaatgatcctgtacctcctaccattgatgatacatccaaaactggaggtcttcatttgcatggtggtcatgtatcacaaagcccacctgattctaatgctttgaggtatgtgctactgcactaggaattttgaaatttagaagaaaatttcttattttctgtgatgtttgactaaaacatacttctttctgtatcacatcttaaaaataatatattttgtcactagttcgcaacgatttgggagttcatctcctggtggagatatgaagaacaaaaccagaaagcgtacctgtaccttttatgctcaagggcgatgcaagaatgggaagagttgcacttttcttcatgaaggggaggtatctggttctgataaccaggtttatggaaatcatggaggtatgaactttttcattagaataagctgaagaatatcatgtagctgtgaacttatgatcactctgtcaatctaaacacttttggttgctccttatctgctgtgttcaggcactggagaaggatctgaaatacaacatccatccagctcaaaagagcaccagttcaaaaattcagcggggtcatcccaacatgagatatataggacccttgttcatgcatatggtgaagataatagggggttgacacatcccgttgttaaacatagttgtcacatgctaaaggcttcgcatggtttcaaaattggtggttcattgactgcaaatcctactaatgaggtggttcagcttccagtagttcaagagaagaatcatgaaccttatttcatgggacatcaaattagtttgggcactaacaactgtttgaatgacatgggtgcctattctagattgcgcctagatggaggaaagctgcagtttgaagtggccaagggtgacagtccaagggattcacatctatcaagatcttaccttgaaaagaaccccttaaagcctgattatcggtatcaaccgtttgactcaactatttcattagatcctcaccaatatagcaagaagttgtcagcttatggtggagcaacagagaatcttcctcacaaacatcaggaagaaaaaagttcaagccatgtctcatacagtttgaatagttatacaggattcagaaagcaaggtcatgacagctctgattttttcttggttaatcagtctctccgagcaacttctcaccatggaaccctgcctcttcatcaattaacacctgataaggatgccagtcaccataaaggtgctgattttgacaagggtggtacctctaggtctacattacatgtgagcagttcatctcaacctgtggtagcatcggctgggaaactttccccaatcaaggatgaggtttggataacttcagtgccttttgtaccttcttttaattttcctgattttcctggcagtacatcaccttcaaaaagtcagtatgacccacttgtcgacagtatcgaccctcccaaagttgaaagtttaaataatctgaagacctcaaacatatcctgcagcatttcaagccaacatgtagatacgaatgttataagagggggaagtcttgaaaaaccattgacttttgctgacaagttggcaaggaatgtatctgctaaaggatcaaatgattttggtttgatttcatatgataggggacacagctctagcctggatggtgataatagggtgaaaacctgtgaaaggaaaaatgatgcatcacttaacaatgagaaatcagactttcgttttcatttggtggagcatgtaaaggagctggtgaaaccaatctggaaggaaggcaatttgagtaaagaggctcataaactgattgtgaaaaaatctgttgataagatttttgcttcacttgagccaaatcagatgccagagactgagaaggcgataactacttatataacagcctctgcaccaaagatagaaaaacttgtgaaggtaaaatatcttgaatttgttggtgaatggcacatcttctgattattgattatatgtttgacttctgtatgatttttgccacaggcatatgttgatcgttatcgcacatcatgagatccaggcttctaattatgagctacaacattgaagagatggggtttgagcctgctggcctaccaatgcgttttgttgctgtgctagatgttttgagtaaggtactctgttacatgaacctgtttggttttgtagacttcagtctgggctccctagcagcatcttaacatggtggatgtttaatttaatatgtttttgcatgtgagctgagaggagatctaatgcaaccaagacagaatctttattgcatgtgtggttaatctatgggttaaggaatgatgcttctaatgctgtttgttctgtttggtgaaaaaaatgtcttgcttaaaatgtaataccctgtttaaatgtaatgtccacataatttgtgttagtaaagtggacaagagggtgtggaaagagaagtgtagaaattggccatatgatgccctagcctcattttatagggtgagcatatagtatatatacaaatttaaccccatggtgcaagggattgaaagttaattggcgagattcttatcatgtgtccaatacattccacgtgttgtgactcagtacaccacttccaagttccaattttcaattggtatttggtgccaaagtacagcatgggagaatatcttctatttccttttgtgcttagagcccttgttcatccgatggcgattacttggttggtccattgaaatcaagaatcttgctcccttatgtctttcttctctaaaatacttgtgtagacccttaacaagagccctcttacatgtagacgttagtgtggttggtagggtattgtgagatatgtgaagcatgatgtggaactcttagtcaataataagcatagttattaggaccggaccggaccggcggttggaccgaaaaaaccggaccggttgggccgcctggttttttcgaaaaccgcttaaaagccggtcagaaaactggcactagagcgctcaaccgtgagatgctactctgaagaccacgtgcacgcatggatgaggagaaaatataggaaaaatgggtgtatggtgggattcgaacctaggatgggttgaatggagtcatggcgcaccaaccaccaagccatgttgttgtttgtgtctagagtgaatcagttatatatttaccttactgaaccgctttgaacatacggttcaaccaatcaaaccagtgaaccatcgaaccgagggcctggccggtttgatggtcggtctggtctcaataactatgataataatatcctcaaggatgattgcctaaaaaataggtaaagaattctattgagctaacttatttgaaaaaaaagggtttgggggcatttaatgctttttaattcgggtaaaggtaaacaccgatatggccatatgggtgttgtaaggaaggtagagatttccctaaggggaaaggtatatatgtcttcgtcactcgtggatattttgcatggtacgacgctgtgatgaatccgagcaaacaccaagatggtttaaccttcttgcgtaaaattaatgtgtgaagtatgaatagacccttttatggtatgaactgaaagtaatagtccttgaatgtaggattttgcttcgtttgtgcttttctttgtgtagtatgtgtagatgaatccatatcaaggaaatgttaagttgtgtaccttaatggctaacgtggtaatttaatggacttcacatgaaaagattgcctcaagaatatgaatatatctattgattgtatatgtgtggatttaggttggggcactttgtaatttccacttgggcattcatatgatcattacctcaagtagtagggatctcctaaagttttatgcgatactttgttagagtgggtacaatagcagactataagtcagctataaacatattttaaggagagaaaagaggagaggagagaaaagaggagagagaagagcaacagactacaaatttgtagccagctgcagcactgactccaagacgaaatgtgtgtatgacaggtgggatcatatattaatagtgtagtaggtaactattgtatgaattggctattaaattgactatagatgatttggagctagtagttggctatactattaaacttgctcttaagtacaactcaaacaagataggtggttgatggaccatagcgacccttgtcatgaccaaggggttgatagaccaagtgataggcgatttgctcctagatgaaatgatgtgaaagaaagatggggtcagccctgtacaaacttgtgttcgtataaaattatggtgcaacagtttgagttgagttggattactgtatttgtggtataaatgtacctaaaacaagttgaacccaagcatcgaataaatcgaagggatgaagtcgcctatctcagctcttggggggtgtacccatcttgttgaaccttgtcaacaaaggtacgcgcttccgaattgtttgcttcaagtgttgctagatcaattgtacaaatctaggcggtctagatgtcattgggtgataccaccaagattgtataacatagttgactctagttaaacaacttattggtaaggtcaaaatggaatccaaatgttattagtgactattgcatctacacacaagtgtacaatgagcaactccatgcctaccacattccacaaagaaagaggttggctcatgttatgtgtgatgccattcattgcaacgtggacaagggtggaattgacgacgctcacactacctgatcttctattgaagggataattctcactttgatcaaatatgatgttgatgacgacaatgatggaaatacctaaccctaatgtaactaaacttggacatgatgagcgggctaaactcaaccaacgcaaaactgtatgaaaattatgaggttcggaactagggtttggcgatgagaaaaagcgatacaactatatatggtagacgatggtagatgaaatatacataactaaaactttcatcatgcaacaaagtctttgatccaactaatgatgccttttgttgtggcctggttgttgacgtaaaatttcgtcactcacacgaaggcccgagagatttgcttgactccagtgcaggtcctagatttagatgaggtgcgggcgtgccagtcagtttgatcctgcaactgacaagatggataaattgatgatcaaagagccgatcggccaataagttgatgtagcgatactaaccgacgttgatagggttttgaacaatcggctatatattcaatgtagattctgacacttagataatgacaatggaagaactttaacaaacaatccaatcaaccgattataatatgatgaagtagatgtctaatgagccaatcgaccaatattgatacagaatattaaatgtaggctcgatggttaaaacatacatcggatggaagtccaatgcaaaaataacttatcggatagcactccgataaaaacgtagcacaaatatatgaatttagcaagacttagattatcagcagtcatatagaagatcggacccaaccgagacagttctagattagtctgatcaaataagctagataagtcaatttgatctatgctaacatgatggttataacaaatctatttaaaacaatattgtggttgtagagatatatcgaataagacagaaaatcggacctaacggagaccatcccaactataccgatgcatctcaaaacacagtgcaattaaaaacagaattgaaatatagggtagacaaatataccaactgaaccagagcaattgaagagatcgaagcatagccttgaacaatgccaatatagccgatacaattgccagggccagcggaacttaagggcttaccccttcgccggagatcgaagcgatgtagccccgcgtttggtgccatgttccgccggtgataatacctcggaaaagagggtggcaatgcgctgaaagttggatcgagagataatttacattgtccttgggtgtacatatttatacccatcggtagatacttgtccttattggatacaactcagacttttttaaagataaagtaaaagatacaagtcctgatcgaacactaaacacttttctaagcataaaaaggaaaattactaaaccctacctaattattagataaatcaagttgccatgtcatggtcttcacgatttcttcttaaactcggtctcttctggataaactttgcatcggctgattgtattctttccctgaccgaatccactaaagaatcttaccaaattttggtgttaacaccgttcttttggtgaggggataactctagcttggattgatgaatgcatagttgatgaagtggctgtaacatccttcccaaaaaaagactttagttctagacaagtcaatagccagaaatctaagtctttttgggatgtagggagtatatataatggaaaaaagagacctaaacttccaagccactacaaccacttctgggccacttcagccaatacaactactttgttacaattatcccccttaagggctaaggcctcataagcgcactgcatgtagcccggaaacccttctgatgcagactgtagcccaatgaacatgaaacatataacgaaggtttatactctgatgtcatctatgacacctagcctccaaaatccgcattagtccgctctcacatagagcgagcccatgttcacatagtacctcacttctacttttgtcatcgattcgtgtaaaaggattaacctaggtttaccatagttagagcaccaaggcttataaactgaccggcacccacctaaacatccaaggtggtactaaaccaccacttctaggccacaccactcctataggcttcaaacaagacaagctggggtgttacagatgtgttctaggtcatggaggtgtggcattgcatgcataaggtgggtagtctattacaaggcataagccctaagtttgacttgttccatcaacaatattgtttttttaatgaccttgaagtgctaaaaatgaattttgagatcagaccggttgtgtaggaaagatgatgagataagatttacatgaagtcaaagatcatccaatttggagttttcatgaagttgtgcccattagaaattagtatcatcttaggagaccaagatgacgtgttgaacttgaaaaatagttgaaggtattgacaagatcctctattgcctttatagattatccaagcatttgtcgcatccttgatcatgagagcctctcttattatttaaagatgacacaatcatagctcaatatcatttgctcaaacagatagaatataaatctaacataaaccgggtctagctatggcaaagttttgtacttctcatgcttattatgtgcaaatacttgatgaccataccaggaattatgttttaacctttctgtggggtagggcagcttaaggccctaggagagtgtggcatcccttgcaacttttattgtgcatagaggacatgaaggcaacaatttgggactaaagagatatggatggaaccaatggagcttagcaggtaagctcttcatttgatgattgggctagcatctcaatctaaactaacatggcaaaccagccttatatttgacgtcatggcatcaattggcaataagagtgaactggaatcaagttggtgaaatgtatgatgtctagttataaggtctaggaatttaagtagacttgttcctaaatgtaaacactttgcactcaaaattcttaacatggccttgcatggtgatgataccatgccaagggtaatatcctttttttccaaaatgaacatacctttaaacatgcatatattgcaaaatggtgggagtatttgtgatgaccatattaagtaccttactttgagccaaagagtataatttatagagcaacaacgagacttaacttttttgggaagaggatgaaattatgttccctcctttcatttgactaaagctaatatataccatcatttttagttagagaataatatgtggagccttagttacacttaaaaattgacttaacaatttccatctagcttcgaaagatttgattgacttgatgttcaagtggtgaaatatcttttttttaaaaaaaaagagagtaaatttcacctaatcacaggtattatggtctgagttgcacaaaccacatggattttgacacgtggcacataaccctagatattttggccataaagttttacaaaactacactattggtcattttgaccttaatgcaccacactttttagttctacaagtataccgcaatgtccctatagacaaggggacaagtgattcatcacttttgggcataggcctttgtcaatggaaatacaatggtaagaaaaaaaatagatagaaaaactcaaaataaaaaaaatgcatatgttggattggcacgacataaatccagtcaaaaataggattaagttacatctcaaatttatgagttctatatccatcatatgaatgttacatccatgtaagtatgatatttttaaattttaacgtgggagtatgtcaaattagttaacaacgtgcttctgtaaaactttaggaccataaacctgggttatgtgctacgtatcaaaatccttgtggttttgtgcaacttagatcataactagttgatactctgcgctttgctgcgggatatgtggatgaatgcatgttatataatatagaaatgatagatgttatgtttaaatgatgtggagataatgatttgtcattgcttacatattgagttctaaaaatacaataaaattgtaaatgatatgtcatgtttgcatgatatttaaaatactctagataataattgctagtgagtgatgatgtggcacacttgcatgtgatttagaatactttagataataattgctaatgggtgatgatgtggcacggttgcatactgggttttagaagttagtaagataggtaggtgaagttttatgaaatttactgttgcaaaagcaaatagtaccaataaatttagtgaaccacttcattgtcttccattacccattctcatttcacctaagaacttcccttcaattgtattgattgaaatgacacttggaccttcatattgcatttcacttaatatatttcttagcattctgctcaaaaaatatatttcttggcataatttgaagttgatgtgaggatgatatcatatctaaagcgctatcagaaagttatagaaataacttccattagctcagaaggtttaagcaaataatgccaagattggtgaatagccctttgatcctctgtattccacatttaagtacgagtgctagatactatcagtagtaataggaagttctgagctaatggcattccaatgcgcacactactcattcaattcgctgatttgattccattcctctctcataatatcttgaatgtttgtgcagaaaccatgtctcatgtaagacctagtttccttctcttcattaaatctcttgccacatcacaaatcctacgtggcttctcatttaatactgtggaaaccatcctaggtggagtattgggactgccctaataataacttccctatattagctcccatcaatttgaatagccgttggccttccatattatttctatcacttaatatgtttcctattataattgcaaagaatttgatgtgaggatgagatcatatctaaagcattatggataagttttagacaatttccatttagccttggaagatttgagcaatccttgttcttgaggcaatttatgacccctccttttttgggcaaagaccaaataataccatttaacaactttctatcttacaacatgttaaactttaccaaattttggtaggggtatttggagcttgtttgatttgctgatgagacaattctgtaatgtacgacaatgacaagtatatcttttgtcccttcttcgaagaggatattccctgatatataacagtttggtttagattcaaacggtcgtaccttgcagtcttgcagctaactgaatagatactcaaatacagttgagttttgcttttaagtatcatgtggtgctattgttcttcttagtggattgagtgttattccctgcacatttttttttcttttgtgctgcacctgacatgttccactttcttgctttcagtacacaacatagtctacatggagctcatcggcactaacaagctgtcatcaatgataatattgttttcttgatctccctaaaaggtaatttctcatatggcaaactagattgtttatgaatttctgtagccctatgcatccaagtagcattttttatgtactttctatggtggtaagtgatgctatacagtgaaattcacaagatattttattgtcccttttgaggtataataatggttagattcgttattccaaaagaggttgtttaacctgcttaacctaggattcaaacctaggtcacacgctttgggaggtaggacaaatttctttgctgcggccgatgattacatgatgggggctagtagtatgatgtggtactagggaaggccagggcccttggtacgacgggagtaagttcaatatggtatgaggggaacttatttgctgttggcttactagttaattagcttggaattactgaaatcatgtagaagtttatgtacttgaagttcaggttcctctataagtctatatacaagtcaagcagacatatcaaagaaaacatcatcacccgtgtaagatgaatacttagtgctgaaattatatactaatgagaaataattttgtgagattttgtttagattaatatggatggaaatattttaattaaatgtctttcaagctcaattcaatccaaactacaaatgcacgcaacattagcttatattccagcactgctttctggatatagagtgaggttctagagttgtgccctgaaggtgtttgtacttgacatatcatgtatataatatattccctccattttcaaatgcatgtcattgctgctttcaaaatttgttgccaaatacatgtctctatgattttgaatctgattaagatattcaatgttgttattatggtttactttttacccatgacaagctgaaatcacatggtgctaattaagatattcagtgtaggcactatggcttttgcagtcagtcgatgtttgtgcaagatcctaaaaagcatgtttttgggtaactaataatatagataaaatactaattatgcttagcaaaacttccaatgagatcctgagactacatatttcatccttcatagttactgtcccagagcttcaaattatatccctctaaaagaacatcaaattattaacaaatagttatgatatttcccttcttcagtttgtaaaatgtttttttccaatgcttgtagcctatcagcaattacaactcgcacaagtccaattatcatgaggtagttattaggccaacaactacacttgttatgttgatttgtaactgtaatgtgatttgtttcaggcaccatggattatatgtttgatctggttatgctatgagtggaacatttgccctaatgagcactgctgaattgctcgataattactagagtaagatggcatcttgctgactgcatctgcttccaataattcttaatgaaggcacgaaacatggtacttgtttgcaccaagatgattatcaagtgttcagtaaatcagttccctttggctactaattctgtgctctgagagatgttgctctcgagattccagtggagttgatgctgatccccagtctttatttagtaaattgaagaccgcgatggtccacctgaatatattacttctcaaagatagcagtactgatacaaagcccaagcacaggcgtgaaaaataagtgacgaggaagggaaaagagtacgatgaggttatgtttcatgattttcatcttgttgatgacagggcagaatgggggtcagtttgtgtaggttcttgggtaggttcttgggtgcgcattgaagccataacttgatgatccgttgtttattattccttcatgatattagcttggttggttagaggggttggagagatatcttggagatctttcagttctttggatcttaccttcacttagaggagatgtgattcgagttgttcaaacagggctgcatgatgtgtttctagttcacgtgtatattcatgggctagtaatatatccagaaacatgctgcaaatattgatgggcaagtaacacattcagaaaaatactgcaacgagggtgttggtgattcactaacttcacttaatgatggaagtgaccagggttttttcctcttgtgattcagaataacataactacagttctagcttacaaagtgtttgacgtgaaccataaacatggccgtttgagccatgctgattaatcataaaccctctttctgaaggatgtagaccatgcagtgtttgcagtcttctgctgttgggtcggtgcatcgcaaatagaccttggcagaatgcaaaccctacctgccctctgcatgctcactcatattggaccatacatgatacatgtatgttggttgagtaatttcaatccactgtcacgtggtgatttggtcctggatcagtgtgcttggatgacaaaaactatatccttgcttttattgtatttgttgtgcatcagagaaagggaagtgaacagaagcacaaactctactattgcttttattgtatatccattgagcatcagagaaggggaagtgaacaaaaccgcaaatgaattggtttgttggcgaatgctaccagaagtcgagcagatagtatgttaaagcgttcagggtggagaattagaaagttaacgagatggggacaagatggcagttgccgggtcagggtattctcacaataaatcttgatggcgtgtcttcctttcagcatcttgagtttgttttatgatccgtgatcacgtttgagttgtaatctggttgatatcctgtatcaagggttcggaaacagcgacgaatctgggcgttagaatattgttagttgaacccaattctgtgatcctgaagaatgcgactgaaggggattcttttgatatctcagcttaacgacgccctgttcgtattcaaaaggtgctgaatatgttcttcagtttacagtagttctcgtgttttctattgtcggtgcaagtgtgtaactgtaaccaagtggttcatgccattgccatgtccatgttgggttctaaccctagctcatgaggaatctccaggttgctttaatggagccccctgatgttgtcctggacctgctggccagcgatttcattgtaatcacaaaaatgaaaaaaaaagagaactttttctttggtccaaagcacggtgtttccagacataagtatagatggaattattcatagcagctcacaagggaccatttgtgaagagagaaggcaccacgaccagcctactgttgcatcacgctcgtaccatcatgaggggaggacgtgccctgcacagatctcacacgcacgctgatggagcaaccgccaacgaggcaacgacggacgaggcctcccctcagaacaggaaagaaccacatggctccttgtgagccatgtaacgcactggtccgcagatccatcaaatcgtcctatcacgccgaaccagaaaacgtgaagcaattcgattgcccgtatcacaccctgacgcgtcgacgaaagcaccggtccgctcgcctcctcctgtggatcctgtgtccctacagcccaacagcccctgacccagcaatcgtcaacctccaatcggcaattaccgcagtgtgctgctaccacctcagctcgttcatccacacgactccacctactactacgcggagtcgtcgtcatgatccccacacactgtcactgaaagccacgaaaagatactagaagtctagaggagactaagagcaagagcaaagagcaagataataatagtagagctcactatctagtagactactactccctctatcttataatataagggattttaagtttttcttacaatgtttgaccactcgttttatttaaaattttttgaaattattaattattttatttgtgacttactttattatctacactactttaagcacaacttttcgtttttatatttgcaaaaaaaaatttgaataagacgagtggtcaaacgttgcaagcaaaataactaaaatcccttatattgtgggacggagggagtattagcccattttaaagcaacatataatagattagctataaggttggctataatttttcttttcctatctctatctctcacttatacatttattatttttgtcttggagtttgtgttaagctagctcttgcatgagagccaacacctttgatttttttttgttacctctctcctccacataagtttatagtaagcttatagctcactattatacttgctctaatcccctcccccgcctgctaaacgagagttgtaaacgcatggattaacttagggtgtgtttagttggggaaaaggaaatttttgggtgtcatatcgaacgtttgaccggatgtcggaaggggttttcagacacgaatgaaaaaactaatttcagaactcgcctggaaaccgcgagacgaatctttttagactaattaagccgtcattagcacatgtgggttactgtagcacttatagctaatcatggactaattaggcttaaatgattcgtctcgcgatttcctccataactatacaattagttttactttttatctatatttaatatttcatgcatgtgtctaaagatttaatatgatttttttggaaaaatttttagggaactaaacgggccctaacaaaaaatagggaccaaatccagcagcacgtcacggctgctaaaagcgacacacggcgacgccccctccaaaagaccaaaaacccaagcaggactgggaacaatacggtttcgagctgaaaaagaagagaaatcgggtggatctggccagtacaccgaaccgcgtaccgcgtagtacagaggagagagagagagctcacagttgttagcgacccggagagcggagacttgctggcggcagacgcaacggcgaccgattcgcccgagcggcacaacccactacgtgtacgaccaccaaaccaatccccatcacccccatcacccggctccgttctttaataaagaagcattccttctgtgccaaaatataaacatttttagtatagtgttaagttaaactttttaactttaactattaaaaatttttaaaaaataataatgtaaaattgatgtcaatagatttatcgttaaaaaaaatatcataatacgcaactctttttatttaaaatatcttatttttatagatattattagttaaagtagcaccttaaaaaccgtgtcagtctaaaaatacttactatattttaggacggacgaagtagattttaactcggttttttttaaaaccgttaaatagtgtatttcgtgtaaaaattttatataaaagctatttaaaatataaaataaatttattttagaatttataataatttataattgattttctggtttttacgtgtcatcttcatccgttgcaaacaaggcctacgtcgtctcgcgcgctcccgggccgccaaaacccgcacgaaacgatcgaacgagagacgccgccgccgccgcgatgcgcatgttccacgcgcccagagattcgcggcaaccaagacgtgacccgagcgacaaggaccccgaaaccggcggcacgtacgctcgcagccacccgtcaccctcctcgctgtccccgtctccgcgccgcggtcccgcggattattccgcgatggatcggatcccatccaagacgccacggcgtttttagcgtagcgtaacccgccagcccggtggaggggcccatcccccacgccacgagaccgcgcgatccggcggcgtcggtacgagtagtactagtcctccactagtacaaggagtaatactctagcggtagccgtccgtgctttttttaaagcggataatgtgtcggccgaggtggattagcggctaaaatgccgatactaatcgagatcgggcggcgtgcgggctgctttgtttcgcgtggcgcgtcgttgatgagcggccggcagctgccagccccacccagcgtatcagccggggggaaaaattcaatcgtgcctcgctagcagccggtgatggcgcatggaagctcagagaggcacgttcgtgcgcagttcaacatgagaaattatcacgaagatcgctgtccggaatagttgatgacagtagtcgttccagacttccagtaatttcctacagcccacgcggagcatacggcggctgcctgtcaccgtcgtggcagattgatcgtgcagcacggcagcagaccttggtccgctgtcatcgtcggaaataaatagtgatttcttcttaaccaattgctctttcaagtttggggtattggctgtgtttagatccaaagtttggattcaaacttcagttatttttcatcacatcaacatcttatacacacacaacttttcagtcacatcatctttaattttaaccaaaatttaaactttacgctgaactaaacacacagctgtcgtcgtacgaataacttctgtcattcaaactcatatagtagtaggagtattttagaaccttgaagctttggtggctacagtatagtccttttcttgtactactaaagatatagaaaaactatcctttattactttctaaccatataaaaagaagaaaaatgaaaaaactatcactgcgtgcaaaaccatcattgtgcagtccaaactccaaacgattgctgcctgggtccaattacttctattgtcatcaagtgatgtgtagttcttttttcaacacaagatcaatatccaattacctatacctatgtttttcttttttagccaaacgatactctgttcaaacatttcctatgacctatataaacataaaatatatctggatttattgaattaaaaagataaagcaaaatagaagttaaagttcatctttgtttggattcgaaccattttctgcgttaccaaaacgttggcaactttaatcatatgaaataaatagcactgacatttgtccacggtagttcaaattctatattatcaaatttggctgtgctaatacttattaagcttctgttagtaccaaaatctagctccaaactaaacaaactcaaaagttgctctttctataatatgtgtatgtaatacatattttgatatgggaacacgcatatcttgcacacgctttgcacattagctactccctctatcccataatataagtgattttgatattttgcttgcattgtttgactattcgtcttattaaaaaaattagaattatcatttattttatttgtgacttactccctccgtcccaaaaaaaaaggcaaatcctgggtttccgtgccaacgtttgactgtccgtcttatatgaaatttttttataattagtattttcatcgttgttagatgataaaacttgattaatactttatgcgtgacttgtctttttaattttttcataatatttttaaataagacggacgatcaaacgttgcacacggataccagagtttgtcttttttttgagacagagggagtactttattattcacagtactttaaacacaactttttattttttatatttgtaaaaaaaataagacgagtggtcaaacgcaaaaggttaaaatcccttatattaagggatggaggtagtaattagtatgatagaatttttttaaaaaaaatataaatgtatttctaagagtataacaaatatatctaaagtctcaacatcaaatcattattttaggtaaaaaggaaaaatatgacagatttaagagtgtaaatatgttgtcttttttaggaaatatgttttgtctttttctctctttatatatgttgaatttgaagataagaatttccacacaagtaaattacatgcacataattttctataattttatgtgacacttattagttaaatatgttacacttagtgcacccgaagattgtgcacacatgatcctttcctagtttactacatcggtaagtgtaggagactaacaattacgaagaaaaatcaagtgattggcatggatatcaaagctaaaaaaaaaactttcagtatagtatacaaatgttgccaaattgctcaattcaatttatgtacacaatttatccataagagtttttattttgtcaaccacagctacgtaatgctcctacgtatatttgcatactccctttataaaaaaattaacctaggaggagatatgaccccataaatctggactacctttggccaggttcggtggtataggaagggttatatctcttttagttttgagtttttttatacggatggagtagatatttag

SEQ ID NO: 2432 - DNA, 8612 bp, Oryza sativa
cccacgctacagcctcgaacgtcgtcgcccgcccgccccgttccctcgcgcgcctgccgcctaacgtgccgtcgtcacccgtccctctcggcgttttttttttctctctctctctctcaagtctgtgtgcagtgatttaatccgtcgcggcggccactttacgtggtgggtacgggccaagcggcggccggctttatcggcttgcgcggctgtgcgtgtccactggacgtcacgcatcgcatcccgctcacgccgcgccgacgaggcggttggagagatattgtatgatctctctctcctgacgacgtgaggtggtgtggtgtgggtggacgagacgacgggcgacgcgggcaggtccgcgtcgcgtgccgtgcagcgccgagtagagactggagagaggaaggggcggcgggggccacgtgcctgtgcgcgcacgcgggcggcgactttggttgcccccacggatgcgaatgccgcccagaccgcggctcgggacgcacggatcgtgatgcgtcgcccctgtccttgcgcgggtcccacgacgcccgtgacgtgctcccacaacgtgccgttgtacgcacccgcggcgggccccgcgagcggcggctttgatgcattttgtttatgggatgggaacgaggagacttcgcagtccagtacctaaaccatagcaatatcacgcgacgatccaataacgtttacacaaaattaacgtgtttttgggaaaaaaaaggcagaaaattaaatctgcatcattaacaccatttaaaataaattgagacattactttttttcccatgagaaaaagaggcttaactaatacagtattccacctctaatgacttatcatcattttcgtcaaatgcaacacaacacaatcatcctattgtcttctcaatctcaaataaactactggcggttatcatttgccatcacctaaccacttaccattgtgttcatttggtttcattagttcaaacattaaagatgtttttttcaccgatatatgtctgtatctaattcatcattcccctaatttcattcccattgcactatcttcggcctcttcgttgccaatgatgcacaagctattaaagagcacggtgttgttaggcaaaacacaaaccttggcatttgttgttgccattcgccaccacatatcacttgtcttaccactaacaacctatgttgttctcttcgagccccaccatgatactctatactaatagtaaaaagtagtctgaatcgttaatttcatttgatgaaatggtttaggtctatttatactaacaccttagttagcagtagtagaaacatgtagagatactgttgttcaaaagaatagatgcggatagatataatcatcatttaacaatgactaaaccttttttcttcttttttggattttttccatggaatattagcgatgccaacgtaatggatgatgatagatagttttagatgggaaaaaacataaataatagttactcataatcatgttattgtaaattactaatttacctataattagttggactctagctctagcctttatctaaaagttgggttacctgtgaacttagagtgatcctatcccagttctttaatgaatatttttagctatcgcttatattagccgctacccttgtttctcaatgaatatttattcgattacatagaaaatacaaacacacatacattcctaagcatttaacgacaatccaaaaccacaaaaacattacctaatgcattttaaaagaggcatgaacctataacaacttcttgactgtactaaattccgattcggaatttcactaacatgtacgcacctaatggtataactatgcacacacaattttaccacagtatagtcttgcatatttcaccgttttgttgtcgtcaattttaaaatacctgaggatataattttggtacaatccatccgtaagaaacaagactacaattcatgaaaaataataataaatgtatatttcctttaagtaaaaacctctccggactaatacaaacacatttctcctggtttcccgtttgccggggctgaaatgcaactgcactctacaggttcactcacgcgcaattagctggttttgatgggtcaggaggaaaaaggcgcctgccgaattgtaatgccgccacgctaaagacgaggggcggcggcgcggacagtcaaaccgctccctgactgcgccgagttttattccctgccgctccaccacccgcccgctcgcccatttcctctccctttttaaccccccacctcctccctcctataagtccctcctccccaccaccccctcatccgcaacaccgcagctgcacccgcatccgcaccgcaccatcagcgcgcaccaagaaagaaacacggagaaaagaaagatcgccatggcgccgagaacgtcggacaagactatgtcaccggcggccgcggccaccggactcgcgcttggcgtgggcggtgtcgccggagccgccgccgtgggcaccggccagcacttccgtggcgtgaggaagcggccgtggggccgttacgcggcggagatccgcgacccggccaagaagagccgcgtgtggctcggcacgttcgacacggccgaggaggccgcgcgcgcctacgacgccgcggcgcgcgagtaccgcggtgccaaggccaagaccaacttcccctaccctaacggcgcgcccgccgccggtgtgaacagcggcagcagcaacagcagcaccgtcgagtcgttcggcagcgacgtgcaggcgcccatgaaggccatgccgatcccgccgtcgctcgagctcgacctgttccaccgcgccgcagcggccgcggccgccggcgcaggcggcatgcgtttccctttcgagggctaccccgtatcgcacccttactacttctttggacaagcggccgccgccgccgccgcctctggttgccgcatgctcaagattgcgccggcgccggtcaccgtggccgccttggcacagagcgactccgactcctcgtcgatcgtggatctggcaccatcaccgcccgccgcgttggcgaagaaagccatcgcttttgatcttgatctgaactgtccgccgccgatggaggtctagcagccggagtttttacatgatgaccgctagttcatttatttctttttaatttttagtagtagaaaaattccgtgtacctcttatgcctagaccctcttgcttaactgagggaagacatttttgtaaatagtttttttcgccggcgatgtagtttaagagaagatcacaccatgtgtgtcacctaagacatatcctgccggcgttgttatggagcgggattatatatgtattattattattttgatagtcatgagaaactatgtagaaacccttctaagaaatcatcttttcactctgttttgcttataagctctagctcgtgataaatcaggagcgttaccggcaaggcggttcatttattggtggcatgtcgtctgagcgtttgcacttcgaacccgtctcttctggtctcttgcttgcgatccatgcaacaatcgccgttatctttgtcgattaatgaacactcagtcgtctcgtcgtgcatgggcatcccacccatacagtctacaccactcacgtgtcgactttagcaggcaccggatcgatcacccgtatcagcggcgatgtcattttaaccccgggtagttggcagcacgagtgaggtggaatcattgtcaattcttacgcgtgtagagggatgaggcctaccgacgctacagtcgccgttgccgacgcaaagattttttttttacccgttcaacgcgggcactcgccttgcccgcgcgcggtcgttttctgaccaatggtgtcagggaaaccggagggaggaaaaaggagagaaaaaactattgccgctatagtacgtgttgctgtcaaggctggggcagcggcacaaggaggcgacgacgcatgtggataacgaacgcgtaaatcgaatcgagccgaatagaaaaaaacaccggcgcgggggcgggcggccgccctgagcggcgtgcggtggggcgggtggatctttcggctccgcgtcggtgtgcgcccgcagctgtcgtacggcgtgtggatggctaccggcaacgcgcccgcgtgctgccgggttggttcggttggttggtgggttggttgcgccccgcccccgcctgtgcctgcctttcctttccgctcgtgacctcgggagtaacgtgagcgtgtgggcgacgacgcccacgcccacgggccacgtgtgcgccgctgccggccactcgcagcagcagccgggccccccgggatcgtcgctgcggccgcgcgggcggtgtggcccgatctgcgggcggccggcgcgtaggtggaggcgagtttccgttggctggattccgtggtgcgtgtttggcccccgcgcgcgaggacctggcgtggtcgcggcagacagggggcgtgggaccacccgtcgcccgcgcgggggcgtcggggcggggcgcagtgattcgcgcggcggccgtttcgccatcgcgcgcgcggggggcgtgggccccacgcccgcatcgggaggtcgccgctttcgtcgcggcgcccccaccgtttgctcggctgtttctttacggcttctctccctttcttgttttttttttctcttttttcttctggagcggctggaattgcggggcggccggctgctgggtgtgcgtcgtgctggacgactgtccagaattcggcgtatggccttttctgcgaagccggtctgtcgttgccgtcggggagacgattttcgggcgatccggtcgatgtgaggtcagaagtgacgagcggtgattcgtcgaaattaattatacttggaaattcagggctcttcattggtgaatccaactgtacttccgtgtgatttgtcctatcctatactggtggacaaaggtggcgaagctatgacctgtgaaggcgaattcttatcttatgcgccagtactattgctgcggcgtgccggcgtggtgctcgtcgtcggtgcggcgctgcagcacgtgaagccgcgcatcattcgcaccgcaaaaggtgcagcgccctactcctacatgtcactggtcacgtagcgtgtactagtccatgtagcccaaaatactttgagctgggccgccaatcccaaggaagaccgagaaaagcgaagcagccggtcaaaaggtatttgcggctgcggcatgcgattcacttttatgcttttcgtctactctatcgatcggtccagcctctgcttgatgccctctttgcgatagctccagtgaaaatgtagagtgtaataccctctccatctacttttgatagtcatatttcatcttggcacacagatcaaagataaataattctacttatcattcatttaaaatacgctactagttattcctcgtaaacaagcaatttattgatatttacgtttctcgatgtatatgtaaccaatcttatgtggaagaatggagagtcatgcattaaatccgagaaaattattaagatgatagattgttgaagttaaatatgtctatcaaaaataaaattttcagatttggaaatattactatcagaagtagatgaaggggaacatgagaaaatacatttgaaaatacatttggtcgctaatgaagtgttaattctgagagtatcaatgataaaggacacagttgtctcattttcttcgctacacgtaactgctttcagtcaacatctgctgaatagcgagtttataaatggtactttatctccgtactaaaataaaattatttttatatgcttctttaatgatcgtgtataactaaacagaaagagactattggctaaaacagtttctgcagcaataatcaactgctacaaaatgatatttctaaaataatccataagttcccaatgtgttaggaattaaaaatgtattgtaacacagataggtaccaacaatatgacctaaatacaactatacggaaaaaaagccttgcaacaaaggatagaattccggacagataacactaatatagaacaccaaatatgtgacatcttgtatgtgttgctccaattaaaactggcgcatgtaagacatttgccaattcggaatcggtactactctaactctatatattgtgacgttaatatggatgctatatcaatgccggtcattttgtaaatcagcataaagaagaaacgagctaaccgaaccgaaccacccgatagcacggggatctagatcgattgatatgtcctctccctcaccttcactcttgttgtcaatccctttgtccctgcactatccgtctctccagagtccacccccctcactttgctcagcacggcaacggcttctcctctgcataagattgggatgagggaactacacgagatggaaagctgataggaaagtcgttgttgcagagactaaaaacttcgaaacataatcaggcttgtggtagtggaaaaaggaatcgaattgctagcaatatggaagttgtgtgatgatggcattcaatccgtcacgatgtgggacgacataacaaggtaggggtgggtagaataagactaaaccaaaaagtccaaaatttattcggctaattccgtctgtggtcttggttaaccatagtgaccgatataaccataatgtcatttgtgatgtattgtatgtcgtatgaagttgacgactaaatgcatgatgcttgtgagttgatttattcttactacttgatcctatcatgtaatgtattgtttggtgtctgatgttgccttgtatatatgtgatatataattatcaaaagttgtcttaaaagaggtaaagttctgccaaaatttatcttctaaaattagcacagttcagtcaaaactgagactgaattaaccgatcctgacaattttgcattgttattcggttttcactttacaatgatcgaactgactaaatgactgaagaccgaatatcgagaccgggatttggtctgaccgaatacccacccctacaccacagtctaagtagaagtactataaattttcataacagtagagaaaaaatgttatgttcccacacgatacttttttttattattttgttgtagggagaagccgagtactagtgttttattctccacttagtacccgaaacatgtaaataacattatatgtaacattttgatctaactaattaaacatactattacctcggccccagaacataagaagttttattgttggacacagtttgtcggtgacatgggaccgggagtatcatgactagaggcttgaggcagacacaatcgcccacgtggcctgtcaccctcggggggcgtcgggcccgagggtgatgtgttcgccctcctctttgtctccccgaggggtcggaccgctcccgcctcggccccgagggccgaggtgccccgaccccttgtgggttttgcgccgcgtatatgaggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacattggtcccggtcagatatataccaggcttcatcctaaccattacaagcaagacattgtatgaagaggggcgaacatgcagattgataaactgacgcgtggtggacaagaatgaccgatttgtgactggtctgacactggtcatgtcgtcagcagacagccatgttcccacgtcgcgcctgcttccggcggaagtggaggtaggtatgggccgtcccatcagaaggtcattcggacggcaatcatacaaatctccgtccatttatgaaaagataggataagtccccacaaaaaagagagagatggtgcatgtggtatccccttgaggtataaaaggaggaccttgcccacttagaagggggatggggatttttcggatggagaaggatcagagagggagagagtaagagctctctggttctccagctctttgtagcttcttcatacatagatccaccaaaacacaggagtagggtattacgcttctcagcggcccgaacctgtatacatcgcccgtgtcttgtgtgtttccattctcgcgaaccttccacatacagagagcttagaatctcaccctgagtccccggccgaaccggcaaaggggggcctgcgcggtctcccggtgaggagccccacgctccatcatctggcgcgccaggtagggggctctgcgagtgatcttctgagctctcgcactcttgcgtgtgcgccaagcttttcctgttcagcccaatggccgaacaagcaaaggcgcacaacctctctccgagcgttagcggtgacgatgggaagtcaaacccacgccgtcgagctcgtactccatcgccccctccacgccaaagtcctaggagggaggaggtgctcgagagggtcgaaggatccgcgacttcgacatccacgggtgatggagaaggac

SEQ ID NO: 2433 - DNA, 2673 bp, Oryza sativa
tccggttccggtgtggcagcatcggccgcccccggatccgctgctcagacagggcggcgtgacaggaggaggaagaagaggtcagcccataccgacgacgagggtcatctcctcgccgtcgagggcgcttcgcgggccacccgaaaggggaggcctgcgagcgacaaaaagaaggaagccgacgctccctgacctcggctacttggaagagcgaaggtggcgcgcggcccttcgagccgcgcgcaaccagcagagcctgcggcgctaccatcagcgccacgtccgggcccgatcactctgcgtcgacgacctcgtcctacgccgtgtccaaacgcgtgctggactgagcaaactctcaccaatgtgggagggtccgtatcgagtgatcggcgtcccccggccgggctccgttcggctggccacgggcgatggcacagagctgcctaacccatggaacatcgaacaccttcgtcgcttctacccctagtgggggtcgggtgtcaggtcttgggctcgggccaaccccgcacccccccgggtgtgcagggttggccgggggcttatcttttttctcttccgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccgggacgtggtgaactccgggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaaggaggcccgaaggcctcggaagaagaaggaaaagaagaaactatttaaagattggcgggggcctgggggctcactccgatgcacccgggtcgccagcctcgtcgccactgtcggttttcccttgctgatgcgcgcgatttgcgaccgccgggattctgcccgaagagagagagagcagggaggagaggcccccgagccgaacggcggcccaaggcccccgacggccggagctggctctccgcctgcttgtccgacggtgccaggcgcccccgacccccaggatggccccgaggccactgcgggaaggccgcgcctgtcgccctctgaccccgaggtcgtcggcacagaagccgagtgcgctccgcgtggcctctcggatggagagcgccgtggagatgtggcccctgacgaagaagatcggccccgccgaaaggtgcagcggcccgtctacttcgttagcgaggccctccgggacgccaagacccgataccctcaggcccagaagatgctttatgctatcctgatggcttcgaggaagttgcgccattatttccaggcgcatcgggtcacggtggttacgtcttatcccctcggccgaatcttgtataaccgagagggtactggacgggtggtgaaatgggcaatcgaactctctgaattcgatttgcgctttgaaccaagccacgcgatcaagagccaggccctcgccgactttgtggtggagtggaccccaactcccgagctcgtctccgtccccgaggccagctcgagcccatcgcagctgcctcacaccgccctctgggtgatctagttcgacggcacctgtaggaaccggccccacctatcaccaggccttagaagtggcgtcacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcaggcccgagggtgatgtgttcgccctcctctttgtctccccgagggggtcggaccgctcccgcctcggccccgagggccgaggcgccccgaccccttgtgggttttgcgccgcgtatatgaggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacattggtcccggtcagatatataccaggcttcatcctaaccattacaagcaagacattgtatgaagaggggcgaacatgcagattgataaactgacgcgtggtggacaagaatgaccgatttgtgactggtctgacactggtcatgtcgtcagcagacagccatgttcccacgtcgcgcctgcttccggcggaagtggaggtaggtatgggccgtcccatcagaaggtcattcggacggcaatcatacaaatctccgtccatttat

SEQ ID NO: 2434 - DNA, 2956 bp, Oryza sativa
ctcaccctgagtccccggccgaaccggcaaagggaggcctgcgcggtctcccggtgaggagccccacgctccgtcacagttatttagaaagtaggtaaaattaaatagggagatgttctgattagttgagaagtggagataggtgagaaaagtgaatggttaggaaaattttttggtggagagattattatattttaggataaatcctgagtgctaaaggttgttatgtcttgagaaggagggagtacgttcttacatgaacagggcatggtgtgctcatgagaaaagatgggtaaattgtggcacgcttgacgctagcaaggaagctatgcgcagagctcgtccatctcccgcttccctcctcgacggcaatgcaacgtcggcaacagtgaacacataggatggatcaaagctgacgtcataccacctcttgttatcacaccgtcatacatccaccacatgctatgagttgattcagacgaccccgtcaactcatagcaacactgaacgacgctcatcatcgccatcagtgatgcacgaggtggtgaggatagagtttctcttgaattgcgcagcagcagccgctgcacatgagacgggtgaaatatgaggtaaggggaggacctgatttttcgacacccgtcaattgtctccaaagcattttcctaggagttgtagtaacaagtggaattggagctctgaacccttagcagcgtaccattttacaaaatggagtactccctcagtcctaaacggttgtttatttgaagttcaaatttatcctatattacctgtattttaaaagtgctagtatttgtcaaatcagtcatctccaatttaaatttctatatattttattctcacaactcttttgcttccattcaaataggggttaatatagtctttatttctcaaagcttaatttgtgctaaacagtataaaaatataagcattgtgtgacggaggatgtattttgtgcggagccgcggagtatagagccgtcaggccgtgcgtttaatcaaatcaaacctaagattagcgtactgccatcgctcgcaacgaagataacctagctactcccccatctacgcgacacgacgccgctgtctccccacgctgcacgagcagtcgttccctcgtcagataccaccaacgccaccacgcgccccgtgcgcacgctgctgctagctccagtgttcgtggtggggtccgtcccgtcgtccgatgcacgcaagggctaaacgctactgcatggctctactcctactgcacctcgacgtgctagcattgctaggatcagtagctcgtgtcctccaatatgtcttgctcgtcttggctaagctacgtccttttcacaataagttcttatttattccattttataaacaattttaaaatatttttaaataattgttaaactggagttcgtgaaagtacatgataaatatattaagagtagataaagtgaaaataaatatatttgagatctgacatagtaagaatattttaatcctttttagttttttttaatttttttagtccgtaatattagtaagaaatgaatttattttgagacctcgcagtatggcaaggcgccatgaccgtccgcccccctttttacggctgatgacctgatgtagcgtgtacagataataaactctagtactcctaccactggctactgctcatctattgctccagtacgcagctatgctagcgccgtagtgtacccagcagttactaccactccactcctaccgttgatttggtctgtgcttccgtcacactcacatggtcgtgtagtggctcagcggcattgagcagcgaaaggtgcaccgtggacggtgccggccttgaggcgccgtgcgcaggcagccgtccggaacatctgaacatacgtgtggtcgaacggtgcgcggtagaattgatttgaggtgacgcgagttgtgggttgaggagcaagcggccgaccgtcgagtttaaataaataataatttataaattttcgtgtcacgacccggcttgtcgtatctaaatatataaataaatgtatccgctaatcaaaccgacggattacgcattatttttatctataaacgggttcgcgggtaaacctacttgcacccttatatgtgggtgaaacggagaacgggcgtactccaaccccgtgccgttgatcgtgttaacttgattgatcaacggccaatcacttgattgatcaatgaccaatctgtcaacgccatatagtagtgtagtactaaaagcaaccgagtcctactccaatatcagcaatttccgtggaaaaaaaaaacttagtcctactctctccgttttaaaataagtgcagttttgtactattcatgtctcatgttttaccgttcgtcttatttgtaatttttttacgattaatatttttattattattagatgataaaacatgaataatagactaagggtgtgtttagttcacgccaaaattgaaagtttggttgaaattaaaacgatatgacggaaaagttagaagtttgtgtgtataggaaagttttgatgtgatgaaaaagttggaagtttgaagaaaaagtttggaactaaactgggcctaagcctaacttattttaattttcttataaattttttaaataagacggacagtcaaacgttggacacggattctcatggctgtacttattttaagacggagatagtattataatacttgtctctctggaatttaaaaattgtcctaaaacaattgtcacttggaaatacttattgtcacatcaaccacttccaattcaaatttctcccaatcatacccctaaaccatcatgccacatctacctatataatattttattaagggtattatagtatttttcttttaaccttagacctataatgacaaaaatattctgggacaaaggttgtaatcaattttattacgatacactagtac

SEQ ID NO: 2435 - DNA, 25875 bp, Oryza sativa
agggccctggtcacttcgcgggctcgacatcagccacctttcgccgtggcactatgtctacttcccggcgagggtgcaggcgatggcgccggcggcggctggccatgtcgcggcgcacgtcgccgcgtcgctgccgtcgacgacgctggagctccggacggggccgagcgccggcgagctcccgttcgacctcaacgagccgccgccggcgctgctgttcggctcgtgatctcgacacgtacgtgagtagagcatcactgggtagtactaggaccaaggatcaagcttagagatcactagtagataggggtaaccgattaatgtgggagtggagagcactggtccggctgtgtacatacgtactactatttaaggaaagtttagcgttctcacattgcccctgttcttgtttccattttaagaactttttagcgtacagcttttcatctcttctgtagtataagacggttttctcactcgaggttagtactattactgacctgagaacttgcatggtgatggtggttgtggggcgagtgagcggttggttcggaacatttggttggtcaaaagctagtactacaaaattttaattcatgtaaaatactagtactggtattataagaaagatttcagttatacatattgatcagtaaatcaaatatacttaacgctctaaactactagtgctatcaatgcaagccccgttagtgaaaattaacagtatcaatggggtttcaaaaaattaacagtatcaattgatatcaatgcagccttaatttacttaactgtttaaactctaaactagggtttgtaaaaagacattcaactcgagatgaatggcacacccggcgtcccgagctcccggcctcactgacttgaccatctgcttaaaagtcccatcacaaaatggctcgcgagtccaccctgtctcgattgtcgtttcctgtagtattactagtacacacgttcgattatgcttctgtagttatgcgcacagcttattaactactccatgtgtccttagattttaaattagatattgtaaaataacttatgataaaaaatctataaaatcaactctaaaataaagttttaaattttataattttatttataaacaaaaacataaaacaaacaatgcgtccgctacagactgtgcccaacatttgatccatttagataactatggttttaatcacctatcaacagacgtggctaatgtctccttgccaggaaaccaaagtcgaatcttaccgataataaagtgacaagttgcccgtccaacttgcttacaggggaaaattcataggccttttcatctatatgaaaaacataagaaattcaatggatctcaatactatgaaaattatatttgttttattttttccgttttctcaaatcctgcattttatataaacctgcgatgcagatatcataatcagccaattccaagggtaatctgtaaaaatatccagttcacgtgcttttctacatccaccctttggaacatctcgtattatgctttactcggagtattatgctttattcccttcattccaaattgatctacatatagttttttttgaggttattactaaatgatctacatatttatgttcatttattaagtatattcgttatttgtgtattggagtaaatagacattagcccacatataatatcttgatttgctgttggctaggaaatattagagatggtgtatgcattaaatctatggctagagtagatatagtataagagagttattagctttttttttttgtcttggtgtacctataaaatatgtagatcaatttggaataaagggagtagttctcaacctgtttgtctacacaatctttcttatcatttggtccacgtgaacgcggggtaccagatttgtaacgcaggagtacgtagtattacaaataaacgacaggccttactgaattaggttgtgttcagctggggcatgtgatcacataccttacgttaacaaatgtcctttggtctcgttcatcactatacacgcacaattctaaatcaatttgttctacaaaagcttgataccgaaggaacctcggttccatgctggcaccacgcagacaacagattacatctaactcaaacttccgtagcacaaacactaaactaccttcatgctctccgcaaagcttccgggattgatggttatactcttggtgcaattatccgtcttgtagatgccaaccagcctatcagctagttcaaacatgttgtttctgagactgcagacagggcgacaaacgtgagattggggaaatttcaccctgcctcttagcacgtataaatatttcggttttaactttagtagcattacttttgtagatgaacaactaagtctcttgtatggatgaatgtttggcaaacatatatcttcgacagatctttgctcagtatttctcataaaattattttcagctggagtataagtggggcgtggcacatgcgggtagaaaaattaggaaaactaagctgccataagcatacctgataataatgaactgagcatctttggtccggtctttcacgtaatgtccaacgatggagacattcttaaagtctgcgagcagcaatgtcattaatgtattgaagtgttaatatatgttaaacgccaagaggacggccactaaacttacccaacgcagcatctatctcatccataacatataaaggagttggtttataatggtgaagagcaaacaccagagctagtgagctaagcgtctgcaagataaaaagcttagttcagtaacaatctactaaaaaagtgatattagatgagataacacatgcacagaacataatgccaacaagaaatgtaaaactcatattactgttgaataaggaaacaaggtatggagtagaaaacaagttctcgtaacgatattgaaaaccatctttgtcagtaaaataaggccatattaactaacatccttgcacaaaaaaaataataataattgcaaaaataccttttcgccaccagataaattggcaatgtttttccagcttttcttgggaggtctaacactgaaaacaacaccttctgaaaacgggtccaaggaatcaacaagttccagctcagcatcacctccaagcgtaatcatctaaaaacaaaaaggaattgctgttgaaatcatgttgtttagtaatagaggttgagtggtaaaagtatttcagattttcagttaattgggtaagcctgctcttatctcaactaactctttaactttttttggcttcctagacttcatttcttacaaagtgtggtcagacttcaaattgtaaaacaatggaagcaccatattacatgctttgatatatgtattcattatttcaaagtacctggtacatctccttcagtttcaaagatattatgttgaatcctgccatgaactcatctaacctgaaataatgcatatttgcatgtgaggcaaatagagcaacatggatagaaattcaaagaaaggaataccttctcttcctcaatgcatcgtattgctttttaagatcatcacgctcctgagtggtggcatttagctcatcaacgcgttcaccatatacacgagcctttgtgcggtacctgatccagccaatgtaagccagtaaggaaattggtggtgccaaaatgctactgacatgtatagatcattaattcatactctgctattgaatccaggttaggactcaagtctttaagcagggcttccaacagtgccaccatctcaactgcttttctcatgtcacacgcctcattgaattgctcgtcactcaatgtttctttcagtttctcatgatcaatagcatccttttgaattctgaaaataacaagatgcacattagtctgagaaacaatacagaaaacacgtagcagtattgaaaatagcatttacacatactgatccatgtgtttaacaagatttgtctgaatgtcatcaagctttttcctgaatgccttcaccttcatttcccactccttggcaagcttttttgtatcttgcagtttgtattccacatcgacctgtacatacatacaaaatgtaaatattgtcaaaaggaacaatatcatagtgacttaacataataactaaatataaatataatatacctcactggatctcagttcatccattgctttctttaatttgttgtattctacctttgttttgtcaagctcatctttatggttgtccatcatctgcaaaaaaacagattaacattttccattgaacaaatgaaaaaacaatccaatcactttacagcttgtaaggcaatacaactaaactacctcttgtgttttcttataatcttcttgaacagtaaaagctgccttctcaatctctttgaaaatagacatcatcttctccttttcagcaagaagcttttccttttctttcctagactcctcgatgcccttggttaattttttcaccaacttctcacatgtagtaattctaactttgtggcggttgatatctgagcttgttttgtcaagttgctggcggttgacgcacaaaatcttagacatcagataaccaaaacgaagaacagaatcacacaagcattgaagcttatactcacagattggatgtttgcaacttttagcttctgatccttgagcacttgtccccctgcgttttcaattttctgctgtagttctgatgcctagtatagaaagcaaacttaagtcaaagctatgtaacaaataatttcagttaacaactcaaagcatagaaaaatcaatatacgcaggcacagattcaaacaggagactgggagagtgagttctgaatgatggagcatttgaagtaatttgtgagttgaagcagacgctcactaaggcagattagcttatgaattggcatgcgatcaaaaagcctgtatagccacatacctgatctttgagcttgctggaacatttagcaagtctatttagttcagcttgctcagcagatatgatatcatccagctcttccattctgcgaacctcgtccgctttgggatgtgatgcagctttcagagagtcaagtcgcttttcattgtaactaaattgtgcattcatactctcaacctatttcaagagatgaatggaagctgacctcaaggagaaaatagaatctcacagcagaaaaagtagtttacatacctcctttttagcttttgccagttccatctcaaaacgggatttggcatcttccagggcccggtaaccttttttagcatcattaattttttcacgtaacctgttgagttgatcgactagcttattaagatcattttcagcatttgcaacagcctcttctgaaatactttcccggatggatgtgcccatcttgccacctcttggtttgctaccaccaccactcatggtaccagacttctcaaaaagtgcaccatcaagggtaactactcgacggaattcactggctgcactatatgcaattcgagtagcctgacaaaaacgattattgatgtcactgttataaaaaataaaaatataagcagcactgcaacggtttttgtatgaaaatagaacgatatgtcctcaattaagtaattctagccttcttagaagttttccataaaaaatgctagtggggcagtagagtactttgagaaacaaatatacaaggcacatgatagaacaagcagcaaaagaagcaaataatagaacgaaaacaaacaatacaattcaggtatatacctgatcaagatcacttgcaacaatagtgttccccaaggtggcaaagaaagctaacttgagcttctcatctttaacctttactagatcaaagaggcgtggaaccccttcaggtgtttttactttctcctgtagcttacgaagatgatgtgtttgtttttcctgtaatggtaagagtaccaaatcatgccaaaagcaatgaaagcaacgaaaagatagcttctatacaaataaacatgaaaacgctatgaaaaggatccagaattttaccagtatcataaaagttgcaatgccaagatttcttctgcgtaataactcaacacaagcttgagctgaattggttgtttcaacaacaatataatcaagcccagggcatgctgtagatatggcaacatcatactttgctgcagagcacaacagctaacacaattaagtgatatgcagcacaatccagacctagagtacataaataaaacaattatgaacttctcctagttctctagtatatttactcggagaatcagtaaaatacaataatatttgcaaagcaagtttaacctccagttctttccaaagtctaacaatatcacacactgactaatgactagtatctgttaatacgatgaatttggaagtatatattcatgacataataaaaacgggcaaatgtacagaagctggaaaagtcttcaggtccaaaggaaaaaagaaggcatggttgtttaactgcacacattctagcacaaattgagactacaacaattacatcttaccatcgattgcgccaagatcacctagcctgccataaatgccttctatttcctttgattccttagcttgcaaaattgctttcaagacagtgccttgattcttttcagaatcccttgtggttttaatctcagcaactttctgcctagctgcttgttcaagaggaataagtgactcttcctgttttaggcattcctgttatgcataccgagatattggaaactcaggatcatccacagcaaatgggaatacagtgatactgctcgagggaaagaaatggcccagagaagtctgcaaatgctttacctgttcaactttacgagcctcatttgcttcactatggtgtttctctattttttcttgaagctccataatatatgtatccttcgctttgatttgctctttaatgctttccatctggttttgagcagcagttaattctgctcgggctccatcatgctgaaaacagttaataacattcaagtgagagtccacaaaaaaagttggataccaaaagaggggctttcgtatcaatggaattgagaggaaatggacacgcgcgtcgactccaaggagagtcaaacgtgggtgggcgcgcatgcatgaacgcactctagccatctgtgctaatgcacagttcctagtgagaattcacacaacttgaaatttatagatacaattagttgttttcaaaaagaggaagaaagatgagcactcttgttttcgactatactccagcaatcaagaaatatcatgccatactcaattctccatatggcagatccaggttggcgatggcaaaactgtagcgtactaggaatagaagttttctagtgagtagtgacctcatgggcagtcaagtggttcgtgtagctgaatagtactggagaaaattgacaatggcctaccacaactttttaattagaaaagaaatacaaagcaggacaaaccttctctttcattaattttttctcagcagatgcaacatctaagcttcctttatgctcaattatttgattttcccatggttcaagttcagaccttacttgagtaagtttagaacgaagtctctctgtctcttctgtaattaccaaaaaagagagaagagagagaggtttggtcataaaaaggaacagactgcactagaagaaatttataggcacatgtcttgctctaaaaatcacctcgagagttttctttaatttgctccagcaccttctcttcttcattaaatttttcttgcaatttgggtatctcttcctctagttgtggaattaaactggatgattcttcaacctcttttgttgattcatcaattttcgatgtatcctgcataaaaatgaaggtggactttgttgctttgcttgaactacatatgggatcattttaaatataccttttcagttttgtcctccagcttcttaatcttctgtttaagatgcttcaaatcctccctatattttacatcttttctctcaaactctttaaattgatccttgcaagacttcatattattttcaaggtcctaaacacatccagagaataaatatacaaacgagcattataatctggcaatgttagaaagggagtagaaaatctgtcgctaaccatcttgtggggaaaaaagctctatcctgaacatctaggaataaacagctttcgagtcacaagtaatgttccaacaacacaatacctcttgccttttagcatgtttgttgtaaacagactccatttccttcagagtttgagaactatgctgaattttttccctggattataaccaaattaattagtgataaaactcagtaccaaaatatcatgttcatccacaacaataaatgacctttcagaggcaaggttcttttccaagtctgcaacattctcttgcagctgagcaacgtgtgaggtagcatcatcagaagccaatgtggtcgccttctcttgccatttcaaaagtaagagttccttcagcataaatgtttcagcctcatttttcgcactctacaggaaaatatatcaatcagtagtgtcattcaaccagaagaatcaattcatcaccctcagaccgtcacctctaagttatctctttccttctcagccaacttcagcatctgcacagatgctgtccgtttttcattgagcatttccaatctaatatgtatcagaacatgtcagatttcattacagaatggacagaaagcactcattgtgacaacaggccttaaatcagttaaagaactcactgcttggaagcttcttcaattttctcaacatactgatttgtcccaatgatgtcttccagatattctagaaacccctcatcatgtggaccttgagattttggtttcatcagggagatttgttcaacctcaccctgaaagtgcccaacttggaagttatgcagtgcaaaaccataaaatataacaccatatggatgtctgttatatccctcatagtcatgtaaacatactaaataatatgcaacatatgtccaaaattaaacttacaaaacacgcgcatttttcatgtgtaaatggaaaaagaaacacaaacctgaaggatcaaaaagcgattattatcaaggtcaactcctttgcccttcaacagtttagttacttcagtgaaattgcttccacggtcgtttatgtagtatttagaagtgttgtcacggaaagcaactcttgtgatgataaaatcactgccctcaacagccctgtagttcccatcatcctatgatggacatagagggagggaaataaattatgtggcactagctaagcaatatgaaatgctaaatacttggctcaagaaataccaaatcaatgatttcttgaaaatggacggagaccccagcactgtctagattctggtggttagaagaattgtgtatgagttctgagaccttgttcaggcgcatctacaatgatggaaaactggtcagaaacagtctatgatttgaaacaacctaaataggttgttctgaattaagaaaatatggagtagctaacaaatagcaagatcatctctcaagagcttaagttattcgtgaattttatagcatttaatccaaaacttttaaggaaaaacctttggaggaaatgggcaatagtaaacaggaaatacaagggccccattgtattcaagtattaaatacatttctcttcaataactagtttactatcatgaaagtaccattacactaaattctcaaaaacctttgggcagagactttgaagcttacttttcgccttgcatacaaaatcagtaacacactaacaaacataaagtagcagtttgttgcccagcctttaaaaacattgggaataacttacacttacatgccaactttggcatctagcactcgctgaatggataaaaaaatacaatgactttttgagatagaataaatcaatgattagcttaaatctgccactgagctgaccagaaaaatgttgaacatcaataaacatttacagttaggaagcaatattgcccacctgttttgcacgcttcccaaacacaaacagcatcgcatcaatgacattgcttttcccgctgccatttggcccaacaacagctgagaaactctgaaagcaagaaaaagcggttattcttttatacgatgcatggatcctagcgacagagtggtagacctatgttcataagagcttgaagcatagtgcactcatcgatagtacctataaacagtttataatgatattctgcacagaacacgatggttacacacacaagaattgtgaattctgcacaggtcaccataaaaacacgattataaagttagacggcatttctggaatgtaagatgtgttactactcacaaatcatagtcatttggccacttaaattgatgcacttgaaaatcagtaaaatttaaaattatgataaacgttgctttccttatatcttaggtactacagaacaagtgaaagttaaactgcagaaacgacattctgaggataaaagagttaggtctgaaatttcaacgtatgaaagggcaaattcagatagaagccatagaactgaataaggaacctccatttctgggtagaacaaatgccattaaaccatgtgacttactcttcataataaaatatctccaaacaaaacaaagtgaacccaaaacatactactgatggagtatgaccatgccactctaaagtttcagaacaaatgtaaaaccagtgcacaactcaaaaacctccactctaatctaacattcgtgagaccaaaactagaccaacaaattcagaacctaataaacaaaacgtcacataggttcagaacctagtaacaatgcgcgtatcggtatttcacttcataaactagaggccaggcagaacggccacactgaagataacacgaattcctaaaaatgctataacacggtttttaacttatttaggattctgtaggcactgggaaatggaaaactcaaatgaaagtatacgtggtcacctcctacgctatcacaattgaagttaaattgctatatccaactgccgtgcctagggttcaacgatcgtacaggtcaagtaaaaaaagcaagcccaccacatgacattgcagctggagggtcctgaatagcgccaaaaacaaacgaaaaccggggattggtagtgggggaatacgtcatctatgactatgagcgcgacgaattaagatatactgtagctagcttgcgcgctcgtgtcgtgtgcttgcgagtgagagagagaacgagaccttgtggaaagggccgatgcgctgctcccctgcgtacgacttgaagttgcggaggaccatctcctttatgaacagccgcggcctccccgccctccctggcgagggcgcgggtgacctcggcggggaactctccatgcctgaccgcagcagcaagggaggaccggaccgcgagagccgccgccgccgccgcccgcccgccggaagatcactcgcccagcaagggcggcaccggctgaaggggggcggctcgaggacaaaggcgaccaagcggtgcgcaactcgggacgacggcgaccgcgcgcgcgcaactccgagcgacggcgaccgggcggcgcgggtgctccgggcccgacgaaggccgcggcggtggaggcgcgcagatctcgggccgtcggcggtggaggcggaggcggtggcggtggggggattttggggaaaagtcgaagcggccgagaggggaatgtgggatttgggaattttgggcgaaaatttgggagggaaaactgaaacggcgagaggattttcttcctcccgcttcgagcaaatgtgtcagaccaaaaggaagactctggagttgggctggattacgagcgatgcgctgctttcgtgtgcgaacttatatggggctcatgttgggctgatttctggtcggccttctgcttcggagaaagttcacttcaggttcctcttcttgtcatcgagttttgaaattgtccatgaattggaaaaccagatatagcacatccctaatattataaaactgaggcatattaagtcccaagccagtattgataatgattttagttgatgtggcggctgagtcagcacggaacccacatgccagtggcccaatcttcttctacctctctccgcctcttttcacatctctctcctagcctccatgaggttggtggtgggcgatggccgaacaggagaggtgcggtgagttgacggggctgcaaggagctcagtgcggaggtggcttgatgcgtcggcgagctccctaccactgacaccacaacgccttgtgatttcacgcggctatgatccttgcaccgctgccaccacaattcacctttggagacacatcctttctctactactacggtgggtgtcccctctccctctcgtcgaaatttttcggcccttctccctccatcgtctcccctcaccactgcgcgcgtctcactcaaaccattcgccgtcaaggagtacctcgtcgacacctgcggcctcacccgagcccaggtatgcaagacttcagagaagttatcccacctcactaccagggaagcaccattgtagctggagacagcagccctacctcaaatggctcttccggcttggggtgtgacattgcagcaggaaagtggctcaaggtcgacgtcgcccgagtcatcgtcgtcgcagaactagagcgacatcgagatgagagatagtgggtgcggaggtagagacaagtgctgtggcagtgggcacggaggcggaggctggcccggacgtgggcactgcggtgatggaatcacattaggagcggagggaagagagggacggtgattattttttttatgacatgtgggttcaacactgactcagtcgccacgtcagcaaaccgctctaaatattgtcttgagacaatgagacccattgtaacccggttttaaaatattagggatacattataattggtattccagtttatgggcgattttgaaacctaacggtaagatgagtgaccaagtgaactttttccttctctttttggttgagatgcgcatgggctgttcggcccaggcagacagataatacatagaatggctttaataacgtctttacaagctagtaatacatagaatggtcctacaatatcaaaagtgtaaacaccaacactgtttggaactttggatgatctgaatcatttatctcacaatcacccagccatcaggatggatttgtcatgggggtggaggggcttgaagcccagactactgatgttgggagtatgggagccccctctaattttttttttcactctgtaagaaaacgtgataaagttttgtctaaggtggtgtttgaaactcatgtagatgaagataaagattaagtgtttttatgtaaaacaatgtgttaatagcgtataattaattgagttttaattactacaaacttgaaagataaagtatctatctagaagtaatatttagttttcgcacaaaacgtaacgtttagcagtttaaaaagcgtgccataaatatcaaattttttatccaacttttgttagagaaactaacggggtctaatttgttcaatttcgcctactgcttcttcctaaatccgcccccgcaacctcggaaacatccatgatcttgcaaattttcaaccaaaagaatattaaaaaaagcatgcagtttcttgaacaaacttcagaaaatctttttcgaaaagctacggcactcccaaacagaatattgacacaaggagaccaaaaacaaaacgaggcagcaggtcaatgcatccggcattccagctcgcagcaaggagtagtgtgtaccataatgacacccacttctacttgattaaagccctcatcctatctttaagcctgcgcatgatccacacaaatgcatacttatcctaaactaatcagcttaggaccatgtatatcattttagactgcagcaagaaatagttggcaagacactgtttgaaaaatccggtgtagtgcaaaatttgcgggtttgtcaatgagtttccttcgaataccgtggatagcaatgcactgagaaaatcacatcactttcagaaatctcactgcgttctcttgcgcattgattaaccctacacaaaagatacatgtaacttcgctggattttgaactgggtttagacctatgtgacgtactaacatcggacaaacagaatgtcactcaaatttcaacggaatttgccacagtaatctcaaaattattcttctagatggctcatatatatcaccatagagcttatgtttcgctgggttatgctggccactttctagacgaacattatgtaacgcaaagtaaaataaaccgtggacagtttgccttacaaatagaaagcaaaggcacatagagtcctggtccactataaaaccggtcgctaaaccaagtccacttctgttatcccaagcaaagccctcgcttcgattccttcttctgtcaagctcaccgttcgagcagcttagtaacacccaccatggcttctcccccggaggacgcgccagctattccttcaaatccatcggtgcctcaggaggtaggtaaccagctaccgcggcggtcgccgccgccgccgccgcggcttgagacggcggcggacgagatcggcggtgtcaggtgcggggtgctgtgctttcacctgccgagacgctccaagaagaagaagaagaagaagccgccaccgcccgtcatgcagctcgcgggcggcgcggccggcatcaagagcgtgcagctggagaccacggcgacggacgacgacgacgcgtcgtcggcgtcgccaccaccccagcgcgtcaccttcctggcgtcggcgtcgctctccacgtggtggccggcgtcgcctcccgctgccgccgcggccggcgggaggggggcgtcgtcgtcgtctttctcgcactggcgccggtcgctgtcgtcgtcccggcgccgggtcacgccgcacggcgccgccgcggcggcgccgtccgcgcccacgtcgttctccttcccttcgtcgccggcgtccgcgtcgacctcctgcacgagcacgccgaagctggtccacgggtgtcacgtcgactagctagctattgttcgatatctctacatctcgtgtactgcatgtccatgtatcatgtatacgtagttccagttccaatattgttcttgctttcttaatttctttgtactacgaaaaacagtactgatcattgtcagtgatcaactgatcatagtagttggcatcacatcaggatcgatcgtgtgggttactcttttgctgagatgtggtaaactactaattaaacaattcgtgcactttgcttttttttatatatatatatatatataaagaaaatctgacctggatgcacgtacgaattgaaggtcggatgaatccatcgacgtgatctagcactacggcctgcacggctacacagttacaataatatataggatgaaccagtcaatcgaatgaagagtccagcgtccagcccagctctagtgataaattaggactttcttttctcgacaaggattttctatatctatatgacatgatatccatcatttgcatacgacttaaatagttatagaaaaaaattaaaaaaaatagtaacatcgtttgtgatgatatatacaagtctatacacaaacatgcgggactaaatttgatctacaattggagaaacaaaaatagtaaaatcaaacggtgaatagtacccgtacagataaaatttgttatttttgttttttcatacccagcaatggcgttagtacaggtcgtcgccactgcaagctgcttccccatgcgccagaatgcatgaacgcgtggactatacaagttgacccggtgaaagacgatggcggcgccgacgcagcccttgtcctccggtggcgaaaagagggtcgcggcgaccatgacgatgtccgtgtcgaaggctggtctccccgtgaagtcccagcgggcgatgtcgggtaggtagaaccgctgctcggtgcggaggctgaggagcgcgtggcgcttgatctggccgaatgcgaggaagagccagccgccgccgtacgtgccgaagtagcgcgcggcgcgcgcgtcgtccgggatgccgaagcggtgtccgcggcagccggcaatggggcacgagaaggaaggcccgtctgcgccgcgcgggacgaggatccacgggagcgggcgctccagcgggtgctgctcctccttacggcggctcgaaattagacttgcatatttgtatagtgtcttatattattatggtctatcttattaaattttataaaatttttatataactatttaaattacatgcatacacctaggtgtggcacctaagtgtagaaaatactttcgatcgcgtccctgctcaaatccgacggcagcgaactctggccgaaggccttgccagcaaaagatggatccaggacattcggggcgcgctggggatacaggctatcctggaatatcttcaactttggtcgcgtttgcaatcattccagctcgaggattgcctggatcgttttatttggaagtgggagagctcaggtcactactcctccatttcagcttataatgctctcttctttggtcggatcccctttcagtcgaaacctatctgaaggtctctaccaccccccctcgatgtcgttatttcctctggttggtcgccctgaggcgctgctagacgacagacagactgcacaccaaagatcttccacatccggatctctgtgttctctgcgagcaaagcgaagagagcatcgaccaatcaatttctgggtccgttacgcgcggcagtttttcggacttcaatttaaattcactcatgaccgttgagcttcacctggcgttatcgatcactccttgtctctcggtcctcacaccgagaacgatgacaacctcgacatcagaagtcgcgatcggtttcgcgagttcatttaagcagaagtcgggggctactgtcagggttacgggtaaggtataccctctacccttcgatatacgtcacatatcgatatggtatacttgcgcgtatacggacattttcggcatacgttaaggaaattcattatggagttcacagatggaaggagtcctactcggatataactgggtcgtcattgtatcgtaccgggtccgatgtctccgagtcctacttggagaccagttgacctgcggtataaaagggacccccgggaggacctaaggcatcgaatcttaccgccaacacatccaccacagcctacgaagccggagcctacaggagccaagtcgccgggtgatctaatcgaatcaactcgactacgatctcgtcggtatcgtcgagttccactatttcctttgtaatctgtggtttccatcatataatcccatatcaactggattagggctattacctgtcaaggggcctgaaccagtataatctttgttttctgcctactagatgtcgtattacgtagattctcgtaccggcgtaccccaataccctctatatccgatctacgggtatcccccgtcgacagtggcgtgccaggtagggggacttggtgctcaaggttctactactatgacatccagcttcgtcgacaacaacgtcaacaccaacctcaaccaaggagttcctacttcaacaatgctggtaaggactcaagtcggcgaaatcgtcttcccggtttacaccacggtgccgatctcagctggtccatcaatggccggaaacgagaacgcagtggctacaactcagggcgattccatgttgaaggatcctcccgccgaagcggagatcagaacgtcgacgacatccgagcccgagaaggatcctagtgcggccaagccttgtctttccgacaagaatcacgagccgacgaggatgaattccgaggtgacaaggtcctggtgtcctatccacaaaaccagaaaacacaccttgcaagcatgctgggtttttctcaacgtccacgctaaaattcgtgcctgcaaagagcgtggaattcagcgtacttctccaactcgtgatgtctattgtcctattcacaagacaaagaatcacgacctctcaagctgcaaggtctttctcagcgccatgaagacgccacctcctaaggtccagcagtcacgtgtccccctcagggatgaggacaaggaacaaggagcgacactgatttcagatcgatttgttggggtaatcgacatcgatccccacgaaccatcagtcttgcacctgctcgaagattatggctcatcgtcaacgagtacgccgtgcgaggtattggctatcgacgagactggcacgtcagcgcacgctaatgcggaagcggagaatcaagtgactacaccggcccagcacccctacgatcccgttctgaacgacgatctcgcacgatggacagaacggttacgggaatcagtgaccaacctcagcaacgcgttcgaagaggccgctgctgcagtgcacccggaacagccaccaactggcgatgctaatggtgagaaccctgaacagtgggaatcgcctcatcgagccacccctccacctcgcggcaccagcgatctccgcgatcacctgaatggccgccgagaggcgtgacgcacacgagacaacgagaaccgctcccgacatcacgtctcttaacggcgtcacgacaacgaagaacgaggaggctgttcgagcgaagaccgagaccgtgttaaccgccacaaccgccacaatcacgacgattgcgaacggcgggtactgggcgatactggtcaaggacgtcgccataatgacgacgatgatggagatcggcgccgagacaacaacgggagacgacgacaggatcctcgagaacccggccaacgtcctcgtaatcatacgctggaaccaagcgacccatcgtcatcgtcatcctcctcctcatcctcatcatcagatagacatccacgaaggacgtacgattgccgacagcccactgcccctagcgctgggtgtagagctttcggtcgttcacttcgagatgtccgatggcctgaaagattccgaccaggagcaatagagaaatacgatgggagtaccgacccagaagaattccttcaggtttactccacggtactctacgctgccggagcggatgacaacgcgttggcaaattacttgccaaccacattgaaaggctctgcgcgttcatggctgatgcatctcccccctactcgatttcttccaaggaacttacaagcgccacgcgatcgaagacgacctacatgcgttaacgcagaacccggatgaatcctagagggattatgttcggctccttaatgagtgtaggaatacaatccccgagatcaccgacgcttctgtaatccgcgccttcaagtccggtgtcagagatcgctatactacccaggagctggcaacgaggcgcatcacgactactcggagattattcgaaattgtcgatcgatgcgctcacgcggacgacgcactaagacgcaagaacaacaaaccgaagaccggaggggagaagaaaccagtcaaggacgcacctgagtcaagcaagaagaaaaatcgcaagagtgggaaaaggaaagctcaagcggatgttctcgcaacagaatacgcagaccctcccaagtgcccagactcacaaggcagcgacacgaagaaaacatggtgccttatacacaagtcagacaaacactctctagaagattgccttgtcttcaaaaaatcgctcgcaaaacacatgacattggaaaaaggcaagcgagtacgtgtggtcgagaaggacgctgaggcggttactcaggaatcggactcagcatacccagactccgatctccatgtctcgcacatcttcggaggttccacggcatacttctcaaagcgagaatacaagaaggtggaacatgaagtctgttcgacgtagcagggggctgcgcccaagatgaagtggtctgagcagaagatataattctcagaagaggaccaccccaaaactgctgtcatcccagggcgatatccgatcgtggtcgaactcactattcagaatatcaaggtcgcatgagttctgatcaacggcggtagctcaatcaaccttctcttcgccagcaccttggacgcgatggggatcccacgaagcgagttgacacccaccgatcaacccttccatggaatcactcctcagtcatcgtccaaaccattgggcaaaattacattgcctgtgactttcggccaagcaaataacttccgaacagagcagatcacctttgatgtcgctgaattcgatacagcatacaatgccatcattgggagaactgcactcgcgaagttcatggccgcatctcactacgcgtatcaagtgctcaagatgccgggaccgaagggaacaatcagtattcaagggaacgctaagctagcagtgcaatgcgacaagcggagcctcgacatggtcgagcacacgcccagcccacccgacacagctgagccacccaagaaagtgagcagaacaaacaaaacgccgaaaccggacggcgcaatcaagatcgttccactctctagtgccaaccccgacaagaccgtcaagatcggggcatcactaggcgagaaataggaactcgcgctcatcaccttcctccgcgacaatgctgacgtgttcacttggcagccgtccgacatgccgggggtacccagggaggtgattgagcacaaactcatggtgcgacccgatgccaagctagtaaagcaaaaactgcggagatttgcaccagatcgaaaacaagcaatacgagaagaactcgacaagcttctcaaagctggtttcatcggagaggtactccatccagagtggctaaccaacccagtcatggtacggaaggccaacggaaaatggagaatgtgtgtcgatttcaccgacctcaacaaggcgtgtcccaaggatcacttccctcttcctcgaatagaccaactggtggactcaacagccggttgtgagttgttgagctttctcgacgcttactccggctaccaccaaattagcatggcgaaagaggacgaggagaagaaaacattcatcacgccgttcggactaataactgctggaaacactttccagcgcacggtccaaggtgcacttagcgaccaactcgaaaacaatgttgaggcctacgtcgatgacattgttgtcaagaccaagacaagcgactcattgattgacgatctgcgggaaacgtttgacaacctccgacgatatcacctcatgctcaatccagagaagtgcacgttcggagtaccatcgggcaagctgctcggtttcctcgtctctggtagaggaagagaagcaaatcccgagaagatgaaggcaatcgagaacatgaagtcgcctacaagactctaggaagtacagaagttaaccggatgcatggcggcactaagcaggttcgtcactaggataggagagcgaggacaacctttcttcgctctgctaaagaagcaagacaaatttgtatggacacaggaagccaaagaggcattcattgcactcaagcgctacctatcaaatccccctgtacttgttgccccccaacctaatgaagaattatttctctatattgccgccacgccatattccgttagcactatcattgttgtcgagagagagaaggtacaacgaccagtctactatgtcagcgaagctctgcacgacgcaaagacaagatatctacatatccaaaaactgctctacgcggtaatcatgacatcaagaaagctacgccactactttcaagcccacaaggtcatagttgtatcctccttccctctcggtgaagtagtgagaaacaaagacgttgtcgaccgcattgcgaaatgggtagtcgagctaagccagtttgatgtctgctttgtgccacgaacaaccatcaaatcccaggtacttgccgacttcgtagctgattgaactatgcctgataataggtcagacaaccaaatcgacaacgaaacgtggacaatgacgttcaacggtgcactcaacagccaaggagcaggggcaagattcatcttgacatcacctttgggagatcaattcaagcatgcaattcacctcaacttcagggcgactaataacacagccgagtacgaaggactactcaccgggataagagctgcagctgcactcggagtcaggcgactgatcgtgaaaggggattccgaactagtcgcgaaccaggtgcataaagattacaagtgttctagccccgagttatccaagtatctcgcagaagtcaggaagctggaaaaaaggttcgatgggattgaggtccgacatgtatatcgcaaggacaacatcgaaccaaatgatctagcacggcatgcatccagacgagagccactcgaacctggcacctttctggacgtcctgacaaggccatcagtgaaagacgcaggcggcgaagatagcccggtctccctcaacaacagctcgggggctacagaggcagagcgcgccgttgccgatatcgagaccacagacgactggcgcaccccactcatcaaattcataggcagcgaagagttgcccgaggacgacgcagaagccgagaaaatatcccgtaaagcaaaagtctactatatgatcggcaatgatctatacaagaaggcaccaaacggggtactcctaaaatgcgtcttgtccgacgacggcagacatctcctcctcgacatacataaagggatctgtgggtcacatgccgccggtcggacattagtcggaaaagcttttcgataagggttcttctggccaaccgccctcaaagacgcctgcgacatggttcagcggtgtgaagcctgtcaatttcacagtaaacacacaaagctaccagcgcaagcactccagactatccctctcacttggctgttctcgtgctgggggctaaatatactcgggccattcccacgaggacagggcggctacaggttcctattcgtggcgatcgacaaattcactaagtggatcgaagcgacacccacgggggaaatcaaggccgacaacgccatcaaattcatcaaagggatattctgcagattcggattgccccaccgtatcataacggacaatggctcccagttcatcagtgccgatttccatgattactgcattaggttgggagtcaagatttgcttcgcctcggtttctcaccctcagagcaatggacaagtcgagagggcaacggcatagtactacaaggaatcaagactcgcatctacgacatgctcatgtcacatgacaagaagtgggtcgaagaacttccatcagtactatgggccgtgcgtaccacaccaacaacgtccaacaaggagacacccttcttcctcatgtacggctcagaggccatgctcgccaccgagctacaacatcaaagtacacgagtacagaagtattctgatgaggatcaggaggagcaacaaaacgatgatgtgaatctactcgaggaacatcgcgaacgagttgccgttcgagcagctagctaccaacaggcccttcgctgttaccacgagaagcgcatccgagcacgcacgttttcaatcggcgactacgtcctccgacgggttcaaagccaagcagggtgaaacaagctctcacctaaatgggaaggaccgtacacgatcacacaagttctgcggccaggcgcattcaaaattacagacggcgatggtcgcgagttggcaaattcctggaacattgatcaattacgtaaattctatgtataagtcaatagtatccatacttgtaagacatcttacagcttcaataaagcctattttcaggcccagaccacaatcaaagtgttccttcccgatgatcccttacccatatgacacctactgttaaaacctatcctcatgtccctttacgccgtcttgacaaggcctccaaggaacctaacggaacttcggctggggatgcccaaagccgataaggccttgtcggatcctgtagagacgaaagaccatgtaagatctggtcgtgtaagagttctcgccgtgcgtattaaccaagccgtgtaatcggaaataaactttccaacttcacggctgggggctaggatcagtgcttgttcaaccgaggcaggtcaaaagtccaagagccttatcttccgagaagaattctccgatgacaaggctgggggctagggagagtgtataactcaaacgactgatcgaagtcgcgaagtgagaagacactcatacacgctacatccagagtaagaaagcttagttagatatatttcttttctatttcacaagtacttcttacaattccatcaaaatccaaaattatattacacttttttcctaagacatttatcacaggatacggagactaccaggaaggccaacgatagtccatcgactggaagaccttctccgccagcggcgccatcgacttcgccaggccatctatctccgtaggagttctccgagaacgagaaaacccttcgcggaggaactcgaggtgcagctgcggacgatgttctcgtatgcaagccaacacatgccccctggcatatcggcttgatcgacgacactcctacttcaaggcctcgtcgatacgttcaccgatgccttcgagctgggcgtaggccctattcagccacgagatgtattcggccgccgattccttgggatccccacggggtactcggagctctctacagactcttgacatggacgtgcagcaactcttcagatacgagttgaaccacacctcacgacctcagagtgtctctacggcctggtccttcttcacttccagtatagtcctctcaagttccgcgacctcaaacttcatcctccaatactggatgcgatgatcctggtcagtaagcgcactctcgaggtctgctcagcatggaaacgattaagtcaagctgctcttctctcccgagaatacaacaaatcaattcgatccagacggaagagtaaaggaaatgataacaaagacaaccaaccaaagggagtcgttgccatgctcgtttccacaggcgaactttgatctacattgccccccggcacatgtggctcgaacgcaagtgccggaacgatcactggcaactcaggctgtccgcgttgctagacatcctcgacatcaacatctctacaaacgacaacaaattaatcaagatcacaatgctaaagaaagctaaggtgatgaccgcacacacaaacgcagttggaaccaataagagttttacaaagcatgactaaagagtacaagagagctaaaatactactcttcaaaaagtgggaggacggactcccccagattgccgacctccatcacatccttgcgcgcatcgctagccgcccccctgatctaagatcttccgcaggtcgagttcaggatgcgccagcctcacacacgcaaggacatggcatgccctggtatagatcccgttggacgtctcctttccgatcctggccgcgtgcttggaggggatcgcctccatcgccgtcgccagttccgcaatcgaagacgtcagcgagaactcatcgggattcgccgggatggtggccttgacgccgcactccccggtgagctggtgcagaccggtgtaggtgacccgtagtgagccacgaatctccgacaagtgttctcaagctccgacatatgatgctcgagcccttgccgttgtcgctcattgccagccacaagctcccgcatcttctggatgtcctcgcgaacctccgccagatcacgtgtcagccggtcggcgcgctcattcgccgacgacgccgccgccgctgtcggtgacatggggtcgggggtatcgtggctagaggcttgggtagccgcggtcattcaagcgggctgaccccctcgggggggtcgggcccgaggg

SEQ ID NO: 2436 - DNA, 21878 bp, Oryza sativa
  unsure (1)..(21878): unsure at all n locations
ttggctggatgacgtggccaacttggtcatgacggcacggcagcgcctaggtgctggtgggcggtcctccgccaccaagacctctggcgctgctaccaccggctccgtatcgtcaaggcggagggtgcggcgagcggcgctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcttcctcatccggagcgccacatcggtccgggcacggggatcagccccccgtgtccccggttggcggtgccggctgtcgagcctttgtggcgagccttcggaacgcccgttggcccccaaggttccggcccaccatcaccgaaaaatacgacagaagcgtcaaccccgccgagtttctccagatctacacgaccgggatcgaggccgccgggggtgacgacagggtcatggcgaatttctttcccatggccctgaagggtcaggcgcgggttggctaatgaacttgccacccgcgtcggtccactcttgggaggatttgtgccagcagttcaccacgaacttccaaggcacatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcaggggggacgtgcggcacaaccgcatgctcgagaagatcgcctctaaggagccccagaccaccgcgcagctttttgagctcgcggaccgtgtggctcgcaaggaggaggcctggacctggaactcctccggctctggtgtggcagctccggccgcccccgggtccgccgctcggtcagggcggcgagacaggaggaggaagaaggggtcggcccgttccgacgacgagggtcatgtcctcgccgtcgagggcgcttcgtgggccccccgaaaggggaggcctgcgagcgacaaaaagaaggaggccggcactcccagcagggagcgcccgaccggcaagtggtgtaccgtgcacaacacctccctccacgacctcgcggactgccgcgcggtcaaaagtttggctgagcgcacgaggaagtgggaggaggagaagaggcaggagcgccgtgagggcaagtccccggcggctcccgccggcaaccggcgaagtgaggccaagcagaaggccaccgccgagggcatcgacgatggcgacgatgacctggggttccaggagcccgaggccaccgtcgccaccgtcgatgggggagcgtgcgctcacgcttctcgccggagcctcaaggccatgaagcgcgagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaacgtgaagttggggcgtgtcctcatagacgggggtgcagccctcaacatcctttcccccgctgcctttgacgccatcaaggccccggggatggtgctccggccgtcccagccgatcatcggtgtgacgccggggcacacctagccgctgggtcatatcgacctcccggtcaccttcggtggttccgccaacttccgcacggagcgggtggacttcgatgtggcggacctcagtctgccctacaacgcggtcctggggaggcccgcgttggtgaagttcatggcggcggtccactacgcctatctccagatgaagatgccgggccccggtggccccatcaccgtccatggcgacctcaaagtcgcgcttgcttgcatggagcagcgcgcggaccacctcgccgcggcgtccaagcccgcgggtggcgacgagaggcccagcacctccgtcccggccgccccaaggcggcggatggtcacgtgcgacgaggtcccggtcaaggaggttgccctgggcgacggcccgtccaagaccacacgaatcggtggtcttctggacgacaaataggaagacgcgctcgtctccttcctgcaggcaaacgccgccgtcttcgcctggagaccggcggacatgcccggggtccccagggaggtgattgagcaccgtctcgccgtgcggccgggcgcaaggccggtccggcagaaagtgcggcggcaggccccggaacatcaagccttcatccgcgagggggtggcgcgacttctggaggccggattcatccgtgaggtcatccatccggagtggctggcgaacccaatcgtcgtccccaaggcgaacggcaagtttcggatgtgcatcgactacaccgaccttaacaaggcatgtcctaaggacccttaccccctgccacgcatagatcagattgtcgactccaccgcggggtgcgaccttttgtgttttctagatgcatattctggttatcatcagattcgcatggctagggaggatgaggaaaaaactgcgttcattacccccataggaacttattgctatacgacaatgcctttcgggttaaagaatgcaggttctacttttcaacgtactactcgaatttctttgggtagtcagataggatgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggtcaaccccgagaagatacgagctatagagcggatgcgccccccagcaagcttagggatgtgcagtgcgtcaccggcttcatggccgccctaagtcggttcatatcgaggctgggagagaaggcactacccctatttaagctcctcaaacgctccgggccgtttacctggacggaagaggctgagcgggccctcactcagttgaaggcgtacctcagttctcccccagtcctggtcgccccggagccagatgagccgttgctactctacctagcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccgaggcccccgacggccggagctggccctccgcctgcttgtccgatggtgccaggcgcccccgacccccaggatggccccgaggccactacgggaaggccgcgcctgtcgccctctgaccccaagggcgtcggcacagaagccgagtgcgccccacgtggcctctcggacgaagagcgccctggagttgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattacttccaggcgcatcggatcacggtggttacatcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccacctcgggcccctcgcagctgcctcacaccgcctactgggtgatgcagttcgacggctccctgtctctttagggcgccggtgcgggggtcacgttgaccttgccgagcggagacgtcctcagatatctggtccgcctagacttccgggcgaccaacaatatggcggagtacgagggactccttgcgggactcagagtgacagctggactggggatccgccgcctcctggtattaggcgactcccagttggtcgttaaccaggtctgtaaggagtaccggtgctctgacccgcagatggacgcttacgtgcgccaggtgcggcgtatggagcgccatttcgacgggatagagtttcggcacgtatttcgacgggatagagcttcggcacgtgccccgacgaactctcaaggctcgcttcctcgcgagcccagaccccaccgggcgcctttgaagaaaggcttgcccagccgtcggcgcgacccgacccccaaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatatccatgaaggcaagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcacttaaattcatcaggggcatcactgctcggtttgggttgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcagaaatcctcaagggcctcaaaaccaagaccttcaacatcctcaagaagcacggcacctcgtggatcgaggagctgccgacggtgctctgggcgaaccgaaccacgccaagccgagcaaccggggaaacgcctttcttccttgtctacggcgcggaggcggtcctcccatctgagctcaccctgaggtcccctcgggtcaccatgtattgcgaggctgatcaagatcagcttcgccgagacgacctcgaccatttggaggagcgaaggcggcgcgcggccctccgaaccgcgcgctaccagcagagcctgcggcgctaccatcagcgccacgtccgggcccgatcactctgcgtcgacaacctcgtcctacgccgcgtacaaacgcgtgctggactgagcaagctcgcaccaatgtgggagggtccgtatcgagtgatcggggtcccccggccgggcttggttcggctggccaccggcgacggcatagagctacctaacccgtggaacatcgaacaccttggtcggttctacccctagggggggtcgggtgtcatgtttagggctcgggccaaccccgcacccccccgggcgtacagggttggccgggggctaccacatgcatatacttaccttttttctcttccgtatttcaataaaagcattttcgatttcctgaggactgtgtctgtgccatcgtttccttttgaagaatcttggcttgaattagtacgctcgtgcccgaccctaccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcctggccagtctcgacacgtggatctccccaggcactagctccgacccgcgccgtttgaggctgggacctaggcacgagcccttgttcaagccaagacacagaaggaccgcggcacagaccatcctcgtctcatacacacaacaaacagaactgacgcagaaatttcctctttacttgattacagattaaatcagtctatacaagaagggggcccgaaggcctcggaaaaagaagaaaaagttattaagattggcgggggcctgggggctcactccgacgcgcccgggtcgccgtcctcgtcgtcgttattgtccgcaccgtcgtcaccgccctcctcgtcagagtcgagggcgaacgcgagccgaggggccgtaccctcgaagctgtggacgatgtggtcggcggcatcccggacctgcgtgcgcgcgccgtcctcggttccgggagggaactcttccagcgctgcccacggggagaagtcagggtccctggcctggtagcttgccagtacgagctccaccgccccccgggcgaggtctctcgaggatgacttgatcgtctcctcgagctcctcggggagccgccggagggccccagccatctctgagaggcgctgggcgagacccccctggttggcggcgtacttcgcgcactgcccgccctagaggcccgcctgccgcccggcgcggtctagacgggagacggcgtcccgaagcatgccgggccctacctcgcccgccaagcggagggcctcgacctccccggcggacgagttcagcgcgccctgcagctcggcgatggtgtgttcggcggctgcgaggcgggcggctaggtcgccgtcgcccgcggccgccctgccgctgcgcgctctcgcgtccagctccttcgcccgcgcctcgagctcagcggcccgctgatccagtgcggccctctcggtgcgggcgccttccagattacggcgcgcctgctcctcccgccgctgcgccgcggcctcggcctcctcgagagctcgctcccgctcggtgagtgcgtcctcgcggaggcggagtgcggactcctcttcggcgcaggcggcctcgtgcgccgccaatgttgcctcccgggtggcgacggcggcctcgcggtccgccagctctctctccttcgcgtccagggcgcgggcgcgctcctccagcgccgtggcacgagcctcaagggcctcttcgcgctgccgggatgccgcctcgttctccgccgcccgccgttcccgggcagcggcggcgtcaaggactcctcgggcagcgtcgagcttcttctctagctccgccgcccggctcccgtattgaagatggaggtcgtcccgcgcctcgtcgagcacggcggtggcgatgagggcagtctcccgctcctcctccacctccctggcgatctccgccaggtccctacgacgggcctcgagctctgaggcgtgccggcggtgtgccttacggcccgcctccaccaaggcctccaccgagcgccgcccctcctcgacgcgcgcccacgccgcgtcgagctccgcccactccgcctgcaggacctccatctgggcacttaacccgtccagcaccgtgctgttcgcggcggccaaggcctgcaggaggggctctgcgctcagtggggcagcggaaggcagaggggagagacgcctcggtgtgggtgccgcgcggctcagccaccgatcgacgtgccggactcgggggcgtcccccgaagctggctcgtcccgagcgtcgcccgaggggtcgggcccgagcggcgcgcccgcagcctcgtcgtgggtggcttcggaagtcgtcgtcgcctcgggcggaatcgggtcgggggcttggcaggacgcctggcgtgcgcgcgccgcctctgcatcccggacggactccccggcccggcggagtctggcctcctcccgagcggcctcctcagcctggcgaacccggacggcctcctgggcagcctcctcggcttcctggaggcggtccgcggcttctcgccggtcagcttcccgccaccgggcctgcgcggtcaccgtctcttcggcctcagaccggccggacttggaatggcgggggggggggggggggggcgacgggatctcgctgaggcagaagaaaaaccagaagacaaaaagaaacgggtgagtgaaaactcgccttgggagatgggagaatgaatacggccgcggtgggcgcggagacgaacctgcggggaggtcggttaaatgaccacctcgggggcgagatgaggttcccccggcatggctcggtcccccccatcttgcggagccgtttcttctttcgctcctcctcgggctgcggcgtcggcacggcaccctccgggcgcctgctgctggcacgcaccgccccgccccctcggggaggagatgggggaggggtaccctcctgcttcctcttcccccgggcgtcggcagggcggctgccccccgggcccccgtcgcggggccctgaagcgcgaccccctcccggggtagattgttcccccctgcggctcccgcccgcgccatcgtggcctcggggggcccgctcccccgacgccccgaccgcctgcatgatggtcaggatgttggcgcggtctggatcgcagcagagggggaggaccccttgggggatgagggatgcctctacggagctgagattcagcacccgttggaccaccatcttgaagtcttcagggacccagtcccatttgcacccctggtgggtcctcatgtagtcctcggacccggtgtactcccaggcgccccgggcgcgccgctggagcggcgcgatccggcgacgaaggtagtcgccgaagaccatggcccccgtgagcccctgggatcgcagacccgccaggcggtcaagaacggcgtcgtagccgtctcccagatctaccgccgcccgccagctggaggcctgcgccgggggctggctcggaagtcggaggcgcgcttcgtcggcgaggggggtgtagaaccagtcgctcttccagtcgtcccactttttgcggaggacgcagggaatgtagcggttcagcaccggcccccgcggctggaagtagcaaccaccgactaccgtcggcggcgacaccggctgtacagtgaagaaccaccggaacagccggagagatgggcgcaccccgataaacatctcgcacaggtgcgcgaagatggccaacgtcattatcgcgttgggggtgaggtgcgccatctggagatcataaaactccagaatatccatgaaaaaagtagagaatggcgggaccagccccgccattgcgaaagagaggaagaagacggaccgccctgggtagtgtggcgccgggcgtccttcgcccagcgcgaccacctcccggccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcgagggtagggcacaggagacgaagagttggagcgccccgaccccctgaggttttggcgccacgtgtgtgggttaggtgagcacagcggggctcacctaaccgcatttatagcgggttggacgagcgcgccacgccgcatttaatgcggcgcagcgcatgcttatccggtccgtgaccggtcgcggcgtgtgaccggtcacagaccggtcagatcgcgggattaggtggcaacaggcggcctgtcacacgcctcgccccgtcccgtcggaatgatgagagtttcctggctctcgtccctagtcggagccggcgtgctcactcctgtagttggtatgtcagtcccggtcagattcattccagacttcaacgcaggcatggcaaggaagtcgctggccattaaatgaaggttgaaatgggcgtccaccggaaaagcgggcgagcagggcaggaagcgtgtgctctgcttgtcagaagtcatttccggctgtagactagccctcattgtaaaaagcatgtttcctttcttaggcagctagaggcccatgtggtgacccctgatcagataaaaaggaggcccaggcctaaaagaaagaggagggaaaaaagaggaggaggaaggagtgctagagcctgaacggtctccctcgctctccggctctcggtaattcttacacacacagatccaccagaacacaggagtagggtgttacgcttctcagcggcccgaacctgtctacgtcgcccatgtcttgtgcatttcctctctcgctgaagttcctccagatcgagggcgaagaacctcacttagcgcccccggccgaaccggcaaaggggggcctgcgcggtctcccggtgaggagccccacgctccgtcagccgccctcgcctctgtgatctcgcggctaatgctgcgagcaccagcctcgaggaggcgccccatctcgacctggagctcctcccaggtgaggacggcagccggcggaccacgaccagccacgagatcgctggctaggccgctaggtgtcgcctcgtggctcctgggcacgaccacgacatccgtcgaggccacagcaggagacgcgctggaggtccccctagacccgtcttgcaccgccttcgcccgcgccgccctgcgaaaggctgcaattgagacagactacaagagtttgacgaagtcacgaaacctcaaattcattcacttacttctcgccgagcgtcacaagccgctgccgtcgcggaggcgggggagacgcatccgaggcctggagtataacgtatatgaggtgaggtggaagtttcccgactatgcgatgaaagaccaggagagcttaccgagggggtgggcgtcttccgacgatgtctgatcacagaggagaatttcctcccctttttcggaacattgccatcactcgttgtggcagcagcggcagcagcgtcagacgcctccttggcgactttctccttcagcgacgtcgccacctaatggtccacgagcggcccgatgatatcagttagagggagagcctacacttcatgaagtcatgatgtgatcccgaaagaaaaatgcaaaaggaccgctgagtgcacttacatagttggcagcttcgcgctcggctgcccctttctcgcaaagggggacggggacgttgctcgccgttgttgggccactgatcatcagttggctgacgcggcactccacggttgcgctgtccaagcctgtagatcgagaccagaattcgataagtcgggaagaacacgcacataagggagtcaatttaactaaaaaaaataccccgaggagaaacccgggtcgcgtcctccggcccagaataatcaaaggctgggtgggcccgagcctggagcggctggatccgcctatcaatgaagtcggcagcgacttcataccccgacaatccccgtactcggaggtcatcaatgatatcgatgaaagattggagggatggggtcaaggtggatttggcggtccaagatgaaatcttgtctggttgctcctcaggaacaataaagaccggatccgaatcttctatctgaagatagaaccacctcccccgccatttgctgtgagatgaggggcactagaaggggggtgtatcgcgacttcaggccatcccgaagtcggaaaccgacacatccaaacacctttttaggtttcatccagcgcaactcatagtaaaagcggaagaggtcaagaaacggctctaccccaatgtaggcctcacaaagatgcgaaaagatactcaggaaggcgacggaattgggtttcaaatggagcaaggaaaggccgtagaaattcaagaccaagagaagaaattcagaaggcggaggaagaaaaccacagagaataaagtcctcgatcgcaaccatgcgacccaggacaggctggggttcagtacctcctgcttctctctccatggttccgcgactgggaagggcgccatcctcctgcagcttcttcagcgatgcgctggtagaggtagacttgtcgagatccattgctgccggggatcgccggagaaaggaccgagatgagctagctagggtttttgtgggagcggagaagacgagggacacttggaggctggagagttttttcacaacaggcggacttcaaattggatccccaaaactcccttaaatagacgcacttccgacggtgtgaattctaaggaaaggagagagatggccgccggaaatttctgggtctgttacgcgcggcagtttttcggacttcaatttaattcactcatgaccgttgagcttcacctggcgttgtcgatcactccttgtctctcggtcctcacaccgagaacgatgacaacctcgacatcagaagtcgcgatcggtttcgcgagttcatttaagtagaagtcgggggctactgtcagggttacgggtaaggtataccctctacccttcgatatacgtcacatatcgatatggtatacttacgcgtatatggacgttttcggcatacgttaaggaaattcattatggagtttacagatggaaggagtcctactcggatataaatgggtcgtcattgtatcgtaccgggtccgatgtctccgagttctacttggagaccagttgacatgcggtataaaagggaccccccgggaggacctaaagcatcgaatcttaccgccaacacatccaccacagcctacgaagccggagcctacaggagccaagtcgccgggtgatctagtcgaatcaactcgactacgatctcattggtatcgtcgagttccactatttcctttgtaatatgtggtttccatcatataatcccatatcaactggattagggctattacctatcaaggggcctgaaccagtataatctttgttttctgcctactcgatgtcgtattacgtagatccttgtaccagcgtactccaataccctctatatccggtttacggatatcccccgtcgacaccctccgtcccacattatatgggattaggggttaaaagcgtgtctcataatataagggatcgggtaggcagagtactaatccaaaccgacatataagaattgtttttttaaaaaaatatatttcaacatcgtattgcaataccttcgaaagaattgctcaggatatattgagattgacgaagtcaccatagacatcttgctatcgacgggtgcattgccttatcactaaaaaaaataattagccgtaaattcgagcacccgtgttaaatctagaatttaaacctggagggccagttcgaccacaagaaacctaaagttgagttacgctcacttcgcaatccacagtaatacataccaagcttgctctgtgtaagcacagttttttgaacaccctacacgatggtctttaaaaaaacgctaccttcatcaaaattttgacatcaattaaatgatcatgtattaccaaaattttgacaatgcctaatttttgaccgaattttaagttaacaacatttcgctaaattcacataggaaaaaatacaagttacaaaagtccaaaaggagaccgtggatgacgactacctggcacgacattgggccaccaccgccaaccctcccaaccactgccagatgggacgccaatacacagctcagcacccacccccaaaagtccaaaaaaacccagccaattcgctcatttccattggacgcagccaactccgcgtccgcaaagaaactagtctacgccgccgcctcgccaacctccccacgccggccaccgccgcacgggctccggcgacgaacgagggcgctgctctcgagcgcgatggggggccggaagcgcgcgctgctggtgggcatcaactacccgggcaccaaggcggagctcaaggggtgccacaacgacgtggcccgcatgcgccgcgccctcgtcgaccgcttcggcttcgacgaggccgacatccgcgtcctcgccgacgccgaccggtcggcgccgcagcccacgggggccaacatccgccgggagctcgcgcgcctcgtcggcgacgcccgccccggggacttcctcttcttccactacagcggccacgggacgcggctgccggcggagaccggccaggacgacgacaccggctacgacgagtgcatcgtgccctccgacatgaacctcatcacaggtgattgctccgcgcgctgctgtctacattttttttgtcgtcctgcttcggaattggggatcgaataggcgagatttgagagggacgttgtccgattgttacgtgacatgacttatgttcgaatcgtgctcagtgtgctatatgaaaaaaagttgaatttgatgggttatgaggcgacttaagttttgggatctaatgggccaaccactagtaattttgctactgaaatggacaaaaagctgaattcaacaacaccaaagattccgtatgatagtatttggtttcttttctgaaaatgttgattatgtttcttttaaatgtggaaaatgttaatatttcgagtgcatagaacctccatgctgtctataaaccaaagttagtgtacatcacacatttctgatacaataattatatctatacctgctatcccaactcccaagttggttgtaggtgagtggagggaaaagcctgaagccgaactaacacttgatcagaaggctctgattcagatcaattgaaccaaaatgcccttttagccacaaacaattagccaggccagattagaatttgccacttggtgtcctgcctggtaaatttaggtaacttagaataggatatgctcttcctgtgattccttcttaccgttaagttatgatttgattgttctacctctggtttcaaaattttaggtagcaagaaaaaaattatcaatcttattcactgagatagaatagtggcttacctatcttttttgaacggaagtagcttacctatctgattctgttgtcaagagcatacatcaatctttggtagagtagtagctcatctatctgattatgtagttaagagcattcatcaatcttgttcactgattcactgaagtagattagtagcttacatgtcttattctgttgtcaagagcgtcctgattttcttctgtaccctgcagaccaagatttcacagaactcgttcaaaaggtcccagatgactgcttattcaccatagtatctgactcctgccacagcggtggtctacttgacaagaccaaggagcagattgggcacagcaccaagcagaaccaggcccagcagatcaagcgagaagaacgttctgactctggcaccggcggtttccgatccttcctcaaagaaaccctcaaagaaacagtccgggacgcgttcgagtctcgaggagttcacatccctcaccagagcagccgccgcaacgacgacgaggatgaggagccacacatgggctcatcctcccatggtggcgatcgcatcaagaaccggtcattgcccctctcgacgttgattgagatgctcaaggagaagaccggcaaggacgacattgacgttggctcgatccggatgacgctgttcagcctcttcggtgacgacgcgagccccaagatcaagaagttcatgaaggtcatgctgaccaagctccaggagggccagcacggcggcgtgatgggcttggtgggcgccctggcgcaggagttcatgaaggctaagctggagggcaaccaggaggcggacgccctcgagccggccatgaaacaggaggtgcacagcgtccacgaggcgtacgccggcacgacggcgagnnnnnnnnnnnnnnnnnnnnntagcgggtgccagaccgaccagacatcggcggacgccacgacgcccaagggcgtgtcctacggcgcgctcagcaacgccatccagaccatcctgtcggagaagagcggcagggtgacgaacaaggagctcgtgctgagagcgcgcgagttgttgtccaagcaagggtacacccagcagcctggcctttactgcagtgacaagcacaccagtgtggccttcatatgctgagagcctggaacatcagctgtgctgcgtggattgctacatatgcgagaatcttccctttcccctttgatgttttacattgttatggagtatggagtctatttgttttttaaatgaaagacaacatggagagtggtcgactgttaatatcaagagaagatgttacaaaatgacagtaaaataatcaccaaatcccagccaccgggaaatgcgatttgtttgtcatcacggccaccatttcactgtcagatccccggtggtctccatcagtccaccacaaaaaacatgttgctaaaaaggctgtagaatggcagcctccagccaacctggtcaggcactcaggcacaccagccgatctgccagtgtcgagtggcatcactagccaatacaagaaagcgcgcgccctggcagcgacgatcacctcgcgctaccgcactcatcactcatcagagctccaccaacccaccacaaaactgccactctgccagtgccaacctatcggaacggcagctcgccgccccaccaacccaaaccggtgtcccggcagagtgcacacacctcgccggctcgccggtgctcacagccgcggtggcgattgatcgatcacatcgccggcgacgaacacgacgatggggcggaagagagcggtgctggtgggcatcaactacgccggcacggagggggagctgaagggctgcctcaacgacgtggcccgcatgcggcgctgcctcgtcgaccgcttcggcttcgacgaggccgacatccgcgtcctcgccgacgccgacccgtccacgccgcagcccacgggtgccaacatccggctcgagctcgagcggctcgtcggcgacgcgcggcccggggacaccctcttcttccactacagtggccacggcttgcagctgccgatcgagaccggcggtgacgacgacgacaccggctacgacgagtgcatcgtgccctgcgacatgaacctgatcaaaggtgatatcggagacaaacacctgatctctcgctaacacccagtatatatggctatcactcatttgacacgagagctggatgatgcagaccaagatttcacggagctcgtgcagaaagtcccggatggctgcctgttcaccatggtctccgactcgtgccacagcggcgggctcatcgacaagaccaaggagcagatagggagcagcacgaagcagagcaagatccagcaacgggagagagagttgcgccggcagcaagctccctctcccggcacgtgctcgtgcgcctccctcctgcagatcgcgctgcgccatcttcctcgccgcggtggccaacggatcatcggtagccgcagccgcgatggcgtgggagaggatcaaccaccacgctcgcaggcagagctgctggccgccgacgcgacgcgcgccggcatcaagaaccggtcgctgccgctctcgacgttcgtggagatgctcacggagaggaccgggaaggacgacgtcggcgtgggctcgatccggacgacgctgttccaccacttcggcgacgacgcgagccccaagatcaggcggctcgtgaatgccatgctgggtcgcagacacggcagcgccacggcgagcgaggagcacccggataaagctaagccagagcgcgtcgacggcgagggcgaggcggcggcggcgaagcaaggggcgccggagacgaggccgttgccgcgcaacggcgtgctgatcagcgggtgccaaaccgacgagacctcggcggacgccaccacaccggagggcgtgtcgtacggcgcgctcagcgacgccatccagagcgtcctcgccgaggagcgccgcgggaaggtgaccaacatggagctcgtgcggagagcgcgggagctgctcgccaagcaagggtacactcagcagcctggactttactgccgcgacaagcacgccaacgtggctttcatatgctaaaaacttcatctcgtgtcatctttatgcgataaattttatttccccgtgttatttagtatctcttggtgcctttttttttatcatagcacacgcaaaaaaaaccaaaaaatagcataagaatttttcgctttcgatcagaagcacaggccaccgatttttcttcgccccatagcacttcagtcaggtttgtagttaacagcattacactgaagtatgaaaaaaaattgttggacccatttgcccttcgtcttcctcgccttaatctcccattctgtgtcatctcgttctctttattctttgtcttcaccaaaccctagctctcgctccccatccgattatacaccatgtggaagacagagtgttcaacgggagctctcgggtcggtgcccacaatgacggcgctggcgtcgttgccaaatggcaatgcgtgacgagggtgtcaaggtgggccttgtcgggggcggcgaacactatgaggaagacctccgtgcaggccacgagcacgcgcgccccgtggttgttctcggcgatgtccttggtgaggcgaagcgcgctgcagctggcggagcagccgtgcatgtagaggatggtgcgttggacggtggcacggaggccgaggagtgccgcgagccactcgtcggtcccaagggagtgggcgccggcgttagtggagacaacgaggtgggtgatgtccgcggtggggtggccccacttggtgattaccctcaccgcggtggccatggctagctttggcacgcgttcttggtgaagttgagccgagcgtcgagagatggaacggcgcggtcgaggaactctggatggccggcaatcatctcctccatgtggctcatatgaaccaaggcatgaaggcaatatggtctttctaactcttgactaacaactaaccagttcactggaacgatgaccacgacggaagtgttacggggtgaagaaaaaccggtggcatgtgcttctaatcgaaagcgaaaaattattgtgccattttttgtaccgctttctttcctatgttatggatcgaattttctattttttcccctccagtttaacatatacaacacaaaataatactcttgcttcctgcattctcagctaaaaagaaaggaagaaagttcaattgcacttttcttacacagccttgtaaaaaaaatggcatacaaaattaacagtcatgtgggtgtcaggttgatcaagcagtaaacaataatcatatactccgtagcatgttccacgagatgtgctatggtagtatgctgtgacaaagaatatgccaatgacaaattgataaatccctaccgctgaactggcctcgagaaaaaaaaagtgttttgtctaaaaaaagagaaaaaaattgtgttcaacgaatcacacgaaaatggacaagttttctccaaactccgatcgatcgattcgatcacacggatcacacaaaaaaacaacggcgatcacggaaggcagcaagccccacacgtcgccgtcgcggcgatcaccgccgcctcctcccccacacaaccaccggtatcatcgacccccacctcccatcccaattcccaagttcccaacctctcgccagcgataagcaaatctccccctcccccctctcgtccacaaaaccctctttctttaccaaccccccaacccctcgtccccctcccgcctcccaccttctcgcggttccagcctccgcgcgcgctccctcgtcctcccccaatggcgtccgcggccgcgccgaccacgtcctcgctctccctcgccgccaggcgcgccgcggcggtggggcccgccgccgcgtcgccgctacggcgcggggggctggcggccgggtgccagccggcgcggtcgctggcgttcgcggcggccgcggacccgcggctggcgacccacgtcgcgtcgcggtgccggcaggcggcgtcgtcgtcctcgcgcgggacgcgcgccgtcgccaccatggcgaagaagagcgtcggggacctcaccgccgccgacctcgaggggaagcgcgtgttcgtgcgcgccgacctcaacgtcccgctcgacgacaaccagaacatcaccgacgacacccgtgtccgcgccgccatccccaccatccagtaccttatcaagaacggtgccaaggtcatcctctccagccacctggtaaagcctccgtccctcatctttttcctcaatgtaacgctacttgtcacagatatacaatgcaggatctcagaacctgcgggatgccagtcgctgtgatctcatctgattccatgggatgattgttgtgcatagtgtcttattaggcacgaatttttcttgttgtgctgtttgaaaggctaaaattggttatcaaatgttgttgcaaataatctagcaaagtaatatgtgaccaatctttttactcgttgcatatgaatcaattgtgatcttattcgttttctcctataaatgtgcagggtcgcccaaagggtgttactcccaagtttagcttggctccccttgtaccgcgattgtctgaacttctcggcatacaggtttctgcgttactgttatttctaattgaatctttacgggctaatttgatcacactgattaaaccatatttgtattcgcaaacaggtgactaaggcagaagatgttattggaccagatgttgagaaattggtatctgaattgccaaatggtagtgttttgctccttgaaaatgttagattttacaaggaagaggagaagaatgacccagagtttgccaagaagcttgcctccttagcagatctctatgtcaatgatgcattcggaacagcccacagagcacatgcatcaactgagggagttaccaagtttttaaagccttctgtcgcaggattccttttgcagaaggttactaccgtttcaccttacattttcaagtctgatgcttgaaatttttgaaagctatacctagaccagaaattttagagtaccctttcttttctttcaaaaacaatataaagttctgagcctcaatgtttatcattaatttaaatcacaggagcttgactaccttgttggagctgtttcaagccctaaacgcccatttgctgccatcgtgggtggttcaaaggtgtcatccaagattggggttatcgaatcccttttggagaaatgtgatatccttcttctaggtggtggtatgatcttcacattttacaaggcacaaggactctctgttggttcttccttggttgaggaagacaaacttgagcttgcaacatctctccttgcaaaggcaaaagaaaaggtgtctcccttctgttgccatctgacgttatcattgctgataagtttgctcctgatgctaacagccaggtctgttatgttttattcttttgtaatcactgatgatgattatcatagatattgtctagtcgataacttgatatagagcagctcaaagtttggtgaagtgatatactggacctgaccttgactttgaattgttctacaggttgttccagcatctgctattcctgatggttggatgggtctggatattggtccagattcagtcgcgtcattcagctctaccctggaaacaacacagacagtcatttggaatggacctatgggtgtcttcgaatttgacaagtttgcagtaggaactgaggtgatggcctgtgccaatgctctcattcggtttgattacagatggaattgccaaaacaaacttaacggaattgcgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2437 - DNA, 769 bp, Oryza sativa
cagacttcaacgcaggcatggcaaggaagtcactggccattaaatgaaggttgaaatgggcgtccaccggaaaagcgggcgagcggggcaggaggcgtgtgctctgcttgtcagaagtcatttccggctgtagactagccctcattgtaaaaagcatgtttcctttcttaggcagctagaggcccatgtggtgacccctgatcagataaaaaggaggcccaggcctaaaagaaagaggagggaaaaaagaggagaaggaggaaggagtgctagagcctgaacggtctccctcgctctccggctctcggtaattcttacacacacagatccaccagaacacaggagtagggtgttacgcttctcagcggcccgaacctgtctacgtcgcccgtgtcttttgcatttcctctctcgctgaagttcctccagatcgagggcgaagaacctcacttagcgcccccggccgaaccggcaaaggggggcctgcgcggtctcccggtgaggagccccacgctccgtcatctggcgcgccaggtagggggcgcgcgtgtctttctaagccctcgtcctctttcgtgtgcgccaagcttctcccgctcagccctatggccgaacgggcagtggcgcacaccctctctccgagcgctagcggtgacgacggggagcagaacccgcgccgtcgggctcgcaccccaccgtccccctctcgctgaaatcttgggcggggggaggcgctcgagggggtcgaaagatccgcgacttcaccgcc

SEQ ID NO: 2438 - DNA, 717 bp, Oryza sativa
tgcagcccgaactgactaaatgactgaagaccgaatatcgagaccgggatttggtctgaccgaatacccacccctacaccacagtctaagtagaagtactataaattttcataacagtagagaaaaaatgttatgttcccacacgatacttttttttattattttgttgtagggagaagccgagtactagtgttttattctccacttagtacccgaaacatgtaaataacattatatgtaacattttgatctaactaattaaacatactattacctcggccccagaacataagaagttttattgttggacacagtttgtcggtgacatgggaccgggagtatcatgactagaggcttgaggcagacacaatcgcccacgtggcctgtcaccctcggggggcgtcgggcccgagggtgatgtgttcgccctcctctttgtctccccgaggggtcggaccgctcccgcctcggccccgagggccgaggtgccccgaccccttgtgggttttgcgccgcgtatatgaggtaggtgagcatagcggggctcacctaaccacatttattgcggtttggacgagcgcgtcacgccgcatgtaacgcagtgcaccgcgctcgtttatccggtcagtgaccagtcacagaccgatcagatcgtgggttaggtggcgacaggcggtctgacgcacgcctcggcccatcccgtcaggatgagagcct

SEQ ID NO: 2439 - DNA, 16308 bp, Oryza sativa
  unsure (1)..(16308): unsure at all n locations
tctagagtcaacctgcaagcatgcaagctaggctagtctaaaaagatctattggatatattccaccaggtgagataagctaatttttaagttgataattctgtttaatgatacacgtggtgtctggtttctaattttatgacttctgtaaatctaaatgcagagtatggcatgagcaaagatatctcaaccaagggtgatgtctacagcttcggaatccttctcttagaaatggtaacaggtagtagtcctattgatgaaaaatttaatggtggcactaccctgcatgaatttgttgatgcagcattgtccaatagcattcacgaggttgttgatcccacaatgctacaagatgatgtcagtgtagccgatgtaatggagaggtgtgtcattccattggttaaaataggcctctcatgttcaatggcattgcctagagagcggccagaaatggggcaagtttctaacatgattcttcgaatcaagcatgcagcctcaaacatgagcgtcaaatgaggcaaattaagatttggcaatttcatgtatggaagaataatgtaatgtaacatatttgtagcttttgttttgttttctaatccaatgtagttagtgttcaaatgaggcaaattaagatttggcaatttcatgtatggaagaataatataatgtaacatatttgtagcttttgtgttgttttctaatccaatcaatgtagttagtggtgttagcattcgccacattcctcttaattcttcaaattgaatatttctaccagcacagttcaagccaccagagctcagtcgatttgcagaactagcatcagaccaaaccaagtggatttggtgtcagttagtaccaaatcaggcgtgaatccaatccagggcaaaattcgcccaatcaagagcagggtggagaggggatgcacacagattgatctcccgcagcctaatccagcccaaaatcccacaataaaccaatcagagagacgggtgaatgagcacgtacctcctagccgcggaagccctagttgccgcgacggcccgcttccttcccaatcccaagcgccgcccgccttctgccgccgcttggacctcggcaaccccagcactcggctggcactgcgccggtaaccggtcgccgcgctttcaccatgggcggcgattcgccgacgagccatggcgattgccgttgtcgccggcggggtgcgcgggtgggtggatgggcggaccacaggagtaaatcaggaaataagttcacggagatgcgagattttctaagttcccttaaccgcaaaaccagaaatcttcgcccctcaactttacaaaaccgtctaatttggtcccaaggcagtacacatggctagttttgatgatgtggcatcctagtcagcaaaaatatttaaataaatatgtggggcccacatgtcagtgagagaaaatgatgtgggcccaacaactctcttttttttttttctttttctcttctcttctcaacttctcagctctcacgtgcaggcgggaagatggcggccgacggcggagcgggcgcggttgccggcgcagcgggcgctgcggcgcgcggggaagaagcgggaaagggggagaggaggcggccggctcgaccgcccgcgacggagggagcggcancnggcgngngctctctccccatccggagccacggcgggttagcaagcgaacggcgtactcgctatcgccagccacgccgcctccacggcgccgcgcacctcctcggcgcgacaccggcagaggatgcagaggagagcggccggggtggacgcgtgcgccgatgggagcgccgggagagggctcgacgacgagcaagcggatgggcaggccgtcgatgctcgctgccgcttcgcctgcctccggaacgcgccgcggaacccgccacggaacgcgcgtctgtccagccgacgcatcgcctccggcgtccgctccttcggcggcaccgtccccagctgcctcgtctgcctccggccgccgccgttgtcgtaatgaaacacccattaattagtttgcacgctgcatgcagctagctagccaaccggattcatggggttgtccaccatgccctgcccgaccatgggctggtccaacacgggaggaggccgtgcttctccagctgcccacgcagcccgacgccgctgaacatcagcagctgcaggccgctcagcatcagcagctgcaggctccccagcgtcccggtgtggtcgcgtgcgccgatgggagcaccgggagagggctcggcggcgagcgggagaatgggcagggaaggttcgagctacggcctgcaggtggctgcggccgccgcccgctgcaggctccgctctccgccgctccgcgtgcctgctcgcccgccgtcgccgctagtagccgcgctcgcccgtcgctgcctgccgcctgcttcgctctccaacgctccatctacctgcttgtccaccgtcggcactcgcagccacgcttgcccgccgctgctcgtcttgcctgcttcgcagccgccgactccgctctccgccgccgcggcgactgctgcagctctcccctctgcggcaagaaaaggaaaagagaagaagaaaggcagcgtttggctaatgggatggggaaatcatttcccacccatcaaaaggcatctttaaattctaaccattcattctctctctttcatttaatcctaacccttcattcatttcccaatctcagtcccaccctccatttcccattatccaaacacacccaaagagaaaggaagaggatgatgctgacaagtgggcccttactatttccttctcacttacacgtgggtcccacattattatttttattttttttgctgactaggatgccacatcagcgaaactggacgtctatactgcctagggactgtttttgaacggttttacataattgaggggtacacatttctggttttgtggttaagggactttaaaaaaatctcgatgttaagttgagggacctcgggtgaacttattccgagtaaatcaccatctttctgcagccaagggcccatttgccgtaaggcctagaaagccacgtcgtttgtggtggaatgggctggaacggcatcaacaactgtaggctatcggtaacgaatccataataaaaattattatagattgatattctaatgatataaattagctagacttatataatctgccctaggtactaggtacagtgaatcaggaaagtgtacataggtacaccactgaaggctactacatatggcggttgacggagagatttcatcacatagcatttattacgatgcgaagaagggaaagataacctaaagggagcggatgcacaaatgatcagcattcgtttgatctccgtattatcttacagagagcataatatcgcaagtatggttgtaatgttaactatagaataattacatgaaactaatacaaataactcaaacaaatattttactatatcatagcgaattcattccaatagttgtgatctaaattattgtttagcctaagccaaaggtggctacgacaaaagatagtaaaagaaaaacatttgcaaaaaggagtaaaggacatgagtgcgcaatatggctcccaagctagcctgccgaaaggggccaccgtagaaaaactggtcaccaacaatagatgtgaaggtgtagatattctcattggtggagaagccaatcaaatcattctctgccgaccaagctcgtccttgcccatcaatgaactgaaggtttttcgtggatactgccatattgccaccgtcaactgccatgtaaccattgcccataggaggtggaagaggtgttggttgaaaagttacattagtaactacaatgcctccaaaccacatattgatggcagagtaagatagacttttgaagaatgacaaagggatgcgcccgacgagttcaggatgcttgttattaaacccatagtgcaccaaccaatcccctgatgccatatcctgcacatcattatcaaagagaaaatagattaaacttttttttcttgttctcgcgtaggagtatcatctactgataaacaggattaatttatggattgatgaaaaccaaccttgaatactttaagtgtgatgtattgcttggctccatttggttgtgagataccagggattgggtcgccaggacgtatgtatgcgcccctctcgggtcgaaaaccagggcagtcttcgtccatatgggagggatctgttaacggagagctaagatccgacgtcttttttaaagagataaatgattatttttagtagcagcaagagtatcactaaacagaatacaaaaggtcgaatattatggatgtgtaaataaaaccacctaccttgcaatagaggtcaaaaacagggcgttcatcacctggtttgacctacgaggatagttaaacgatcaactagaaactgatgctatgatctttaagagaaaaatagggacaagaactaagaaaccttccctccaaccaatctgaaatacttctaaactggatgctggggcatcaccattatcagttatgatccaaactgaaccataactgaccaattggcctggggttaacgagaagccataaacatccatcgttgctataaatccatagcgcacttcatatgtgtttgttatgtacccagtcctctgggaaataaacaacaagttagttacataaataagtaaaaataacaagaaaattatttttcctctaaacttttccctatccctttcatgcttttgagttttgtcatctctcttgtatgccctggagttctcattttgaaccactctatccattcagttagttgaaaagcttcttataaaataattactaaggcgaaagcttcagtcatagttaattgaatgagagtcgttttacaaatcgaagataaaaattttaaaagaatcgcaatcaaatttaatgaaatttcaaagagcaaaaattcaacaaataataatttgcttttcctatgtttcctctacttagaaaccagaaatttctacttttaaaacaacttcaaccaaaattttaatatatctccatagcgagagatggtcaaataccatttaaaattttatcaattttaaaaataatttcaaaattaaaatttgcagtaatataattatctcctttgtttttaatctaaaattgtttttgccttaagaagtatacctttcaagttagcctctatgtaaggaggtagtcattaaaaaaatctaacgacaactaatggaatggggacagagtagatcaaaacgaaaactcataggtataggcatataaaggagatgataaaacttaggggtatggacagaacagcgcaaagatttcagggcacacaaagaattttctcaaatataacaccgtatggcaggcaatattaattcttgtatgtcaatctatttactagtataacactagaaagagatgactaaaatgaaccaccatatacgctctatcataactacttaaaaaattcgcaactttctgatcgtcacatccatatgtccgtgtcatgcgagcgtcttcccctgtcttcctagcgcagtcagtttccgtggcacatacaccacgcaacaggccgcaagcgatcaagcccataagctgtccgtctgcatcatcctcaaatcttaggttcctccatctcatgcgacgccctatcctattcagtctcatgttcttatcctcgcgacgcacaacatctaaccgaagatccttcaagaagggttctgctgcgtgtatcaatcttcattgcggttatcaaccaagtatgaaaatggaacagctggtaagaaacatgttccgcaagacgtcgtggaaatatgctcaggaaagcaggacatcaacgaacataatttaataaattttaaaaattatctttaaccatatagcaacacacgggccattttcctagtgagcataaatattactacattaatataaaaatagatacacgtagctaattataatgggatcagattataacgggtttgatcaattaatgcaattatatccaaactacaattatgtctatagcaaaacgtgatatgtatgtccaatgcaataatactatttgcaaaaataaatattagtcttgatccatgcaaacgggttcgtttcaagtaaagaactgacctcattacccttctcatgaatgatgtagtatccgttaacgagctctttgcagaccgctgttcctcccattgcaccaacacatttgccctgatgaaccaatcccaagagtatatatgatttgtagatagaaatataaacagatcgatactgcttgcaagccgcttccattgccaaatgcagaggaaagaagcaggaagcaggtcagaagaacgccgacgaagagaactatggccatctcggtggtcaataataataggtggtcgtagtatgattcgaggctttcgatctgtatatataggtgcaacaagcaccggtgttgtgaggaataattgtcgtgtatcttttttacatggaaggtgttttaagaaagaatatgtatctttccttcgaaagaaaagttgttcacgaaagaaaacaaactgtccttaattgactaatatatttatatatgtgtgtatattttttagataatggaaaaaattccagcatttgctttaaagaatatatgtgggtatatagactatagcaaggaaaattatagaagttcggggagctgttactcccttcctatccctttcatggctctaacatgcctcttataaaccaggccaactagctaagtggctgacaatgggaacattttttttaaaaaaaaattaagccaataagaatttttaaaaatttaaatttaaaattaatttaaggatatttttaacgtattttttttcaaaatatgtatatataatttttacttatgaattttggagaaaacatattttttaaagcgtgaagtaaataatccagtgaataagcgaaagggcttataacctagtggttacaagagcctcagtagcacctaagatcctgtgttcgactccccatgggagcgaattttctaggatttaggcgttgtacccgtcgacagcgaggcgtctgtggtaacttcgtcaacgctgtcgtttgtggtaacttcgtcaatctcaaggatttgtcggcccagtgttcgaagatgcatatagagatagggtttgtgtgcgcgcgtttataggagtgagtgcgcttgcgttgttagtatctgtgttgtactgtgtaattctaaaaaaataatctagtgaataagctaaaaagaaggcatttgtaagttgtgacgatgcaaaggaagggagataacgtagaagagagggatgcatgcatgcattgacatccattgatcctgcactatcttatggtcagcttaatatggaatatcttaagtattaagtacaattgtaatgtttaacagtgttacggataagacatatctcctttacgtggatttatagtgtacggagatactacatatctaatattatacggaaaagtatattcaaatatggaaataaaacgagtcaaaaaggaaactactttcatgggaatagaagacttaaaagtctgactcggaaaaggcaaggtcttctcggcctaaaagtctgactcggaaaaggaaaggtctcctcagcccatatcctaatatggttctttaagttctacttggagaagaagacgcccgaccatataaatataccacctcctaggaggagagagcatcgaatcacaaccttaactagacccacattaagatacagccaggaggaagacaagccctaatcattgacatctactcatctagacatactcgacgtatcctagttggcgggttagaatagctaacttgctcccactgtaatcaatatgatactctccacacacacacatactcacatacatatatatattattgtgaaggaaaagaaagattaatgcatcataagtgcggcgcccgatcgccacgtggacattccagatcaatccaaagggatcagacggccacagcaaggaaagtccccactggccattccaaccaagaggtggcggcacatgaagcctgatggtcgccgacgacgaccatccaacacgagagtgggatgcggcgaaggaagctagggagggagaaggagtgcttaccgagcgcatgcgaggtagataggacgaagggagcacgctgatggcgaaggccctcgggttggcgacaatggtagcggtacggttctagtctgcgagcgaggagtagtagttgggtgcctcttcatgctgggcacaagaagaggggttaggggatcttagggtgggtagaaactgcggagaaggacgaccgggggccggtaccgagggcggtgctcaccttgctcaaagaggatggagtttcgattgtatttggcgaaggcaaagaggcaccgaggtacgtggagagctttcgaagccagcggagcaggcagagcagcctgacatggctctaatcgctagcggtagatggctggaggcggcaatcgacagtggtaactcgggctcatggagaaagaggcattctggtggcctctgacttcaaagcaggggacaccagcctacggcgtggcacggctagtcacagctgcaagaggcagctggatgcggcgaagctcacatgacgtggtgaggagaaggttataggcacggggagctcgagcgcgagtaggaaaatgagagagggaggtggaagggccttgatgtggcctagagggggagaggatgaataggttgtcacgcccagaaatttaacccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaattccatcttcagctcagaagcactacacttctaaaaagggggaataatagcaaggctgagtacaaccaccgtgctcagcaagccacaccaacgatgccgacgtgcaaggggatacaaggaggggtttgtggctatttgcagaaaggcagttgtaaaacactttattgagcaaaacagtaaaacggttgggtaattaaagtaatattgaatctccactgatcaacgctacaccacgttgaacaggcccaaccaacccatctgaaccacagtgtattgggtcgatttattaagatgggactaatcacggtgaatctgatcgatcgcccataaccgcgggcacggctattcgaatagttttactctggccagaggtgcacaactgtacccacaagacacaacccaccgacatgtcaccgcgtcatcatgtgcccatgaagcacacgtcaccatgtcgagtgattgtgacgagatccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttacagggtttcccgtgaaccggtccttaattgccatgggtgcgactcacaaaaccatgcacccacagcccaccattcagttgcattttagttggataattacgaccatgaaacatggccagatgtcacgagcacgcagctcaacaagatactaggatgtctaatactgcaattatcccatcgactgagctagtggtaattaagcatggctaagcatatagttctagctaggtcacataagtaacacgagctagtcaatttatcacccaaggttgacaaaggatagatatcaagtaaacatggcacaagcgagcagataggtaaaccctgaccccgtgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccgaaacgacggaaactacacgctggcacgcaaaacgaggaaaaactctaataaaaaccaagaaaacagtacataaaaagtaaacaaacatgtagagcttaattttagatgaattttgcaagttgaatggctcaattcggagttcgaatgaattagatatgaattttagaagttttgagccatttaaatgaatttctagaattaaactcgatttattgcgcaattattatttatttttccaaaggaaaagagggttgctgacgtcatcaacggggaggggcggcgccggcaagcgggccccaccggtcagcggcacaagggcgccggtccaccgtggaccgggaccaccgaggcggttcaccgccggtccacgggaaccgacggcccggatcggcccaaagccgatcggacggccacgaggcggcgcggctgggcacggtcacggctcaaagccggccagccgagtgatggcgcacgggagcgcggccaccggcgacgacggccgacgacggcgcggggagcggcagcgcatgcgggcggtggcggcgcacgctagggagcggcggcgcggcgcggtaaggtgagtcggcagccggctgcccggcacagccgtcagcggcgcggagcgcggcggcggcgacccggtcggacggccaccggcgacggcggcgcgtcgcgagcaggcacaggaggtggccgacgaaggggaggaaggggagagggaggggagtgctcaccgagcggcacgacggcaaacgggcggccgacggcaaggaacggcggcggcgaggctcctcgggaagacagcgcgacggagctccggcaacgggcgtcgctcaggaaggggcggacgggctcggcctcggtctgaggaaaatcaaggaggggctagggaggtgagaactggtgcgaggtaagcggaaacgactgccgacctcgacaatacgaggaggagctcaccggcgacgaggaaggtggagctcgggcggatttccggcgaagagggccagtggccgaggatctccccgtccctgcggagccgagggaggcgacgacgcgggttggcgaggaccgaagcggcgttgcgacgcggctggaggtggccatggtgagggagagaggtggtgcgcgtggcggcggcgttccggaggcgaaatgggaaaatggagtagggaccggggtggagctcggcggggcgatgccggcggtggcggcggcacggcgcggtggtggctggagcggcgaggagcggcggctggagctcgtcggtgagcggcggcgatgggagcagcgaggggagctcgggagagcgcgcgggagggggcggcgagttggggaaatggatgaggggaggccggggtacacttttataggccccggagggggagatcgtggccgagtggggcggcaacggccggcgaagtggcgaggcatcgtgggatcgtggggggcaatactggcgccggtttttggggaaaaacgggggaggaggtggaggagaggtgtggcttccggtcccacgcgagagagggctcgaggaggccgggaatggcggtgacgtgggcggttttcggcggccatggcggcaacggcagctgccgacctgaggttggggatgacaggtggggtccacgggtcccacctgtcggagagagagggagggagaggccggctggggaggcaaaacagacttgagggagagagagagccgagcgggccgagggagggggccggcccgagagggagagaaagggggcgcgcgggccgcgggagagaaaggaggggttgggccgaaaggggcccaaagagaggaaggaggattttaattgttttctttttattttaattgatacaatgatctttgtgctattaaaactatttctcgagctccgaaaatttgcggaaaaatccggagagtattttagggcacaaagaatattacaaaatattcttggccaatgatttttaattccctcaataattcacttgattaagttgatttaacttttatttaatttctagaaaatgcattattaattgatttttaaacccgaacgaaaatcggggcgttacataggtgttcctaaaaatattataacttcatagcatattagaataaacaaaaatttcggttcaaatcagaactttcggtatgggatcagaagttctggtctcaaccaaaatgttcgatggataaaacataatctatgaaattgtagctcaaatagacaatatgtatatgaaacaaaaggtgacaaacaagatatctaaataagatatatggctaccaactagatcaaataagaatacaaatagaccgtgcaaaaataagcttaagcataatattagtaaaggcaagaaagggcaaaccaaaagagaagacatgtgatttatttcctgatgttcggatctactgttcctacgtttttgttgagggccataaaggctaggtctctttcaaattttacactcctagacttcacttttgatttcttccattgcaaaggtggaatcgaaaccttcacaatctttttgtggtacaccacaaccttgggtgctcaccggtgacacctagccatctaggaggccttagtctccaaaagtaatgaattcaacaattattttttggggacgaatctagagttatttagatttatcgaatattttactaggggtcatgcatggtgatgtaaattttatatatgcatacatgactatctgagaagttcaaacagaggcaatcaagtaaacacgttaggtgaagaaagtaaagctaacaacatggtcacaactcaacctcgccaggaaacgagctcaatcggccggcaacaaatacaaacctatgaaaacagaactacaacgataataatgtttgattttaaaaattctaatgataataaagagtaggggtgacaggtgggctgtaaaggaatagtgtggcataagttgaggtgacttctaaaaactttaaaaacgaactccaatgatgattaggttcgattttttaaattccaatgaaaatgaagatatggaccatgggcggcggtggttgacgcaacttataaaaactataaaaacgtaaaccctaacgagaatcaggttcaatttattctaatgataataaagaggagagacgacaagctgattgtaaagtagtagggcagtgtcgattgacggaatctccagaaactataagacgaaacaagagagaggaaatgtttgatttttaaggtcacaagaacaataaatagaaatggtggcgagccagacaagcagtggagtagcaatggttggtgtgacttcttaaaaactacaaaattataaacataattatgataaggtccaattttttgaatgatgtgacaacgagttgactatttaatacattttaaagaaaatgatgtctaaatagatagataattttgtatcaggtgatataattacgcgggccaccatacttttttccagggcctgcaaggtttacagtgtaaatggcataaatcacgggagctccttcttggatgaagcagatagaccacgaccggagcttccatcctcttctaccggacgagtatgagaaggatcgtccttagagctggtgactttgtcatgtacgtcgccggcgatgccttcattctctgtcacagcggcgtggagattgtgcgagggcgggcctgggggctcaatgggtttctcaggaccttcgtgaatgggctctccagaaggggaaaccccgtgttgaccatccgatgcaactgcaacaccaaggattcactgattaaacatgaaatcaacaaaagaagtaaaaatatatatatatacggacgctcatgtgggatatcatattagagctccaaaggggacatataagtatttgtcgctttttaagatgcgataattaaggatttgtcactcactgtccatagcatgtgggtccagtggtaaatcctttttcaccacttgtaagggttgtcagtatcccgattcgtatcgtagtatcttacgatacaacgattctaccaagccgaaacgataccgattccacctagtatcctaatttttatagtatcgcgatcctactattcattactacacgatcctaagaaatcttagatggtatcctaattctacgatccctacgatactacaaaatattatttaaaataacatggtttgaaaataatgtaaataaatatactcaaatttgtataaaaatcagttaaatatatcaaaaccaacgtggtttctcttgataaatatctctatttgcatgacatatatcattacgacattttttatatagattggctatatataactaatataaatattaattaaacttaaaaaaaatctcataatatcccgatactacgatacgatactactttgagtaaaacgatactacctggtatcccgatcctaacaaccttgcttgtaaaaagagtggcaaatagttaattatttcctccaaaggtgaagagaaaaaaaatccagttacagtactgaacatccagaaggagtacctacataatctctccattccaaaatataaagtaactttaaaatgatgttaagtcaaatatttttgactttaactattaataacaaaaatataaaaaagatcaatcatgtgagaatgatgttactagaattatcactaaacaaacaacataaatatgttactctatttatttaaaataatatatttttataaatattatcggtcaaagtagtatatcggagacagtgataagtccaaaaatatttgtactctaggacgaaggcactaactatataaatttactagaccgcaccatgatgccacgggaaggtggcatgcaaaattgtattatatgacttctcgtgatgacttcttcttatagttatatagacactaagagtgacatcgatcatatatttataaatatatataccccatccatctcaaaatatatattagcattgattttttataacgttgaaccattcaccctattaaaaaaatataagtataatttattttgttataacttatattttcaaaaagtttggtgtgatggcatgaaatgaggctacagcggcgtgactttttcgaaaacatcacagagtttcactacatatatgcatagatgcatagtttgaggaaaacttcagtgctacaaagaaataaacataaaactattatacagagaaaattatatatgcactcttccttttttttaaacatctcttgtgtacgtaagtacatacgtacatagagaggtattatagttcgtttttagatagtatatatctaatctaatggtttaatggttgaaagtaatggatgtactgatttaagtgtaaattgatggccatatatttttttcttaatttttttctaattcattagatctatcatgtgacatcttaagtgtgctggtaaaagtgtagaaatgtattactgatactgaccatctgtttgtagtcgactattgtttgttgtggtaattaggtgacatgctctactttacctactatttgttgatagttcctcacttagtatagtttgttaactttggtgcttgatgatataagtgctcgttggatttcagctaattattaggtgtggcttgccaaatgctggatagaacttacatacttttggattagtggtaacatacgattgatatattaggctaattcttattgacacggactattatatagtactacatattaaacgttttagtaaataagcaattagttctaaagtagtattcgattggctgctccttattggttgtaagcacataccccagtgatcgacccattgatctagaaattattacaaaagaaatatctttttataatagtatcttaatacaatccatccactactggagaagtgctcatctctcccggttcgcaaccccctttactcccgggtagcgaaccgggagggagaatccagaactaaagatgggtatatttagtcccggttgataacaacacccgggagtaaaaaaaaggggttgttgttatcaaccgggactaaagagagggtagcgggcattcaagatggtccccttttcatttattttcttttttatttt

SEQ ID NO: 2440 - DNA, 3497 bp, Oryza sativa
  unsure (1)..(3497): unsure at all n locations
gcatcttgtgtttgaagccatgtgaaaaaagacaaaaaaatctgtatcaaacacgcatcaattagaacatatagacaactaagcttagccggatagagaatttctaatggtgatttttattccaggatatgcttaattgcttaccacttctattacacgataaacccaaattgatagctaaacagatttcactacatgcaaatagttctcgaaggaaaacaaattcctgtgaagctaaaggatatgaaagcctatgccattatgcaccgtagtaacatatggacatcagtaacaatttggtgttggaattaatgaatgggccttagcccactcgaagattaattctttggaaaatcacaaaagcccacctcatgggatggcatgcatgtggagtttagtaccaccttacttattctaggagagggggacctccttaaaagggaggatgtcctcctaaccacttgaagcatgtgtggtggagagaagaggggaaacacacgcgcgcgctcgctcgcctcgcccgggtagggcaggcggcgcgcgtgcacgacgtacgcgtcgaatggtccgaaaaattgactcctcacccttgcgcagatgcagcctccttttgcagttttgttttgctgcaaattcggatttgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacgattgcgaaatcaatctagggtttgcctcctactctgtactgcgccgtcgctcgtagactactccatcccgctcgccggcgtgcaccggcgatcgggagagcaggtctccggaacctctgcctttgacgtcctgcaccgggagaaggcggcaataaggttttttaggaagcgcttcgcgcgactgctccctgtttgttcgcgacggctcgccttcctcttcgctcgcgtgtttcatgtcttcgtagacacctgcgaaaagtttcgaccaagcaaccggtctttccgtcacctcggtatgtgttcaatatgttgcgcatatttgatctgttcatgttatactgtgtagtttacatgtatagatctaatgatgcgttcattctagttttcatctgtaatatcatgatttatttatggaatagattaaatcattatatgtctataatctcaacaatccaaaaaccttattataggcactgtgattttactatggctggttttgccgatgcactgagaccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatagaaaccatggctaaggaactcgaactccttaagtgtgtcttacccgacaaatttgtggccgggtgcattattgcaaaactacctccatcttggagaagtttcggtactgcactcaaacacaagagacaggaatactccgttgaggggttgattgcgtctcttgatgttgaggagaaaactcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctagaaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaaatagtcgtgtctaaacatggatattttattggtaaaggttatgagtgcggaggcctgttccgcttttccctttctgatttctgcaataagtctgtgaaccatatttatggcactgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacagggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgagaaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagaattcctaacagaaataaggacaaaacaccatatgagatatggattggtagaaaaccatcactttcttatttgcgcacatgggggtgcttggcgaaagtcaatgtaccaataacgaagaagcgcaaacttgaacctaagactgtggactgtgtttttctgggatatgctcatcatagcattgcctatagatttttaatagttaaatccgaggtaccggacatgcatgttggtacaattatggagtgtcatgatgctaccttctttgagnnnnnnnnnnnnnnnnnnnnnnnnnnnnnnnnnnnnnn

SEQ ID NO: 2441 - DNA, 8097 bp, Oryza sativa
gcatgcctgcaggtcgactctagaagatccccattcctaacagaaataaggacaaatcaccatatgagatatggattggtagaaaaccatcactttcttatttgcgcacatgggggtgcttggcgaaagtcaatgtaccaataacgaagaagcgcaaacttgaacctaagactgtggactgtgtttttctgggatatgctcatcatagcattgcctatagatttttaatagttaaatccgaggtaccggacatgcatgttggtacaattatggagtgtcatgatgctaccttctttgagagctttttcccaatgaaggatatacatagtggttcgaaccaaccctctgaaataattcccagttcaatcacaccaccagaacaaactgaacatacacatgaacttgtctctgaggaggatgtcagtgaagctcctcgaaggagtaagagataaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatgtatcaacctgatgggtttgtagttgaaggtcaagaaggcaaagtatgcaaattgttgaagtctttgtatagtctgaaacaagctcctaagcaatggcatgagaaatttgacaaaacattgacatctgcaggcttttcagtcaatgaggcagataaatgtgtgtactatcgccatggtgggggtgagggagttattttgtgcttgtatgttgacgacatactgatatttgggacaaatcttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatattgaatcgttttggctacattgatagtaagccttctccaacaccttatgatcctagcttgttgcttcgcaagaacaagagaattgctaggaattaactggaatactcccaaatcattggctcgttaatgtatctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcgaagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcgaagatgttgtccttcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttaagtgaaacttgcttgcacaagacttgcaattcaaggcgtagtccattgttcaagttgtgagtaagtgtagcttggagttctaggtggatgttcaaccttaattggtctccatcgaaccgctggtatataaacagtatattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgagcgctcgctcgcctcgcctggccgggctgggccgggcagggcaggcggcgcgcgtgcacgacgtacgcgtcgaatggtccgaaaaattggctcctcacccttgcgcagatgcagcctccttttgcagttttgttttgctgcaaattcggatttgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacgattgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggttttttgggaagcgcttcgcgcgactactccctgtttgttcgcgacggctcgccttcctcttcgctcgcgtgtttcatgtcttcgtagacacctgcgaaaagtttcgaccaagcaaccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatatctataatctcaacatttggtttgtctcaaacacgaagagctgaaaatgcttctttgattgcgatgacttcagcgtaaacatcttgcattgctgggcgatcttttggtgtctccatggagcatgagataccaagtttagcaagttgcatgacgcagctcaacattccagtcatgacatgattttcagggtcacaattattctcggtatcttcttcaatgttgaatatgtaaacgtcttcaactccttacaggaaggatcagatgcttgcttgactttattcctcttcttcagtagaatgagcgctaaacatgatgttagagccagacaaatagctataggtcctactatcttaagtattttattggtgtgctttccctttgatggctttacattgcagagtggtaactgtagcaatggatatgtaccacataacttcttgttcccttggataaaaacctcacttgcattctgaaatatcccttcagttggtacctgtccttcaaaatcattgaaggacaaattgagaagcttcatggacccaaaggattccatgaattcaggtattttaccagatagattgttctgagaaagatctaactcaacaatgcctcttaaatttatgaaagaatcaggaattcgtccatcaagaaggttcccttccatacggagagagcttaagtggacacagtcgccaagagcagagggaatttgtcctgacagtcggttattggaaatatttagaatatcaagattgatcgagccaccaatctctgatggtatttctccatcgagttggttgtgagacaagtccaaccattcagaaagagaggaaagagtaacgagttcctctggtatgctactatcaaagctgttacaagacaggtttaaagcttctagattcttgcaactccctaaggagctaggaatcggtccactcaaattattttcctgtaagtagagctcacttagatgacttagattaccaaatgaagttggaatttgtcctgaaattttgttttgggataagcttaggataaacaagtttagcagatttccaagtgaatctggaagatttccagtaagtagatttttttccatataaagaagcgtaaggcttgtgagtttctctatctcttgaggtatggtaccggatatttcatttcctgttagcagcaacacctgtaagcttgttgaaagttttgcgatggaacttggtagggttcctttgaggatgtttttgtccaggcataattgaaccaactgtctactagttatcaatgaggataagaaagaccagtctccagcttctagtcgattcatcccgagattcaattccatcaagtcaggcaggttcccaaaagaaggaataataccatggaatgcattgtcacgaagattaatcacttggagattttttgcaatgcctagtgaagtggggatctgcccttggaattgatttccttgcaagatcagtgttttgatatttggaagggtatatcctatgttatctggaatttctccaatgagtttattagtgcccatgccaaggtatacgagattagacatgttgtacagagaagccggaactgtccctgacaagttgttatatgtcaagtccagttcttgcaagtttggtattctgcttaaactagatggaatggttccctggaagttgttctgtgaaaggtagagtatttcaagggaggagaggttttctatagaggaaggtatgctacctgagagattgttttgggataagctgagataccacagtggtgaggagatatttgagattggtgggatagacccaacaaagttattaactgcaaggcttatgagattaagtgacgagctattaaaaagagcaaaaggaatctcgccgccaagacgattattagttaaatcaagcaatatgagtgatgaactattagctaggagaggtgggatgcctccagtgaggctgttatttgtgagaatgaccacattcagaaaagagttacttccaagtgagaaaggaatattgccgcttaggttgttatttgaaagatataaaactgaaaggttggagagtgtacctaatccttctgggattactccttgaagtttattgtcaaacaagcagatagcttgaagatttgagcatttgttcatgcttgaggggatctcaccatcaatcgagttatttgagatatcaatgatctgaaggttagagcatgaagacagagcctctggtatcgtgccagtgaggccattagaggtgaggttcaggtaggtgaggcgacgcaaatgaccaatttcaggtggaatgttgccagtcaactgattaaatggaaggtggattattgtcaagaaagtaagattaccaatgcaaggtggtatttggccatggaggttggatgactctaggttcaattcagtgactcgagatgtgtggctcttgctacaagtgacaccgggccattgacagtattgcgaagaatcatttctccaggaagccatgactccggcattgtcattgagatggagcttgaggcaaagcagagcctgaaaatcggtagtatctgatgcatcatggagtggtgcagtgggaactagggagaatgcagtgatgagaaagaatgagaagcatgccaataagattgtgaccagaacagggatgctgtgggagcccaaaggcgccatcagttttgctaatgagaattacaatgtgagcaacaggtgtttcttacttgggtacgttgcaaactgaagctgtctggtgtagtggttgttgtgctaatgtacatgaatttatagaccagcagcaacaccataagcaaggcaattgtaatggccaagtggtggagattggccgtactccggcatatacggcaggacctagacttagacgctcatggctttggcccagcttaagatttgtgcttgaactttgcttcggcactttgtagctcaattgggagctgagattaacagttgccacttaaaatatgcaactcatatgtcatgttgtagtgatgttatcaagtgcatcgatccatgtatctgtctgttactgcagtctacattgctaacttagcgtatactctggggtttcactgttctctcgtcgagacaagcaaattaattggacaaagtaactaagataactgcctaactagagcattagaattgtcctgatcttgcatgagaaagcaacttttacaagtgtaagatgtttttactctatattctaaaggtttggttgcagggagttagcaataatgtcagttttttcccaaacacaaccaggctagcaagctagttagagtgtctattctattgctaatccaaactgatattcggacgaagtagtcgtcagcgtttcccttaatgaaacaagcacagtgacagtagtgttcaccgttcactgtctgactctgaaagtctaattgtaaactcagctcgtcaatttttcagtcgaattgcactgaaaaatatcatcttcttcagtcagcagtcaaatgacccgaactaatacggcaatgtatatgcgtagtacatagaatagttcctttaaatctgttcacagatgtctcatcgaaaaaactgaaatctgttcacatattcaaagacttcaaacttgactctgacttcaattactctccatgctttgcttggttgccagaaatctacagttcgggtggatcatctaagtgaaattaaaacgggatagagaacagggttagaaattctggaacgaaattttagaaatttcggtcattttggatacgatattatttcgaccgaattttttattttttttaattttttcatgaattttggtaatatttgttcaaattcaactaaatgttgtttaaaatttcagaaatttcggaccgaaatttccgaatcggtgagcaccgatccaatcggctaaaccgatgggtttaaccctgatagagaaaggattatggccttccggtgatctgtgagtcgactagctaattcgtagtgacagcatgacaaattgacaatagcgtgccaccgtggtagactcgtcccatacatgtttggatgggagcggccggccggcgggcggcgacgccgtgcaagactcggcagtaacaagtatgctctgctgacgaatgtagtcccaccaaatcaggagtcctccactgcacgccatgcacactagtggagaaaccgtctttggtcggtcgcccgaaatccacaatagtctcggttccactaaaaaccgggactaaagacggttggtggctacagcgggcatatttgatcggttggtgttaccaatcgggactaaaaatgatttttagttccggttctaaatctgtcaggccttgtcaggccccctgagatcaccaaccgggactaaagataagggatctttaatcccggttgataacatcaaccgggaataaagcgtatgcaccagcccacgcagaagcgcatgcgtagcccctctctctctatcttccatccttatctctttttcttctccttccttatctccatcctctccatccttctccttccat

SEQ ID NO: 2442 - DNA, 15903 bp, Oryza sativa
  unsure (1)..(15903): unsure at all n locations
gtcgcccggtgagtcaagttttttttttattttttttaatttgtggtttgaatgttttgatctgtgaatgaatctatgaatcgatattgtgaatgaatctaggatgttgtgagtgagtatgtgactcgatgttgtcaatgaacctgtgaatcaatattgtgaatatatttgtgatgttgtgaataaatatgtgaatggatattgtgaatgaatttgtggtgaatccgtgaatcgtgctatggagttgtgatgtggatttggggtttgatttgatgatatgcataccactcgattcgggagaaaataaaaaagaaaaaaggaccagctgatggactgccgctaccctctctttagtcccggttggtaagatccctatctttagtcccggttgatgtcatcaaccgggactaaagatcgatctttagtcccggttttttcacccgggactaaagatagcgatctttagtcccggattggtagtcccggtttgaaaaccgggactacagggggttacgaaccgggactaaaaagcacttctccaccagtgatggtttcaccaagcatacataaatccatatactcagccaatgccctatgatagaattgttagagatgccgatcgaacacattacatgtctaacaaactcaacgtacagtataggatagttactcggcacacgtcgtaagtataggatgccggcgatcaccggccgacggccggtggctcgattacgcgcgataatccagctcgtgctgttggttcttgtgatcggcagtggcatcctcgtcgtgccggcggctgggggcacgggaagcagtggccatggtactctcccttcgttatgcaatttttagcatttaaaatatgtctaaaaatataacaattttctagcctacattattttctcaaccaatcatgactctctgccgtttaattttttttacctatattgttttttcgatcaataacaacccttcacaactaatttaatttcacaaacttcttaatacccgtttttaagcataaaactttttatatttcttaatattgtattcaagcctaaaaactttacagaggtagcataccattttctttgcatgttaatgtactccctccgtatcttaatatatgacgccgttaacttttttttatcaacatttgaccattcgccttattcaaattttttgtgtaaatataaaaatatttacgtcatacttaaaaaacatttgatgataaatcaagtcacaataaaataaatgataattacataaatttgttaaattaaaacgaatggtcaaagttagataaaaaatcaatggcatcatacattaaaatacggaggtagtacttttttttggtagcatttgtttggtttggggaccaagtgggatgggttagatctattctaattttttgggatggtatggttctagttgatttatggtatgggatggttatagttttttgtttggtaggaagggatcgaagtgggatgggatggacaactttgcacggaccattagtgtcgtctggctcccaatggctggggtgcagcagcgaacatggggacggtggagctcgtcggcgcgagcggcacacaggtgaaagagtggcggctagagggaggggagtcgacggcgttcgtggaggtggtggccagtcacaaaggcgaggcggcggcgggtcacggaggtggcgtccagtcgcggaggctaggcggcatccggatctaagaggagcagtgaccgctcatggaggagaggcggcggtgggtcgcggacgaatggcggcggtcacggaggtggaggcaggcgcggacgagcggcggtggtcgcggaggtggggcgatcgcggacgaggcggcggcgggtcacagactagcggctgcagtcacggatgtggcagcggtagcacattattcacattaccaattcacagcaatagttacattgacagaacatttacatagacagagagttctaattagtcatataaattgtccacactcacacttggatgcagaataaatattgacatacacataatttttagtcaatacaaattaaatcttcatggcttgcatgagatacaaattaaatctccatgaccaacacacggtgtctccggcacgaggaaagcagggcagcgcgcggtgaaaggcgacggagaactggtggccacggcggcgcacgcctagtgagcaaggctagggatccaatatggctgtggccgaatctggtgcctccgcgccggatttggcctaggtcaagtggccgacacggtaagatatggtcaggagggcagccgtacgtgggcttggcgcggctgaccggcaacaggcacagcaactcccatggccggccagtggtggtagaagggcagctgtgggcatagcgcggcggagggtgcagcacgagcggtgatggaaggaggcctgtcgtgtgcgtggaggccggcgatgagaactggccacccgcaccagcaatatgggttggtaccaatgttatgtcgagcatgagagctattggggtcgattcgtccaagctagctagctagccataccccccttcttctccatggacctcgtccactattatggttgattcccttccggtcatggggagctcttttggtgagacgccagcggtggcggtaatggaagaagatgttccagtgacaaagctccgtgggagttgcgacatggtggctgtgggaggtgacgataaggccgcgttggagactggcgggtctggactggccgacaatggggcactggtacggaggaaccgcattctagcaaaggttgttcagttggtgatgcactggtgtggcgacgataggtgtgggaagggtgttgcaggaaaaagcttagcccaggtttccctgagctgacaacgatgatgtctccgagcgccatgatcaccccttgggtcatcatcgagctgccaccctgccactccttaataggactctctaggtgaaaacctagtccaaatggacggacaatgatggcatctaagatgtcatgacctccctggaggtgttgcctaggaggtctttgttcctcgcctttgtagtcttttctcaacttgtcctatgtggcttattggttgtcgttatctggttggtgcgagggatgagttggtattcttctctcttgctctctccctcatcaaccactctacttagggatgatcgggaactcatctattatttttttggtggaatctatgtcggtggggtgtttgagacccccttgcaggtctagccctgattctaggggtggccggcttggtgcaactgccttatcttggattttgtagggagctcttagcacgcggttgcgatgtgtttgttttgtttcctgattataatcttttaagattgtaattttgtacttatttttatgctacataaatatgaaattttgttctatctagcgtagatcgttccaaaaaagttcaaaaaaaaagagatttgaaatctgggggtgggacaagctactgtagcatagctgaattttgtgcagtaatccttgaatggtgaagcgttcattcaagaacatcaacttctcaatatgtggctaaacctaaattaaggagctcggaactacctggacaagagtcaagaaagacaatgaaattaaagatttatatctcttttatctgttttgaaaagaaaacaaaaagaataactagttaactacattagttttaaaatataatctgtttttgcacgtttttccaaaataaaaatctgaaaaatatacgggaatgtgcgcttctaggcacagtcgcacagattactgtacgtgtggcaccctgccggccggtatcagctgagtaattatggcgtgctcagtgaccctcgagtcacccacgcgcacggcggctcaggggcgaaccctagccgccgccgccgccacccaccctcctcctctctttgcctcgccaccgccggagtttgccgccggtcaaccggtgtcatatccagatttttttgtttcaggatttataaattatctaataaattattaatagaatttaaattaaatgttctttaatttacaagtgaagttaaatgtgggaaataaaatttcctaaatataaagcatggatggatttaatttttattaaattctccatgtttaagtcaactctctgaaattttctcggatttttcagagctcaattcctaaatgatacgaagaacagttcagtaattatttgatcaataatgatctaattataattgttaagagcttttcttgtttaaaaatccttaaattataaattgttgtttaaaaggaattattagaaatgattttaaaagcttaaaagagaagatctaattttaatttgttaaatctcaatataaaatggggccagataaaatttcattaaatactttgcttaattctataattcctagatttttctgggatttatttgagctaaggaagtatttttaataaatggaattgcatttcatgaataatttaaattgaaaaaggttttaaaagtctgttttggctttgggccgaaagccggcccaaaacctctctctttctctctccctccccggcccagtcggcccagtccgcgccgccgctctcttctctttctcagtcgctgacaagtggggcccgtctgtcggggtcgtcgttcttctcgcgtcggccgccgcccgaaaccctagccgagccgcttcgccgccgtttccaatccggtcgccccttttcttctccggccgaattgatagaggggaaacaatcttcgggatctcctctacctttcctcctttggaatcttcgcctatttcggtttggaaactcgtggattcgaggtcgaatcggatcggtctctttcctccgaaccccgatctttccttcgccgtctcagccgccgtgggccttcgccgtcgcctccgagcccctttaaaaggatccccggtgtcttctctacccgccgccaccctcgcctttgtctctcgccgtcggaagcgccctagcgccgtgagaccttgtgccgccgccgtcgccgccgctccagccgtgcgccgccgtcgctccagccgtcgccgtcgctcggggaggtcgtcatcgtggtcgccaagtcgccgccgtcctcgtccgccccttcgccgccgccgaagaccgccggagcaccgccgtcaccgtcgacccgaagaccgccgccgtttcttcctcgtcgccggcgctgtccgttgctcttccgccgcttctttggtcaccggtgagttcgccgcgtcgccctctacccgttggtgccctccgttcgcgtcgccgcgccgtcgttcgccggcgagcatgcaagcccgagccgccgagccgccgccgccggtggtgacgtcatcgctgacgtcatcgtcgccctctcccgtgagccggtcgtggaccgttggatctcggccgtccgttttggatagggttgatctcggccgttcgttcccgtgaactgcctccgtgcgcccggtccaccgcaaaccctagccgctgacgcaataatcctccttttccttttcaaaaataattcattattgcgtcataattcaattaaaattcatataagtgttttaatccgatttaatctttaaaaattcataactaattcattgtaactcagtttaatgtggttcaagttgcaaaagttgtataaaataaagatctacatattaaaattgtccataaattgaattaaatttatttaattctttttaaatgggctttaattatatttaatcttgtaaaattcataataaattcatttgaagtcagaatgaggccgttcaagtctcataattcatctaaaattatgatctacatgtttgtttactttttatgtattgtttatttggtttttattagtcttttttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccctgggttattataacttgactagttgggctttatatattggttcagctagatattagatatgattgcttagccatgcttagaaacattagcacactattgggataacttatgactcactattatttaatgatggcttaatgatagttcacgatggtcaatcgtgattggttaaataattacttgccaactaaaatatggtaaaggtgggttgtgagcacatggttttgagagtcgtgctcatgacaattaaggaccggttcgcgagctactattgtgaaacattaaccatgccaaccacaagccagcgtgggcaacggctttaccttttgtataacatggttcattgcggggcaccagactgagaagtggcggagataagcccacgggggtcgctggggagtccatgccttgtttataagggggtgactatgatccgggaatggtgcgctgcggtggattgtgttatgcaaggggtaatgtcacagcccctttccgaggtaccatggtggtaatgaggcacatggtgacatgatgtggggctgtgtcttgtgggtacagtggtacacctctggccagagtaaaactattcgaatagccgtgcctgcggttatgggcgggttgagcaatgttttttgtgattagtctcacacctctcacaataattatagatgttatacctggtaataatttgcttagctcctggtttggagattagatctgtacagccgggtatggttgttcaggatggttgggcctgtacagcatgggtgtgctgttcagtgttgattaaaatttctgattaattactctactgttttagtactcttaactccttgctaaatgctgctttcgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggcgaagacgtttggcttataccccagttgagctgcctgtgggagtggagccggagcttcgctagattttattttccgctgcagttttcttcatggtgaggactaagtgcctcttaagtaagtatatatcgttttagttaatttgatgaatctgtatattaaattgtcagtttgtgtacctcggctgattcctggacgaggattttatgcacaaataagttcggaaattactagtgaatttccgggcgtgacaaccgggcggggagccgagatggcggtggcggggccataccgcggcgacgcgccgtctccggcgcgagggaggcggggcaaagcgcggcgaggaaggtggggcagagccgggcggagtgtggcgcgccggtgggcgagggaggccggggatccggcaccgcggtggccggatctggccgcacggcgcaaggctgcggctgcagtggcgcgagggctgcgcggcggtggacggggcggtggcgcgagggccgcgcggcggcggaggaggcggcgttgcgagggccacgcggcggcagaggcggcggcacgagggccacgcggcagcggaggcggcgtcagcgcgagggccacgcggcggcggcggcggcggtgacagcgccggctccagtgcaagaacgagaatgacgccgatgccgatgcctcgcggggttgtgacgacgccggtgacgtcctgctcgccgctccggcagaggcagcgcagggaacgcccgcttggcggtgtgtccttgcctctctccggcctgttgtgtgcgggaaggagccgtggaatggtggactgggctagctggttgccgaggagatgacagggtggttcggcaacgactgttgtgtggggcggtggtggcaatggatgaaatcgctggcaaaagccttgcttagcccttggctggcgtgacgacgacgatgtctttggcgtcgttcccttgttagaggcgtcgttatggcgtctttctccgtcgccatcaatctccaggtgaaaactgtgttccggtttccgaacaggcggtggcggcgtttcacgtcgtatccttcatgggggcatcgtcttggagaacactacccttgcatcgattgttgttggtgtactcctgcgtcagctcgaagcactagataccttggtttggcgaggccttctccttggctcctttcttgtattggtggcatccagcttctttgtttgtctctgtcaggtggagtcggagctgctacgtcgttggggtgcgacgatgcttggcaacgataacatttgcagtttctctctaggaatgttggtgttgccagtacaagttttggcgtctcaggggctttggctgatgtccaaagtgtgagctcggtgttgttttgctcgtttggtggtgcctccaatgatattacgatcaccgtgaagtcgaagctgcttggtcgttggacggcaagctcggcaacgatgacatgcgctttgtgatgtcaaagtcgtgtgccacttcttcagcatctcgatgtcgatgttcgtctttggattccgccgtggtagtttggctagaagttgtgtagtgctccgtgtgctgtgtggtttgtaccggccacggttgagggacttggcgagtttctactcgccaagtggttgtatttttctttttctgtaaccctgtctgggtttttactcctgcttaattgaaatataattggcagttctcttgccggtttagtttaaaaaaaaaaattatggcgtgctcaactcttcacgtacatgttctgccgattacagcagaacagcagccagcaggtgttctcctggtctgatctccagcagtagtagtaagagagtatagcaaactgcaaacacactgataatcaataggcgatgatcgatcgactgatcgagcgctggccgtgcgtgcgatgacagtagtgcggttctgctccccgcgtctccttctgctgtcgctacttgttgtaactactgtcataaagaccaacaaatagacacagtccaattttgaaatgttaaattgaattaaatatccaataattaattcgttagatctcactagccggaaacgttcaagtcgcgcgtttcgcataatctccagcgcgtttacaccttggtatctatactacttaagaaaaacagtgacggtgacaatgaatctatcaccccacatagcctcattggaaattttcaaaattatcctttgacttccaaatattaaggtgaatgttccctatagtaaaacgaggatggataatacatctcatagaaaacatattttttatttgtttcaaacaatatctatatctatactatctatattattttaaaagaaggtaggtgttgtagcagtcaatctgccaccccacctacccacattgtaaattttgcaaattactctttgaacctcttaatatcaagatgaatgtttcctatagcaaaacaaggataaatgtgtacaacatttcatgaaaatatatttttattaatttcagacaatattataatttatttttcttctatccgtggcggacccaagattggttcaaggcccgagccagcccatatggagatttaggccttatttgttgtttacatggtgaaaaaattatcatcttaatggaccttcacacctagaccttggatcacggcccaggtggcccaaggcctaggtccatcccagtcttcttccggttccaatagcaacaagcttcactatatacaaaatacaagtcacaagttgctggttggcatctataaggatctcatcggtgtctattctaaaacctcatcactgttgactaactgttactggttggaaaatccgatctttatgtgggtttttcaaccattgcctattatactttagtggcataaatcataatctcccccccccccctaaatatgtacaaaccctagcctatgtctagtttgaagatatagtcatacagacataatccatatgtaggagtaattatctagagcccgtcaccgataataactattggtggcgggcttatgtttaggtccgattgagattatctttgtaatctttgttggcccttaaacataagcatttaattttcagtgatatgtgggccgtctatctaaaactcgtagtaactgcatgacaatagcgttccaccgtggtagactcgtcccgtgcatgtttggacgggagcggccggccggcggcgacgccgtgcaagactcggcagtaacaagtatgctctgctgacgaatgtagtccaccaaatcttagtcgtccactgcacgccatggtttcacgaggcatgcataaatctatccaccgatcagccaatggctgaatacattacatgtctaacaagctcaacaatcagtaagcatttataaagatagtttttctagactgaattatactttattccatcttttattactaaaatttcactgtggattatcctttagttaatatttttattttagagtaagtaaggttatctttgcactttgcaccatattaaatcacttctctatatctatgctctcatctagcaaagaatagcctaaggagtaagattacggtgtataggtgccaacgtgttcaagatctttgatgtgtgttgttgcaagaactcaacaagtgtatgtctagtgctcctgtatccaatgtgcccaaacaagagcggtttttacatatttatacgcgagtatataagagaaaattccttcggtgcccctagccctacaaaggatcttgagtggctggccagtgggccagcccttggccttttggcaacttcacaggtggtaggaaggagacacccattaaggaagcagtgctgatttccgagggagcccgctattacccgggtaaagacatgctctgggtaatagcagactcttcgtctggtcatcatcaacagtgtcagaggtagttgggacgcatggtgcgcatttattccaacccactagcgtctgattcctgacttgagccgctgggggcatattgagactttattcgcccccggcagcgcggcaagctccagaagcctccggactccgaagtctctagccacctccggagtacctttgccgggctccagaagccctccgggttccaaagctcgagatgcctttcgaagccccgtaacccttggatactacggcctcccggatcacccctggaaccctcctggcggtctccgagccttgccaggctccggagctcttggcctccgcgggagctgtttctcctctccgggacccctccgtagcctccggagccgggggctaaagtggcatcgacccacggtcatctccccggggaggatgattctccggagtgctgtagcccttcggaggctgacccctcaatccggagccattccccaacaatgtgcttaaggaaagtttttcggatggtagtctagagtaaaacaaagaaaaaacataattcaaactgaaaagattagcttaaaatgtttgtttgaagcgaaactctgataataaaatgtgacattatattaaaggcaattcaattttctaaaagtaaaaaccggctatatttctcgaaataaatgcagggtcgtggagccacgaggacacccttcctcgtccccgataagacgacgaagagacacgattgtggtactcctactcgcctccgtgagttctatatatatatatgctgctcgcctgaacatctggcttgttagtttgtaaaccatcagtaatatatatagcagcagatagttataccatcaccagctcggcacacgtcgtacaggatgccggcgatcaccggccgacggccggtggctcgattacgcgcgataatccagctcgtgctgctggttcttgtgatcggcagtggcatcctcgtcgtgccggcggctgggagcaccggcaaaaccggcggcacgggaagcagtggcaatggtacgtacagtacttgctacatcttaaaatataaaaacatttagcattcaaaacttatattaaaatatgacaacttttcgatctatgttgttttctcaaccgatcaaaacactccctcaattattttctttacctatatcgtttccttaatcactaacaacccttcgtcattaatttaagagcaaatttcactttgggccaccttttgttaccgatatttcactttggaccaccatttaagtaatattttcactttggactagataaacctgcctttgtttcactttggaccacccgactctcttctcaagcatatgaaccatctcgattacatcgtctctctactcgttaatgaactaccacagctatatgtaagactatttcttcgacatattacaagttggatgtagattgataaaaaagtaagggtggtccaaagtgaaataaagataaaaatacccggtctaaagtgaaaacattagtcctaaggtggtccaaagcgaaacatcagtaataaaaggtagcccaaagtaaaattaactcttaatttaatttcacatatatactctttttagggagaatttgaaccatgctacacaaattttgcatgccaccctgacccatatgtcattgactcatatgggtcttacatatcattgagatatgggtggcatatctcaaattttgcaaatatagggtggcatggttccaacaaaacccatattgaagcctaaaacttcttatatttcttaatacctaataccttattcaagcataaaaacttcttatattttagtttagaacagaggtagtgtaccattttctttacctgttagccatgtatactttatttaatttggtttctcctagtttatatatggcttgcttactttttttttttttgtgtgtgcaggtcgaccaactggtacgggtggtccgtctaccgcatcaccgtacaggacatatggcagacgggttagtgcggttagtggtttcagcgtaggctagccatgacaggtctcggagggcaatggccgcaggcggcggtgacgaatgctcgtgtcttaattagcacagaagggcacacgagagcagcaggcgcgtatgtcgcatgtctggttcattcgttatatgaaaactatctgaattcaccgtcgaaaattgtgccgtcatatataccgatacgtagctcagtttgttgactagtttctgtaataagatgaatttactattcacggtgtgtagaactgtagattaactatatatatgtgactgcaggctgaaatttattttgatttcagccgaatttctcaccggacgatgctaccatgggttggaaatttcggactgaaatttccgaaatttcggtcatttcggaccactctgatatgatattatttcggccaaaatttttaatatttgttaaaatttaacaaaattttattcaaaatttcaaaaatttcaagctgaaattttggtatttcggtgatgtccaatcaaatcggctaaaccaataggtttaaccctgctaccttgtgctcattccgagcagcctcctgttcgctacacgcacttcatctgttgttttgtcatgttaatgggttgaaaatccattaagctgttttgtcatgtttaacaaaagcccagaacactgttatgttttcctaccacttgtgttttatcaatgaggacataaaattcagagggcaaaatgacgacataattttgcaaatctgaactagaaagaacccaaaacttctgaattcacgagtacaaattatactaccaatacaacagaaacttggataatatggcttgacaggggtctgcgtgctgctccaattgatccccgcaacaccgatcagccgtatcatctcccaacgatcttcttcagccatcagtgtcatgttgttcagagcataattaagtaatggtgaactcttactcagccactatgcattcttgtagacaataattagcagctcaatgcgtgaaaacaatgttatgaataattgtcaaagataagtgtttgttaaaaatacggttatgtgtttctaaacagtgaacaacgtggtggctagcattgtgaggccggtcagaccgggtggctgccaccagtcagaccggtggtgttggtgcgatctgaccgagtagcccgatggtcagaccagtagattccaagagggagtaggttttcggttgttttcatggaatttctataaagatttcttcatgtttatgacttctagatggtttctattcgtatgtgatactattctatgctaatgtgagtcaatttggtatgaacttgtacttggacatggaatttctttgttattcatgtataggtgttgcttgaggctacgggagtatagccgatgatagatcgggactagattttggagaagttgagatccagacggtcaaggatatcacatgggatgctcatgctagagagcaatgcacacggaggtaaatgtttccatatatatgtcatacacgtgtgcattgtgcgcttatggaaagaggagttaaatttggaaagattggagtgtggatgttgttttcctgatttggtaggtttcctatatgattgggagtcctagttatagttggattcttggccaggggcatctacattgtggatataaatagaagatgggttgatgctagaagatattaactctttgggagaaaaaaattagggtttgcttcgaggtttcaattctagttcgtgaattgagagatgggtactttagatgcaccttgtaaacacatattgatgcaataaagttgatttatcttcaaaagcatcttcggtgtgtttttctctggaccccgacagtctaaccgacggcataggagtggtcagaccggtggcggtgataatatgggctggtagcaacgttgtgtcgagcatgcgtgttagtggggccggttcatccaaactagctagctagccataccccacttcttctacagggagctctctactactattgttgattccttcacggtcatggggagctctttcggtgagacggtagtggtgggggttggggaataagacgttccaatgacaaagctatgtgggagttgcggatggtgggctatgggaggtcacgatgatggccatgttggagaccggtgggtttggactggacgacagtgtggcaccattgtggcagaaccgcagtctagcaaaggttgttcggttggtggagaaccgaggtggcgaagataggtgcgggaagggtgctgcaggaaaaagcttagctcagggtttccctgagctggcaacaatgacatctttgagcgccatgatcgccccttggggcgttgttgagctaccaccctcccactccttggcaggactctccaggtgaaaatctagtccagatggatagtcaacggtggtgcctaaggtgtcatgacctccccgaagacgttgcctaggaggtctttcactactacaaaaaagacaacaggtgaaacttgggaacctcacaaaggtaccggttttcccaacaggtacctttgagattccacgaaaaaaaaagttggctcgatgcatcagctcgattcgagccaagaagctcccttcaccccgaccaatgaaagaacattcaagaacacaaagaacactaagtcactaatcacatactaattccttcttggaatcgaatcaaccacactttacccccccaaaattaaccacaatcatcatcattgaatcacaaaaggaataatagaatcacaacaacaacaacatctaaaaannnnnnnnnnnnnnnnnnnnnnnnnnnnnnnnnnnnnnnnnnnnnnnnnnnnnnnnn

SEQ ID NO: 2443 - DNA, 2136 bp, Oryza sativa
ccttcaccccgaccaatgaaagaacattcaagaacacaaagaacactaagtcactaatcacatactaattccttcttggaatcgaatcaaccacactttacccccccaaaattaaccacaatcatcatcattgaatcacaaaaggaataatagaatcacaacaacaacaacatctaaaaacatcacagaacttccaagaaccttactcccgtcgccgttggatccaccctcggctgtcgccaccaccatcggatcctcagacgagggagggaggcgagaggggtcagagggagccactaccaccgccgccgcccgatctgccctgggagggaggcaagagggggcggagagagttgccgcccctgacgcccccaccaccaccagatccacccgcggccgccggagacatcgccggatccgctatgggagggaggcgagagggagaggaggagggggcagtgaagagagagagagagagagagtgagagcgagagagatggggaggggtgtcagtttttctttaggatcgacaactatggttcgtgaaaggtgttggttctttgttttttccaccgcgcaaggtgagcaaaagtctataggtgtcggttttaactgttccggcacctatagtgccgacctctatgtgtctttctgtagtagtgtttgttcctcatcttttgtcttcttctctcaacttgcctatgtggcttcttgattgtcatcatcttgttggtgcgagggattagcggatattaattcatctttgaatggtgaagcattcatttaagaacatcaacctctcatatgaggctaaacctaaattaaggagctgggaaatatacctggacaagggtcaagaaagacaatgatactaaagatttatatctatttcatctcttttgaaaataaaaaaaaagaataactacatctattttaaaatataatctgttcttgcacgttttttccaaaataaaaatctgaaaaatatacggcaagtgcgagtccagacagtctcacagattacagattactgtgtggcaccctgccggtatcatctgcaaacggcgtgctcaactcattacgtacatgttctgccgatcgattaccgcgtgatgactgtcagctagcgccgagtgccgccaacccgtgcaagacccggcggatcatgtcgtatctacagctcccagagatgccaactggaccagtctataatttcttctagactcggcacaatcaaacgagtcaagccaggccactagttgcattcagcaagaaaccaagagatttttgcgccgtcgtacgttacgggcgggcggagagtccgcgcgccgggtgagatcgacattctgcccattttaagcgactgccgttttcctattgtcgccgtgcgtctcggctggtacctggctgcagcctgctctgctcccccctggcctcatctccagcagaagtaagagcgtatagcaaacacactgagaatcaataggcgacgatcgatcgagcgctggacgtgcgatgacagtagtgcggttctgctccccgcatctccttctgctgttgctactggttgttactgctagtagtcctgaaatttttacattttgatcctttttgaaaacttagtttacaaatagacccctgaaaaaacttaaaccggaaatggtcctttttgggacgccagagtggttggcgccgtaccccaacatggcggcgccagccacactggcgccgtgcccgtgccaccgtggcaatagggctgtcgtggaggtgctgactaggccgaaaggggctccagccagagtggcgccgcccctcataccacggcgccagcatggctggcgcgcccctcctctgcgggccccaccaactttctcccccctcaaaattttcgccctgttctgcctccgggcaacggctggcgcccccccagaccgcggcgccagggtggctggcgcccccctcctccccccattgaagcccttctgcctccgggcctcggctggcgccgccctcatggaccacggcgccagggtagctggcgccgccctccccccagctcgaaacccttctgcctcgcggcactggctggcgccgccctccccaaccgcgacgccagggtggttggcgccgccctct

SEQ ID NO: 2444 - DNA, 1165 bp, Oryza sativa
  unsure (1)..(1165): unsure at all n locations
ctagggttttttttttggaattttatttttttctggcgattttttctctttgcatgcggtcggcttaagcgcccggattttcgcatgagggtgccctggccgcatgcaaagttggcgattttcacagacgatttcccgcatgcggttgcaccaaccgcatgcgaaaatctctcccgcccgtatgcaaagacctcttttgtagtagtgcttggcttcaagccaaattaccttggcgactggcgagttgtcttttgtgttgtgcatggccagccaatattgaggcaaggaagagaccgggccactgagcgtgcgatatttgtggtggcatcgaacgtaagatcgatgggaacagatgtagcgtggacgtggatggagtattcagtactgtctcgtcatgcagcgagtcctgggaaggatcagcctacctgtcaagcaaatacacgaatgagccttcattttactgatgggcctttgcagagattagaagaatggatttccttggcaaaatttatctatgcaatccatagtgagaaatggcacacgtacaattttttttttcacaaactcttactaacaatgataacaagcgtttgatttatatctatataaaagttataaaaaaatcgagatatacttagaatgacatatcacagttagtaagatccactaagaaaaatttagcacctatagacttttccacggtgagctaacctaaattttaacattgttaactattacaaatgagtaaatggcacattatgatactgactttcaatggctagttgttctgtcagtgtcctaagaaggcagttatgaagacggctatacaagtcacttatcgaagtctaggtgatcatgcaattcattgtttcatactatctattcctctcctaaagtgccggtggacgatggctgaaattgagttgatatgacaattattgagggcagaaatgaatcaattaaatgttagaaacttaaaaggttattttagagaagttctctaataaatccagatggtttttttcccctcaaaatcttaccatcaatgaacttggaaagcgtgataatccgtcgttggttcaaaacaacggtcctagccttccgctgaatnnnnnnnnnnnnnnnnnnnnnnnnnnnnnnnnnnnnnnnnnnnnnnnnnnnnnnn

SEQ ID NO: 2445 - DNA, 716 bp, Oryza sativa
aacaaccgaaaacctactccctcttggaatctactggtctgaccatcgggctactcggtcagatcgcaccaacaccaccggtctgactggtggcagccacccggtctgaccggcctcacaatgctagccaccacgttgttcactgtttagaaacacataaccgtatttttaacaaacacttatctttgacaattattcataacattgttttcacgcattgagctgctaattattgtctacaagaatgcatagtggctgagtaagagttcaccattacttaattatgctctgaacaacatgacactgatggctgaagaagatcgttgggagatgatacggctgatcggtgttgcggggatcaattggagcagcacgcagacccctgtcaagccatattatccaagtttctgttgtattggtagtataatttgtactcgtgaattcagaagttttgggttctttctagttcagatttgcaaaattatgtcgtcattttgccctctgaattttatgtcctcattgataaaacacaagtggtaggaaaacataacagtgttctgggcttttgttaaacatgacaaaacagcttaatggattttcaacccattaacatgacaaaacaacagatgaagtgcgtgtagcgaacaggaggctgctcggaatgagcacaaggtagcagggttaaacctattggtttagccgatttgattggacat

SEQ ID NO: 2446 - DNA, 775 bp, Oryza sativa
aatttaccaccaatttttttgacttcaacacgggaaacccactgcattccacgggtaaaagaaccctgtgcagatctcacctggaccagactcagacgggtcaaggagacgactgtctaccggtgaagtcaaaaggaactgattagttgtattgaagcctactgatgggctactcggttgcttcttgcttcatcacaaagcaaaatcatatccctgccctaatttaatggcagcatgatcgcagctaatctggagcacgtagtaataataataatacttagtgcgcagcgttttgacaatttggcatcttcgatcagatccaacactattaattattaattaatgtctgtaattggagaatggaagaacgatgatacttcctggaaacaatatgttaacactctgtgccacatggacgtcatactcatacctgtaggaacttgtgttaagatgtaaacgcagataattacagaactagggattgaaggtattataggccagcatttgttaggaattaccagctcatctagcggagaattctcgtacgaaggaatactcatgcattgcttgaagaaaccacactcggtcatgtcatattttgaacatccacggagccaaaaggatactcccctccctaaataagtctatttttatatatgaatatatccgtattcacgtataaaagtagacttaattatttaagtaacaaagaaaatatcaacacttattttaagtatttagcttggacaaaccatatcaaaatcctaaaacaagt

SEQ ID NO: 2447 - DNA, 737 bp, Oryza sativa
attcaaaatagtgatttgtcgtgtaccaaaacttttgttaacctcataacaagtcatggtttatactaattgaatgctctctttaaaccaccacgttagttctgggatgtaaaaggaatcattgtagtctagaaattgccacattatcaataattgtatagcctacattggcaagaatcaagcttggtctgtacatagtcgagaagtgaaatttagtataattttaaggtgagaaaaaaatcctcatagcaaggatttctaactgtatacatcaataaaagactaaactgaaaaacggattcgctacatatgcttttgtaacaataattgcgtaagagaacatgcatcaaaacgtaaaacaaaacgtgctccagatctattcaatgtttcacaacatggctgatttgacttagataagtttttcaaaaattgaagtttgaccataagaattatttcgcaatgctgttccacatgttgatgaccagtatatagtttataatctgtgaaattgttcaagcatgtacggaaagcagagcataaacatccatacctctcgttgttgttccgggttcgcagaagccaaggaagtctgaaggttattgcttggagcttgcaattcccccacgggcaccacatgcttgacagcttgttgcattggctgcattgggctagacaagcgatggtgctgatgcaacattgctgggttggccacaccattcctacgatttggcatgtgt

SEQ ID NO: 2448 - DNA, 779 bp, Oryza sativa
ttttttccatataaaaagcgtaaggcttgtaagtttctctatctcttgaggtatggtaccggatatttcatttcctgttagcagcaacacctgtaagcttgttgaaagttttgcgatggaacttggtagggttcctttgaggatgtttttgtccaggcataattgaaccaactgtctactagttatcaatgaggataagaaagaccagtctccagcttctagtcgattcatcccgagattcaattccatcaagtcaggcaggttcccaaaagaaggaataataccatggaatgcattgtcacgaagattaatcacttggagattttttgcaatgcctagtgaagtggggatctgcccttggaattgatttccttgcaagatcagtgttttgatatttggaagggtatatcctatgttatctggaatttctccaatgagtttattagtgcccatgccaaggtatacgagattagacatgttgtacagagaagccggaactgtccctgacaagttgttatatgtcaagtccagttcttgcaagtttggtattctgcttaaactagatggaatggttccctggaagttgttctgtgaaaggtagagtatttcaagggaggagaggttttctatagaggaaggtatgctacctgagagattgttttgggataagctgagataccacagtggtgaggagatatttgagattggtgggatagacccaacaaagttattaactgcaaggcttatgagattaagtgacgagctataaaaagagcaaa

SEQ ID NO: 2449 - DNA, 704 bp, Oryza sativa
attttctttgttacttaaataattaagtctacttttatacgtgaatacggatatattcatatataaaaatagacttatttagggaggggagtatccttttggctccgtggatgttcaaaatatgacatgaccgagtgtggtttcttcaagcaatgcatgagtattccttcgtacgagaattctccgctagatgagctggtaattcctaacaaatgctggcctataataccttcaatccctagttctgtaattatctgcgtttacatcttaacacaagttcctacaggtatgagtatgacgtccatgtggcacagagtgttaacatattgtttccaggaagtatcatcgttcttccattctccaattacagacattaattaataattaatagtgttggatctgatcgaagatgccaaattgtcaaaacgctgcgcactaagtattattattattactacgtgctccagattagctgcgatcatgctgccattaaattagggcagggatatgattttgctttgtgatgaagcaagaagcaaccgagtagcccatcagtaggcttcaatacaactaatcaggtccttttgacttcaccggtagacagtcgtcttcttgaaccgtctgagtcctgtccaggtgagatctgcacagggttcttttacccgtggaatgcagtgagtttccgtgttgaagtcaaaaaaatt

SEQ ID NO: 2450 - DNA, 831 bp, Oryza sativa
  unsure (1)..(831): unsure at all n locations
nnnnnnnnnnnnnnnnnnnnnnnnnnnnnnnnnnnnnnnnnnnnnnnnnnnnnnnntaccgatacatatgcacaagtgaatcaatgccgattcataccctccccgcctcgatcgcagcctcgcgatgacgggcctcatagtacgcctccaaggctgggtaagtcggcggtgtccctcctcggccatcctacatgaaaaagtaataaattcaccgttagttaccaatgtgacatacattaaaagaaaatgaatgcgagaacatgagtaggaaaacaaaatatttacctccctaacacttatattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacccgagtccatttcattcttgaatcgtttcgatctcctcttccctcttgttttaatcttcaaatttgggtcagcaacaaattcttcaccatcgtacggtggccactgtgtggggtcgaggtatggctcaaagcgacttgcccatgtgttcacaacgtgtaacgccccgattttcgttcgggattaaaaatcattaaataatgcattttctagaaatttaataaaaaattaaatcaatttatcaagtgaaaatatggaggaatataaaatttcctttaaaaatattggccggaatattttggaatattctttgcgccctaacatactcctcagaattttccgtgggttttcggagctcaagaagtatttttaaagtcacaaagatca

SEQ ID NO: 2451 - DNA, 9939 bp, Oryza sativa
ccaattcacagttcgcaattcaaatcataattcacagattcgtacagactaaaacaagttccaattgcacaaatcacaatgccaaaagtccatcacatagtccatcacatattccacacatcaaacaatgccaaaagtccatcacatattccacacatcaaacaatgccaaaagtccatcacatatcccacacatcaaacaatgccaaaagtccatcctatattccacacatgaaacaatgtcaaaagtccatcacatagtcctcacatagtccatcacattttatatcacatagtgcaccacatatgtcatactaccaaccaatagattaacttcatacaaatcacttcttccgttggcgccgaattgcttgcgagcccggagtgtacctacatttgaaaatccaatgtttaaaacattttaaaaacaaaataagggaaatcaaataacatttgagaatggtaagctcattttacctctttttcgctgcccgagtggatcgcaagttgtattgcgtgggttgcgtcccttgaggcgcgtcgggaagctgcgacatgtctatatgcgacatgtctatctcctcggcgtctggtgcgacgtagtcctcatcctcctcgtcctcatcgtcatcgtcgtcgctaggtggagccggcgccttcccctttctcctcccttgcttaatgcgtgacgaggacgagccaccaactccttcacgctcttctatcctgatggagtgtcgagcggtacttggacgcgcggatagaggtagtggtggtggtagtctccgcggttggtacacgtcgtccaatccaaccgacctgcaacctaatcttgctgcaagtttctggcacctttgacgaactttctgcatttcaaaaaaaaacaagaagtttgttaggcataactcaagtaatgcaaagtgctaaataaattttacctctaaaacattgcggagtgtgttctccgtgtcctcaccacccctcggagcttggagggcatgccccatttcattcacactcctgaggagctctctcgactgaaagcgtgagaagatatatgttagggtctagggtgcaaatggaaataactttgacaaatgcaagaaaacttacgcctctgtctctaagtggggcgtgctccatttgatatccaactctagtctggacatcatagggattccgcccctcatcggagtcgcggtcatcctctatgtcggcttccgttcaagtagggcggaggaacagtctatatgtcctatgcagccaacgaaggtactctgagaaaatatgattttggtgtatagtctcgatgtacctgtcattccttccggctgtcctccattcatcaatgtatctattatgctctagcccccagtctttcaccttctttgttctcaccctgtcatacctagacaagtagaaggtgatgaaacaatagtgagcatcgacaagggttaaatggtacaaaattgaacattgacaatgaaagcaaacaaagataagaaatatttacttgggtaattcaactccagttgagatgtcctctaccggccaatcttgtttcttcccgaactgtcgcatgacacggtgcggaaggtggtactcaactgcccagaaacaaatcaatgggcactggtacatgaaatagtcagagtttcgattgcacatcgagttcagggtcaggcttgaagcctcatttgtgtggtatggtaaccactcaatctgcaaaagttgaagagatgtcgttggttagtatctcaattaaagaagtaaatgtctaactagaagtgatattggaagtacttacatgttgaggctgtaagcagtccatctcattgacataatgcttatatgccacatcccggtgagcatgtgcagtggcagtactctcaaaaaggtaggccactgtcttctccatatctggctcattgtagggccaaggagtgaagctttgcctccacttaggccttccaaccggtagtcttaaccacatccacagctgaatcaatagcacacaaccactcatgttggatgatggtgcctgacgacaacaggcctcacagagctctctatatgtccacgccaacactgttgagccccaacggaaacggcctagatcaccaaggttggcgaccaaaggaatccatatcgccgaagcaatgtcacccccagcatcaggaaacagaacccctcccaacaagtgcaagatgtatgcacgggcataacactcaacacgccatggctcagcgtcgtcgtcaagatgtgagaagttctgactcagccaagacaggggtattccattctgcttcttcttccccccttgcccctgctcaatgttcagtggaatgccaaacagctgctccacttgtgcacgccatccaggagtctctgtcctgcccgtcacggcatgcccccgtaatgggagggccaagatcatagccacatcctgtagagtgatggtcatctcaccactggggaggtggaagctgtgtgtctcaggcctccatctgtccacaagtgctgtcaacgcaggagcgttgaacactggcattcctctgctcacgaccaaggccaccccgagcaacccggccgcccttaggtacgggatgtacctatcgtcgaacactggaggggcatgagctctgactcagagcggttgaagtacctgcattagcaattgtaaatcaattagttaatataatgtcaaatacacgctaccgatacatatgcacaagtgaatcaatgccgattcataccctccccgcctcgatcgcagcctcgcgatgacgggcctcatagtacgcctccaaggctgggtaagtcggcggttgtccctcctcggccatcctacatgaaaaagtaataaattcaccgttagttaccaatgtgacatacattaaaagaaaatgaatgcgagaacatgagtaggaaaacaaaatatttacctccctaacacttatattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacccgagtccatttcattcttgaatcgtttcgatctcctcttccctcttgttttaatcttcaaatttgggtcagcaacaaattcttcaccatcgtacggtggccactgtgtggggtcgaggtatggctcaaagcgacttgcccatgtgttcacaacgtgtaacgccccgattttcgttcgggattaaaaatcattaaataatgcattttctagaaattaaataaaatttaaatcaatttaatcaagtgaaaatatggaggaaattaaattttcctttaaaaattattggccgggaatattttgtaatattctttgcgccctaacatactctccagaattttccgtgagttttcggagctcaagaagtatttttaaagtcacaaagatcatttaactcaatttaaataaaaaaagaaaacaaataaaatcccctcccctcccttttgggcttggcccaagccttcccctcctctcccgtgggccgcgcgcctcctccctctctcggccggcccgcgccttgtgaaagtctactttacgtcccctggtttccctcctctctctccatccggccgacaggtgggaccgtgggccccacccgtcagctcctcctcctacctctcgccggccaaccccaactgccattgccggccacgtcgccgcaaaatccggcgcccacccgcaccagagctcgcatccaacgacgtgggcacgatcacctccacgtcttccaccatttcccccactcgtcccacaaaaaccagtgctggccgagccgccaccaccccacgtcggcgccccactttccccgcaacgccggcccactccccctcgaaatccgccgcttcccggccctctcctcgtccccttgagctataaaatcaatccccgtggcctcctcttcctttttccccattttcccgagtccccccgccctctaccgtgctctccacaccgatccccatcgccgccgctcgccggcgatctccagccgcgcgccaccgctgctccacccaccggcgcgccaatccgccaccaccgtcggcttcgcgtcgccgtgccgcagcccggcctctactccatttcccctctccgcctccggaacaccgccgcctcgtgcaccacctctctccccctccgccgccgacttcagccgcccaccatcgtcgctctcgtcgtcgccgcacctcgccattcgcaccatcggcatcgccgtgccgagctccaccccggcatccactccgttctcccttccacccccgcagcgccatttccaccgtcgacccgagctttaccaccgcctaccgcctatggctgcctctagccgccatcctcaaccacctcaagccgcgccactgcctctgttagatccaccaccgcgagggcaagcccggccgcccatccctttttcccttccaccaccagaaccacctccccaccacgccaccctaccggccacctttttccgcctccggtcgccattcgccatcaccccggctgccgccgcgacgcgccagccgcatcgcctccctcgccgcgtcacgctcttccccggccgccgctcgaccgacaccttccaccgccgggagcccctccgtgttgtcgacccgaggagcaccgccgcctccctccgccggctgctctcgccgtcgccgtgcccctcgatgagctccgccacctccctctccctctctgcctccgcttcctcttgccgcttcccacgctgcgcgccgccgccctctgtggtcgatcgggccagccccggctgtgcccgtgctcggccatcgctctcctcagccgcccgatcggcttggccgacctgggccatccaacccgtggaccggcggtggaccgtccttgtggtcccggtccacggtggaccgcctcctcgtctcgctgacgtgtggggcccgcctatcggcgccggcctcacttgatgacgtcagcggcagcctttttcctttgtaaaaatatttaataattgcgcaataattcgtaataattctagaaattcatataaatggctcaaaacttctaaaattcatatctaattcattcgaactccgaattgagccattcaacttgcaaaattcatctaaaattgagctctacatgtttgtttactttttatgtactgtttccttggtttttattaaagtttttcctcgttttgcgtgccagcgtgtagaatccgtcgtttcggaagtccgcggtcgcgaggaaaagagtctggaagattgtttcgaagaagcaaggcaagtcacacattccccttgtgcattttgatcctaatttacaaatgttttatcgtttgcaaataaaattgcatgtcttgctaattacatgggatccgggtattacctatctgctcgcttgtgctatgtttacttgatatctgttctttgtcaaccttgggtaataaatcgactagctcatgttacttatgtgacctagctagaactttatgcttagccatgcttaattaccactagctcagttgatgggataattacagtattagacctttttagtatcagaatgagctgcgtgctcaagacatctggccatgtttcatggtcgtaattatccaactaaaatgcgactgaatggtgggttgtgggtgcatggttttgatggtcgcgcccatggcagttaaggaccggttcgcgggaaaccctggaagaattcctcgtactttccacaagccagcgtgggcaacggctgggcttgtagtgtagctttcctctagctgacgcatccaggcaagggtgggcgtgatgtagcggggcgggccctgcgacggcctctgtcgcttccggattcacctaggcacgagaggggactgcccgttgcccgctggggacaggggtgaaacctgaggtgtggtgtgcttggctagagggggttatgcgaagggtcctgtcacggcctctttccggtatgtcgtggtggcatgtcggcgcacggtaacgtgtcgtgaggctgtgtcttgtgggtacagttgtacacctctgatcagagtaaaactattcgaatagccgtacccgcggttatgggcggttcaccagattcaccgtgattagtcccaccctaataaatcgacccaatgcactgtagttcaggtgggttggttgagcctgttcaacgtggtgtagcgttgatcagtggatatttaatgctactttaattactcaatagttttactgctttgctcaataaaatgttttacaaccgcctttatgcaaatagccacaaaccgtccttgtatccccttgcacgtctgcatcattggtgtggcttgctgagtatggtggttgtactcagccttgctattatttccccttttcagaagtgtagtgcttctgagctgaagacgaagttagaagaccaaaactcagaccccagttgagttttgcctgtggagtggagctgaagccccgctaggatcgtctttttccgctgctgctgcgtttgtttcggtataaggactaagtgcctcttctgtaagtattttacgctttatttacgtttggaactatatattacttgtcgttttgtgtaccctggctggtcctggacagggatttaatacacaaaatagtctggaaatttgggctaaatttttgggcgtgacacaacggctcttgaagagaactgatatggcattcggttgggagattcctcatcaattgtatgaatcagataaacgtgtataagatgtgagcaaggcatatggtagagcaatggcctttggcaagaacatgagttcccctcaccttcaactttgaaggctcttgcgctgaatctaacaccaccacgcgttataccacccctctctgtgacctcgtatgtctttttctgcttatcgaaacaccttgcagtgtgtttgttcgccttacttttttgcaccttcatcttactatcaaccttggtggaccaacgctgccctaactggacttgcttcaaagcttcatcatgtttgttcacaaagtagtcattgcacttcatgaacgtaaatgatactatggccatcactggaagcttatgaacaccaactagcacgctattgaactgttcggccatgttggttgtcatgtaaccccaccggcggccatttctatcgtatgcacgagaccacttatctttatccaacaacttatcttcaaaccatttacgaggaccttcgggaatacgctgccttagtgcctcaacatccctctcaaatatccacttctcgtcaatctgacatattcttaggagctcttttgtctgatgcttgtccgcaccggccttgtggaaattagcactgaagtccctcatgcaccaccggtggtgaaccggtggcaatcctggaacaggagtcgtcatggcattcattataccagcatgtcgatctgagataatacaaacctccctatgcggcccaaccacaacccgtcggacaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtattggcctacaatgcttaaaaacctcaatgaaggaccaaagcaccagaatgcacgcataaaaattttcttggtcactccatcaatgttgacaaccctatcaggatgagtatcgatgtggtagaccatactgggattcctctgcttaatggcttgcagcaaagtgggcaaacggacatacgcttcaccccattcaccgtaaatgagcttcatagcctcctctcgtgccctccaagccttgccatacttcaccctatactggaaaacctcaaatatatacaaagctaacacagaagcagagagtgtaggttgcagttttatggcattgcataacctatttgctatgaactttgatgtcagctgccggtggctccctgaaccttcggcagtagcacaactatgttccttacctacccgtgatatcctccacgtgccactagacctcttagttgcatggaccttctatttgcaccgtgggttttcacatttaacagtgtacctcctatttgcggcagaattgacaacacggtatggacgatggtgcacgatggcgtactcctggagccatagcttcattgcgaccatggatgggaactctaaaccctttctgagaccatccacctgaaatggttctgacaactgatctaggttgatgccgccatctagtagtgcaccatgggcatgtgttaggtccctaaactcaggaatgtccggcttcctcccaaacaccttctcaaacgcacaacattcctctaatgctaacttggcattattagtaagtggaggaaatggacggtcatcatcagagtcttcagcaaattcaacatcatattgctcaacacttgcctcctcgtcaacatcatctctattgacttctactgagacagaatcgtgaccaccacttaattcgacatcaaagtaatcatctggattcacatattggcctgctacttctgtcgggtattcagggttgactccatacgacgaccaatgaacactcgccgacaaatgttcacttagatcaagcccctctggtactaactcccttttcatctccctcgctgcatccacatcatcagtaccgcaatgtctctttgatggtcctgcctcccataaattatttccaagcaaaggtctcttcttctctccttccccctccaagtcttctcgtaccaactcagtcttacttgcaccccctccacgacgagaataatatgtcacaaaattcttctcaacgtaatgataagaaggagatttgtttagatccaaattttctacggtacgaactaactttgatgcaaacacctctagagatctaaactgagactcttttaccaaatcaaagtaaacttcccattccaactgacctatcacatttaatatatacttatgcccttgaccaatatcgtatctcccataaaaacgaatctccacattatcctcggtccatccaagaacttctttcactcgtgaccttagttcatctagagttgggtaggtgggaaacaaaatggtcttcaatgacatatcctcaaactcaacatgtgcaccaacataaggttccaccactctatcaccgtagtaaacacgaataagtctatccatctacaccaaaacatcaaatgtaactttgcaacgaaaattaaatcttcattcctaaacgtagtccaaaccgacatattataaccaatgcataacttaaattgtcctaaagctactactccaaaaaaatatttaatccacctacaactatcaacaagtttactagtgcattacacatcgaaatattacaaatactccgtcatacaacccaacctagttctagttaactataatcaatttatataatgcaaccaaaattttcaccttcatataattaatggttaaaagtttaacctatagactatagcatcaagtccatcaaattaaaattactttcatgcctcaaccataatttttcatccatccatccaaccaaaccatccaaaaattaacattaccacatatatggttaaaaaaatcgtgacaccaatgagtacattgcaaacatgtagcactacaacaagccaatcctaagaacaaatgctaaaaatcacaaatttgggtaaaaaaggggttctagggttacccaccgatctacaaattcaaccaataaaaacgaaaaaaaagaggggtgaatgaaggagtctactttctcttcgatttccaaaaaaaaatcccgcgaaaaacgagttcaaatggagtgaa

SEQ ID NO: 2452 - DNA, 17129 bp, Oryza sativa
ggggtctatttgtaaaataagttttcaaaaaggaccaaaatgtaaaaatttcagggattccatcaggacgggacgggatccctttcacccccttgcctatcaaagaggagagagagctaagcgccttagccgtgaggaggaggtggctgccggcgagggccggggaagaggacccgctcggcgagatgtggacacggccatcggcgatgagccctgcgcattaagctcccgcggcatcgaggacctcgtctgcgtcgtgtcgaggcagcggcgcatcgcggccaagccggcggcaggggagacatcgacgaagagaggaggggcagcggtggccggagccaggggacggaggggcggcgatagcggtggccggaccccggggagggagagacggcgatggctggagccaggaaagggagcgatggtggtggctggagccaagggagggagggcggtagtggtcgtcggcttctaatacccagtagaaatcacctgatatctggtaggtatcgcctgatacctcgcaagtatcaccttctacatgataagaatcgcatgatacctggcaagtatcacctgatacttcgcaagtatcacatgatacatgatagaaatcgtctgatatcttgtagatatcacctgatacctcgcaagtatcgcctgataccggttagatatcatcccgtcccaacaggattccattatatagcagcccccttggttgctccgtttttacatgctaggagggtgtcaacgccaaaagttggtatgccccgaaaattatcatcagcctagagtcaatattcgcttcagagttctggaataggtcgatggaaacatcagtcaccaacagttagattctcgatggattcggttcagaaaattaatcaattaaaagaaacttatctaaaagagactgagttcaaggacgatgcgacatgacagtttatctattaattaggtagagttacttatttccttttattttcaggaaagattatttagagcccgatcatgacttgtatcttttattttatctataggaatgtttgtgtcttgtccaataaggactaatatctaccgatgggtataaatatgtagattcggggtccctgtaatctatctccacatatcaatatatatactaggtgacaactgtagcagcatataactgttgcagttttgtaataatttcccacgctattattacagcaaactgaaacatgtcgctaatgttgcagcaaactgatagttttgtcactagagttgtagttttccaaaatttactcttatattatcattggttgattggttgattgctcaagtttttccattatatttatatcgtcatttatccaagtgtcagaatcaatatctcagacccctatcgatatctgctagcatcattacatcagtttgttagctggtcggctatttgatcatcaatttatatatcttgtcagttacaggatcaaactaactggcatgcccgcatctcatcaaaatttaggacctgcactagagctaagcaaatctctcaggccttcatgtgtttccacatagttcacgtaaacgcagatttggcaccatcagccggatgcgaatttttcatcagcaggggaaaggtatccaatcgtagctaccgaacacaaccttatttgtcttagtcaaaacatttatatctttatcatttatcatatgcttcaataacttatatagtttatcatgtgtttctttagattcaccatgagaaatactaaatctattttactccttctgaactgtttcattttatcacttaattaagcgctctaaactactatgttctcattttaacaacaccaccctccccaaaaaaaaaaaaaaaatccccaccacacatcactcttctttatttctctttacatgagtcgtattttaagttgagctttttttaaaagccatacatgataccattatcaaacttttaaaatatttaaaaaaaattcatgattttttgcttgaaatttaaaaccttgatatttaaataaatcttaaaacctatgcaaatagtgataaaaaattaaaaatatttaagtgtaggtcttttcgaatgaaattaatggataaagataaaaaaaagtttacttacgacattaaatgagaagtaacgaattggttggagtactagaaaccacgcgtttagatcgtgagaacaacattagtacggtcagtcaaagtcttcttttcgggagaaaaatcaatcaggttaaatgtgattggcatctcgttatcaatgtttgaagccctggaggcctggacgatggctgcaaaataatttggcgcatgctccatcgagtggcattagcattgactaacagatttcgccaagtcaatcctagattagtttgttattcagtaatccctccatcccaaaattggcggacccagaatttgaatctagggtagacctagaaaaaaaaatccaaatacaatacaatatgattcgacataaaatctggtaaacgatacggtatataactttaaatggttcaatacaaataaaaaataacaaataagtttaaatcttacctaaatgacaatgtaaattgtgtcttcatcaattggagcatcaactacagcaggaacagacgacccttcatccactggtgggattggtagatcacaagatgcaactttttttgcttcatgcttctggaaaagtaacgcaatgctttcttatccatatgcctcaatctcctgacaaccatcaaaccatgtaaaaatgtcatatgatttttattgttgcacacaattttgtggtaatctattgatatggcatacgactagaaatctaaaacttgattattgaaggggatagtactggtcgtctactactactagaactctagaatggggggaggggctgaggaagtgctcactgctcatcgaagagggagtgacgccgggcgctggcggcgccacggcgggcacgcgcgtcggccggaaggccgccagttggacacggtcatgcgggacacagcgcggcggcgcgagtcgcgacgggaaggcgctaaggtgggcaggcccagccgccaaggctagggcgcgccggcgagggccggagagggcgcgagcgcgcgaagccaacggcgccatggcggggcgcgcacatcgggtgggaggtcgccggctagacgcggcgccacggcgcgagtcacgatggaaggcgagcaggcccaggccagggcgcgccggtgagaggcggagtgccactgcaccgtcgtagcctcgcgggacgtgaccacacgggagcgccggagcgatggcgttgctgccgactgccgtgctagcgcagtggtgccgtcgggagtggactaggagacagggagagacggagaatgagaggccaggactggagagttaggggctgtttggcaggactcctctccaagaaaatagctccatctccaagttttttttgccaaacacgagtagtggagtagctctggctcttaaatcgcagctccatctctaggaatattctggagctcctcaaggggtactccaccaaaacctggagtcatatgtcctcatggagatggtaaaaaattacccaccattgccattggttaaaaaaaacgattcgcttctattccacagtaccgccccgttcccgttcctcattcgtgaaaaaaatgattccaccagagcgccgccgagtctgcaggcagatcgccgccgccgccaaccctagagccgccgccaccgagatggctggatccgcctctgtccaagatggatccggcctagaggaggaagtcccggccgccgagatgaccatgggcgccggactggagcatggccacgggcgcggcttccctcctcccgcaaccggccaggggcgcggctgcccgcctcctgctgccggccagtggcgcggccaggggcgcggctgcccgcctcccgctgccggagccgccctgcacccgcctcctgctgccggagcagccctggggcgcggctgcccgcctcccgctgtcggagccatcctggggcacggcagccctgccgccggagccgccgtggggcgcggctgctcacccgccggcgtcgcactggggcgcgggtcccagccgaccggcgctgcccagcagcaagctggtcccccgcgtactggagcgacgaaccaggtaattacttgtctgatatttggatgacatccaatggtataacctcatgtgcttcgtgtatgatatgaagaagctagctaatttgggttgtagtcaaaaccataagcatatggatgaagtattaccttctgttatgtgatatattttttatttcagaaagctaaaatcgtccatttatttgcatcttgaaaactataaaatctctaatttgactggacagggtgattcaatggaatggattgatgagcatactaccattgtttgtcaattgtttgcccaacaagtggtgaaaggaaataggccaaatacccatttgaactccgtaggctatgacgaagtgatccagttgtttcgccaaataactggaattgagttgagtaagcgacagctcaggaataagtgggataagatgaagcctgattttgtggcatggcaaaaattaatgaggcagcaaactggaacaggatgggatcactcaagaggtgtgattgtaatggatgatgagtggtggagaaaggcaaaaaaggtgaattagctttatacctgccccttaattattaactagaattagcttgcttctaacacattgtttcatggttgaaattgaataggatattcctggatgcggcaagtttaggaagaaacccttgcagaatgtagatgaccttaacattatgttttctgacattattaatgatgcatccgatcattggaatcctatgagtgagaaccccatcatacctgagcacatgactgaggaggtccaggaagataatcttgtagttgatgatgaagaggtccaagagacccccatggaggaaatgaatgacgaggcccaggagtgccatgaggtttctccttccattggtattggaaagagaagatctcgggctgttcttgacaaaggcaagaaatcaaagatagggacagcacttgttattcaagaacaaatcaccaagattgctgagtcagcctcctctttcacatcaaaaaagtcaaatgaagtaaccgtgcaacaaatcatggatctagttttggattgtggggcagattatggtagtgatgagcattttattgctatagagttatttgtcaaaaaggaccaaagggacatgtttatgaccctaccaaataaagagtttaggtttaattggcttaggagaaagtacaatgccaagtatggagcatgatccatacttgctgttatgcaggccttcttgttatttcataatttctcccatttgaaatatttgtaatggatttggtgtaataatagtactgttagactcatgcttgtttgtctgattgaatggatttggatgaaggctgggaaaagaaatggcatctacagattgatgtcacttggatgaagtttttttttttctgtgattgtgttaagttaattagtataatttaacaagtgctgtgatggcgtctacagatataatatatgttaagtttattttttatactatttgtaacaagtgctgtgatctaacaagtgttgttctctttttttttggcctgcaggtgactgacagtgaaagtgagagtgagtcaggggactctactgatggtgaccttgttctggaaacttgttttaggtggtgcccaaatagctcaagtttatgctgatatgtaccttcacaaaaatccaccaaggacatcaattcttagtggcatgggatggttgctagagacattgcggactcctggtgaatgtcattcacagcttcgtatgaacacagatctttttttggacctaaatgatttgttggtgcaaaggtatggactcgaaccatccctgcatatgagtactcatgagatgcttgcaatgtttctgtttacatgtggtggaaatgagtccaataggagagctcaaaataggttcaaacattctggtgaaaccattagtagaaaatttgatgaggttttaaattctttgatggccatggcaaaagattacattcgaccaaaagatcccaattttcgttcggttcataagaggataagagatgatagaagaacttttccccatttcaaagattgtattggtgctcttgatggaactcatatccgtgtgtcattgtcacctgatgagcaagttagatatattggaaaaactggaattcccactcaaaatgtgcttgccgtttgtgactttgacatgcgttttacttatgttgcaacgggtcaaccgggagctatgcatgacacaagtgttttatacaatgcattaagagtggatgaaaaattcttccctcatcctccacaaggtaccacacttgtattatgctctctatttgtgctaactgtgcatgtgttactaaaatgtatcaataatcatactatgctatcttttgtaggcaaatactatgttgttgacgcaggatatcctaatcgtcccggttatcttgctccatacaaaggtgagagataccatttaccagagtggcacagaggtatggaacccaatactccaatggaaaaattcaatcgtgtgcactcttccatccgcaatgttattgagcgatcatttggattactaaaaatgaagtggcaaattctgtacaagatgccgtgctaccccatgtacaagcaaaaaatgattgttgtggctgctatggtccttcataattacattcgtgagcatggaggtgaggatcctgattttgctaggtttgatcgtgaccctaattttattccaacaataccagaacggtacaacaaatacgcagttcctcgaacggcatctgatgagtcaactcccgaaagaagtgcaggaactatggatctcttccgtgatgaactagccaccgctttatcaatttcttggcgctagatttgtaagacataagatgataatgtatctttgttggacttcaattatgaacctttgattaaaatgtggtaccttgtgcggattttgctcccaactcgtttctcaattgcggcagatttgcatgtgttccattaagatgtaaaataaatattacgataaaaaaattagctactcggaggtgcaattccctagtacagtagcagcattgccatgcgtgttgctttgcactgtgactgtgcgctctccagtctactgtgtagctcgatcgtggccgttttcgcgttttgctgcaacattacctctcgcagcaggattgaaataggtgcttgcatcgtcttgaaaaaagtctattttataatttttttattttttattataaaaaaattagctattcgagctaattttgtaccgttcttgaaatagctacttgtatcgtcttgcaacaagtctattttgtaatatattttattttttattattgttatggctgtgagaaatattaaacatcactatatattagtaatcaacatccatacaagatccatgggcaaaacagtcctttcactcctcctaccaaatctggagctggaccatatgtattattacccaaacaggtgctagctccaggagctcccggtggagaagatttcctggagaggagctcattttttttgtagaggagctctcccaaacagccccttagggttttttttgttaggccatacttttttgatgggccaagaaaaatgaatatctagtcttttctaggccaaattctagggtagtcctgggcctacatggactaccctttgggttcgccactgccaaaatataaagagttttggttaggacatatcctactattacgaatctggacaaactgatgtatctcatccaaccaaaactctttcagccccattgtttcgtttatttgtggaataagccaaacggcatatttgcagactaaaaagtaaattgtgaataaacttttaatatgtgttcttagcgatctaaaagcaaaggctgaaaaataaacttcgatgaaaaccaaatttaaggttgaaaattcaaattttggctgataaacataagcataagcgaaaagatgaggccctttatattttttaaatggagggagtactaacagtacttagtatactgagtagtactcctactccacttcagtaaggatcataggaccaaaaggaaaagactagtggctcagtttgaaataaattattggatagattgttgtcacggattatctatttaagtatagtgataaagtaaatattttaataaataaacttaacaactaacttaaagtgatctagacaaaacagtaaaagatattatttttaaaataatgtacttttaaagtatgggacaaataatctggttcaacgatccaatacgtaatatgaacaatttgtgcttccttcgtttcaacttcgagtactgatagctcttaaatagttataataatataaagtagagtttaatgaatatgtttagaatttaatatgctttattaataatatggtaattttaattaagtatttagaaaacctttaaagaaaatgagttgtcaaaagtttgaagattaatggtgtacaataacaattatttggaaagatgagttacagtaaatttcaactcacacgtattggtgtgccgaatcgtcgatggatcacggatgtggaagtgattatcgacccttttttgttaaccttccaaataatttagctcagactttgtaccctcacagtgacttgtacaagcgtttactccaattactcccaaacaattcaagccactttttagacttccttaaaaaaagtaactttttttactgggataattgaagcatgttcagttccaacttctacaaaagcatgcatcatgccatcctccaagttcccaccattctctcaaaaacgaacagcaatggctgctttgagagtcttctctacaggcgtcatttgccatcttatatttcatttccttttcttccagccattagccatcagtgatgaaactgagactgatcgagacgctctcctttgcttcaagtcgcagctctcaggtccaactggagttctagcctcatggaacaatgcatccttgttaccctgcaactggcatggagtcacatgcagcaggagagctcctcgccgtgttatcgccattgatctcccatccgaaggcatcataggctcaatatcaccttgtattgccaacatcacctctcttacaaggctgcaactatcaaacaatagcttccatggcggcataccgtctgagcttggcttcctgaacgaactccagaacctcgacctcagcatgaactctctggaaggtaacataccatcagaactctcttcatgttcacaacttcagatcctagatctgcagaacaattccctgcaaggtgagattccacctagtctaagtcaatgtgtgcatcttcaacaaattctccttggcaacaacaagctccaagggagcatcccctctgcttttggggaccttcctaaactgagtgtacttttcctggcaaacaacagactttcaggtgacataccaccctctttgggcagtagccttacactcacatatgtcaatcttgggaagaatgctcttaccggagggatcccaaagcccatgttgaatagttcatctctccaacaactcattctcaatagcaatagtctcagtggagaactcccaaaggctctactcaacacgttgtcacttaacggcatttacctcaaccagaacaatttttccggttctataccacctgttaaaaccgtctctccacaagttcaatatcttgatttaggagaaaactgtctcacaggaacaataccttcctctctggggaacctttcctccctactttatcttcgcctttcacagaattgtttagatgggagcataccagagagcttaggacatattccaacgctacagacattgatgttgactttgaacaatttctctgggacaattccaccacccctcttcaatatgtcatccctgacatttcttactgtggcaaataactcactcaccggaagattacctttagagatcggctatacactcccaaacattgaaggcttgattctattagcaaacaagtttaagggctcaattccaacctctcttctcaattcaacccatctacaaatgctttacctagctgaaaacaagttaactggaatcatgccatcctttggatcactgacaaacttggaggaccttgatgtggcatacaacatgctagaagcaggcgactggggctttatctcgtcactttcaaattgcacaagattgactaagctgatgttggatgggaacaatcttcaaggaaacctgccaagttctgttggcaatctatctagtagtctccaacggttgtggctaagaaataataaaatttccggacctataccacaagagatcggcaatcttaagagcctcactgagttgtacatggattacaatcaattgactggaaatatatctctaacaatcggaaatttgcacaaattaggcattctgtcctttgctcaaaacagactctctggtcaaatcccagacaacattgggaaacttgttcagctgaattatctaaatttggataggaacaacttgagtggaagcatacctctgagtatagggtattgtactcaactcgaaatactcaaccttgctcacaattcactaaatggaacaataccagagacaatctttaaaatttcttcactttcaatggtgttagacttgtcatacaattacttgtccggaagcatatcagatgaagtaggcaaccttgtcaatctgaataagcttatcatttcatacaacagattgtctggagatatcccatccactcttagtcaatgcgtggttctagagtatcttgagatgcaaagcaacttctttgtaggaagcattccgcaaacatttgtgaacatgttaggcatcaaggtgatggatatatctcataacaacttatcgggagaaattccacagtttctaacgttgttgcgttctttgcaagttctcaacttatcattcaataattttcatggagtggtgccaagcagtggtatttttgccaatgctagtgtggtgtcaattgaaggaaatgaccatctgtgcacagaaactccaacgacaggtatgcctctttgttcaaaattggttgacaagaaaaggaaccatagtaggtcattggttctagtcctaacgatagtaataccaattgttgctatcactttcactttattatgccttgcaaaaattatttgtatgaagagaatgcaagcagagccacatgtacaacagctgaatgagcacaggaacataacatatgaagatgttctaaaggccacaaatagattctcttcaactaacttacttggctcaggatcatttggtacagtttataagggcaatctgcattttcctttcaaagaaaagggcaatctgcatcttcaggaagaacatatcgccatcaagatttttaaccttgatatccatggatctaataagagctttgttgccgagtgtgaaaccctacaaaatgtccgccaccgaaatctcgtgaaaattattactctatgttcttctgtggattcaactggggcagacttcaaggctatagtgttcccatattttccaaatgggaatctagatatgtggttacatccaaaatcccatgaacatagtagtcaaacaaaggttctgactttaagacagagaattaatatcgccttggatgtagcatttgctttggattatcttcataaccagtgtgaattgccattagtacattgtgatttgaagccaagcaatattctgttggatagtgacatggttgcacacgtcagtgactttggcctagcaagatttgtatacacaagatcgaatgcacataaagatatatcaacaagcttggcttgtctaaaaggatctattggatatattccaccgggtgagataagctaatttgtaagttgttcattctatttatggtacacatggtgtctggtttctaattttatgatttctataaatctgaatgcagagtatggtatgaacgaagatatctcaaccaagggtgatgtctacagctttggaatccttctcttagaaatggtaacaggtagcagtcctaccgatgaaaattttaatggtgacacaaccctgcatgattttgttgatagagcattgcccgataatactcacgaggttgttgatcccacaatgctacaagatgatatcagtgtagccgatatgatggagaggtgtttcgttccattggttaaaataggactctcatgttcaatggcattgcctagagagcggccagaaatggggcaggtttctaccatgattcttagaatcaaacatgcagcctcaaacatgggtgtcagatgaggcaaattaagatttggcaatttcatgtatagaagaatagtaatgtaacatattagtagcttttcttttccctttttttttttgaaccaacataattagtggcattagcattcgtgccacattccttttaactcttcaaattgaataactacaagcgcagttcaagcaaccagagctaaatcgattagcacaactagcatcagattgaagccaactggatgttctagaggctgattttgtgtcagattgggaccgagacatccgattcgggcatgaatcaagcgcgaaattcgcccaatcagaagtagagcagagtgtagatggatgcacattcagatcgatctagctagcgcagcctaatccagcccaaaatcccaaccacaaatcaatcagacagacggatgagtgaatgagcgtgtacctcatggtcgcggaagccctggttgtggcgccgcccgcgtgctgccgctgcttggacagttgggcctcggcggccgcgtttcgccgccacagctcgttccgcttcgtctcgcgctagcagcccagcacctcggccggcaccgccgctcgccgacgagccctggcaatcgccggtgtcgccggccgtgcggtggatggacggaccacagcgagctttttttttcttttttttaaaaaaaatcacaaccgtcaatcaagcacaagtagacacggaggtaaaaaagacggtgacggggcacggcgagctttttcttcttttttttttctttttttctctttgaaagatccttattactactttcttttacctttttttttttgtcattttcatttttctagatggatgacctgcgtactgttactaataacagagaattggtacattacacggcgcggagccaagaatttgttaagcgattaaccagtatgatttgttcgatcttcatgcccctccgtttttcaataaataaagccattagcttttgagcacgcgtttaaccattcatattgtttaattttttaaatacgtaaaatataaattatacttaaaatatttatagtgataaaaataactcataacaaaatgagataaaacaactcataacaaaataaatatactccataattatgtatttttttctatttttttaataagacaaatagacaaatgtctaaaagtcaacaacatcgtttatattttaaaacagaagtagtattttatttttttaatgaatttacaaagtattagcagacaagcatatggatcgaaccctaattgctaacaaaagacatgctaagttactaacaacacaaaatgcttataaaaagataagctaatagcagcaatctattcggtatcaattggccagataaatgttcattaccatgtttagcaggaaacttaaacagaaaggctcactgccaattttacacatgatttgaccgatctacatggctgtaaaaccaatacacaatcataagccctaagactgccagagtgactagtagcacttattttctgttcagtcatgccagagatataatttgataaaacgaacaggaatttgcaactgtacagattaacatccagagacagcactagaatgttcattaacatacaggattatattacaaggtagttattggatgggtgccacaggaacataaattaacacgtgtataaacatatctgagcagggaaagaacattcagaaatgtagctgcttgcactgagaagcaacagcctctgagggacagtatgggcatttgaagggtctggagctgctctttgatagcttcattatcgattgtttcgacacaacgtgtccgcagggcatcagcattggagggttttcatcactcgactgctctctgagcaccggacatacaaagacagagtggtactggaattctggtccgatatctatgggtactggcagttgtttcatcgcctgccactcctgttttttggcagccatcactgtcgttagcttcagcaaggttggaagtccttgaaagccagctgatactgccacaccaagtgggctctcactagattgccccaaaagactgcagaattgatgggtaagctcctctgctagcttctcccaatgagtcgatgacatgaattcggcataaggggactgatcaagcctatcagcccagagaaggcaggccattagcttttggatctctgccttgtgcaaggatgcaaagggcactaagtgagttcttgcatactttaaagcctcatctctacttccttttgttagtatctcaacaaactgaagctgatgaagtttcaactcaagcattgaaccattctgcaaaagctgatcatggttcttggcagcccaactgagagcaggttggaggtttctaacttgcattgcttcaagaattgaatacatctcttggaattgtagtttcaagtgtgccccatctgattcaccacactcacggacaaatgagtctccaagatcaaaaaggccctggcggtagaaatgatttgctattatgctgtttatagtactggcctcaaaatccacatttcgatatgctttcgatatgtctggactgaaagacttctcgagcagcttgagatatttgctaagtgcaacattcaattccttttgacaaccttctagttgatttagtggcgccaattcattcaacttggctttcaattctgccaggatggatgaatggtcagcagtacccatggaatctgtattcatcatctgcatcttcgtgattgcctgctcaacttcactcactatctgatcaataacttcctgagctttagcagaagaggaagcacgtttttcaataactcgatcaaacgcctctcttagactgtcaagctccattgttgtagacttgtagtgcacactgcacccaactaagcagcagagtatcactgccctgtaccaagtcaaaaaaccacagatatgtaagtagttcattgagaaaacttccagaaagaaattttttttgaaagatgtatgatagagtctaactgctattaaatcagtctgcgttgaattgcagcaagcataacacaggttcagaaactgtaaatgtaaatatttagtgatcaagaagctacagaaagagtacaatggtaaaccatacaacggtaggtatttaacttttctccttgtttctgagataaaaacatcaaaagattagaacattgtctagatgctacaggtaagtgaaatatgtttgggacaagaaaatgctgaacgacaagttgcagagttctattctgcataataacaacattagaacacgccaaaatgacctaacatagtcatatcctcctgacactgaaatcaaaagaatgggaggaaacgaaatgatcatgtaagcctgatcccagaatccaagatcactcacagtgcatgtgttcccactacagagcagaacataaaaggtccatttcaagctttatatatgcattgcttgaactaactcggttgttctaaacaatcggtaaagaatctccatgtgtacgaactgtatgcctcaagaacattgcaaacattaaccattaaaaccacatatatgcgtgaaggtttccttctctcttgatacataacatagcaactaccacgcttaatctgttaaagaaacaatcgcgatagcttatagaagatgcatcactgtaggaaacacatagctcagtgaagaaacaatccatttcactagtataataatgcaacacgattcatgactctcatattctaaatccaatctagcaaccagcacacagagccaaacgtccaatggaaggctcaatccatcccccgttggataatccatacacgaagagaacctatcagtgtgttctatacacaaagagaacctatcctcgaggttccatacgccggttgaacctatcagtggggtagtcaggctcgtcctggacgggatgctagtaatcttttaccccggggcagctgcttgcgggattaatgtcgtatttgtaacctaaactctcttctaaatctcaacaaacttcgcaaaaaaaaaagagagaacctatcagtgtgttcatgcttactacggattggcgcgccgcaaaaagtcacacatgaaccctagggcctatccactctcgacaagccaccagcagcggggcgacccaaagctaaccccggccgcattcaccgaccggatcgaccgctcccccgcgcacggagatcgaaacagggggggtcagtcgccgggattccagactggggggaagggaaaagtgagagcgaaggaaggaaccaatcgaaggggacgggcctcacctcgggcgtactggggagcggacggatcgagcgcggcgcgcggggaggagtcctcccgcctcgacgaccggcaccggcggcggcggcggaggtggcggcgacggcgagggagcggcgctttggtgatggaggaagtggtggttgggggtgggggaggagagagagagagagacgccgcggtggagagagagatcggagatgatggggttgggggtaatctggtaatttttgtgcgtgattgagttcctcgagagaggagagatgggggaggagggacggggcgtgacgcgtgcgccctaggatgctattccgcctacgctaacgctagtgggatgatgaatgggttcgggggctcacgggccgggcttgagccaacag

SEQ ID NO: 2453 - DNA, 30082 bp, Oryza sativa
  unsure (1)..(30082): unsure at all n locations
cnnnnnnnnnnnnnnnnnnnnnnnnnnnnnnnnnnnnnnnnnnnnnnnnnnnnnnnctgtactaaacaggccattaagattatgagaaacagcttgtgaaaatctagaaaaaaactcagcttatatcctatagttcattttctccattatacaactatggattctcagaatttagataaaaatctggactgtttggggctgctagaaactcccccaaacaggcccattatctggttttgattttagggagaaaatcgggttatagttgagacggtaatataggagttttcctagaattaactagaccaactacgctagcaacaagtcacacgcctccttttcgcatcacatacataagtgattttgcttcacactacgcctcctttgcacatcaagtcaaactctgatctttgaagcttccatttgtgttgcaaactttcacctcaaatcaaaaaaagaaattctaaaatatgaaactttcatctcaaatcataaacttccaatcccgaacttccatatcaaaatcacaaaacttccaattgaagatgtgaaactttccacacaacatacaaaaagatttaaaactaaaacttccatataaaaagattcacctaaaaaatccaaaacttccatctaaataaaaaaaatcccacggctcctacagccacaaccatcgttgccttcctgggcgctatcacaaaggtcgcctcctatttcggagaggccgacacgagcatgatgcagccctggctgtgacagagagaacgaagagatagagtccttgtagcagggagcagtggttgatggttgacatcacaacccctagcggtgctagggtcaaaggacctaggggtgcccacttgatggcccgagaaaaacagatagggaagaatagagggtggtcggagacaacggatagggaatgttggatgtcagtaagatggggaaggatggaagcaaccggagatggggattattgggagctggtggagcagatcaacaggtcacaacaagccactttgacagtgtcgaatgagaatggaaggaaagagaaataggagggggtggacgagaaaagaggaatcggtagtctcttcgcttcccaagccttatgggccaagagcatgtgctgcaggcacatatgcgtgaaatagcattaatggagtaacataaggtatttttgaagtttcaagagcgaacgcttaaaattgcgagcaatgctacacatacttataaaattcttatcaacaacatacttatatatatatttttgaatgactcgcattagacagtgcgaagttcatattgatagagcatgaaaaaattacaagattataaccccggaaggtcgtaaccaggaaaaagaaaaaagaataccaccacccacacaccgacaacaccaacgcacagacccagaagaaggctagcactgcgtcggctagcactaagcgtgatcggccgccgctaagccaacaaaggaactatagccaagatcacccaaaaaccaaacccttgcaaccgacaggaacccccgctctatctacatcattgggattgaggaagagagggtgagagagaaaaatggaaccgctctcccccataggccctccgacgtggccaacttgcataaactagtgcgtcgacacaagaggacatgaatctagaatgagcttgcacgagttgtttgggaggcttcggcaagggggttgcctagacaatgtctctagggagagaagtgacgaaagaccgccgccaccgtccgtcaaggtctcaaaaatagtcgcgactaggttttcacccggcagccccactagaggccgagacgacacgacaacgccctcaggagagggagtgacgcttgagcgccattattgccggcccagccaaggccaggctaggttttcacccaccacctgcctatccatagctgcaccgctccaacggcgccccaccttccccccaccggccccaccggtcgcgtcgggcctccgcctccaccggcctcacctccctctacactggccactgccgcagctggcctccaccgccgtcgatcgtgcctccacgcgcgcgcctactagccttcgccgccaatgtcgtcaaggaacacagcgatacgccagcgccaccaggtgtcggagctgcacgtcctcgcagcgaggaccattggccacagctgtcgcgctgccgcaagcctccaccggaccgtgcctcccgaatcgcgccaccacgccaccgcgagcttgccctctcctaatttggccgtagggggagcatttctgcccgatgcccactccggctgccgcctcctgtcagaaacgcgccgctccacctcccacgctgaggagaagctccgccgccaccttcccggccgaccgcttgcttccagcggttagaagggaggggggagggaggtgtcggggtgggtggctagggtttttcccccgggccgcccgcatgagagcgacgcgagggagtgttttacgattcacgtaaacaagtcttatgtgcaccttcactttaacaacatacttataaaattcttaccaacaaattatcaattgtttgatttgactagatggggattatagaaaatctaaatttaatcctaatgtgctacgcgtgtgcgtttgctagaaaaagaatgttgaacacatctataggaaacaacgctttaggtctcaaaatgattagaacaaatatacaccagtaacttcaggtgctgcaggcccaacgaaaaagcatcgctacagcctactgaagtacaaatgaaagcaacggtgcaacaaccaggagagcgatgtcaccaagacgacggaaaaataattgcccattatattacacaaagaatatgatcaattcaaaggcttctggtcaaaggtttatgattctttgcagagacatatacgtgcagcaacaagttgacaaacatatataaaatacaatcaccaatatacgcctacacacaccatctttttttctataacatacacaataacacaaaccttatctacaaaagaccaaaagaagattgaacaaaaacaacatgccataggatccttatgtacagaaaaataagcaaactaatgcctgacaaaagatttatcctactttctgtacaaagtacatcagaacagcacaaacaaaacatcatttttgcaccagatcatcatgagagttcttcgctcgactgcgcccctttggcgaccttgacgaacacgtcttccatggtggtgtccgcgagcccccacgcctggacctccgtcctcctcttgaaattctccacggccatgaacacatccgcgatcctcacctgctgcttcggcagctcgtacttctgtgtcccagacagatggtatactttcctcgcgttcggtgagagctttcgcgccagattctcgacctcttgctcaaactccggggatgttgtcattgtcagcacgtagtaccctccgtatcgcgctatgagctgtcattgaaaatttttgtgttaaatctttagatgaagcaaggaacaaagatagttttaccatccttgagaagttccctttttaatgtataacgctgttgattttttgagatacgtttgaccattcatcttattcaaaagaattatgtaattattatttattttattatgacttaatctatcatcaaatgttctttcaggatgatttaaatatttttatatttgctcagaaattttaaataagatgaatggtcagacgttaattaaaaagtcaacggcgtcatacattaaaaaaagaagggagtaccactttttctatcgtaaaacttggtacttttagatacttgtatcttgaggtaccaaaatttttagtgtaaaattttgatacctagatatactttcttaaatactataaaatttctcgaggaacaatgcttccaatagttatttttattggattatgaagtaggtttgtgagatgattaaacctctttgggtgtcccaatgcactggaggctgccatctaccatgatgcacaacctgtcacagagaacttcagcttcttccatggaatgggctgcaaaagatgtgtcacaggaacaaaaggaagcgtgttaattcaatcatggaagagaaattatgtccaaacacaaggtaggtagtgtatcatattcaaaattggtatgtagtttgaacattactagtaagaacgatcgctctgtctcgcttcgcttgcttcacagcgtcccatagactcttcctcgaagccgggtctaatcctgtactgggctcatccatgtagacaacctgaggccattttatgaatgtgcataagcagggaattatcgatgagtcacaacgcaagaagatgttggtaagcgctgtagctagaaaggtgtactttagcatctccaatcagcgagatggctacactgagacgcctcttcatgccaccactgtacttcctgacttgcttatcaggagcaccaccatgaagtaaatttacacttcttaaagattcgttaacagcctgcaaatcattttcatttcagtaaataactctgaaaggcttctaaatagaaatagtaggaaagcgtcctattcagtatattatactagtaaatttagaagtactgtgtcaaaaaacacatactgaaaatatttcaagacaaatgaaaatgaaaaaaggatgatggagaaaatcagggaagactatctagattatatccattttttcagttcagagaagtattttgctccatgaaaacccatgcacttgacactttatgcttcaaacactcttccattcttaatacatggttcagtgctttcgagcatccactcatttgttcttaattcaaatcctataaggtttctttggagtataaaaatccatataataaagcacatctacgggcataagtattgaaagacagtacattgatattaagatatgctagcttcaccttaaaaattatgctatcagaagaagaaataagggacctggtatacttgatataacttacagtgtccaaatcagagccattgaggctcttcagccgcccataaaactggagatgttctctgccggtcagcatttcccagagcatactgcattcaacatagcaaaaacaaaaggtgataattcgaaggtgtttttacatgaacaagtgctaatgcacacaacagatctgcaatagtaggttgcatatcctactcattctgtggacaaacccccatgctgttatatatcttttccatgtcagtctgtatgctgaactcccgtacgaatgcatttccggatgttggccttgtaagcccaatcatctgtaaggcaacagttggaaggaaacagagattattacagaacaccgaataggatttagaaaactaaagcgcaaaagctataaatttcgggattttaaaaaggacattcagtggttctagaaatatggtcaataaagcataattaattctacagaaatatataaaacattaacagataaaagagaatactataaagaaaaaataatcgtcatggacaagaaatcctacaattataatttatgtgtttaagcagaagaaagagaaaatgactaggcaattgtttggatcaagtatgtcgtgtgagggatcaaattacaaaccatgctaatgaaagagctcttgccagctccattaggaccaagaatgcccaggcactctccataaggcaaagcaagtgatagaccccgaacagcaaacttatcaggattaccatcctttccatgatatactttcttgagatcatcacagacaactgcatagccgctactctgttgttgtagtacttgatcaacagtttccctctgtaatccaatcataaaaaattagcaaccactagatatcaagtagtaggtaacatctgatatgcagatttatgtgattcccaagaaatgaatatagtaaattagtactggatgatatacataattatgtagagtagtttgttgaaaaatattgcagccttataggtaatcctgaaattgcaatgtaaaaaattgcaatgcatttacagaccttattgaactttgctgtgtgtttcttttccttttcctcttttctgtttcatgtaaatatggacttttttatttataaaatttataactactgggtaagtctagtagtgtttcccctcaaaaaaaaatgcattgaggtgggagattgaactgtctgaaagactgatgagtgcaatataagaactataagaaacttacttctttaataatatcttgcttcaccatttctacatgaacagcgtcgttaactacttcgttaatagatacccttctccaagttgggttcttcttcagcagattttttattagggaaaggaaactagatttgtgtccaactgaagcagaatggtccaaatagtacgcaacaggaagcaaaaccaaccattctagaataataataatcagcgcatctctcattccatttgcatggtcatttagatcactccatctcatgccatgacttccagcttcagaagccctaatagcatattggccaagctcatatagtcctcgatacaaagaaaatgcaggtattatctcgagaactgtaatccagtgctctgcagtaacacaacaggaaaattttgtgcaattatttcagccccatttatcaaaataaattgctagcagcaggaaaggcatcccatatggctagtttacttatgtttaaaaactgttgctgccttgctatggcatagtgaaaactgtgatataatattcaaatgaaggtaatgtgattgttaaaaacatccatttggtaatatttgctaaacttacttgggaacttgccaccttcaataaaattgcgaataagagatcctgcaatcaaccccgatccaaatatgtacaggtatgcaattgctggtggaaagaacataagaaacaagaaacatcatatattttgcagtacagaataggtcacggatatggagataaatggtataggtttgttgtaccttgagcagtgttgactttagaaaagaaggttgcagttaggaaggctagtacaatctgcaggttcatgaaactaaaaaagaaaacaaattggatactgtagtcatttatcttgaaaaagtttagacctgcaaattacaactgagttagataaaatgggtcaaatcaagagatgattgttgaaaataactgttgggaatagcttcctacgtataacggatccaaaaacgacagatagaaccgaatacaccatggacaaaataaggaaatatgcatagtagataatccagtaaggggccatccccaagtccatgcattttcatcattgttcggagcttatgttgcttctcatatacaaggtatgtcaacataacttgcattaaatctcaaattttcatcatgaattataaaactgatcatgatttgttctaccagttctctacttttctccacttcaatatatctaatatgaggatcaatattttacttactattaactattaagaaaccctgagagggactagttaacaagtcaaattcatagctactatatcaaaagggaagaccactatcaatttgttgccacttaccgggaaaagcaaggcaacaacccattcaaaaaagagagggccgataacagaagaaaaatcaaatctcaaacgagtctcttgcttaggcatttcttttgtgaatgcaagcaacatttttacacctgatcctcgaagaaactggagatatgcatttgagacctacacagatgcccagaaacatatgttattggtagaactgagttgtatagcttcctgactgctttgcataatagtattgccaagttagagatatttttcagaagtatgatatgactataatgataatgggatcagttttgatccttcaatattctaaacagagtagaaaatttcaaaactatagtgtaaaaaggacaagaaaggtattgtccctaataaattcataatgtgctactatacttactagagaacaagccgaaaacacatgattatgcgtgctcataagttttaaaccctcctggattattacagcctacagttttctagtattatgaatattctggttcacatcagatgtcatgtttccttggatcttcttgtcaatttgttatgaaccataaatgattgcagaatgaaatataaaaatgtttcaaactttttagtgggttggcagacaagaaaaataagaatgagagatccactttacaaattaaacagatatatttgatttcaagaagagtggtaacttgaacccattatctcaactatgatctaccactagtctatggttgtccctaataaaaggtcaattttatgaagtgagacccaccgcgttcaaggagcgcgagatatgcagaagtccaaatggcattggaacataagacacattctgataagttgagttatataaagctaacacgctgaaatgcttctcgtttgagtcttggaaatcataggctgtaataacagaagtaattagagttatttgcacctttaatgccagcatatgatgcaataataaactaatggcataggtaagaaatgcctgcatacccattggaatctcatttatcccttcctgacttttccctttcctgtagccgttgaaggtttcctcatttattattgctgaactattcctccacaagggtaaaccttgaatacataacatctctgctaaaacagaatttgaagttcagatattaagtcattttcaaccaaaaacattcaacaaaacaagaggcacataaacggtaatatgcagaatgtcattgaaggagtgcacagaggttgatggttcttatggcaaacaatgacaatcacaagtctgtcatggtatcaggttaataatctgacaacctcatcagtttgccaacattgttatttcagattaatctactcagaaacagtagaagcgatacataataagaattttacctttccgaatattaatatcaccaaacgtaatggggactgtaactgaatcactggctttgcattgaggtctaagaacatatatgggtcgatctgagacaaaagcgggttcaatgaagcctgtataagtacccggtacatctgtcccctggaagttacatgataatagagtaagttctttgatgttcacccttaaaaaaaagtagccatacaagtaataatatggttatttcaacttacaaggagaagactggatatgctcgcattatcagaaagatttgaaagcggtgagcttgtgaacaaattttgcatgacaactgccaaacaaatgggcaaaaattagtggattatggaatatggtgaacacactacagcttaacagattttccttctctcagataagtcatataatcattatttcatcattactgaaaacaaaaaaataataagagaatcatgcctcacttcttcatccaacaagccctaagcatttttctaaaggggtcctaagtggattttgaggcaggtttaaagaagtagatggtacagaactacagattacttactgttagatagggtctcatttgctcctgtgaagggtatagtagctgcgcaagattgtgattttctgcatgatacatctgggaaacctgcatacaaggaggattcctgcatggcgcgatactcaaggcgcggtaactgcaagagagcaggccattccggggggttcggtatggggcaactgccagcctgatccagtgtagagtactgaattccacacacattttggcaagagcctgtgccgttgacatcaacacacttgcaaccacatctgaacttgggcttgtcaagaacgctgttgatgactctctgaagaatggtgagcaagaggcagaggtatatcggaactatgattagccgaatggttcctttcctgtttcgtttctgcaagaaacgatcaaacatggatgccacttcttaattagcttgactcaacgaccagtttgtgcaattaataaaaaacgaattgcaatcgtgtgaaatgtaaaagacgcttgacagttgacactaataatctacagaaacagccatcgaagtgaaatatgaagcacaaaaacaaaagggatttcagtgcgcctcttcgcgttccaaacatctataattcaaacgatcaaggaaattcacctatgctgatggatgcgtattggtcccaaattctttccattttgacatcaatataaatcaagggacgacggccatgccaaaaagtcaacaacgacgacaagagaatattctgaataaacataactcaagcccacgacttcaccagaacaagttgacgcctacacttcaagaacaacgaaaactagcaaattatgccgaaattttgctgttccttttttttgaaaaaaaaacaacaagtgaaattttgtactgaccatcttgcagtttcctcttttccctaaggcatatcatcagaacaacaaagaagactcatccgagtaccaaacagatcatagcagttaaggcgaagaggaaagaaatggctggatggaaaaagggggatccgaacctggaagatgagattcttgcggaggagggcattcgtctgcgcggtgaagctcggtggcctcgacgcgacggccgccgagggctccatcgcgtcacgcggcggcggttcgcgtgatttcggttttctttctctcgcttctggtggttgactggttgggagttggaggaagggaagaaagagagagtttattagccgttaagacctgggggtggggggattttataggagcaaacgggaggggtacattagatatgtttcccgccattatatgttttctttattttcttttacatatataccattatatacgagggttattacggagcactataccattccaacaaaatattagtttatttgtgcttatatcagcacaatatattaggtaccaaatccagtacctatgataccgtattagtagataggtattgtctcagactctggtatctatgtatcatgatggtgtcagcatggtaccgtaagtattagatttggtaccaagggtatcatacatgatatctcgtagaaactatcatatgatatcttatagaaaatatatcttagtatttaagcgtcagttattctgttgaaacggtatattgttttctagtatttttattagtttttcagctctcctattttttttatcctcgctaaagtgaagcgtagcatagcgctttattagattcgacttcatattgagaagcacagggttgttgtgttggtccaaactccaaacattagagtaaaaatctcggtacctacgttctggtgcagtgatttatctgtcctccctatgtgtatacacatattttaaaagcgtaaactcacaattatattgtatgtggtgtattgaccgtgtgttaaaagtagggatgaaaacggatcggaaacggacggaaactagctttatcatattttttttttcatattttttttcggaatcggaatcggaatcgaaaactcggatacggaaatgaaatcgaatattatcgaatacagatacggagcgaatacgagacggatcgaatacggtagcgaatatttaccggtatataaaaagcccctcaaattgagtttcttaatcaaggaagagatatcacttattattttagttcaacatctccaacatttatatcgtcaattttgtagatggtctcacaaccgtatgtgaaaatcaattttcatggttgtttctctaagagatccatatgcaaatatgattatcattttctattctcaagaccttttattagatgtataacttacttgccattgtataaattggagatgttatttattttacttcacattttcgaaacttgcaatatttgttttatgctttaaatgctttcaaatataaatgttataaactaaaaagtggtagatcctgttgagctctacaactttgatatagaacacatctccatcagatgtcgtttgaattgtagatctgagattttgtaaaaattaatatggtatattataataaatatttagacccttaaatgatctcaaataataaaatagtcaataaaaaagttgtagatctcatcaagctctacaatgttgatataaagtttgtcttcatctgattccgtatgaaaaagttatgtatatatacgtattttttctaaaattttatcaatgtctgtggatatccgaaaaaaaatccggatagtttccgaccgttttccgattccgacggatagtacccttactgtattcgttttcgtttccgagaaaaaaaaatccgaattcgtttccgaatccaagaatttctggatagttccgaccgaaactatccgaatccgaaaaatggtccggacggacggaaactatccgaaccagtttcatccctagttaaaagggcatactcgcgagcatgcgagtgcggtgtatgcatacatcttccaaggatttgaaaaaagaattctaattcaaagtcattatgttcaagcagttaaaagaataaacaaaaacatagagtttaaagagtatggaagtatatattagttctttctttttttccctgcttttttataatgtacatgaatttgaaattttgtaaatagttggaggaagattttaggtacatgtagaattttattttcttaaaaataataagtatttgttagttgctgtgcaccgtcaccgtggttttgtatctactggcagcacaatgatgtttttgcaagaagaaggtagatcaatctgtaataagcaaacgggaaaaaagaaaaaggctcagcggtgtgcacgtatattctctgctgtctgaaaaatcaattaaccgcgttaatagatgtgtaggaaatttccaaatgaatcctcggcaaataacttcaacacaaaaggtacaaaacaattcatgcaagccgcgaagtcaaacattcaaaaatcgcacatcatgtctctaacgtttactctgaatacacatggatcaaatcaaagttcatgattttttcttaaaaaaaaaatggtaggacgaatgcaccgggaattaatatcttattcgtgtggtatccgaaccatatatacttacctggcaaatactcgtgctgactgacaatgacccacatgaaactgcattcgagtatttgactgcatattatttaatttacacacttcctggataattataaggtgtctctgttttcaaggttcaaaaaaatttgttacttggaaattgatcgacgcttgggtctgatttagttcccaactttttcaacaaacttttaacttttctatcacatcaaaacttttctacacacaaacttttaacttttccgtcacatcgttctaattccaatcaaactttcaattttgacgtgaactaaacacacccactttgctgtgaagctgtaaagctgcatatttgctgcccacagtcactttcgattttgccatgttctttttagcttattcaaacgaattatatgctctaattttcagaagatatgttttctcaatatacgtttatctactgcatattgtttggctgtgttattttaagctatcttctttaatttttttcttaacatatttaatttatctctataattaaatagatgatccgcgaaaataatcttaataatcaaatgtccattattccctcttgcgacaattggtctacttatttagattacttgttttaggattttgatatggtttgtccaagctaaatacttaaaataagtgttgatattttctttgttacttaaataattaagtctacttttatacgtgaatacggatatattcatatataaaaatagacttatttagggaggggagtatccttttggctccgtggatgttcaaaatatgacatgaccgagtgtggtttcttcaagcaatgcatgagtattccttcgtacgagaattctccgctagatgagctggtaattcctaacaaatgctggcctataataccttcaatccctagttctgtaattatctgcgtttacatcttaacacaagttcctacaggtatgagtatgacgtccatgtggcacagagtgttaacatattgtttccaggaagtatcatcgttcttccattctccaattacagacattaattaataattaatagtgttggatctgatcgaagatgccaaattgtcaaaacgctgcgcactaagtattattattattactacgtgctccagattagctgcgatcatgctgccattaaattagggcagggatatgattttgctttgtgatgaagcaagaagcaaccgagtagcccatcagtaggcttcaatacaactaatcagttccttttgacttcaccggtagacagtcgtctccttgacccgtctgagtctggtccaggtgagatctgcacagggttcttttacccgtggaatgcagtgggtttcccgtgttgaagtcaaaaaaattggtggtaaattaactccttgcacttgtcaccatgcagtaggtttattttccctactgaaacaacagcacaactgtgaagaacttgtttattactccctttgttttttaatatacgatattgttgactttcgttataacttttgtgcaaatcttaaaaatttcaaataatgcttaatgttactatagtaataaatcaatccacaacaaaagaaaaaataagtaaatatttttaataaaatgaacgttcagatataatgtaaaaagtcaacgacgtatattaaaaaacaaaggaaatactaacattttcagtgcagcaggtaagatatggtttgcgcttcaaccacatgctagtctaaagctatatcaacttcggattacatgtttttcataggaattttaggaaaatactgttcacagagattttttttttctttcctatcattcggatcacgcaaaccactcgtacgaaatttgaagaaaagattcctttgctgctgatttcatgggaaaacacacaggaaaaattcaatttactccaacctcatttacgttttccttgggataacatcgaggcaatcaagcagatgctatcgagaaagaaccttttcacgaacacaagcagagcaagaactatggaggacatgagtaagaagcaatccaattcaaacaagcaagaagcagaagcaaccaaggttgccagccgctcgagcttgcgacggcctgccgccggctgttcgggctccgccgtcccgattcgccatcatctatggcggcaactcgctcttggcgtgtgccagcgtatgagctcgtcacaggggcggagctagcgtccaaacagaggtggtgcactaccattgaaagcctaaaaaaaaaatcaatgcatcactgcacattttagtgttcttgcataagaattttggaggggaggggggtggtgttcctgtgcaccacctgagttgaacgtggctccgccactgactcgtcaggcaatcgccgcctcacttgctctgtctggtacgcgctccgtcgatgggcgcgccaattttgctccgctagtcaccgagctcgccatctccgttgcttgagtattaatataagtcatcgccatatccatcattgtaaaccagacaatttttcatttatacaagattcctcctatagagaatgagcccaaactccattttttaattatacgagtgatcttgtatagttcaaaagttgtatagtttgcaatgatggatatggagccaatgactccatcctaaaaatcagtaacaaaattaaaaggaaatgctaaatgagggaataccgttcacagtgcccacgacggaatcgtcttgctcctcgtcccatagcacttaagcgtggcagcagagcagcgcaacggcggcatgtggcaacgaagaaagaagggggcttgctggcggaggaaggagagagagagagagaggagcacatcgcctctctatttcgcctcacctcgccatcagggagcacatcgccggagaaggggaaggggctctctctggcgtggggcgtggatgacggaggacgcagccggcatcgacgagctccgacgtggcggccgccaacgacgagctccgatgtagcgtggacggtgggaccaccggtgatgatgctttggtgcccggctcctaatacctcgcaagtatcatctaatacgtgatatgaatcgcctaatacctaacaggtatcacctgatatgtgatagaaatcatttgataccttgcaagtatcgcctgatatctcaaaaatatcatgatctcatacctaacggttttcgttctgtcccagcagaattccgttgtataccacatacacaactgtaacttccattactaggtagagcacatgggccccgggtaacagctaaccaaacaggcccacggccccttaacaacgccatttacgcccccacgcaccccacgcctccccccctcgttcgaaaatttcccgattccgccgagcgcacgcctccttcccgcccgccacgcgattcaaacgcccttcccgtgggcccctccccccgctccggcgctcccctcaaaccccacgccacgcgaccctcccctaccccatctcactgacacgtgggcccacggaccaacggcaccacccccgggcccgcacgtcggcgagacacatctcctcctcgcgtgtagggtttcccagccccgcgtgggagttttatttatatacaacgtgtagcactagccattccaaaacgcagaactcgtttcccgtctcgtccgcatcgatcggcgccggcagttttcgaatttggggtttgagaaggttgaggaggagttgggaggttgagaaggcggcggctgattcgttgggttcgatcgggctcatggcgacggcttccggcgatcagtcggcgggtattggatttttttttttctgtttgtttgattgattggggtttaggcgggagatgcgtgtggtttggtcggtgggtgtgatgtgccggttttggtcgtgcaggttccgcggcgagggcgtcgaagctgaggtacccgctccggtcggcgagccgggggaagggcgccgccgatgctcctccgacgagcggctccgtggcgaggaggtctgtctctcctattcgaagctgcaatttctatatgcgagtgaaatctggcatgttggtttgtggaatatacttttgtcggttggaattttcagtgatttgccttcgcttatttagttacaaggacatgttagatgccggcgtttatcacgagaagttctcatctaatttaaaccacatctgctgcgaaactgaattttgctgctccggattagcgttgaaatctttgtttcctacatcaacgtgttgtgcaaatgatttatttgtttccagaatatgtagcacagacgtgtacagctagcaattagatgggtatttacgttgtcaagtggctgattgatctgaaaatagtttggtaaacgaaacatatttattgcaagaacaacaaagtatcgaatggagtgtactgtgtacatgaatcttataggactttatgtcatactgttcatgctgcagacctgcaaatcagttgccatgtgaaaaaaaaagaagttggtgccatctacagaggttgtgcaccaaccagctcactccggttctttacttttagtaatatcaagcaaggactttactactaatatcaatattggatactacataaatctgatttgtgagttgcactcactgtcaaagaagtaaaacatgcaaaacaagaacaaatgtcacaaaaactttctaaggacttgtcaacccacttgccatagtgtaatgcaagttttgtttgttaagaggctggtagaccgatgctctatattgaaagtgcatgtaaacaagctgatttagaaaggttaaccaatagagtttctgtattacttcttgttgaaccatctatggagtatgattagtccaaataatgaaatactcctaagtacatcaaaactcagcgtattcataaggacatgggcataatatttttgaattcaaaacaaagtaaacaaaaaccatcttgacttgaatgcagggtctgctcttcatttcttaagttctataatactggtcgttaggtcatatcatctttgtgtttacatctcagataagatttggtagtcctaactagtttgttccagaggttaagaggtttagctatcacaaggctgcattatctcaatatttctgcaagcttatgggaaaacaataggccagcatacacatgtgtattacttagaaactaagcatctcatggtttggtgctatgtcaagcaaaatagactagcaacttaatgcctcttacttagatgccaactataaaatttgctggatactagctctgtctttgataccatttgtagttttattccttgcagaccaaaaccatctttggatgtcagcaagagcgtttgtggtcttgatctttcatcggtgaaggataattcagccaaacctccacggaggcactcaatacagaccaagccaggtgttagccccaggccaactcctacaggaactatcactcctgtgtcattggttcgttcaaggaggtccgatagtcaagggaagtttgataccccgatatcagaagtttccatgtccacagcaaggcgcaagttcagcactctgtcctcaacctcatattggatgacacaaatcaggcttgcagaggctgcttccaagcactctatatcgttgggcttctttaagcttgcacttgaatcagaatgcgaggtgagcatcaagtgatcatttatgagcagttcagtttctttcattgatcatcatattataataagtgtgcttttccacagcctctggatcgtatgagagatgagctaaaggcttatgttgtccggcatggccttgcaacagagttggaggaaccagtgaaggatattcttcaggtttacaatatcgtggaggatcttgagaagctaaagatcactgtgaactcttcagaacagccgaaaaagtctgacaaggctgctcatagtgccaccaatgtgtcaccaaagggtaatctgaagccaagatcgctgaattctgatgcagctcaaagtaaggaagcagctaaaaaagacaacattcagaagaagcctgatgcaaaggttagaggctcctacaaccggaatcctgcaaaagaagccatcaccaagaatactggtaagaaagccaagaagcaggtcaaggggcagaaggaagattgcaatggaggcagcgaggctttgccagttggtacagagcaagaacctggtaagtgccatcatgtatttcagatattgtaattatcagtatatcacacctgttataactccacaattactgaattgttgtcaatcgttggtgtggtgaatttatatttcagttgatgtggtgaaggaggtgacaaatgaagataaggagaatatggtaagggtggcaatgatgtaacagcaattgagataaacaatacattttctggaaaatctcattatatttcttgtcttgctaatcagttcatttgtacttgtagggggacagtgaaatgccaatggatcttggcatagcccaagaaatctagaacaaccaaaccgacttcagattcaaatctttttatcgctggatatgaagtagagtgtgtggtgcttgttttttcccctcatttgttcatatatcgctggagcttgccttattatcaaaaccataaagaggtctttaagtgtgtagtatggtttgcagggtggatgtttgctttattatccctttgttaagtttgcaattctgaattgtccagtcatgcatctgaatataattgaattctttatttgtgtgatatactcctacttctgggcagaaattccctgctggtgtctgaagttttctcgtattatactgaccgtgtgtcagagcatggtataatcttccattgcgtgtgttatcgagttgattgcatatatgtaaattgcaatcagggaatgaattctatccatgtgtgcgcacgttccatgcgcacatgggtctgcttgtattattggatctgtcatagaatccagagcacatgcacagttttggttaaactgtaggttataagcaacatttatttttgcctgggatcttggtttgcaactttgcaagcttgactcgatttgttcctttatctgccgcatccagtttttatctgtaattgttggcattttcatttaccattctgaagtgattaatgcgttccaacaacaaaagatgctggctagacgcccatctacatcgcaattagtagtagttgcaacatcactgcacctactacagaatagacctgcgacttgtgagatcattccaatcacagaaataggaccggctatatctagaaatagtacaagaaacagcttatccttgtttcttgtcataacaacgtgccaaggacccttttgatttgcaggaaaacatacgaattttagaagattttaatattgtagaaaaattcctatgaagatacttgaaaaatgattgaatcatatcctatcctttgaaaaatcctatggaatggataatcttgtagagattttggaggaaacttaacaataactttaacctctttgaaaaaatttccttttgagtcgatctttctaatatgatttatgatttttgtgttttttccacggtttagtcaaacagttattcctgtgctttccatgcattttgcaatcttctgttttacttatgaattcttaccaaaattctatttttttcctattcctttgtttttccattcctacgattaaaagggccctaaaactatactatcttctctctctttttttttcttcttgaactgtcgtgggaacgaagtgcctacacgaaaatttagtactacttcaaaggtgtttacacagaatgagcttcgtttgcaaaagggcgtgccggtttctaaataggaaaaaacgttgtttgctgtcatctttttcctttctcaatacccgctccttttagattattcacctgattatttgctctatgcatcggaatatatattctctaaaaaaaagagtgaattgcatattaggccatataaatttaccagagtttcagcttagaccacccctaatacaaagatttcactttagaccatatgactttaccatttttttcactttggaccaccccagtccaccatctccaactccagcagcctgctgccactgttggtgtgtgcgccaccactgtgaggatgccaaggtgccgtgagggcttccgcacgattgttgctggcctctgtccactcatccccttcctttcagtttgtataatcgagctaccatcgagcatgggtggcttcctcaaaattgatcaacagaagattagagttggtcggcacatgagctccagccgttcttcgcctgctctggccgagtaactcgagctcagctgaaggctgaagctatctctacgcgaactggcccgatgcacgtgctcgcagcctcgcactcgaccgtacctccttcctagctctctctctctcggatgcattgccggagttggtgaatgcccgaagaagcaacggcttgccgcttgcgtagtgcagtagtggtggcagtcggctagcagatggaaacagatagactgacagaatggtggcccaatgtgcaactagatggtaacaaacccttgcctaaagtgaaaatattgcatatggcctggtccaagatagaaattagacaataatacttggtccatgatgcaattcacttcaaaaaaaaattcttctaccgcattgtttagaccgcttgttttaagttatttattgagtttattttttttatagagaaggatattttttacccggcctctatatccaaccggatatatacggccattgaaataggaaacttagccccacaaacaacccaatctgaaattggctccataggagatttgaactcaggaccttgggtactactcaggtcactgtaaccactaggctacatgccctttcgttaattctgtcaagcagataatttacggtaataattcactcaataatctaaataaagcgtggagctggcactagtgacgtgttttaagcgtaccgctatagaagctactaatacaggttgtataagattctgacaattgcgcaagacaggcaaagacaggggagtatgtaccttcgctgctgcacaaaatgacattgctcataattggtggtcgcgcaaaaaacagatgcaacaacgcaacgttgagcaagaaaacaaacaagttaggtgcaggagcaagaacatcacttcagacagtggcaaaaagccattaagggaaaggaacgggttaggttcctgcacccttttctctggaattctggtgttcttcactgcttctttttgttctttccccctctatttatttgttcattattatctttccttgaagagtgtttgttcatttatttctgaaacgagattagtagtatgttcatttgtgatttgttcattcatccgttggtttgttcatagtttgtctttgtccctgcttctgcacagctgcactagtgcagaacagcatagctgcagattgtgcatccgtcagtgcttggagcccaccatgctgatgttgcaggcgcagtgcatgaaggcagacgtattagtactgcactgcatgatgggggaaccaattgatggcactggcctgggagcttttgccgatcgcttcaagcctggaaaatgacatgccacattgcccggttatcctcaagtctgtcctttaactattcttcacctggatcctgagaatcactagcatgcacattgccatggtaatttggccttgtttagttggggaatatttttaggtttagttgtcacatcaaatatacggacatacatttgaagttaatgtattaaacggagtctaataacaaaaccgtctggaaactgcgagacgaatttattaagcctaattaatctgtcattagaaaatatttattgtagcaccacattgtcaaatcatggtatagttaggcttaaaagattcgtctcgtaatttacatgcaatctgtgtaattgatttttttctacatttaatattccatgcatgtgtccgaatattcgataggacaatgtgatttttttttttttggaattaaacagggcctttgctcagttgcagatgaccgaccaatctgagtcaggtaaacctaagaaccacgtgctccctccatctcaatataaatacatctagcacatgatgtgatatattttagactatgaattcacattctgtattaggtgtacttatatattcggataaagggagtactccgttacctctctagcatagcctagtaccactcgtaatgtacagatatcagtccaaattacccatgggtaaaccacagctcagtgtacagataggcatcatagagacaaaaaaaaaaaaaaccagcattatcatagtagcaagcaaatgtgataggatgactcacatgccacatcaacatcaccattacttgaagccttgaacccatgagacgagaagaaagtgtacacatccacatgaatacatgatccccccgaatttccagtcgccctaccagctaaagccatgaccacgacgattgatgatgctcatctcgatcgatctacagatgcatgcgcgtgtcactggaacgaggatcccctgactttatgcattttgcagttgtgccactgatatgtgggccataccaaagtggggcccacatgtcaagtggcataactgtaaacttcacaaagtcagggatgtttccgtgtcactgtggatgcgggccccacggcacgagtatccgaagaagggaacggtccacgtcagcaccgacacacgcaccaaaagatgctccagcttttgggccttgatgattgagccggaccacgattccatgagtgatggtcgatctccccgatctcggagtcaaagataaaatttaaattttaaaattgattttcatgtttgttcaacatagtattttttttcagttttgacttttaaaatcgctaagtcaattgatttttttttcagttttggtttttaagtcgctaaggacatatgtaaaagttttacccatggattatttttttaatcgctagtaaaccgttacgttacgagttataataaatcataagcaacccataagaacctcaggcactctcgagtggagaattgggtatggaccgatagaggtgtaggagtatgacacgtgggtccattagtatgaatggattttaatgatggatggtgcggatgaatactgaaaaacaatgcgttgactttgtgttttttttttgttgttattagatatgacactgtttgttgaacagaaaattaacccttgattttattaacggaacatacatatgcacgtttatgaaaactaaaacaaatttagtacacgctagtaacacaactatgctaaatagtaatttcgatcatacatacaaggatggagctaaacgaaatagaggagggtggccatttgcttaatttactctactttagatcaagtttaagctaatgcaggtgcctaattttgtattgagatgggcgtgcacacatgatgaaaagatgtgaggtttagcttaaaaaactttattgatcgggttcctggacacccccgtcccatactctacctccgcccctgcatacacagcctatgttaaaggccataagaattctaaggctatttgtgatcgcacgggtcacacatccctagagagacgactatggggaaatcaatagttttactaaatttgagagcctatttgtatttgtgtaatagttatagacatcggttttaaaccctaacggataaaagttttacatgcatgaccagttagccacaccttttgatacttaacttgcctgaaaatagtgttattagcggctgatatgttgctagcgctgtacacgaacgaaacaacccatcatcattcatggtcgtgtagtcaatcagctccttcatggcaaattggcaatggcaaccaaacagactcgatcatattactacacaccaacagtccaaaacaccataccacaaagttcctgtagcgcatttatcaagctgattagcagtaatggttgaggcagagtcagctgttctttatgcttgggttcagaagttttttaaggcagagattcacgggtccaaacaccgtgcaggcgtacagtattaaacaatcaggagtactagtgttagttcaaaaaataaataatgatggtattaaatagggattggttgtttctgatactctttgattcttcaacgcacagcgatcgagcattttaaaattgcaaccagtacggcctgaaactgcaggggcatgttcattggtatgtttgcagccgctcaatcttaatttcaatagttcttttagtaattagtcaaagtacatttggtaacgactactttcacatgtaatttcaactgtagtcacaaagtaccataatgaatttgattccattcccttaaaagaagctccaacaatgaaattgtgaagtacacttcagaaagagcatttttacgcttgcccgctaatttaatgcagaacaaattcaatacaaattggttaacaagcaaggctggaattgtacaactttgtcctggtaaaataaaactgtgcatcttcatttccaaggaaaaaaaaatcagtgggtgatgcatatgaatagttcatgttaggaaaccgccggcccacgaaggcccagcccggttacccactaattgggcccaacattaaacatggaaggtggaagagggaatgtctataaatagaggagtagggaggaggattgtacactagagaatgcaatggatgaatgagaaatgatgccacaccctcatatcttgtgtctccacttttgtaaaattacgggatttttttggactatttcgtgtagcgagagggttgcgtaatagttcaaaccagaggccgtaatattcacaccaaattatgtacacaaattaataccattggtcacttggcagtatataccactagctagcattccacaagagatacagccaaacggatcaagcctaatccgtccgtttctctaatgattttcctccatatatcccccgatcgatgcgtaaccgacacatgcttgggatggcatctcaccaaatccactcaactttcaattcacttgtctttcactctttacagccaaacggaatgtgtcatgttgctgcttaattaacctgattgatccggtttagcaagtgctacatctgacctcaaaagagtgtgcttagattaagtagcatgtccatactgtaactaaccagatccacaaatttaagaatgtgctacaaggtgattggagatgagactttacgcataaatataatattacaaaaaatatatacaatcttttcttaaaaaaatatgatatttttaagttagcgtgcacggtgtgtacatgagaatgctggtatgcataggatacgtttcggagataaaacatttgatccggtagttactcatgtggatagtacggacggaagagaatggaaggaggatgactcgctttcaagacaatgagacctccatctcataagggcacccacaatggttatctataggctctctataagagatccatgtcagtatattttcctacatggaagatattaaatgaagagagagagcaaagctatcactaacttagggatagtctatagagaaaaacgaggcaatgcatgagagagttatagatacccatgtaaacatactattgaggtggtttactattaatctagcctattgctgagatgtacatgttttataaagaacaccttactttactattgcgggtgctctaatgagtttatctttgcctttcctatttatcccaaaataaatttacttttagtaatcattgcattagaatttgtgaaaataggggatggatatattggaagtagataaagtgaaaaataattacattgagattttataaagtagatatttttttttgttttgtgttgtattggtatattttcggccctattgtttggcttatttgtggaataagaaaaatggcatatttgcaaacgagaagtaatttgtgaataaaacttttatatgcatgttcttagcgacttaaaaagcaaatgttgaaaaaaaattcgataaaaaaactcaaaatcagctttaaatttaaggttgaaaatttaaattttaactaataagtataagcataagcgaaaagatgggactgtttatgtatgaggtatgtgaaaattgaagttatttcgagagaaagaaagtaaaaatgaacgtggacagtaacaagcccaaggcctgaaaaaatgacggaagcggcgcaactggtttgacgaccccagcattgcgcatgcggcgtgcaacgacgggcgcactcgcctaacttttttcgtgggaaacgtagtacatgatggtgttcaaagttgaaagcccaaagccactcgattgactcgtagcatccaagttaggtacactccaagccgatgacttattactagcgtccttctccatcatgccacgatcggggaacctggcccattttttcagtttcgtccaattgactactgttagaaaaaataaaaaacatcccattcgacgtgtggaaaaaattcacgcggattgaaccagattagatacgggacaagtgacaaacaaaatattactatcaccgtagtaaaatatgagagattataatacttgcgatggacgtcgttagaacgacatgtatttgtctgactcgacttgatattttgttttatttgactcatcctcataaacgcacacactcgatttgatattttttttactcacccctataatcacacgtacttgaattgatatcttattttactcacccctatggacgcacacacgcacaccctatagttgtctaactcgactttgatattttttttactaacccctataaacgtacacgcgcacactctatccctataaacatctttgcaagaataggccgacatatcgctatcgacgtgtgggctagctccaccagaagaaacctaaccagctaagctacgctcaattcgcgactcgacttgatatctgtgtatattgggtatttgttacggaggtaggattttgtttgttggctaagaaaagcgaaagagaagaaaatattaatctaaggaaggtggagagggcattagtagacgtgatcttccgcaacaattttcttttattttttaaaacctttttattttttatttaaaacaaaccattctaaaaacttattttctaaatttaaatcttctgagcacgccaatccatttagcacagtaaacatcacctgtatttaatgtgatgaaaatcgctatacatacgaccggtacgtacaactcatgtccgaccaacacttaactgctaattgcactagcccacatagagatatgttggtctgcgtggagcggaccgattggcagttaaggttgggtcagatgggggtcggacgagggagtcggacgtatagcaacactcttaatgtgatatccttgtcctgccacgtcaagcatggtgacgtgtcagctgaaccgatgcggtagattagtgtgggctagcgtggttaaaaagttcagatcttgtaaataactcttacaaagaagaggaaaacattcagatcttgtaaataacccttacaaagaagaggaaaacaaactgaacaaatggaattaaatatttgtgtgctgactgctaagcgaattatttagtattgtgaagcgaaagaaatcaatttttcttgctaacattggccaaattggcgtaggtttatttttaaaattaaaaatttaaaaatagaaaaaaaaaagggttccgcgatgcacctgggccctggcgcgcaccgcttaaccgcatacgtcgccgtcgcaccacgacgctcacgcacgcctcgcacatgccatgcaccagtgcagagtgcaccacctctccgaccccaaccaccccctactgcgctccagggcagttaactccggcctgcgcgccctgccctggccccacacccacccagttttcagtcacacctggcgtgcagaacccggacacgtcggacctccggccccacccgtcagcgaaaccagcctccattgaccagtacggggacactgacatggccggcccacctggggtggggcctacgtgtcatggcaatatctggtccagatcgcgggaggggacagtgacgcacagtgtgtgctacgctagcagagtcggcagtggagtagtagtagtagtactagtttggctggcaagcactcgctcgcgcgtcgtccatggccatggccaccacttgcctctcgcctttcttcctcctcccaccaatggccaactaagcgcacgctctcccttgattcgccattgctgaacggagctgcaagctttcgattgctgagttaatcgccgacgtcgcggcggaaatggcttcccgttcgtcgcgcggcgagcgcgtcggtgtggtgttcgtcctcgtcgtcgtcgtcctctgcgtcgacgtctccacgctggtggccgcgcagccgctggtgtcgtcgcaggcgaagacgctgctctgggtgcgccgcctgctgggtttccccccggcgctcgacgcgctggcgggggcacccgacgcgtgcgcgctgccgccaacgccgtcgctcaccgtggcgtgcgcgggcgggcaggtcaccgagctctccgtgctcggcggccgcgcgcccggcgccgcgctgccggccaacttctccgccgacgcgctcttcaccacgctcacccggctcccggcgctgtcgcgcctcacgctcgcgtcgctcggcgtctggggcgagctcccgggcgccaagctccaccgcctccaggcgctgcgggtgctcaacctcaccggcaactgcctctacggcgccgtccccgagcacttctcgcggatgtactcgctgcagagcctcgtgctgtcgcggaacaggctcaatggcgccgtgcccaacctctccgggctcgcgttcctcgacgagctcgacctcggacacaacaggctcggcccggcgttcccggaggtggggaacgcggtggtgcgactggtcctcgccgacaacaacttcaccggg

SEQ ID NO: 2454 - DNA, 6102 bp, Oryza sativa
  unsure (1)..(6102): unsure at all n locations
ccggcaaccgcctgcaggggtggatcccttcctccatcttcgcgctcccggcgctgcggcacatcgacctgtcgcgcaaccagctcgccgggcagctgccggcgagcacggcgtgcgccgacgcgctggcgttcgtcgacgtctcggacaacctgctcgccggggcgcgcccggcgtgcatgcgcggcaactcgtcggcgcgcacggtgctcgacgcgggcaactgcttccgcgacgccaggtcgcagcggccgagcacgtactgcaaccccggcgcgctggccgccgtgctgccgccggcgcaggggaccggcggcgagcaggggtcgggcgggaagggcggccaggtggggatggcccttggcatcgtcggcggcgtcgtggccggcgcggcgctgatcgcgctggtgatgatggccgtgctgaggagggcgaggaggcagaatccggaggtgagcgtcttgcccaagtcgccgctggcgtcgacgccggcggcgaagaagaaggcggcggcggacggcggcaaggcgccggccaaggtgacacagaggattgttactcctgctgaaaagagtaagaggagaaatgcatttgctttgcttaatttgtttttattttgtttttctgcacttcaatttggtacaatgcacttagtcttagttgaattaattatgaaaaggggacacaagattatgcatgggcttcattgaaaggtatatatgattagtgatagagaaaggggcaacacaaagaagtgaagtgctagtactaattagaagcaattacgattagttttgtattgcattgtttctggtgtgaataaaggctactcactttagtgaaatgtgaagtataattaggaagctttgcgtgagctagctagtgtggatcttgcttagactatgagttctgaagcatgggctggatctttattccttgcttcaaagaagactttgagaaagtaaaagcagcaaagtcaatcatcaaactagaaaaaggggggaaaaaacaactaggatcaatggctttagtgaccactaaacaatttgcaggatgatcatttttattcttttttggttgggtaacatgatgtccattgtcatagggcatgcatcacaagctgcaagggtgaatacactagaagtaccagcctaccgtgtgtatacacttgaggagctccaagaagcaaccaacaactttggttcatccaacttgatcaagagttctcctgttgttaaggtatgcagaagtgaagtcattttgagcttcaagcgaaaaatcaaagcaataaatgcacatacaaatgatactccactcatattaaccatttgaagaataatatgcatttcaattttcaaaagaagattgctatgtgccatgcacatttttcttcctttattttcgtgtggagtatattttgagcatgtgtacctgctagcaaactcaaatgtaaattttagaaatccatctccatctttccaaataatccattgcagacctctgcatctcaagtcataatggactagagtacactttggactacaatatcttttgtatttttttctgtcacactttataaatttgatgaataaaaggctctgggtgaatataaaagaatactctcgtaaaaatatatataaaagaatacatttttattggacttaacctgcaactaagaaccttgatgcccttgattacttttaacgtcctaattaagataagtatttgaaagtatgttaatttgaggcattgtacttaggatcaataatattattttcttcaccaatatttacaaaaaaaaatatataagtgcacttgcatcaagtatcattttgcttctagtatatgttgaaggtattggcttattgtacgttatacatgcgctatttttgcaaaagaaagaaagaggaaaaaacacatggaccggctcacattaccttcaagcttccttttcaactggtttacacaactttagctatttatgcctgttctgtttatttgttcttaagtgctttgccactccaatttttgtcatctattgacctttggccatattttcagtacaagttttctgctagaaaattttatttttcatgtgtggcttattgtccttttttgctgatagcattacaacggtcagcttcaagatggttctagagtgtcactgagatgcctgaagctgaaacccaagtattcccctcagagcctgacccaatacatggaaattatttctaaacttcgacaccgccatttggttagcatcatcggtcactgcattgttgaagatcaagagaatcctaatattgctagttcattatgcctcctttctgaatgcgtaacaaatggatccctaagaagtcatctaaccggtaattatattttatgacatcatgcatatataccgcactataactagatatcttcaagtatgtgaatttatccttttactggctggtgcagagtggaggaagcgtgagatgctaaaatggccccaacgtgtttctgctgccattggtgtcgccagagggatccagtttttgcatgatgtgactgctccgggcattgtacacaatgatctaagcatcgaaaatattcttctggacaagacactcacttccaaaatcagcaactttaacctcccgttgatatcaactagcaagaatggcaaggtaagttcgaattttaaattattggggaagctcctaacttgctaacctgatagctaagttgtaaccatgtttatctttcagatattctcagaatccccctttgccacatctgaagacaatgatctcggcaggtacggtgtccttttagatggaaaataacactcccacttgctaaactataacagttgacagtttttctgaacctaaatgattggttgttgaaactcagagatgccacctgacctacctttcagaatgaatgacaatctgattaattttctcaacttgtgaactaaaatgattatgattgtttcttctcgtagcgtgccaagcacagaacaaggggacaaggatgacatttaccagttcggcctaattcttctggaagtaatcacaggcaagccaacagagtccccaaaagacctggactccctgaaaactcaggtaaattgagaatggtttcacatcagagtgaaaaacacctcacaccagcaaatacctaacctttttactactcctcaaaaccagataagtgaagctatagctgaagacccagatttattgaaagacatggcggacccgacgatccgcggaacgttcgccgtcgagtcgctgagcacggtggccgagatagcactcaattgcattgccagtgacacaagcagccggccctccattgaggacgtcctctggaacctgcagtactccatgcaggtgcaggacggttgggcaagcagcgagagcctgagcctgagcaccagatcacagggatgagtaagcacaaaaaagaggggcaatttcacttctccgggtcaagcaaaaagatgcaatttcactttcagattggttgcgattttgctgtaaaagggtgagtttgttgtgctgtttcgttccttttcctgcgattttgctgtgggagaggtgtgtgtgtgttcgtccttttccttgtgtatagaagttctcttgtttttttcctcttgttgctcaaagttgtaacattccagctagagcaattaagaccaaaattattggaccaatattacttatggtgatctggggacagcatttacatctccaccaaacgaaagaggagacatgaattccacaggaacccacataagtttcagggttttgcatacaaaacagtactagtacctaattacctatgtttcatcacaaattaccatatttgagaaataacaactagcaaaacatttaaaagaaccgaacttttgagtctgaaataaggatccatttcaacaaaaaatcctaattaaccatccacacacagtgtaccatcacatgaaaaagaaaaaaaataaacataaagagtacacaaccataaccaatactccaaataatctgcaaacgcaagctgctaaagtcataaactgaacagtcatctaaacagttcccaagtccaaaacacacgacttcaaaagttcatcttattatgataattcatccggccaccaacaccgctcaggcggcgctgaagaaggacggcgcggcggcgtcgccgtcgccggagcctgaatcggcggcggcggcggcggcggtggcggtagcctccaactccagcaccttcatggcctcagcaaccttgtcccggagagtatctggagactctacgaggttcagaacttcagtcttgtccagctcaagcagcatcccagtcaccttataagctttctcgttcaccagctgttcgacgagcgggaacaacatgtcgccaagaatctgtacatcagaaatgggaaaaattaaacattggtgaagttgtagtctaactgtcaataagagaacaaaaatgctatgtccaaccatctcaactcagaaggattttacagagagcaagaatttcatgactataatagaaatcagagcaaggtaataacaattcaaaatagtgatttgtcgtgtaccaaaacttttgttaacctcataacaagtcatggtttatactaattgaatgctctctttaaaccaccacgttagttctgggatgtaaaaggaatcattgtagtctagaaattgccacattatcaataattgtatagcctacattggcaagaatcaagcttggtctgtacatagtcgagaagtgaaatttagtataattttaaggtgagaaaaaaatcctcatagcaaggatttctaactgtatacatcaataaaagactaaactgaaaaacggattcgctacatatgcttttgtaacaataattgcgtaagagaacatgcatcaaaacgtaaaacaaaacgtgctccagatctattcaatgtttcacaacatggctgatttgacttagataagtttttcaaaaattgaagtttgaccataagaattatttcgcaatgctgttccacatgttgatgaccagtatatagtttataatctgtgaaattgttcaagcatgtacggaaagcagagcataaacatccatacctctcgttgttgttccgggttcgcagaagccaaggaagtctgaaggttattgcttggagcttgcaattcccccacgggcaccacatgcttgacagcttgttgcattggctgcattgggctagagaagcgatggtgctgatgcaacattgctgggttggccacaccattcctacgatttggcatgtgtctgaagccctggttggcattttggtgaaacatctacaaagtaacaagcaacgatgttaagtgaagtgaatcctagttaattattaattgctccctccattttaaattagtacttctctttctagacttattctaagtcaaacattttagtttttgacaatcattttttctaaactcatgtagtttgacatcatgatattcatggatttagattcaataccttcataatatataatttacttgtcaaagtacactgttttttaaaaattaatggtaaaaaataaacatgtttgactaagagacacctagaatgataagtaattttaaacgggggagtagctgaagttgcgagtaattgacaacattagcaaaaataagtagatatgataattggatacaattagatgctggatctattgtgttaaaaaagaaaaaaaatatgacaatgatttagccaacaggaatacctggtgaggattatgcagatgtctaggcattcctccatgcggaggaccactcctctggccaggctgcctttgcatgttatatggcatcatcatgtttggaacaaaatttggttggaacccaaagcctgcaggtggtggtggtgggaacaaggcaggcacaccatggccaaaattgaactgatggggagcaatgtttggccctaatgtaggtgccattgttgctagggctctaacacgagcaaaatgtgcctggcaaacaaagaagatatgaatatnnnnnnnnnnnnnnnnnnnnnnnnnnnnnnnnnnnnnnnnnnnnnnnnnnnnnnnn

SEQ ID NO: 2455 - DNA, 632 bp, Oryza sativa
  unsure (1)..(632): unsure at all n locations
nnnnnnnnnnnnnnnnnnnnnnnnnnnnnnnnnnnnnnnnnnnngggatgcctccagtgaggctgttatttgtgagtatatgaccacattcagaaaagagttacttccaagtgagaaaggaatattgccgcttaggttgttatttgaaagatataaaactgaaaggttggagagtgtacctaatccttctgggattactccttgaagtttattgtcaaacaagcagatagcttgaagatttgagcatttgttcatgcttgaggggatctcaccatcaatcgagttatttgagatatcaatgatctgaaggttagagcatgaagacagagcctctggtatcgtgccagtgaggccattagaggtgaggttcaggtaggtgaggcgacgcaaatgaccaatttcaggtggaatgttgccagtcaactgattaaatggaaggtggattattgtcaagaaagtaagattaccaatgcaaggtggtatttggccatggagggtggatgactctaggttcaattcagtgactcgagatgtgtggctcttgctacaagtgacacccggcgcattgacagtattgcgaagaatcatttctccaggaagccatgactccggcattgtcattgagatggagc

SEQ ID NO: 2456 - DNA, 617 bp, Oryza sativa
aatcgactagctatgttacttatgtccctacctgaactttatgtttaccatgtttaattcccctagctcagttattggaatattacagtattagccctttttagttcaagattaagttgcgtcttcaagcctcggcccctggtttcatggtggtaattatccaattaaaatgcgactgaatggtggtttgtgggtgcatggtttaatggtcgcgccatgccagttaagcccggtttcgcggaacaccctggaagttttcctcgtcttttccacaagccagggtgggcaccggctgggcttgtagtgtagctttcctctagctgacgcatccaggcaagggtgggcgttatgtaccggggcggcccttgcgcgggcctctgtcgcttccgaattcacttaggcacgagagggtactgcccgttgcccgttggggacaggggtacaccttgaggtgtggtgtgcttggctagagggggttatgcgaagggtcttgtcacggcctctttccggtatgtcgtggtggcatgtcggcgcacggtaacgtgtcgtgaggctgtgtcttgtgggtacagttgtacacctctgatcagagtaaaactatttgatatagccgttac

SEQ ID NO: 2457 - DNA, 754 bp, Oryza sativa
  unsure (1)..(754): unsure at all n locations
nnnnnnnnnnnnnnnnnnnnnnnnnnnnnnnnnnnnnnnnnnnnnnnnnnnnnnnacccaatgtattctttaacagtaaaaccttaaatcaatttatctgttggctcaagcccggcccgtgagcccccgaacccattcatcatcccactagcgttagcgtaggcggaatagcatcctagggcgcacgcgtcacgccccgtccctcctcccccatctctcctcttttgaggaactcaatcacgcacaaaaattaccagattacccccaaccccatcatcttcgatctctctctccaccgcggcggctctctctctcttttctcccccacccccaaccaccactttcttcatcaccaaagcgccggtccctcgccgtgggcgncaccttcggcgnccgcggcggtgccggtcgtcgaggcgggaggacttcttcccgcgcgccgcgcttgatccgtnccgttcccagtacgcccgaggtgaggcccgtccccttcgattgggtcctttcttcgctctcactttttccttccccccagtctggaattccggcgactgaccccccctgtttcgatcttcgtgcgcggnggagcggtcgatcccgtcggtgaatgcgggcggggttagctttgggtcgccccgctgctggtggcttgtcagaggggataggccctaagggtcatgtgtgactttttgggcgcgccatccgtagtaggatgaacacactgataagttcttttttttttttttgcgaagtt

SEQ ID NO: 2458 - DNA, 807 bp, Oryza sativa
  unsure (1)..(807): unsure at all n locations
ttaggcaagggtttgtacccatctagttgcacattgggccaccattctgtcagtctatctgtttccatctgctagccgactgccaccactactgcactacgcaagcggcaagccgttgcttcttcgggcattcaccaactccgcaatgcatccgagagagagagagctagaaaggaggtacggtcgagtgcgaggctgcgagcacgtgcatcgggccagttcgcgtagagatagcttcagccttcagctgagctcgagttactcggccagagcaggcgaagaacggctggagctcatgtgccgaccaactctaatcttctgttgatcaattttgaggaagccacccatgctcgatggtagctcgattatacaaactgaaaggaaggggatgagtggacagaggccagcaacaatcgtgcggaagccctcacggcaccttggcatcctcacagtggtggcgcacacaccaacagtggcagcaggctgctggagttggagatggtggactggggtggtccaaagtgaaaaaaatggtaaagtcatatggtctaaagtgaaatctttgtattaggggtggtctaagctgaaactctggtaaatttatatggcctaatatgcaattcactcttttttttagagaatatatattccgatgcatagagcaaataatcaggtgaataatctaaaaggagcgggtattgagaaggggaaaagatgacagcaaacaacgttttttcctatttagaaaccngcacgcccttttgcaacgaagctcattctgtgtaaacaccttggagtagtactaaa

SEQ ID NO: 2459 - DNA, 734 bp, Oryza sativa
ccccatttctggccgctctctaggcaatgccattgaacatgagagtcctattttaaccaatggaacgaaacacctctccatcatatcggctacactgatatcatcttgtagcattggggatcaacaacctcgtgagtattatcgggcaatgctctatcaacaaaatcatgcagggttgtgtcaccattaaaattttcatcggtaggactgctacctgttaccatttctaagagaaggattccaaagctgtagacatcacccttggttgagatatcttcgttcataccatactctgcattcagatttatagaaatcataaaattagaaaccagacaccatgtgtaccataaatagaatgaacaacttacaaattagcttatctcacccggtggaatatatccaatagatccttttagacaagccaagcttggtgatatatctttatgtgcattcgatcttgtgtatacaaatcttgctaggccaaagtcactgacgtgtgcaaccatgtcactatccaacaaaatattgcttggcttcaaatcacaatgtactaatggcaattcacactggttatgaagataatccaaagcaaatgctacatccaaggcgatattaattctctgtcttaaagtcagaacctttgtttgactactatgttcatggggattttggatgtaaccacatatctagattcccatttggaaaatatgggaacactataggcctgaagtctg

SEQ ID NO: 2460 - DNA, 563 bp, Oryza sativa
tggttgtgagataccagggattgggtcgccaggacgtatgtatgcgcccctctcgggtcgaaaaccagggcagtcttcgtccatatgggagggatctgttaacggagagctaagatccgacgtcttttttaaagagataaatgattatttttagtagcagcaagagtatcactaaacagaatacaaaaggtcgaatattatggatgtgtaaataaaaccacctaccttgcaatagaggtcaaaaacagggcgttcatcacctggtttgacctacgaggatagttaaacgatcaactagaaactgatgctatgatctttaagagaaaaatagggacaagaactaagaaaccttccctccaaccaatctgaaatacttctaaactggatgctggggcatcaccattatcagttatgatccaaactgaaccataactgaccaattggcctggggttaacgagaagccataaacatccatcgttgctataaatccatagcgcacttcatatgtgtttgttatgtacccagtcctctgggaaataaacaacaagttagttacataaat

SEQ ID NO: 2461 - DNA, 679 bp, Oryza sativa
ttcaatggtagtgcaccacctctgtttggacgctagctccgcccctgtgacgagctcatacgctggcacacgccaagagcgagttgccgccatagatgatggcgaatcgggacggcggagcccgaacagccggcggcaggccgtcgcaagctcgagcggctggcaaccttggttgcttctgcttcttgcttgtttgaattggattgcttcttactcatgtcctccatagttcttgctctgcttgtgttcgtgaaaaggttctttctcgatagcatctgcttgattgcctcgatgttatcccaaggaaaacgtaaatgaggttggagtaaattgaatttttcctgtgtgttttcccatgaaatcagcagcaaaggaatcttttcttcaaatttcgtacgagtggtttgcgtgatccgaatgataggaaagaaaaaaaaaatctctgtgaacagtattttcctaaaattcctatgaaaaacatgtaatccgaagttgatatagctttagactagcatgtggttgaagcgcaaaccatatcttacctgctgcactgaaaatgttagtatttcctttgttttttaatatacgtcgttgactttttacattatatctgaacgttcattttattaaaaatattaacttattttttcttttgttgtggattgatttattactatag

SEQ ID NO: 2462 - DNA, 694 bp, Oryza sativa
  unsure (1)..(694): unsure at all n locations
nnnnnnnnnnnnnnnnnnnnnnnnnnnnnnnnnnnnnnnntatctcaattgctgttacatcattgccacccttaccatattctccttatcttcatttgtcacctccttcaccacatcaactgaaatataaattcaccacaccaacgattgacaacacattcagtaattggtggagttataacaggtgtgatatactgataattacaatatctgaaatacatgatggcacttaccaggttcttgctctgtaccaactggcaaagccttgctgcctccattgcaatcttccttctgccccttgacctgcttcttggctttcttaccagtattcttggtgatggcttcttttgcaggattccggttgtaggagcctctaacctttgcatcaggcttcttctgaatgttgtcttttttagctgcttccttactttgagctgcatcagaaatcaacgatcttggctttaaattacccttttgtgacacattggtggcactattagcagcccttgcagactttttcggctgttctgaagaggtcacagtgatctttaacttctcaagatcctccacgatatttgtaacctggaaaatattcttcactggttcttcaactctgttgcaggccatccggacaacataaacccttagctcatctctataccaaacagaggctgtggaaaagccacttattata

SEQ ID NO: 2463 - DNA, 658 bp, Oryza sativa
cttatacaataatttaagttatattagaaaaagataagtttgcattatctcggatgacttgggagaagaaaacatagtattatgcgcaaaatggataacaatgtcacgcgtgattatgagttaaatggaggtgactggatgagtaatcaatgattaaattaaatggatgagtagcttctttatccaacggctgataactatgtactaatacaactcgatggcttagaattattgatgatgtggtttcttatatgctttgctttatacaagtaaatgctccttagtgggtacaactatataggaagatatgatgagttaactaccccagagagagagagagagaggagcggccaccacttgcgagcccttcccctcgtcgtcccctcctccgcttcatcccactttggagttggagtactcggcgaactcccctatcccattcccaccaccgcagcccgtacaccgaaatcccaaccaattggaccaaccaatgtggtcaccatatggcgatgtcctcaggagctctgcacgccaggtgtttgatggaatggtcctggcatcagctgcattgcacaggttagtgtgtgaaatctacgatatctcggatattatgaacccattttggattactacgattcttgtcccaattacgaatgca

SEQ ID NO: 2464 - DNA, 44293 bp, Oryza sativa
  unsure (1)..(44293): unsure at all n locations
nnnnnnnnnnnnnnnnnnnnnnnnnnnnnnnnnnnnnnnnatctccggccgtgaggccaaagaaaaccaaagctaaaccgtcatcggccaggactccaaatccttggcagttacgagtaatctggatgaagtctatatattgctggtcatgcctgtgcatcgattatgcaatacggcgcctcaggtgtttaactccatcgcaggtatatatccattgtcgattctttagccgccggaattaggacgcttcttgatcatcctgtactttttcatcaggaaccatctcgagatggccagggaagacggagcatccaggggtgcaggcgagcgtggcgccagcgaccggggcggcggagagcgtgtcccgcgagacgggcggagaacgggggacaggcgagtaacatgggacaggcgctcggcaggagatagacacactgtcgaagataagcgcccgggaggatccggcggcaagcaacagaaggaggccaagggtgacaacccttcccagcatatcgcgaagatcccggtccgtagagatgatcgaggaggatacaaacgccacggcgagtcaatcgaattcctgcgtgactggcgtcataagaaggagagaactgctcgtcctgacaaaccttcattgccgaaatcttctaaaaagggtctgcgtattgaagaatctccacatcccgagctggaccgcaccatgcgtgagaagcgaggaaaaaccccggtagtttacaagagggtgtcgtccacggaatcttcaagcgatgatcgtcgccgctgccgccgctctgtggttgccgacacggagcttgatgctgtccagttgagcgactcctcctcttcttcttcttctgatggcactggcaaggtattcgtgtttccccaattcttttttttcttaaaattctatgtcatagtggtttgataacctgtttctttaggacatacttgcaactcaggatacgatagagcaggcaaatgctttgggtgggacctaaagctactgcctcttccgatgttgctccggtacctattgacgatgtaccttcagttgtgccggctgctaatgctcctgtccgctcttctccggtgatgccggcggctgatgccgcttcagctccgggaccctcgactcaaaagcatcaggaaggtaaggatgactagactcctaatagaggtcatattctcctttgctttctcttgatgtattttcttctttctttggttcttctgagaaaagtgtactatacccattgtagaaacttcaagcaatcctttcggcacggctcgccagatgaacgagttgatggagaagacgtcccgttaccttgctgagttcgggacgggtggtcgctatctccaacttaactctgtgagttccgcgactgacgaattgccgacgctggagcttccaaagtccacgcccactgaacgccggaacgcccgcatggtggaggaggatctatttagcatccaagattgtttgatggagaaacctctgaacaaggaaggcaccatagagtacattggtgctgccaccgctgcatgggaaaatagttacgagattggacgccccacagacttggagaagttgatgtcttacttgggagcacttgtccaacgtcttaagggagagctcccggtaacctttgaagggagaactttagctgctcatgaaggcgaggcgcgctcttccttagcaaagctagagagtgcatgttcagacgtgctaccagaccttgacctcctcaagagtggccatgaagacgtggctgcggaccttcagaagtccaagcaagcaggggctacctggaagaaagaggcggaggaacatgagctgaaagccaaagatgcgagggagaaggagcaccagtgtttggaatcagaggaggcagccgccaagaacctgcaagtttatgatagtaccatcgacggcgtcatgcagctgataaagcgtcgtgacgaggcgaaggtctatttggggcatcttgctgaagagaggaaactccttgcagtggccgcgccgccagaggtggccgccattctatcatatcgtagagaatcggcgcctcggggtagtacgtcgaagaattagaatagcctccatatgcttctccttggtttaccttaattaggattttttttcgagtcatgtaaagcacattagaagcgctcttaacttagatgatcagctagctagttttcaatctttgaataaagttggggcattatcatgcacccattaattaggagtacttgttttattatttgagtctgtcatattgtcttcatcgatatatatggagtgcttgtgttttgtcctctttgtttttttttttcaacttgctaatatgtattatcccttctgtatccgaatactcggcactgcgcgcatgcggccaccgtcgcatatagaacccgccgaagatcctgccgggacccgagagctgatatatgggaatatatggctgtaatctataagtgcatgaatacatatgaacttctgttgattatcacggcggcaacatattgagccaaggccagccagcagtttgcattgttaagttaattcctttttaacaaacccatcttgtggcaatgtggccgagcaatcagagggcgacacatcatcaccatgctacagtgtcatgcacaaattctgtactcacgcagctgcatgcatgatctcttccatcaatttctggtttgccttctgtacaagttgcttcatataatacatcaacccatgtggggtagtagcaccgttcagaaaatctggcgctttgaggataggtgaagaataaaaataacttcaggcataaactgtcctcctgaagtcttgaggcgaagacctatgccttcaaataataattaaaggaattttgtcgggaccaagtataggtgccagccaacaaaataacttgaattcgtctcctactcgcagcgaaaaagacccatgccacaattgagacattttatcagaccgattgagaccgttgatatatcacggtgcctgcctcatcagcatgaagggtttcacggcttggcgctgaccgcgttggcacgccgccccgctcccaagaaaaacatcttatcaatccggacgcgaccacttgactgttgtggtgccgacccgtcaggttgaaaggtgtatagcccgatggcgacttcagagtgttatgttgcctctaaatgacgtgaagcgaaaaccctgcatcacgaaaaggaaaacgaaagaggaaaaaaaaactagagtacggttactagagccgagcaaaccaggtgagttgatagaaagaaacccagcaataaaatgattttgttgatttttcttttaaaatgttggctttcccactgaacactggctatgtggtagcgtcaagataagattgccgaagaacgtgtcgcgggaatcgccgaatgaccatgacgattgctccctgtcaacctaacttcctggtgtgcttgtgtataggagtagcatacatggtgatactttcagaaggcagcgaaaatccatgctctagcctttcagttcactaggtaccaccacgagtcccatgcccccggtattgtgcttcatcgaaccgagagaattaggtatggctgaattaagatagggttataggggaacggctgtgagagtggccttttccttttgccgaggatggtgaatggctatcctcctccttctgacagaatgcaatggagatcactaattgtttggatctttttgtttctttttttttttgcttcgcggcttcatgacaccacggcttcattgagattgatattggattgttttcttgagttgagatcatcacgactttgttgagattgatctgagatcttggcatccttaaaacttggaggacaaccattcccctttgtgggctatgtaatcctcgcaggcccatttcttttgtaaagtcccttgttgacatgcctcacagggatggcaagtggctgcacactgaaccacaacttgtgttgaggtaggtagccctttcttactcttctcctatagtcttccctggggcttagtatctccataggtctgaagcacaccgaaggacacgaaggcgtggggaccttgttactaggaagtaacccaatcaagtctttttgctattcctcggaaatatgcacccgtagtacttgtgtgttggtgtgaaggatgtttagttgtaagcacagtctgtcatggtcatccattgaatcctgcagaggtgttctaaggttgccttgtcttcttctaccagctcaatgcaatatggtgaaagccattttgatttttttttgttggacgtggcgtccattttgtaaaacaaaacatggagcaccaaacaatgcaatggtcaatgcacgttggcaagctcacaatgttgttttttttaaagaaaacaagaaaacaagaggcacagggttttatacaaaatatttttttaagaacctcccgttgattggcggcatcggttgtgatccttgatgatcaatcagctggtaagcacctccgtcatatgcttgctcgatgacgtatggcccctcccattttggctcgaactttcccttcatcttgtgtgtaacgacgatgggacgtcgcagaacgagtacgagctcgcccttcctgaagactcgttgcttgacgagcttatcataggctctcaccatgttttggcgatacaactccagattttgaagggcgcctaggcgctcttcctccacggcatcaagctcctgaaatcgaaggcgaatctgttcgtctttagtaagttcatcgtggattgctactcgtagagatggtagctgaatctccaatggcaacacagcttcattcccatagacgagagagtatggggtagcttgtgtcggggtacgaactgtgactcggtacgcccatagtgcttcataaagacgatcatgccaatcccttcgatgcttgtctaccgtcttctttaagatcttgccgagggtcttgttgaaggcttcggccatcccatttgcttgagggtaataaccggtggagtagttccatttgatcttgtatttctccatgaacctatagatcttctgggatttaaaggctttggcgttgtcggaggtaatgcgatgtggtaccccgaagcggtagatgatgtgccgttcgaggaagttgatgacgtcactgctcttcacttcacgcagaggcacagcttccgcccacttggagaagtagtctgttgcagtgaggatgaagcgatgcccccttgaagaaggtggattgatgaggccgatgacgtcgattccccaggcatcgaacggccaagaagggaccgtcgggtgaagcggagccggcggttggtgcttgaaattgtcatggatctggcaaccatgacaggttttagctgtctttaggcaatccgccataatgcctggccaatagtaccctaccagtcggatgctatggtacatttttggtccgctttgatgcccaccgcatactccatggtggacttcttggagaactcgattggcttcactccgatcaacgcatcgaagtaagacctcttgcccgtaagaccgcttgtagaggacaccggccttgtagatgtatgagggaagtcgtcgctgtagttggcgtctctcgacaggatcttcaggtagagagccgtgcttgaagtaatcgaggaagggttgacgccagtcttcctcttcagcagaattagttatgatgatgttgacttcttcggggatgagctctaggacagctggaagaagccacctttcttcaacaacaatttgcgcaggattgtctccttgaaagaccaatgctgcagccagttttgccagggcgtcagcaggcgcatttttgcttcgtggcacatggatgacctcgatgtgttcaaacttgtccataagcctccgggccactgtgtaatatggcaccagttctggtttacgaacctcataaatattgttgatttgtctaataatgagccgagaatccccatgggctcttaaggaacgtacctccatagagagcgccaagagaagaccaaagataagagcctcatattccgcctcattgttagaacactcctccttgagaagagagaacgagtggtagatcacacctccttgtggagttttgaacaccaatcccgccccggctctccgtcgaggggtgccgtcggggttgatgtccttacgtgaggctccgtcgaagtaaagctcccactgttcctgaagctctgcggtgaaaatctcttcatccggtagattggcgatgagtggggagtcatctggcattggatgtgtagcaagaaattctgccaaggcttggcccttaattgctttttgcggtacaaaagtgatatcatattccatcatgagcagggcccatttacctagtcgcccggtgagcacaggctgacttagcacataccttatagggtccgcccttgcaatgagctggatctggtgcgccaacatgtagtgccttagtttcttcaatgcaaatatgagggctaaacataacttctcaattggggagtaattttgttcagcaccaaccatggtgcgacttaaatagtagcaagccacctccttcccttcatcattatgttgagcgaggagagcgcctatcgaggcaggctgcgttgcaatgtagagaataagggggcgccctttaacaggagctgccagtacaggaggattaagcaagtacctcttgatactatcgaagccattttggcattcttcatcccacacaaagggtgtgcccttcttcatgagttttgagaagggttggatccggcccgagaggttggagatgaagcgtcggatgtacgccagcttcccttgtagtttcctcagatccttgagttcttgagggggcggcatattaagtatcgccttgatcttttttggctcgatctcgatccctcgatgacggatgacgaagccgaggaagacaccggattggacgccaaaggcgcacttgagagggttcatcttaagttggtgtcgacgtagtcgctcgaagacaatgcgaaggtcttcttgatgatgttcgtgatctttggtcttgaccaccatgtcatcaacataacattccactgaatgatgaattaaatcgtcgaggacgaactgcatggcacgctggtatgtggcaccggcgttcttcaacccgaacggcatgacagtgtagtagaagttccctttaggggttctaaacgccgtgtcgaaggcatcaaggagatccatcttgatctggttataacctgacagtgcgccataacccgttgttgaatcgaccaccatctccgtgattggtaggggaaagtcgtctttaggacaagcacgattcaagtcgcgaaagtctacgcagactcgaacttgtccattcttcttttccacagggacgatgttggctaaccaccgaggatattgtatctccttgataaaacccacgttgatgagtcgatcgacttcggcgatgacttggtcttggaactctggccttaagcgccttggtggttgcttcactgggcgaaattggggatcaatcgccagcttatgggtggcgacacgagagtcaagtcccggcatctccttgtatgtccaagcgaagcaatctcggaattccatcaagaagcttcgatagtcttctcgctcttcttctgtcagcatgccactaacgaaaatagggcgcggatcatcctcagttcctaaattcatctccaccaactcgtcaatggttggttggccaccgtcgtcaagttgtttaagagcccctgcaacatcgagctcctcttctactccaacagctgcaacctcaaaggggtgttgttggagtaaagcatcacctcttgtagtggtacttatggtgcaacaatgaaatatatcgtcttcaaatacttcatcttcatcatcgggttcatctacgttgatgtagccgagaccgtactttggttgttctttacatctcctcttgataaactcttccgcttgtgcccaccagtcctcgcatactgctggaggtggtggcaacctgttgtttcgctgtagattgatgcccgccttctccaataggcgagccattctaggctcagccttcatggtcgtgcacgcttcttctctagcggggtagaaactgaagtgtagagggctgggggctgcatgcactgagcacccgcttttacctcctctatctctgcaactctcttcttgaccactccctgttgtgcaagcgcggcttccttgcttggactccgtcttgcctgtaaggtgatggtagttggcacatcgccgttgcttttgggcggtttctcgcttcctcgagaagttgcccccaaggtgatcagtgttgaggtagagcgtcttgctttgagcaatattggtgtagtagatggggtagacgtgctggtttcagcgggagatgggagcttggtgctgaggttggttgctgaagaagaatttccccgcctactattcttgtgattccttgacgatgattcgctaatgattggggagcatggcataatgaggcatctcacctcaggggttgtctcggtgccgggttcaacaatgatgtcggctgctggtgttgttcgcccaagttgttgcttgttttcttcaacagggaagtaatacttggcgtcggcatggtatgattcttgaatagtgtatggtgagaaattgctagtgatgcgctgttgcactccattgccgtcaaggaattttaggcattgatggagagtagacggcacgacacggtacttgtgaatccacggtcgtcccaagagagcagagtatgatgtgttggcttcaataacaaagaaccgcaccttgaagctgaatgtagacatttggatcttgatagtaatggcgcctaatgttggcttgccctgattgtcaaagccgcaaatcaccacgtctattggctccaagtcttttgttgtgaaacctgctcgagttagacttcgaacgggtagaatgttcacagcagatcctaggtcaatgagaatccgtcgaagatgagcagaaccaatgtttccttcaatgtagaggggacgattgtgatcgccccctttgatgatgttatcttcatcagcgaaggtaatctcattcacgaacaaggggttgtcgtagagtcgatgcttagccatatcaacttcgtaaacttccggagcctgcaacgcctttataagagcttcgcgcagatcaggcaccatcataagagcatcatagacactcaatagtgctgggatccgtttgagatgcgcaagaactttgtagtcgacagcaggcttctctttgcttccagtttttgtttctggagcttctggagcttctccaggaggagaggccttcttggcaggcttgtctacatttggaactttggacttgtgtggatccggcaaggtcttcccccctcgcaggcttatgttgacctcttctaccttcgtcttctctggatccaactcagcatggaatatttctcgctcccttcccgtaaacgtttcatcggaaccggtactcgtggagtcattataggtgaggatgacattgcatggagcaatgtctggagtcgggatagaattgttcacccccttagcctcccttgtgcttgttgaggactgctcccaacccttgggcagaaattgcgccaaagtaggtagctcacgaccccggcggggaaaagactcgtctccctctgagaaggggacaaatcgaggtggaggacgtcgccgacttggatctagccatcttcttgaagtcgggtgagtatgcggtgacaacttcatttgtgggcgacggggtggaaagctcattggttgaggcttccatcgcacaatactccatgctcggttgttgtcgccatggctagcctccacatgagtggcgggtgctttcgtcagcattatctttgcaatttgatcttcaacttgggccagcggcgcccatgatgttgcacgcctaccttctctttgtttttgagggaaaggctcaacggacaccatattgacggcatggtagtctgggttgatggcgtctgcatcaagattgattcttttctcgttgactgccctttggagccattctttgaaggcgatgcaatcttcaatagcatggccgatatacctatgatacggacaatataatggattgtcagtcatggttacctggtcaggtcttcgtggttcaggcagattcaaggcacggtgttccatcaactggttgaacatatctttcaccaactcccggcggaagatgtattgcttcttgagaagatcttgaagcgtggagcgttgcctgcccccaacttgctcattctttgctccaatcatgggcacctgtccttgaggtgcggtggagaagacttttgtggaattagcttcggttggaactttgggtttgttcccactaccactaggctttgttgcgttaaagcgtttggtagggtcaaaggcgcttgcattcttgtaaagctccattatctggggtgacttctcaaactcgagcttggttgctgccacggcggaactgagtgcgctaaatgtttttggttcacgtcgggacacttcaagagaccaatgctgttgcattccatgaacgcacatctcgattgcgtcttcaagatgcatctcccttgcgagacacacgaagctattccggaagcggatgacatagtcgtcaatggcttcatctctccattgtcgaacttgtgatagttcaacaatagagaaatctttcttcatagcaacaaagtgcttcttgaatacttccttcatggttgcccagtttccaatggatggattctcaccacgtggagcgtgttgtctagcatgttgcctaggatcgccttctgctgtcacatgggcaggtgcactatcaaagttattaggataaccctctccgtctgaaggtagagatgggttgagttcattatagcgagggagattgagattcacttccagcgatgacgatgaggtagactctaactcgtcaagatcttcaacttcaacatgatcctccaggtcttttcttgcttgagaaggagttgcctcaacattcttgatagcgatagccttcatgcgagtgttagcaccaggtcgactcgcaacctatagtagcccgctttggtcatggggtaggcgtgtcgtaatgtcgacgtagcgacgaggggagacatctgaccggagtgctttgcccctatcagataacgatccttctcctgtaccgataggaagacaaggggctgaagctctagttgcttcttgagaggaagatgtgcttcgtcttgaaccctccgagctgaattgtgggtggacttgatccaactgagggaggaacgtcttggaaaaatttgcccttggatttggcacgatctcttcatcagaagggtaggtgaagtcgtgagtaaccggcgggggaacccatgcggcattgggcttggtttcgtaatgcgcggctagtgcgctgcacatgacaatgctttcctttggatcttctatgttcttgcttcccgccacctgttcaactctggctggaggcacagaggatgattcctgctgaggtagaacatcaaccatagggttaatgatagcttcttcttgtcgagacgccttgtcgacttgctctactggtgtctgctcgactccctccattggagtagattggttctccttggactgtcttgctgatgttgatagcgatatgcctaaggtagcttgaactggccccttccctcgctgcaggatggttacggggcaaggttgagttaacgcctgctccctattcttgtcagcaacgtctagtgttctccggggtttcggagttaaacgagctataaggtagttatacctcgcatccctctccaaactgggggagatacggaacacgatcctttcatcttcttgatgcacttctccatctggacgaacacgaacttgagtgtgttttagcaccaggtcttcaagctctctatagagagcgtagcggttgttacgacgtcgctctcgcttgcgttgattctcagtaggtgcatgctgacgtcttggtggaattgacggcgtcgggagaagaggtggtgccacctgccgtgtagctgggttaggtgcgttggtttcacgtcgcctttgtgtatagacctctcgtcttggagaagatggaacatgaggcggcacttgagaagatggagcttctcgaactcgccattcttgagcgagacgtgaagatgtgggataatcttggtgtcttgaccaccggttccagcgtggaggcaacgctgtttgtctctggtgcatcacttgagttgatggaagcgtacgtcgaggagccagcgtgcggcgatcatgttgaggatgataacttggctggtatcgtcttgatctgcccccagcttgtgttgatgatgatcgtggtgcttcatgatcctggagtcgtcttccaagttgggccattcggtcttgcagctcacgaagttcttgtcgcaagtcctcacttcgaggagcgggtgcctcagaccgtaggacggcgaacctgttgttgttgtagtcagacgaccctcctaccgcagacaggtggaggcatgactcccacgtgctctgctggcgaggggtgtacgtattgtagtcgacgaagatagttgagcctggaaggacgaggtgctccctatcacgccgcttccaatactctttcatgatggcgcacctgactttctcctttatcttagttggctcacatgcccattcgtcagggaacaagtcgtaaggtggctctagaatgcttgggaacttgaacaccttcttgatgaggacagatgtgtcaagagaccagtcttcctctaggagggagctctgggcgatgcgcgagctaacgagttggtgtagacgctgcaccttgcgatacttcctcctgtagttgcgcaggggatgaggactgtttgcccgtcgagtatgcgaaatgtgtcgacgaaggttgtcggagacagcttctagagcctcaagcagctccacctctgtgtgttgcacagttggggtaggcagctttggagtagcgactggatcaggggcacgcagggatgcagtaattgaacgcctgttggaagctttgacgcgcagtttctgtgcagcttggatgtctcccttaatctcagctacaacggactccttcaagagggtccgggcttcaagcatgagggttcgccgctccttctttgccttggcagaagcacgcttgcgttgcttcttagactgggcctcctggaattgggtcacatcttgagcttgttgcatgtagaccttggagccatactcgaagaatgtcaccggtggtagtgatccaaactgaatcacaaagggcggcggggtgttcttgatgatggaaggtcctcctgcaagaaggagccttggtcaggtacactccacgttgaagatcatcatgcagcatgctggtgttggttggatgaacggcgaagacgagcttgacgaccacagcatagcgaagatgggaggagaaccaggtcccactgggcgtgccaatttgtttagggtggaaaataacatctgagatctctatatttagagatacatatgtgcgggcgtgccagtgtacctaaatacacaatgtaaacaaaacataaggaacatgctctttattaatcttaaaagatcataaatacaaattcccaatgtaatatatatgtatttgcgctccattgtcattggacagatctgacttgtgcgatgtggtctcctggttactggggccttgagaagctcccagttaattacctccgcaggtctaggcctacaagagaacctccgattaagctgcttgtggtcgtctcgtcgtcttcgtttcgcgttctccatgcatggttgtgatggtgatgtagatgtgtgtgtgtgtgtgtgagcgccggcagcgatccatagcctcgtcagtccgtgcgccggtgttggtagcgtagccttcgcatcggcttcgcctgccctccgtcgtctagcctcggtcttgaacaacgtgtcgatgtagattgttggtgaagacatgcatggagttgcatagcttgaacgacccgacgtcacagcagttgcgtcgagattcgattagagaagaatcaggaagaaattattgaagatggttgacgtagacggcaaccggatttaatcaaagctcggcatctcatttgggacaaataagaaaaaccaacaggacttcttcagcccacgcattggtttgtgcatggcactgtagcagcgatgacatgtcgtcctccaattggttggccatgttgccacaataattaacttaatcaacatgcattagccagcttgttgccatccaacagcactggcttgccgtcctcccgccgtccttcctctgtactgcctccatcgtcatccgctggtttcgacgccatgcgtgatgcttgacctccggcatgggaacggatagaagtcttggcagtcggcgacagctccggcgatcctcggcgctctccggcagagcggcttcccgacgacctcctccatggttagcccttcgagtgcggtgaagcttgcaaatcaaggacgtccggtatctcggcgaggtcgcagcttcgggtagatgcatcaccagcggcttgaattaccagcgtcgagtccagggacaagtagcactgcgtcggcttgaacagacgccggcatcgatgaggcttctgtgaggcgtagatgaatcggccaccgcgacttccccggcgacgacgatacgtgcagatggatccccatgcatggatgtgtgcgtgctgtagatgaaagaaaatgaaacaatcttgctagcttttaccttgactagccatcaagctcctctcctgcgcttgctgatgatcggatcaccgcgcgcgccctctcctgccggacgccgggactccggccgaagtcgctcgccgccgccggtgcgtgtcgtcgatggatggatcgccgatgagagttgatggatggatgtgttgatgctggatgggtagatgtgttgatgatgggtggcttgtggatgctagatgcattggtgaatgaatgtgtggatgagttcgtgaatgcccctggctgccgaggggtcgacgccttatatatgggtctgaggtcggtgctggccgcgtccgcgccgtttcctccgcgtcaagttcgttgcagataaggcttgatcgatcagtttgttatagagataaaatcaattggtttgttggttatctcttaattcatctggttttatctcttccgcacgcgtgagcagaagtcgttcagataaattgaaaccccagcttatctctctaatttgatcgataagtaaactcatctagccgataaatcaaaactgcggatatgtataatacgccgcgattgtgtcattcactgatatgggctaagcccaggggcaggcgcattaaatttcttaattaagcccattaatcacctcacccttaatcaaacaccatatatttgtgtactgccatgcatgcatgcatgcatgtacgtagttgcttcaccggccgactgatatagctagcttgctcttgattcagtatacacacgcatatatatactaattgacaagtatagattgggcacagtgtgtatttcaatatttgcatggcgcatgcacacatgaaatggagagctagctggcctcacatatacctaatgttcatggctatcaggttcatcgttctagccgctgcaaaaatgccatcaaacagttatatactaaaataatgaaggtagtattagattaacttatttgagaatggaggaagaatggagggagtatgtggctcacgtaaacaggcaataagcatatgatgttcataagttcttatactaaagattggacattaattagaacaaaacaaagaaattttccgtaaacgacaatatttgctgttgagtcgttttctgtacagtgcaaataatgactgtactggtgggagcatatgactaactgatgaacaacggtcgtgttacgtatgcccatcgtattcacctccagtcacgcctcatattaaccattttgtccaactccctttcttgccaatatacggagtatctttttttttttttctggatccgaatgagacagagaagcagctagcaacatcagcagcgatcgctcataaacccgggttctccccggatgcaggtcatctacggtacagtaccactcactgacatatgatacccacagtccgtccgggatctcaattatattggttcctccctaagtctcacgcagcaatgcaattatatgacaagaatcaatagcgctacatatacatgtgtcaacttgcccatcgttctggcctgctccgttcattgccatttgccaccagaaaccgcgagactctcttcgccgacacgacatggaaattattacttattaaaccgaagccaacatttgctggtgcctggtgctatattaagtaggacaaattatttacggactcaccaaagataaaagagataaagctgaaaagaaactgaaaaaggagaacaatgagaaaacttgacagcctcgcatgtgttttgttgggatattgtcgcaatatctttggcaccgcacataatccacacattggtctcatctatgattttggtcactggtcgagacaattgagtctcctaactgcagatcactcgtttgtttcgttcgcaccaaatggctcgtcgtcatcgtgtgtgtttagtgtctcgtgtcctagctgttgaaagatgttctcccaaacttgtgtacaaaggtgcagtccttgaaaagtgttgtgttcgttttaaggtttttgtggaaaagctgacagaaatagttgttaggtcatttgacagttttgcaggcttgtagccgatctgccgtgtagattttattttgaagcatgagccatgcgaagttttatatatggcaaacttgtgttgctatagccgacatggaaattaattacaggccgcttcgttcccgggccgaaagcccgtattcacttgcgttgcgcttttcgaccgtggaaggccgcgtggacgcgcaaagcggctcgcggacgtgggagaccgactgagcaaggtggtgtattggaccacatcatttcccacctcaaagttaagggacctcaaataaacttaagatgatgtattgaaccacatcattatgtgcgctgcatcgtgtcaactgacgtggcatggctaccgtacagacgatcatgtggttgggcgttctatccctaccaagcgtagtatgtatgccatgtgggcctagtttgcagtaaaaggggtttcgaaaggagttgcggttttgtggtagtttcactctctacttgttgcatctagctgaaataggttgttaaagttatatctagttggtacttcctccagactaataatatttgttattttggctaaggacacaaaataatttaaaccgctattttctattataatatatatatagaaatatcaacaaatatatgattacattgaaatgcttaaaactaatttgttagcaaacaatttatttttctagtcctgtctctttcaaatggatgctacttttgtcgtggtgcacgcatgcatttttattttctttgttgaggctagcaagtagcaaccctatcaataggctttgtgaatgtgccatgctcataactaatcgtattaagaacattcgatatatattctattgaactgtggttgttcgataggtgttaaatttgtgattttagtaagccgatctatacttttacaattttccattaaaatagattatttctaaaataaaaatcaaagatgtattgactattgcggtgttgcaagatcaactggaagaaatggggagatggattctaataactcgagtggacgtccacccgttcattgcatatcaactagatggttaagaacaattttaaaaaaaaattgacaagatagatcaatatgtaatatatcactccacaaacatgtaagtttaaattcaacttctacaagttgtaacaaaaataacaaatttaattgtaaatatacatatagtaatttaagttaagttttatttgctatttaattgtaaggagatagaatctaataactcgagtggatgtccacccgttcattgcatatcaactggatggtccaccctagttcgatacctcctgacctcctgtgcccatgtactgcaaaagcaagacatgcagtacaacatgtgcatatatcacaagttttcaataaattgttacctcaccaaccttcgtcgaatacctatcgaatagcagttgttcgatatgtaccctgtcgaattttggttgtttgatggagtagtatgctactgtgattttagtcagccgacctacatttttgtatttcccatttaaattgtattatttctaacaaaaaaattaaacatccttttgcttccatagatgctatcttttcctctcttccaatgacacttgatagaagtcgttgctgggtcaactcgagactgattggaattggatgcccagttgcccaaattgatccgtgtcgcgctatcctgccgaattttttgcatctaaacacatgcagcccgaaattttcagatgtgagcacgcaaattcaggatttaaatatgtagacatgatgctcacatgtacactggtgtttccatctaactgctattccaacaaactcatgggcctgtgaattgattcaaactatgatcaaggtaaggatgatagatggatgaaccattacgggaggcaaggaaaatagggcaaatttgccgaccgcttgctgccgttagcctcaatttttcttcgacctccatcgcctctctttactaatccaacaaacaatttttcctgagtttagatattgtttttttatgttggaaattagatctgcataggcagctgtgagcatgtgaccggtgagctccaaatctaatccatctgcttagtgtaatatgttcatagtaagcaaaaaaaatattaaacaacttcgattggctgaaaaaaagagacttactccctgcgtcctataaaaaaccaacctagtaccggatgtgacacgtcctaatactacgaatctagacatacatctgtccagatttacagtactaagatatgtcacgtccgatcttcgattttagatttattttttataggaaagagggagtatgcaactggggctgctagtagtgtacgttacggccagaaacaagacagcagaagggcaaaaggcccattatttacatggacatttagttaaatacatcctatttatttcgttgggcatcagctcaaccggatttgacatggtctaacgaacatgctgtttagaaatagaaattcaaacgttacgtgctcacatctggaattttggagctgcatgtgtttagatgcaaaaaattcgggctatcctgtctttagtcttcactactacccatttccctttttgacccagtgatgctccgagcgtacgtgctgggaaccattcaaacttgaagcagtgcgtagttatggcgactgtcaatctaccatgcatgactgcctgatgctagcaagaaaataaaagaacgcgtttcaaggcccttggtcgatcgatcatcgatatataacgatgaggaaggtctcgtgtcactgaaaccacccaagttgcagccaatctcagccaatatgtcctccattattcttactcagacaccatcagtaccacgacgcctactgctcctcctacagctctcgtttctgctcctcctcagctccgccagcaatgctgtcacgccggctggggtgccatgccggccagaccaggcggccgcgttgctccggctgaaacgctcattcgccgtcaccagcaactccgtcaccgccttccggtcatggcgggccggcaccgactgctgcggctgggagggcgttggctgcgccgccggcgccggcgccaacaatggccgcgccgtgacatcccttcatctgggtgactggggcttggagagtgcaggcatcgaccctgcactcttcgagctaacctctctggagtatctaaacctcgcctataacaacttcggtgggtcaaagattccttctgatggatttgagcgtctcatcaggctcacacatctgaatctttccagctctggattcaccggacaggtgccagccagcatcggcaacctgacgagtttggtatcactcgacctttccacttatttcatgatcgtggagatacccgatgatgcttatgagacgcttatatctcaaactgctaattccatatggctcatagagccaaattttgaaacctttatctcaaaactcacaaacttgagggatctccacctcggctatgtggacatgtccaacagtggagcgcagtggtgtgatgctctagccaattcctctcctaatcttcaggttattagcttaccattctgttcaatctctggccctatctgccgctcactttcccttttgcagtctcttgctgcccttaacttgcaacataacaatctgtctggtccaatcccagacttcttgtcaaacttatccaatttgagtgttctccgacttaaccataatgagcttgaaggatgggtttctccggcaatctttggacaaaagaatcttgtcacaattgatctccaccataatcttgggatctctggtattctcccaaatttctcagctgacagtaggctggaggaattgctcgttggccagactaattgctcgggtttaataccaagttccattggaaatctcaaatttttgaagcagctagacctcggtgcgtctggtttttttggagagctgccctcatcaattggtaagctagaatccttgaatgcattggggatatccggagtgggactagaagggccattaccatcatgggttgcaaacttaacctctttgacggctcttgtgttctctgattgtgggttatccggatcgataccttctttcataggagatttgaaggaattgagaacattagcgttgtgtaactgcaaattttccggtgaaataccaccacacatatttaatctactcaaatggaattactcttgctccattttaacaatttcaccggcacaatagagctgacttcattaagtaatctgccacaactttatgcctttgatctctcctataataatctagctgtggtcgatggagaatataactcatcagtttctcttccccaaattgtgctcctatatttaccgggttgcagcatgtctaagttccctattttcttgaggcaccaatatgaaattaatggcctcgacctttccgacaacgaaattaacggtactataccgcattgggcatgggaaacttggaattatatttcccttttgggcctatccggcaatagatttacgagtgtgggatatgaccctcttcttcccttacaagtagatttgcttgatcttagcaataacatgcttgaagggtccattccgattcctcgaggctcttcaacatctctcaaatattcaaacaatgggttctcatccatgccatctaattttagtgctcatcttagagatgttacctttttcatggccgacggaaatgaaatctctggaaatattcctttggagttttgcagtgctaagagtttacaactccttgatctgtcttacaacaacttcaatggatcaatctcttcttgtttaatggacagtgttagcacgctgcaagtattaaatctgaaaggaaatgaacttcatggggtgttgccagacgatatcaaagaaggctgttcatttcaggcattagatattagcggaaatttgatagaggggaaactaccaagatcattagttgcttgcaaaaacttggaggtatttgatgttgggttcaatcaaattagtgacacctttccatgttggatgagtactcttccgagacttcaagtcattgccctcagatctaacaagttcttcggacaggtcgcacaatctgctgtagagaaaaattcttgtgaatttccagctgcaagaattattgatctagcctcaaacaacttctcgggtccattgccacaagatcaatggtttaagaaattgaagtccatgatgatcggatactcgaatacgtcattagtcatggatcatgaagtaccacgagtaggaaggtacaaattcagtactacgatcacatataaagggagcgccgtcacattgaccaagattttgaggacatttgtattcatcgatgtctcagaaaacaaattccatgggagcattccagggaccattggagaacttattctgttacacgcactcaacatgtcacacaacttcttgacaggaccgattccatctcaactcggccatttgaaccagttggaggctttggacatgtcctcaaatgagctttcaggagtaattcctcaggagctagcatccttggacttccttgcaatattgaacctgtcatacaataagctagagggaagaataccaccacagtcacctcatttctctacattctccagcatctcatttctggggaacaagggtttgtgcggccttcctctgtcgacaggatgcagcaacacgacatctctgaatgtgatcccttctgagaagaatcctgtagacatcgtgctattcctttctgctggactgggattcggccttggatttgccattgcaattgtagtagcatggggaattcccattaggaaacggtccacagtaaggcagagagctctctgaattatctcctgaaataatttttttctgtatcaaggtcacttgcagtatatttgtaatcaaggctatgccattgccgtcgcaagctaataatattcgaatcttgcatcatatgcagagtgacatactaaaaattttactcaaagtcaccgggattgattttctgaaatctgacatctagagcaaattaacaatggacgccgattgttgttaaactaaggaaaaagttcattttacatccctcgactaacgttaagtttcatttgcatccctatatatatataagtggagctaaaataaggacattggggtcactcttttcacgtatcatggtgcaaatgtctaaaataagtgctttataaattagttagaatattttggtagtgtaattagcgaaattcgaggcgcggacacgcggtcgaggacgtgaatgaaactccaatattagttgagggacattaattattattgaattccatatcagccaaaaataattcaatgagagggagagggagagataagtgagaagtagggataggataaagataagagagagaggagataaataatcctaagcagctctctttttttttctcccatgcggctggctcggctcgcagtgatatgtgccggtgctaatgatgtagatactggtttttatttaaaaccggtaactatatgtgtttaaaggcgtcagttttttttttacccaatggagatgggaaatggtcaataaaagcatgttttaaatgaattggcacccatgaaccggcttctattagggattccgtagtaatgctctttcggtttctttcagattaagcatttcttccaattgatcgggcaacaccgcaacaagcaaagcatcctttccagatgctctctttctggcgtggccaattcaagaagctacaccggttgcacacgcgcacatgtgccatctcattctctcacaaagcttcttaaaactcgtgttgtagttagctacaaatctatcacgtacttttcttctttctcttttagttcgacataaatctgaggcgccaactaggtgcgctctcttccaaaacatttgaagttttttttaaggtaaaagagtagccatctttcggcctcattgtttgtttatttgaggaataaggcaaacgacatatttataaacgaaaataatctgtgaataaaatttttatatacgtgtttttagcgatctaagagcaaagactgaaaaataaacttcgattaagaaaaccccaaatcaacttcaactttaaggttgaaattttaaattttagctcataaacataagcataagtgaagatgagactgtttgttttaatagaataaagagtaacagaaaagctatttgcgggacggagaaggacccgcgcctgaacttgtaaattgacaaattgtgtcaccacttttacccaagttatggtctcttctttgatttttcttttacggtggacggggttgcctgcgatgtggcggaagattctcgtgttcctctcgcaacgtagctcccagattttacacggcttgttagggttgtgtggtgtcgagagtgtttgcagtgcaggcttgcagccaccacttcctcaactgaggtagcgttaccccattcctggattcacaggtctacatttgcagctcgacctttgaagtcgttgctacgtggagtactagtattagttgggatcaattcgatcctgactggaattggatgcctagtttgccttgcccaccttgatctgtgtctcagctctcctatcttctttgctcattttcctttttctctgaacggaaactcatttcctttttgacttcttcgtgatgctcatttctggcaacaagccaacaaccaatgcttgttgctctttctaactaaaactgctgtcaccatcttaataaatttcggccgaagtaactttcgtcggcctggcgataaacaaatagtggtggcgactatcagtccagcaatgccttctggccatggctgaccggcaccaactgctgcggctggggatacctgagagggtgttgaggtgaggagtaggcaaaacaaaagtaaaaccatcccttgacttttgatcgatcgattgcgatcgttgtgagcacgtgcttggaatttgtcaccacccttgactacttggccatttcaacttcctaaattcgtatatcgagacgtaattcgtccatatgtagactactcgtcaacaacttcaaacgtccatatgtagactaccgaccatttcaattgcggtagtagactactcgtcagaagttcaaaacctatcggataaagaaattattatttttttttaccggcgtatgcgataagacgagtaacttcttttggatgatgactctgaaaattttgagtgttgtttccttgattttttggctaaataagttgtacacaaagactagtgagtacagtagaatcctccctccatacacctgacccaattctaagctcttacttatagcagataagtagctaacccaatcaaactaagctgctattatgccctccacaatgacccgttacaagctattgttcatgacattgctgctcctcctcttacacacccagctcgttgtcccttcttcatcagcaacatcagctacgtacaccaaccacaccggagtgccgccgtcggcggttccatgcatgccggaccaggcatcggcgttgctccgactgaaacgatccttctccatcaccaacaagtccgtgatcgccctccggtcatggaacgccggcgaggattgctgccggtgggaaggcgtccgctgcggcggcggcggcaccgccgccgccggcggccgcgtgacatggcttgatttgggtgaccgtggcttgaagagtggccacctcgatcaggtgattttcaagctgaattccctggagtatctcaacctggccggaaatgacttcaacctgtccgaaatcccattcactggcttcgagcggttgagtatgctcacccatctgaacctctcctcgtccaacttcgcaggccaagtgcctgtgcatagcattggtcagctcacaaatttgatctcccttgacctctcctttcgtttcaaagttactgaactattcgatatgggttacttatataccggtgcatactctcacgaatggcagctcgtcctgccgaacttgacagccttggttgcaaatcttagcaatttggaggagcttcgtcttggctttcttgacctatcacaccaagaagctgactggtgcaatgctttaggcatgtatactcaaaatcttcgtgttctcagcctgcccttttgctggttatctagccccatttgcgggtcgctctccaacttgcgctcactgtcagttattgacatgcagttcagtggtttgacgggtcggtttccagatttctttgccaacttatcctccttgagtgttctccagcttagctttaatcaccttgaaggatgggtccctcctttaatctttcagaagaagaagctagtggctattgatcttcacagaaatgttggattatctggtactctgcctgattttcccgtggatagtagtttggagattttgcttgttggtcacaccaacttctctggtacgataccaagtttcattagcaacctcaaatctttgaagaagctaggccttgatgcaagtggtttttctggagagttaccctcaataatcggtacgcttagacatttgaattcattgcagatctctgggttagaggtagtagagtcgtttcccaaatggatcacaaacttaacttccttggaggtccttgagttttccaattgtggcttacacggaacgataccttcttctattgcagacctgacaaaattgacaaagttagcactatatgcctgcaatctttttggggaaatacctcgacatatattcaatttaacacaactggataccatctttcttcattcaaatagttttactggcacagtcgaacttgcctcattcttgacactaccaaacctatttgacttaaacctctcacacaacaaattaactgtaataaatggagaaagcaattcttcactcacatccttccccaacatagggtacttgggtttgtcatcttgtaacatgactagatttccgaacattttgaaacatctaaacaagaatgaagtgaatggcattgatctttcacataaccatatccaaggggccataccccattgggcatgggagaactggaaagatgctcaatttttctttttgaacttgtcacacaatgaattcactagggttggccacaccatctttccttttggtgtagaaatgttggatctcagttttaacaagtttgaggggccaataccacttccccaaaactctggaacggtgcttgattactcaaacaaccgtttctcgtccataccaccaaatatttctactcaacttagagatactgcctatttcaaggcatcaagaaacaacatctccggagacattccaacatccttttgtagtaataaactacagtttcttgatctctctttcaatttttttagtggatcaattcctccttgcctgatcgaggttgccggtgcattacaagtactaaatctgaaacaaaatcaacttcatggagaactaccacattatttcaacgaaagttgcacattggaggcactagactttagtgacaataggattgaaggaaatttgcctagatctattgcttcttgccgaaaattggaggtccttgatatccaaaacaatcatatcgctgactattttccttgttggatgagtgcatttcctagactccaagtccttgtcttgaaatctaacaagttctttggacaagtggcaccttctgttggcgaagacagcagttgtgaatttcctagtttatgtatcctggatctagcctccaacaaattttcaggcacattgagtgaagaatggtttacaagattgaagtccatgatgattgactcagttaatggtacatcagtgatggaatataaaggtgataaaaaacgagtctaccaagttaccactgtgctcacatacaaaggatctaccatgaggatagataaaatactaaggacttttgtattcattgatgtctcgaataatgcattccatggaagcgtccctaaagctattggagagttagttctgctaaacacgctcaacatgtcacacaactcattaacagggccggttccaactcaacttagccatctaaaccagatggaggctttggacctgtcctcaaacgagctttcaggagtgattctacaggagctagcatcgttgcatttcctcacaacactgaacctgtcctacaacaggctggtgggaagaataccagagtcaactcaattctcaacattcctgaacaactcgtttctagggaatgatggtttgtgtggccctccattgtcaaaaggatgtgacaacatgacgctgaatgttacactttctgacaggaaatctatagacattgtgttgttcctcttttctggattgggatttggccttggatttgcaattgcaattgtaatagcatggggagttcccattagaaaatggtcgctactagggcagagagtcccctgaattatgtactaaaagaaattttcctgtaccaaggtcatttgcagttcgtttgtaatcaggaccatgtcattgttgtagcaagctaatatatatttgaatcaagctaatatatatttgaatcttctatctcgagataatcgattacgggtgttaaaatgataatggtgttatgcttatttaattactttagagatacacaagtcactaggatacacgcattatatacagatttttctttcgaagtatacgtcatatacaaatttacatactagcaattttactatgattgatttgctgctcaagcaaaatctagcttcagcaacttagctcccacgaaacagctgggtttggaatcggctttacagtggccattgttctggtgagcgaaacgctggaactagaacatttctcgctccaccagtaatactgtactcctaatttagtagtgagcgcgtgcggtgtgtatgagcttgtatgaatctactcttttacgaacaatgcaatataattcgacttcaattgtagtctaaactgtaaattaaggtggcagaatcacctgatgagtgagacgatgctggtcatgtggaaaatcttgattgctttgtccccatctctccagcttcaagaccgatgattaatcgggtgcgggaacacatgctggatatgcaaagctagatgatgtcacctgaaaatgtactgcagaaaaggaaaaactactcacgcaacaaatcgacaggacgatatgtgcaatttgctctcacctgtgctgtgcaactgcacaggcgcattccgtcgaacacgtaccaagcggaaggtagagcgcgacgacgtgcagcgcagcagcaggatgccaggattgattcgctcctgcaacgtctccatgatgacaggaaggtcactgagacttgccctgatcgagctccatgtcgccgccttctagctccgacgggtcacattttctcgccggagagatacacgtagcggcgggattggggaaatccggtgcacggtacagttggtggagtgggtgctggaatttaggtgtggtgggaattggcagagttgtcgaagtgggatgagacgccgacgaggtgagaaaaaaagtggcaggcaaatggggtcggcgaggacggacggcgagcggcgtcggggcgccggacacagggcgtgtgacggcggcgagtaccactttgcccttggcgcgcaggtagatgcgaccgtgaccaccgctcgccacgaggatggccggtttgagacccttcgtccgccggtgcatccaccccgtggatgcattccatggaagcattcctgaacctattggagagctagttatgctaaacacgctcaacatgtcacaaaactgcgaaaggccatgtaaagcctgacttacctcaacataatgttgagttcaaatctttataatagcgaaatttagattgaattatttaaaaggttaacttttcatttttaaaataccgtatataagcagttgctaggtaaaaaaaatatcgttctttaaaaagtaaaaaaaacgtgtcgcacaactcattaacttgtgccgtctaaaccagatggaggctttggacctgtccttaaacgggaagaaaattatataagactgaagtcttaccctcatccgaaggactttgttgctctgcacgacacctgttccgcacgaatcacagcgcatgcttactccctcaatctccctcgtgtctcttcggttactcgttctttcgctcctggcgaggcgtcgagctcgggcccgtccgaccacccacgcggcggcgccccgcagcatcgagctcatgagggcagccaggaattagaatcaaggcatcaagctcgtgcttccggcctgcttgtagaagatatctcaagatttggaagaaggtgtgtcatcgatgatcgattcgactctgctccttgaaactgcaaagagttgccccacgatgaaattattcaacgattagattttgcttgccattgagtttagtctgtatggtgcattgcactgattatctttgctggtgattgaacttgattgagccttcaaagatttctttgtatttgagtctttcaggattataatatgttgatgtcttgacgattcttcccgagcagcgactcatgcgagcatggatgctgctgagtttctctgccacatcgcgaatcccgctcgatgcccgcaacagcgacagccgcgagctcgacgcctcgccgtctcgccgagaagagcatgagaatgaggtggtgtttggatccagtgacttaactttagtctctatatttagacactaatttatagtattaaatatagactacttataaaattaattatataaataaaagctaattcacgagacaatttttttaagcctaattaatctataattagagaatgtttactgtagcatcacataggctaatcattgattaattaggctcaatagatttgtctcgcgaattagtccaagattatggattggttttattaatagtctacgtttaatatttataattaatttttaaacatctgatgtgatagggacttaaaagttttagccccatctatacaggaacagaaggcaaaaggataaggagagtaagcctgtcttgtgattcgtgcggggacaggtgtcgtacagaggaattaaatctttcggatgagggtaggacctccatcctacataattttcttccgcatcgttgcacttcctcacaacactggatctgtcatacaacaagctggtgggaagaataccagaatcaactcaggctcatccaaaaattccgtcacattaaatgtttgacacatgcatgaagcattgaatgtggacaaaaaaaactaattacacagtttacatgtaaattgcgagacgaatcttttgagactatttacgccatgatttgtcaatgtggtgttacagtaaatatttattaatgacgggttaattaggcttaataaatttgtctcgcagtttacatgcgtaatctgtaatttattttgttattagtctacgtttaatacttcaaatgtgtgtttgtatacttcaaacttaggctgtgtttagttcacgctaaaattgaaagtttggttgaaattggaacgatgtgacggaaaagtttaaagtttgtgtgtgtagaaaagttttgatgtgatgaaaaagttgaaagtttgaagaaaaactttggatctaaacacggcctaaggaactaaacacagccattgtgcggttcctcttttctggattggaatttggccttggatttgccattgcaattgcaatagcatgggggaattcccatcagaaaacggtctccagtaggtcggagagctctctgaattctgtattaaaatgaacttttctgtatcaacgtcacttgcagtatatttgtaatcaaggctgtgccatagtgccattgttgtcgcaaactatactcaagtcactaggattgatttgctggaatctggagcaaactgaccattgctgctatctttatttttgagttatagtacaagtcactaggattgatttgctggaatctggagcaaactgaccattgctgctatctttatttttgagttacagtgtactagtctatccaaaaaaacccaaactctggctatgaacctggacacgcgtgtgtctaggttcgtagctaggattggatttttttttgggacggagaggtaggaatctaggatcgatacacacatcatatacatactccctccattaaaaaaaaagacaaaccctgagtttccgtgtcaacgtttgaccgtccgtctatttaaaaaaattatgaaaaaattaaaaagacaagtcacacataaattattaatcatgttttatcatctaacaacaatgaaaatattaattataaaaaaatttcatataagacggacagtcaaacgttggacacggagaccagtgtttgtcttttttgggacgaagggagtatatagtagttacatcacactatagaggctatttaactactgcctccgtcccaaaatataacaaccgtctcaaaatataacaacttttgtctatgtatctggacacgcagttgtccagattaataactgaaaatacttatattttgggttggagggagaatcaattttactcgagtcgctcagattgatttgctgttcgatcaagcaagctgaaatctaccagcagcagcaactttagttcccatgaaacagctgaagcgccgtcgccttcgtcatcccggccggcaccttctcgacgaacagcaggatccccaccgccttggccgcctccacggccaacttctccgccgcctcccacgccttcttctcctgctccatcttctttgtatccaccttgttgtgcttggacgccgagttggagtcctctagctgcagcgcgtccatggtgagcagcgccctggacaagaccttccacccgttcacctgctccttcatgtcggcggtgatcgtcccgctcttcctcaccgccctggggttcatgaagccgcccacaagctccgccacggtcaggaaacgcacggcttcgttcaccatcaggagcagcgtcgccaacgcctcgccggcccgttgccgcgccgcgccgccgccgctggcggcgagaccggcgagcgtgtccacggcctgcgtcatctgctgcgggccgagcgtgacaccgaccatgttgtccgtgtgcccgaggagctcgcggtacgagccgccgaagccgaggtaggtggcgccggcgatgaggccgcgggtgagctcccaccacgcgctggtgccgtcgctgccgcggaagccctccaggtagaggttgtcggcgcgcgtggcgagcgtgagctcgctggtctgcgtccggagcacgacgtggaaccagcggcgcggcgggacgtcgggctccaccggcgggaggacggggcggttgtgggagaagtgcctcgggttggccaccctcttgcggatgccggcgatgaagtcgccgtagttgtcgctgccgctgccgctcacgttgaacgtcacggtgaacagcgggttcaacgccatggccggatgctcgatcgttgtgaactacaactgacaaaagcagaggattgctgaactaccatagacaagatgacacaaccccgccagttagtacgtgtgatttataggcaatggagtatctctgtatctgcttatactagtcaaaaagaaacaatttttgcttacaggtcaaaacaagagcgaattttgcttttgacagagcacacctgagatgttgttccacggacgcctctgttgagaagagaaatatcagcctagagtgagtcaaaagactgcgtcaaatccaagttcaaactggaaacaatgacgtccaggatagcgtgctgccaatccatgacagactagcagcgttggagaggacatgatacagacagaagtcacttgttttccgtgctcatattaacttcgatatggtctttttctaaaaatttcctatatttcttttaaaaaattatattaatctatttttaaatttaaaataattaatacttaattaattatgtgctaatgattcatcttgttttgcgtatcttcttcttcctccttctctcaaagacagcctaataggcgtcacgatcacacaacgctgtagtgctttgtcaactaatagcactggataattggatactatgattgatttgctgcccaagcaagctgaaatctagcttcagcagcttagctcccacgaagcagctgggtttggaatcggttttagagtggccgttgttttggagagcgaaacgctagaactggaacatttctcgttccaccagtaataccgtaacttagtattgcgcacatgcggtgtgtatgagcttgtatgaatctactctttaacgaacaatgcaatgtaattcgactttaattactgtctaaattgtaacttaaggtggcagaatcacctgatgagtaagacgatgctggtcacatggaaaaacttgattgctttgtccccatctctccagcttcaagatcaatgattaaaatcggagccagaacacatgctggatttgcaaagttagatgatgtcacctgaaaatgtactacagagaaggcaaaactagtcacgcaccaaaccgacaggacgatatgtgcaatttgctctcaccaatgccgtgcaaccgcacaggcgcattccgtcgaacacgtaccaggcggaaggtagagagcgacgacgtgcagcggagtagcaggattgattcgctcctgcaacgtctccatgatagacaggatggtcagtgagacttgccctcagctccatgtcgccgccttctagctccgacgggtcacgttttctcgccggcgagctatagggaaatccggtgcacgatgtgggagttcgaagagggatgaggcgtcgacgaggtgaaaaatgaaggcaggcgaatggggtcaagtctaccaactggttgggctgggccgtaacatgatggcccggtagtggcctccagtaattaaagcccattttttcagcaatttcggcccatgaaagtgctctcatgactatcgttggcgccttgccaccgggtgctcccagcgcgcgcgtacgcgccagcgattttgcgcccccttccggcacctttttttttttcctaagctctttttttttcgcttttttttttctgattttggcgttgcgttttttttcaccgtttctttctgtttttttttcaatcttctgtatacctctttacaaatgttagaattgaaagtttttaattttgacttgaaatattttaaatcttgacttaaaagttttcaaaatttaggttgaaagttttcaaatctgggttgaaagtttttaataagtttttaattttaagttgaaagttttcaaatctaggttaaaagattttaaatttgagttgaaagttttcaaatctgggttgaaagttttaaatttgagttgaaagtttttcaaatttgagatgaaaagttgaaagttttcaaaatttgacttaaaaaatcaaatttcgagttgaaagttttcaaatttaagttaaaagttttcagaatttgacttcacgtataaatttcttttcaatctgttacttaaaaaaatctttagaaaaaaaacaaatcttatcttaattatcttaactaatagattttttatacgctaaaaccaacggtattacagctaaatggaaaaaaaagtaaaaaaaaaaaagcgccgacgcgcgcgcctacgcgccaattagctccgccgcttaccacccatcgcttttccgcaaccgccgcctaggatgcgaccagcctcattgtttggcatattttctgaatatgccaaatggcatatttgcaaacgaaaatcaatttgtgaataaaacttttatatatgtgttcttagcgatctaaaagtaaaggctgaaaaataaacttcgatgaaaaaaaccctaaaatcagctttaaatttaacgttgaaaatttaaattttagctgataaacatatgaatataccaaacgatcaggcccgacggatgcgatgaggatgcaacgcaacattgctgagctgacaatgttcatctgctcgggcgtttaatcccagaacttgtggtactacttacgattaggtcatcccgtacacaatgaccatgagatcatcaatgcgtctggatgttgatcatcaattgcagcctgcaggatcaacaacgtaacgtcgaagataattcatatttttcagatagaacaacaccaggaagttcactatactgcagctttgcagctcctcactaagcgctactccctccgtttcataatgtaagtcattttagcatttttcacatcctatctagattcattaacatcaatatgagtgtgaaaaatgctaaaatgacttgtattatgaacggaggaagtacaagttagtgccggtggcatgtttttcaaatgagaaaaatgtgggatactatgcagttgatgtggaatactgatggcgttagcatccgttgttgataaaaaaaataagaagaagaaacccagattagtcgagtaagccagcgcacgcgtgccaagccactaactatcccccctcccaaaaaatgaagatgatgtgttacagttttattttttaaaatattagagaaaaacctaatatcaaataattagaaggggtgagacttcgaaccaggtcgtctagcccattacctcgtggagctagctcaaaaatctccgggcgtttctcaacagttttttttgtcaccggctagctgatcgatgtagttacgttggtggcctttttttcagcaaatagtaatatgatcatgcattattttgtaacggatatttgagattaaggatgggacacatggccgtatgattaggaataggttggactatggattaatcataaaccaccggatccaactgttttttttttcatttcctttggctctcatactacacacatgcggtggacgacggagggatgacttcttttactgtagtagagaaatgcaacccaaacggtgctatatcaattagaaaacagcccagcaatcacttctatgttgcattctttcattttattttatggcagctacttttttgaaggggctttaaaccgacaattgtgtaataattggatgcagtttttattgaagtgaaggccagattttattcattatcttaaaaaaaaaggtagaaacttgcatgtacctttcattctatatactataatcggtttaagaaataattgttataaagcagcatccacgttaagccacgtcatctcagttattggatcaacatgttcctcaaacacttactcatagattaccatacctacagaaaaggactgttgatgctcatggcctatcgtaaattctaagaaagtctaagggcctgttcactttgatgtcattttcaaccttaccaaattttggtaaagttaccaaaaaaagtggctacatttagtttgttgctaaattttagtaactatataagaaatcatgccaaaattttggcaagttaccaaaattttggtaactatgcaaatttgataaggttttttttggcatcaaagtgaacaggccctaaaatggatgttagtgttacggaataatatatgttgggaattttttttttaccaattctaaatcggagtaaagatagaatttatctccttctaagacctctatataaagagggacgggataagacatatatggttaacttgtactcgagaccagaactataatgaagaaagagcttcaccatatatttatggtaattgtttatttctgcaatgttcttgaaagcaaccagaagggtgtgggtattctatatctttactactgtgggagggacaaggaatggatgttaggactagacatactcccatcttgttttttcctcgcttatctttcaatatcttctagtatatattttcattttaacatagttagtttggtagcaactatttttaactacatattctatagtaacgccgggggttgcatctagttatgcaagggcactcgttgaatcaatgattgatgattacttgttgttcatgaagatctcttatgcttcttgaaaaaaatctcaaagaaaaagggagcataatgttgccttctcaaaccgggaaaagaagaggcaatttccatacgtaaaacgtacgtgacacgaccgtcattagtcgttggggtcgtgctctcaaaccagcgacgtctgcagatgtaagtatattttgctacttgtggcgctcaaaatttgtgtaatttactaggaaacatcgtaaaaaccttaaaaaaactaataatttgcaaaagaactcaattggagagatatattcttaagaaagacaagaataccctcagaaccacatgctttaaacatgacgttagagtaaaattttagaaattatgcaactccaaattaatttgccaccaccccaaatacatcatattacatctccactctagtctcaacttaaaagcttttgactctagtggcattctcgtcttttttgaagaattttgctcttcaatttgagtcgaaagtgtcctctaacaaattactatttttatggtgttttcaaacatgatacgtttttatgatatctatcataaatgtaactaaacggagttgatcaacgctcacgaccacgctgatgttggaacagccgaacaggtaaataaaactagcctagtagtatagccttggaattgatcggtcgattgagatcgttgtgagaatgtagggagctttgctcccggccgttgattattcggccctttcaacttggtacattaattttctccggcccacaagttgttctcgctgtaaacttccatcatgcggcccatggctgcaggaaggccgtgcgtagaacgttgcgtatgaatgttacccctgcatgctgattgggataattaccgtttaccgtttaccaagttgctaaacttcaggaaattaatcaggatgacgaccctttgaaaaatttgatccattacctcgtgttgattagttgatatttcctgtaaatcattctcactagatgtcctcgacccgtgactggccggttgatcctctttcttctctcttttttaccaaggcaaaggtatctaattcgtgtataaaaatgagggagcaaggtagaagtagagctacactcaactgtatctctacagttagcgcaatcaaactaagctgctattatggtggcctccccagtaaaaacgttgttcttgccgtcgctgctgctcctacacatccacctcctccacctcttcattccttcatcagcagctacgtacaccaatcacaccggagccctctcaccaatggttctatgcttacctgaccaggcagcggctctgctccaactgaaaaggtccttctctgtcacaaacaactccactgccgccttccgatcatggaaggccggcgaggactgctgcctgtgggaaggcgtccgctgtggtgacgctgacggccgcgtgacatggctttgatttgggggactgtggcttggagagcagccgtctcgacccggcgcttttcgagctgatttctctagaatatcttaacctgggcggaaatgacttcaatgtgtctgaaattccatccaccgggttcgagcggctaaataatctcacccatcttaacctctccacctgcaacttcgctggtcaggtgcctgcacaaagtatcggtcaactcacaaatttggtctctcttgacatttcctttcactccgaaataattgagatatgggaagtgcttctatgcttctttaaaaaaaacctgcacgaaaattaaagcacatcaacagtgaggattaaaagttgattaacagagtaatcccctttaacgaggggtaattttgtcctaagaaaaagctgaccatatctagcccaccctgtccgcatatcagaatcgactggttcctccttgacttgcacctttgacggaggcgccatcttcgccgccgccgccggcaccgccatcccaccgggtcgaacgaacccatcttgcccgacgccggcacgcttgccggcggcattcgacgacagccttgtggcgtccatgctcgcgcatgccggcgcctccgcgggctcctctccttgacctgcagcaccgtaaacggagggaccatctccgccgccgccgctgccatcacttcgtcctctccctgttcctggacgtcctcgccatggctcccggcggcggcgggggccgcggggcgggaagcctggagggcctgcagctagctgaagcgggcgtggatggaggactggagggaggagaggtgggagtcgaggtcggaccagcggaaggggaggaggatgggcgagtggaggacgaggctgtcgcaggcctcgcggaggcgttgcttcttgccatgcagcgtcgcgatggcggcctccatctgcgccggccgtcgtcatcgccatcagagatggttcagggcacagggccgttccgtgcgccggcggcgagctgttgcataatctccatcgccatcgattcttcgtgcggccggtaagaagccgacgcagtttatatataggcacgcggccgcgaacagtccgagacggataggatcagcgcatacaaccaattctatgtaaattcaaaagattgtgatcagccttgtgttaagttcagttcaattctgaatgcatatcaggtatcaccatatactgaggaataaaatggacatggaagctttggcaatctctgccgagaatcatgaagaagcagaataaggtgttgataatggtgagtgagggtgttgtgctcaatgaatcagccaaccagccatgtttcctgaaccacgagactattgacgaacctgaaagcacgacgacgagcaccacctacacaacacgtcaacacgcagctccccgaaggagagagctcgccggtgaaggaagcagcgacggcgtggttagtagcggaaggggaaaacactcttacagttacagggggtagaggacgcttctcggcgaaggaaagggtgcgggcgtgcggcgctgttcaccggaatgcgtcgtgagaactgccgcgcgctggccgcgaatcaatccatgagaagggatgtggatacggatatgggcttttacttctggacgaaattgccccttgctaatggtgattactcggttaatcaacttttaatcctcaccattgacgtgctttaactttcgtgcagttttttttttaagaagcatagaagcacttcccttgaggtatttgacgggagttatttgtttggaggtgatttcactcacccatggcagctcaatctacaaaattttacaaccttagttgcaaaccttagcggtttgaaggagctgcatcttggcttcctggacatatccgagcagcaaaccgagtagtgcaatgctctagccaattatactccaaatctccatgttcttagcttgccgttttgccagctctctagccccatttgtgaatcgctctctcgcttgcgctcactatcagtgattgacctacaatacaactttttgactggtccagttccagagtcctttaacaacttctcctctttgactgttctccagctcaggtataataacctagaaggatgggtatctcctttaatctttcagaacaagaaactggtggttattgatcttcacagaaatcccgtcttatctggtactttgcctaatttccttgtcggcagtagcttggagagtttgcttgttggtcacaccaacttctctggtacaataccaagttccattagcaacctcaaatcttttaaagagctgggccttgatgcaagtgggttttttggagacctgccatcatcaataggtaagcttacatccttgaactcattgaaggtatccggtctagagatagtaggattgtttccccaatgggtcacaaacttaacttccttggtggtccttgagttttcccattgtggcttatatggaactctaccatcttctattggagatttaaaaaagttgacaaaattagcactctatgactgcaacttttggggggaaatacctcgacatatcttcaatttaacacaattggataccatccatctttgctcgaataattttgttggcaccgtcgaacttgcctcattccagatactaagaaacctatctgacttaaacctctcatacaacaaattaagtgtaatagacggtgaaaataattcttctcaggtatcctacccagatattgattacttgagcttggcgtcctgtaacataactagatttccgaacattttgaggcatatagattatgagattaatggcattgatctttcacataaccaaatccaaggggccatacccctttgggcatgggagaaatggactttgggtttttctttttgaacttttcacacaacaaatttactagtgttggatatgatgtctccctacccttttatattgaactgttagatcttagttttaacatgtttgaggggccaatacctctacccagagattctgggaccgttcttgattactcaaacaatcatttctcgtccatactaccaaatatttctactcaactcagaggtactacctatttcaaggcatcaagaaacaacctctcaggcacactgaaagaagaatggtttacaagactaaagtctatgataactgattntggtaatgaaacatcagtgatggaatatgaaggtgatcaaaagcaaatctaccaagtgaccactgtgctcacaaacaaagggtctaccatcatgatggagaaaatactaagaacctttgtattccttgatgtctcggataacgcattccacggaagcatccctaaatctatgggagagctagttctgctacatacgctcaacatgtcacacaactcactgacaggaccaattccatctcaactcggccgtctaaagcagatggaggctttggacctatcttcaaatgagctttaggtgtcattccacaggaattaccatccttggacttcctcggaatgctaaatctatcctacaacaggctggaggggaaaataccagaatcgcttcatttttcgttattcgccaatagttcatttcttgggaatgatgctttatgtggccctcctctatctaaaggctgcagcaacatgacattgccgaatgtgataccttccgagaagaaatctgtagatgttatgctgttcctcttttctggaataggatttggccttggatttgccattgcaattgtaggagcatggggaattcccattagaagacggtctccggcgaggcagagagccctctggatcatgtattgaactgaacctttttctgtatcaaaggttgtaaacttgtaccagggccatgtcattggtgccacaatctactacgtatttgaattcttccatctggatcaaatcaactatatcgtatacagaggtacattacatactactagtagcagttttgctgaagtcgctcggattgattttgctggtcaagcaagctgacatctagctgctgcagagttacattacattttcggtttcgggttgtttatttggatatccgagtttattccatgattatggcttctagatggatactatacgtatgtaatactattgtttgctgctaatgagtcaagttggagatagcttggtctcggaatatgatttctttgtttgttccatgtataggtgactcgatgtctcggaagagtatttgcggtgatggaccgggagtcggcttgaggataagacgacgtccgtggtggtcagagatcatgcgggatacttaggcaagagttgatgcacgtggttaatggagattccatatggcatacgatggaggaattgtgtgcgtatgggatgcggagtcgaatttggaaggagtccaaatttggtacgtttggttatgtaaagtttctttcttgtattagtgggtttcctaaggtgtttaggactcctagtatgagtttggttcgtggctttaggctgcctaccttatgtataaatagagggggagcgtgaggcttcccggtatcgctttagagagcaattgagttgagttttgagttagggtttcgagtttagtcgaaatttttgtaaggagtgctgttggtgcactttgtaaacacagagagaagtaataaagtcgtcatccactttaagagttcttcgatttgtgtttcaccgggtttcggcggtctaaccggcggcgcaccggcggtcagaccggcggcatctcggtggtccgaccggcgggcacacggcggtcagaccgacggctacaggagtcggcgacaggcattttcggcggttcgaccgatcgatctacatcggtcagaccgacgttcatcaggcggtcagaccggcgcaactacttcggttagaccgcgatccatcgatttcgagggtaacttttatttccgctaaaagttatcggtttttgggtataccaaccattcatcccccctctg

SEQ ID NO: 2465 - DNA, 3529 bp, Oryza sativa
ctcccttgagtatctcaacctgggtggaaatgactttaatgagtccgaaataccatccgccgggttcgagcggcttagtaagctcacccatcttaatctctcctcgtctaatttcgcaggtcaggtgcctgtacaaagtattggccaactccatagtttggtctctcttgatatctcatttagttctgaccttattgagctattcgaccacggttatctcattaacccatggcaaatggacttaccaaacttgacagccttagttgcaaatcttagcaggttggaggagctacgtcttggccacttggacatatcctccaactgaggacttgagtggtgcaacgctctagtcaagtataccacaaatcttcgtgttcttagcttgccattttgtgtgctctctagccccatttgcgggtcgctctatagcttacgctcactaaatgtgattgacctacaatataattatttgactggtccaattccagagtactttgccaacttatcctccttgagcgttctccaactgggttataacaagcttgaaggatgggtctcgccttcaatatttcagaacaagaaactagtgactattgatcttcatagaaatcctgacttatctggtactctgccgaatatctctgctgacagtagtttggagagtttacttgttggtcggaccaacttctctggtagaataccaagttccattagcaacatcaaatctttgaagaagctggaccttggtgcaagtggcttttctggaaagctgccctcatctattggtaagcttaaatctttgagtttattgcaagtctctgggttggaactaataggattgttccccccatggaccacaaacttaacctccttggaggtccttgagttttcccagtgtggcttatccggaccaataccttcttcaatcggagatatgaaaaaaatgagaaaattagcactctatggttgcaactttgtaggggaaatacctcgacatatctttaatttaacacaactggataccatccttcttcattcaaataatttcattggcacagtcaaactctcttcactttggacactacgagacctatctgttttaaacctctcagacaacaacttaactgtaatagatggagaaaacaattcttcactgatatccttgcccaacatagatcacttgagtttggcatcatgtaacataactagatttccaaacattttgaggcatctaaataataatataatgagcggtgttgatctttcacataaccaaatccaaggggccatacccaattgggcatgggagaaatggacagattttgaattttcctttttgaacttatcacataataaatttactagtgttggctacaactcctttcttcctatttgtatagtgaggttggatctcagttttaacatgtttgaagggacaatacctctaccccagaactctagattcgtgcttgattactcaaacaaccgtttctcatccataccaacaaatatttcaactcaacttggatatactgcctatttcaaggcgtcaagaaacaacctctccggagaaattccatcatcattttgtagtaacaatatacaggttctagatctctcttataatttttttagtggctcaatcccttcttgcctatttgaggatgccaatgcgttaaaagttctaaatctgaaacaaaatcaacttcatggagagctagcacacaatatcaatgaaagttgcacattagaggctctagatttcaatgacaataggattgaaggaaatttgcctagatctttagtttcttgccgaaaattggaggtccttgatatccaaaacaaccaaatcaacgattcttttccatgttggatgagagtaattcctagactccaagtccttatcctaaaatccaacaaggtctttgggcaagtgacacctacagttgccgaggaaagcacttgtgaatttcctagtctacggatcctagatctggcctccaataatttttcaggcacactgagtgaggcatggtttatgagacttaagtcgatgatgattgaatctactaatgaaacattagttatggagtttggaggtgatcaacaagtctaccaagttaacattgtgctcacatacaaagggtctgccatcgcaattagtaagatactaaggacctttgtattcattgatgtctcgaataacgcattccatggaagcatccctgaatctattggagagctagttctgctacacgcgctcaacatgtcacacaactcactgacggggccggttccatctccactcggtcatctaaaccaaatggaggctttggatctgtcctcaaacgagctttcaggagtgatcccacaagagctagcatccttggacttcctcggaacgctaaacctatcctacaacatgctggaggggaaaataccagaatcacctcatttctcgttattctccaatagttcatttcttgggaacgatgctttgtgcggccctccgctatctaaaggctgcaacaacatgacattgctgaatgtgataccttcccagaagaaatctgtagacgttatgttgttcctcttttctggaataggattcggccttggatttgccattgcaattgtaatagcatggggatttcccattagaagacggtctccggcgaggcagagagccctctgaatcatgtattgaactgacctttttctgtatcaaaggttgtaaacttgtaaccagggccatgtcattgttgccacaatctactacgtatttgaactcttccgtctggatcaaatcaactatatcgtatacagagttacattacatactactagtagcaattttgctgaagtcgctcggattgatttgctggtcaagcaaagctgaaatctagctgcagcagcttagctcccacgagacagcttagccggcgccgatgaggccgctggtgtgctcccaccacgcgccgtcgctgctgcggaagccctcctgaagtccaggtagaggttgtctgaaatcatacaatgttatatactgctttggtaactataatagcactggataattggatatgtacaaaactggctcaatgaagattgccagactgcctaatgcacgttttcctggaggaatatgattagagtaaatccagaaagacaagactttgaatataagatatttttagagagaagtgtagaagtaattgtgaacatagtatcagtattgtcagatacgttcagtatagcaaagacaaaactagcaacgatcaacatctagctgcttcagatagagcaggatcagtttagcacaactatctggaagcatgcattagcaatttcagctgaaaaatcttaggtttccgagtcaaagaagtactccatccacaaatataagcacttttaaaacaatgctaagtcaaacattttacactttgactgtcaatagctgtagcgcccgttccgtcgtggcgcctagcgggaaaattatctcttaaaaaccctaattgcgaaatttgtt

SEQ ID NO: 2466 - DNA, 1088 bp, Oryza sativa
aaaaaaatctgcagctgatgggatcagctaggcccgggtggccgtttgaaaagttgttggcccgggtggccgtttgaaaagctgttggccgggtgccaaccttgtttcaattctaaagactgatacattgcacatactccgaccggacgagatgcactgtctcatccgtgtcgtttgagaagcactcacctagttgttttagaaaagagatcaaataaaataaattgcaaaaacaacagcctttccttgaagcctgcattaaacacttatttcccctggcttgctgagtactcccgtactcacccttgctctatataaatatcctcccccccagttgctgaagaagatgaagcaaatcctgctgatgaggagttcttccaggagcaagctggttacgatgagttttagggtttcagcctagttcccaagtcgcgcctgtgatggttggtccaagtcctggcttccatttcccttttgtaatgcagttgtgagctcgggatctgtccgcaccccaatatgactgtactcttactctataataaagagacctctgttgctgtgatattctatcttcctgtgataccagcactgtttcctgggactggtatcgattaacaggttaatttggaacgtcacgggctagttccagtcgggactagttcggggcgtgacaatagcaaaataaaatcataaagattcacgacataagaattatgttattagatctatcatgaaacaagctaacataagtgcaactcttttcatttaaaataattttagagtaaaatgtacgggcggtccttaaacttgtaggggtatgtcatctaggttcataaattctcaaaatgcatatctaagtcctaaaacttgtcatagtgtgtcatttaggtcccaaatcaccacaaccccttgagaatcctacgtggcggcgatgtggcatgccacacgtacatgacatggcattattttgactgacaaatgggatccattaattttctttttctctttttttttcttcttttctttttctttttcgttttcttcgcattcttcttttttttccttttttaggcacgggctacagagaa

SEQ ID NO: 2467 - DNA, 10464 bp, Oryza sativa
  unsure (1)..(10464): unsure at all n locations
gctcgnccgagccgccccaaatctattgggccgcgccctagccgcccgagagaagtctatgtccctccctcccttcttttctttttctttttccaaaaaggatttaactaaatcctttttcctttagataaaaaattcaataatcttagaaattcaatatcttcccgaccataagtccgtttgactccgttcaacttccaaaattcctcaaatctcgagatctatctaatggcacgtttagaggtcattaatagggctttattttcgccgtttgttgagttgtcccgtttcgcgtgtagtttcggagcccgaagacccgcagcgcgaggatttcgaggatcaagctccagatctcgagcaaggcaagccacctcgaacatcttgagcctatatttgaaatttaagtatattgcttgcaaaatattatgcattgataggatcgcacttaatctgttgtcccgtctgcaaggcagattggcggacttacctaacttgttgcatttgatcctcccattgttaattgctataccatgtccccttgtaaccacccagttgcgcctcgatattcgtgcactctgtacgagtatcggcggacgccttcaaacttaaaacctgaaaaacaatttgggtaaaactggagttttacaaaagacttggaaaacccgacacctgggtcggtgcttgtgaactaaatgattttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagcatggtctgggacctaacctgttgttggtctgggacccctctcgtcggcatatggtaaacctgtgtcggcttttgaaatgccttgtcatgaaagcttggaggtctcccgacgtggctgatccccacgggctgggtgacccgggttagtaatgtcatgtgggtaaagtgtaccccctctgcagaggtcattaaactgttcgaacagccgtgcccacggtcatgggcggatgtgaggtgattcctagcgtagttttgtttgactactgcttgtgaaattgctgttgtgaaaaggggttcgatgtttgaaaaaaaatctgcagctgatgggatcagctaggcccgggtggccgtttgaaaagttgttggcccgggtggccgtttgaaaagctgttggccgggtgccaaccttgtttcaattctaaagactgatacattgcacatactccgaccggacgagatgcactgtctcatccgtgtcgtttgagaagcactcacctagttgttttagaaaagagatcaaataaaataaattgcaaaaacaacagcctttccttgaagcctgcattaaacacttatttcccctggcttgctgagtactcccgtactcacccttgctctatataaatatcctcccccccagttgctgaagaagatgaagcaaatcctgctgatgaggagttcttccaggagcaagctggttacgatgagttttagggtttcagcctagttcccaagtcgcgcctgtgatggttggtccaagtcctggcttccatttcccttttgtaatgcagttgtgagctcgggatctgtccgcagcccaacatgactgtactcttactctataataaagagacctctgttgctgtgatattctatcttcctgtgataccagcactgtttcctgggactggtatcgattaacaggttaatttggaacgtcacgggctagttccagtcgggactagttcggggcgtgacaagagatggtatcagagcacaggctttgccctagggcgaaacccgacgcttaggacgaccctaaggatactaagttcaaaactacttgcgaaaagctaaggtttcttttgttttctttattttcaatagtttgtttccaaaatggttactgatctttctccctctttcaaaattgtagatggcagtgaacgccagcttcagttcccacggttttggtgagggtcaccacgtcgcccagcttcgtgacctcgcccgtttccttggcttctcgtgtcccgagtacacggggtactccgtggaccgcgttccccctcactgtgagctctctgtgtacctttacccccgtggaggtatacacggagctggccttcgcccacaccacttcactgtggccaggcctactctccagatcgcgtaccaggacctctcctggactgcgcttcgtcgcctggcccacgactacagccaccgtctcggaggctccgccttccggcagtttccacgccttccttctggccactcagacgccaggtacccttgcccgtacagcgagtctcagccagtgctgactcacatggttgagctttcggaggctcaggccacccagcacgacctactccttgaggcttaccgctctcttgctcgccgctacgccgctttggaggcccgtctggccgaggagggtgtcacctcagttgacactatctcttgggactcaggtcgcctctgccacgccagccacctgtcctcccacagctcccgcggctctgctcgcactcccagtggcccgcgctcccccagctcgcgtgcgccgtactcaccagtgtactccccctacccacacccagttagcccttcctacacccccggtcacaccccagttgcttcctcccgccgtggcccacgctttatccgcactgcgcggaagcgtgttgttggttcttccaccgtgttccgtttccactacccagctcctccaccgccagcggcccgtgctgctgccggccctcgacaggttccgccggccccttcgcgccagccgatcgacgtttcttcgactgaggagccgactacaggaggcagccaggccgacgaggagtagaggaggcagtcttcagcagccgtccgtgtgttaggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttactttgctccttgccctcctaagtgcttatctaactcttacctcgccctcttctgggagtttagatggctagccgcccccgccgtgcagcccgtgcaccagctcgctttggttttgaagatggtagagtcgaagcagaagcaaatcatgaatcagctaatgagcagtctcaccacagcaaccgttcgcaccgtactgtttcccgcaacgcagaagttgagcaaccccgccgcagcaactgctcgcatcgcacagtttcccgtgatgcagagatggaacagtctcaccgctcttaccgcactgccagtcacaattctggagaagaacgcctcccttccccacctcatgtggaaaacaacatgcaacacttaatggcagttcagacgcaaatcttgcaaggactaaccacagccatagccagttttcagcataatgcgcatggaaatggccacccccacatgggcaacaacagatccaagctgatagactttctgaggtctcgtccgctagagttctctcagaccgtcgagcccgtcgaggctgacgattggttgaaagatgttgatagaaaactcaacttagtgcagtgtactcctgttgagaagacgctctacgcctctcaccagctaagaggacctgccgcagattggtgggaaaattactgcaatgcacatcctgaacccactaacattgcttgggatgagtttgctacggctttccgtgcagctcatgtgcctgaaagcaccattgacatgaagaaagaagaattcaacaggcttaagcaaggcaacagcagtgtcaatgagtacctaagtcagttcaacaagttggctcggtacgcccctgaagaagtggacacagatagaagaagatcaggaaattcttgaaaggtatcgcagttggaatgagactccagttgcttgctcatgacttccccacttttcaacatatgatcaacaaggcactcctacttgaggatgccagaaaagaggctaccgaagaatacaagaaacgctagtctaaccatcagggaaattcttcccgaggcgcacctcgccctcgctacggtcaacccatgcaataccaccagtcggtcactcagactaaccgccagccaggctacgcccctcgtcctcagatgaaccgtccggcacctccgccacagcagcgtgcccctagtggcaatactgcgccaaacagtgttacctctttcaagtcaccacagggaccgtcagcagttcagtgtttccggtgcaaccagatgggtcactatgctagacagtgccctcagaatcctaccaacaccaactcagggcatgctaatggcagcaatgccagaactcctactccagcggcagctcagtctcgtcctagctctcaggcaagtggacaaggttcacgtgcttccaacaacttcggtcgaggccgtgtgaatcacattcaagctgaaaccgctcaggatgctccagaagttgtgatgggtatgttctctgtcaactccgtacccgcaatagttctgtttgattcgggagcttcccattctttcatatcgcaagcttttgtgaaaagaaatggttggaaaacccaaaatttgcgtgtgccaatgatagtacattcccctggaaggaatataagggcaactcaaatatgcccggaagttaaccttagaattgaggaagttgacttcctagccaaaccgatagtcctagactcgcaaagcttggacatcatcctagggatggattggttggcaaagcacaaaggacagatagattgtgccgaaaagtccatcactttgcaaggacctggaggaaagcaagtccgctttacccctaacactcctaccgcaaatcggtctattctaacctgtttacaagtcacctccttggagtcggtgcccatagtctgtgaatatcccgacgtatttccggaagaattaacaagaatgccaccagaccgagaaatcgagttcgccatagaactggcaccaggcactgcaccaattgcaaaaagaccctaccgaatggcagctaatgagttagcagaagttaaaagacaaatcgaagagttggagagtaaaggttatgtgcgacctagctcatctccttggggagccccagtgcttctggttaagaaaaaggatggctctgagagaatggtaatcgactatagagccctgaatgaagtaactataaagaacaagtacccgttgccacggattgacgatttattcgatcaacttaaaggagcaagagttttctcaaaaattgacttgaggtcaggttaccaccaactgaaaatcagatctgaagatatcccgaagaccgctttctcaacgcgttatggtctatacgagttcacagtaatgtccttcggactcaccaatgctccagcatttttcatgaacctaatgaacaaaatctttatggaatacctggaccagtttgtcgtggtattcatcgatgacatcctgatatactccaagaacgagaaagaacatgctgaacacctgaggctgataatggaaaagctcagaaatcatcgactattcacaaaattcttgaaatgcgaattctggttggaccgagtagcatttcttggacacgtgatctcctccaacggtgtcgaagtagatcccagcaaagttgaagctgtacttgcttggaacccgcccaagaacgtgtcagagatccgcagcttccttggcttagctggatattatcgaagattcattgaaggattctctaagctagccagacctatgaccgagctgttaaagaaggaaaagaaatttcaatggtctgcagcctgtgaagacagctttcaggaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcatccaggcagcttaggcctcatgaagtcaattatcccacccatgatctcgagttggcagccgtggttcatgctcttaagatctggaggcattatttaatcgggaacagatgtgaagtatacaccgatcacaaaagtcttaagtatatcttcacacagaccgagttaaatatgaggcagagacgatggttggaactaatcaaagattacgatcttggaatccactatcatcctggcaaagccaacgtggtcgctgatgcgctaagtcgcaaggcctattgcaatatagcccaaatacggcctgaccaagatcacctgtgcaaagaattggagaagttgagggtgaccgtggtacagtcaggtgtccctgccagcttgacggtacaacctaccctagagtcgcaaatccgggaggctcagaaagacgacgaagggataaaagagttaataaaaagaatacaagaaaagaaagacaccaatttctccatagacgatcaaggcacagtttggtgcggtccacgcatctgtgtaccggccaagaaggagttaagagatctcatcctaaaggaagctcatgagtccgcctactccattcatccaggaagtacgaagatgtaccaagatatcaaggcatacttctggtgggctggaatgaagcgagatgtcgcagaatacgtagccttgtgtgacatttgccaaagagtcaaggcagagcatcagaggccagctggtctgctgcaacccctaccgattcccgagtggaaatgggaagaggtcggaatggatttcatcaccggtttgccaagaacccccagcgggtacgactccatctgggtaatcgtggatcgactcacgaaatcagctcatttcgtgccagtgaaaaccacctatgatggaaagaaactagcagaactctacatgacccatgttgtatgtagatttggctgtcctaagaaaattgtgtcggaccgaggcactcagttcacctcaaggttctggaagcagttgcatgaagccctcggaactgatctgaattttagtacagcctaccatccgcagaccgatggtcagaccgaaagggtaaaccaaatcctagaagacatgctacgtgcgtgtgccttggatttcgaaggcacttgggatcgttgtttgccgtatgccgagttctcgtacaacaacagttatcaggccagcattcaaatgtcgccgaatgaggcaatgttcggaagaaagtgccgcacccccttgtgctggaatgaggtgggcgaagccctggtattcggtcctgacatactcaagtcagcagaagaacaagttaagctgatccgagaacgtttaaagacagcgcaaaaccgtcagaaaaattacgctgacaatcggagacgtgaccttgagttcgaaaaaggagatcatgtgtacctacgggtatcacccctccggggtatgagaaggtttgggatgtccggcaagttagcaccccgctacatcggcccctacctcataaccgccagacgtgacgaagtggcttatcagcttgagctacctgaaggtctcgccgatgtgcacaacgtgtttcatgtatcccagttaaagaaatgtcttcgagttccagaagagcaagttcccctgggtaatatcgacctggaaaagaatctgaccaacaaggaaagaccgatcaaggttcttgaagaggcagaacgtcagactcgaaggaagaccatcaagttctacaaagtccaatggagcaatcattctgaagatgaggcaacctgggaacgagaagatcttctccgcgccgagtttccggagctgctcccttaggtgctaaatctcggggtcgagattcttgttaggtgggttggtctgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaattccctccaaatcaattcctccgcaaaagtctagtttgcctcccccgggtttgatgggccgatttccgctcggcccatctctcccccggccccctctccccgggcgctctctctctctctctctctctctctctctctctctcctctcgctccctccccaccccggcgcgtttccccccccccccccgctcgctgctcgcgcgtgcgagagccgcgccgagcgcctctttcttcgctcccctccgctccgcccgcgcgccgcgcgcgcgtgcgcgggtgtcaaccgcgccgagcgccccctcctctcgcgcgagctccccgctcgcaaagccggccccgcgccgttgctcgcgcgcgcgcccgcgtggtttcccgcccgagccgcgccgtctgcgccgtcgtcatcgcccggtcccgctgcccagccgcgccgcccgttgcttcccgcgcgcgtgtgccgagtggccgaccgcccggtcgccgccgtcgtcagcgcctgcggcgcctgacgcccgtgtcgccgctccgctccaatccgctcgccgtcatcgccgtcgtcatcgcccggcccccgccactccgcgcgcaagccgccaagggacggaggccgagctctccttttcctctgccgcgtcgccccgctccctcctctttttcccgtttcggcaaaggggcgagccccctttctctccctccttttccccttttctccttctttccctcgccggcgtcaccttctgtcgccggtggggacgctagccggagcgccagctcgccggcttgaccgcccatgtcggttcctctctcccaaaccgacattgccgcccatttaaacccgtcttccccctcccttcctttcctctcccattcgcctcctcaccattgccgccgctcctgtgctctgcctcgcctccgccgtccatcgccaagcgccgggagagccggtgcgttcgtggacgcggaaggggactccgggcgcgccctcttctcccttttcctcggcctgaggccggagagattactcccgtgccgtcggcctctcgtcacagcgcccctcctcttctcggtgatgcctctctccgttctccctcctcgctccatctcctcccccctagctttcggtagtagctcgagtagaacccccgtagctagccggcgccgccccaaccgtagccttcgctcgccgtgtgctcgccgccgtcgccgcccgagctccatagcacccgctcgtcgccggcctcgctcggcgtagttccgtccaatccgacgctagcgttgagttcccgaagccgcgtagatgctctcaccgccgggaattagcccctcgtggcctcgtcgccgtttcccctttctcccgccgccggttgccgccgccgcaatccgccgccatcgagcaacccccggcaaatccgagccgttggctcgtctcccctcgtctcgagcaaccgcccggtgtgctcgcttttggccgtatcgccgtggttcgctccgccgctcgccgctgtcgcccgccgtccattcgcggccgggtcgtcgtctacctcccgccggcccgcgtggctgccacgtaggcgccacgtcggcgccacctcggccgcgaccggatcagccgacccagccagccgctccctccgtttttccccgtgcgcgtggtccgcggtgagccgtgaggttgcgcgtgggcccgccgcatccgttcctccgcaaaccgcgcgcgtgcaccgcgtcccaaccccgcccgcgcgcgtgcgccacgtgctccctccgcacggtgagccgagccgctgacaagcgggtcccacccgggaccgcgcgtggtgagcccggtccaccggactctctctcctccctcccgcgcgcgcgcttgggccgtcttgggccggccggcccgttaagctcggccgagccgccccaaatctattgggccgcgccctagccgcccgagagaagtctatgttccctccctcccttcttttctttttctttttccaaaaaggatttaactaaatcctttttcctttagataaaaaatcaataatcttagaaattcaatatcttcccgaccataagtccgttggactccgttcaactttcaaaaatcctcaaatctcgagatctatctaatggcacgtttagaggccattaatagggctttatttttcgccgtttgttgagttgcccgtttcgcgtgtaggttgggagcccgaagacccgcagcgcgggatttggagga

SEQ ID NO: 2468 - DNA, 2373 bp, Oryza sativa
agcttatacctgatggtacaattgaaaagtacaaggcaagacttgcggccaagggttatacccaaaaggaaggcgaggacttcttcgacacatactcaccagttgctcgcttgaccacgattcgagtactacttgctctggcagcctctcatggtcttctcgtctatcagatggacgttaagacagctttcctaaacggagagctagaggaggagatctatatggatcaactagacgggtatgtactagaaggtcaggagggaatggtgtgtaaattgttgaaatccttgtatggcctcaagcaagcacctaacaatggcatgagaagtttgacaccacgcttacatctgcaggctttgttgtgaatgaaactgacaaatgtgtgtactatcgctatggtgggggagaaggagtgatcttgtgcctatatgtcgatgacatattgatctttgggaccagccttaatgtgattgaggaggtcaaggactatctgtccaagagttttgaaataaaggatttgggagaggctgatgttattcttaacatcaaactacaaataggagatgagggtgggattacacttgtgcaatcccactatgtggacaaggttttgagtcgctttggatatagtgactgcaagccagctctactccttatgatcccagcgtgctattaaggaaaaaccgaagaatagcaagggatcaactgagatactctcaaatcattggttcattgatgtacttggctagtgcaacgaggcctgacatttcatttgctgtaagcaagctgagccggtttgtctcaaatccgggacatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcatgaacttctgatggatttgccggtggttgaaaaatcagtgccagctatcctaatgaactgtgataatcaaacagtgattattaaagtgaacagttcaaaggacaacacgaagtcatctaggcacatcaagagaagactgaaatctggtagaaagcagaaaaactccggagtgatagcattggactatgtccaaacggctagaaatctggcagatcagtttaccaagggactaccacgtaatgtgatagacaatgcatcgagggaaatgggcttgatacccacctaaggttgcacaatagtggaaacctgtccattgtgatcggagatcccgtgaatttggatggcgaaacaaactattgtgtgactgagagaagagacccttgaaaagggctcatttccatgatgtgcttctcttctttcctgcatggtaggatggctcatgccttaatgtgttccgagtggcttctccaagcagagatgttgacctgcagaacatctcagaaggaacacacctatatgagttcgactgctagtcacagtctacgaggtttgggcgatctctagatactcatgaaaggcctggagtttgacttatatgctccaaacagaggggatgcgaatggcagcccagtaccagtcaaggttctaagtgaaacctgatcacacaaaactgacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaacttatcctattaaatctcaaaggcccataataagtgttaaggataataataccacatcaggatttaagcgaggaatatctcaacctaaatagggagttattggaggccccctgttgattggttgaggtgggggtcggaatgccacacgcgcgcgcgcgccgggccgggccgtgggcgaggcgtggcgtggctggctggcggcggcgtgcgtgcgtcacgtcgctattcttttgcagccactaaccacttcccacgactctcttcgcaacagcgcgtccacgttcccacgactgcctctctctcctgatagataaagaggccgcgagtccgatcggttcccgacgcttgcttctttctcggtgttagttcctcctcctccgcgccagtgcctgtatcggtttctcgcttttgatctcttgcgcgcac

SEQ ID NO: 2469 - DNA, 9625 bp, Oryza sativa
gaaaagctgctataagagaaattgaggtggatcatatttgtgagttgcgcaaacccagatgctgggagagcggttcccaaaaaatcattgtaagcaaggttaaggtttctaagagaggtgaggttaaagagtgcaggatcgagacgatggcttatcaagttcaactcactgaggtcaagggaaatgaccctgccggaggccatgtcacaggtgacaccctcccagtggcagcagtccgatccagctcgccatgatggcagcaggtttgtaccgatgaaggaagctttaagccgtagtagggaagaagcttgatctgggcggcaatggacggctgtgtcatgctgggctgcagtatcactatgaatggcgtaagagcacaagaggagtatgaggatgttgatctgttgcttgggtgaaatcatttttgacactggcttgcgtcctccaatggcgtccagtgaccctctatatattgggaaaaagaagaacatccggtgacctagacagttcagactttggactcgtaattagctcttgtttagttccaaactttttcttcgaacttttaacttttttatcacatcaaaattttcttacacacacaaacttatcaaaatttgattccataaaaatcaaggccgtatttagttccaaaggttttctttaaactttcaaatttttcatcacatcaaaactttcctacacacaaacttctaacttttccgttacatcgttctaatttcaatcaaacttttaattttaacgtgaactaaatacagcccaaagcaactcctaatacgaaaccaaggagatgatcgatttgcaagccgccgctaacagtaccgatgagtgagcgtgtggaccgcgagtagggaacacaagggtacaagcgtgtgggccgaacccgcactccactccacttcgcgctgtcaattgagacgtggtggtcccgttccggtgagaacacgatggacgaccgaccagcggatccgtcaacgacgtggtctcctgccggccgggccctgctatttccatcccatccatctgcctgcagatgggctgtggtttgcccattgatgaacgcctcatgctggccgcgattttgtgccccgaatttagttcctaaatttttttagttccttgcgctgtgtttagttccaaaataattcttcaaacttctaactttttcatcacatcaaaactttcctacacacataaacttttaactttttcgtcacatcatttcaatttcaaccaaacttccaattttggtgtgaactaaacacagcttgtttagttccaaaattttgtgccccaaatttagttcctaaattttgtgccttaagggttaaggccttgtttagtttctaattcttttataactttcaactttttcatctcattaaaactttcctacatacataaacttccattttttttcttcaaactttcaattttagtcaaactctcaattttggcatggaactaaatataacctaacttgcgagtgatctggctgcctcctggccggcgatacctaccgaaaatgatagagctcagtgattgattctcaggctgctaaacacgcgggtggtgatgcgcgcggcagctttgttctctgacgagggggctataacaccaccggcttccggaggcagtggcgtagctagaatttagattaaaggtggtccatctattagtggcggacacaactttaaaatatagatggggcggagaaaagagatattcactcgataagagcaatcgaacacaacacatatcgtattaatagttcgttcatataattgtctcaatctgtcaagtgtttatatcttgttatacctaattttgatggcctatgactactataagcggataaggggggatgatactccctctgttccataaaaaaaattaaatactaaggatagatatggacatagtgtatgggacaagtttgtcttttgtaacctttctctacagttttattttttaatttgcaattataggatagtaagaaagcaggagctgaaaatattcgcctcaagatacagttggataactgcagtgtagtgaactccctggtgttttttcttaattatctgaaaatatgaattttcttcaacgttgttcatgattatcgttctacaagcattcatggtctcatggtcattgtgtacgggatgatctaatcgtagtagctagtagtaaccaactaccaagttatatgattttagacgttcgagtttcaaaagggtagcttttagtaggaaagagtcttgtacttaggtcgatgaacctcttggttatattctaagcactttaacaaacgatgtaacaatgtttaatgatcaataaagctagccgaatggtattccctcgaaaaaaaagttatatgattttagacgttcgagtttcaaaagggccaggcctttcggattcaggggatgagcataattgcacaacgtgcatcttgtacagaaggattatccaagggcagaagccaagaaagtgttcgagcagatgaacattgtcagctcagcattgctgcgttgcatcctcatcacatatcggttgagatccggcggttgcggaaggcaaagggaaggtaatgcgcgggaacgccatgcaggggagaacgtggcgggagcggcaacgccgccaacgcgagtcgcgagagcgcttcgatgggccgagattgccacacaaatgggctttaattactggaggccaccaccaccaggcccgtcatgtgtgtacggccccatacgatgcgaggcctgccactagatctgcgacggttgcgaaatggcggcgcggccatggtgccatggccggcgacgaggtggatgcgccgaaggctctcctcccacccagaccggccatcctcgtggcgagcgccggtcagcatctaccaaggtccaagggcaagtggtacgcgccgccatcgtacggtcgatctcgtcgtgcgcgtcctgttcgatgccccgacgccgctcgccgcccgtcctcgcggacgccgccggagccggagccaccggttggtttggtagacttgtcccccttcgcctgcctccgcttcacctcgtcgacgcctcaccccacttcgattcccaccaccactccaccagccgtccatacaccccgatccccaatccccagttccagtgaggtccactgccacttgcaactcgccggagagaaaacgcgacaggttggaactgcaaggtgcgacctggaggtcagggcaagtctcagtgatcatccggtcatcgtggatgcgttgcaggagcgagttaatcctgctgctccgctgctcgccagtgcggcgctgcttctgcctggtacgtgttcgagggaatgcgcctgtgcagttgcacagtacatgttacagcaaattacacaatctcattgtgccaacttggtacgtgatgaactgatgactagtgttgccttttcttcattacattttcaggtgatctcatctagctttgcaaatcaagcatgtgttcctgcaccgataaatcattggtcttgaagctggagcgatggggatggaaccatcaaggttttccttccacgtgaccagcatcgtcttggtagactcatcaggtgattctgccacctcagtttacagtctagaactagtagataaatccaaattgcattattcgtaaaagagtagatttatacaagctcataccacacgcatgcatgcgtacactacttaactactacagtgttactggtgaaacgaaaaatgttccagttccagcgtttcgctcgggaaaccactgacaaaacaacggccactgtaaagccgattccaaacccggatcccacaaacacaaacaatattattatccccacactatctcgagaggatgatggtgatcttgcagcttctatgcctgaatagttgcactgtttggacagcggccttccacagagtcctgcattgccttcgaatgatctgttgccgaatgacaagaactgtggcccttgtggtatctgtccagtcaaattgttgtatgagagattcaatattgcgagagatgttagggatgccaactcctgtgggattgcttctgagagctgattcaaagagaggtccaaggactcgagctgaaccaatttaccaatcttagatggaattcttccagtgaaggagttgcgtgacatgttcaaaccatgtagagcaattagcttcccaattgattctgggatagcaccattgaaatcattgtttgataagtctatcatcttgaaagtagtcaggattttggtaaacatgagatcaaaccctttaaatgtaacaatcatattgttttggtataagcccttatatatcccctgaatgcccaaaacatcaccctgatcactatttatcatcattgtttcaaggttctcaaaccattttgattgcaaactccctgataagttatttgaggctaaatcaataatttgcaaacctgagaaatacttactggttgcatcactttctgtaggtagtcctactgaaccatagaattgattggatctcaagatgagaacccgaagattggacatgttccctaaccaagatgggaaagaatcaagaatctggttgttacccatgtcaagaacctctaagctcttgcatttagacaatgatctaggcagtttccctataattcggttgctgttcagatcgattgtctgaaacatacatccttctctaatattcttaggcagcacgccatggaagttgttctcccttaacttcaatatggtgacatcaccattttgtattaaacaggatggcaccataccactgaagttgttgtgtgataagtcaaggacctcaagataacattgggtacatatagaacttggtatatgaccacttattttattcctggaaaagctaagatagtagacgtttcgaagatacctgccgaagtcacgagtaattgaagagaagctgttgctagagtaatccaagagaacaccaccatctctagtagttgtcagtggtataggtacgttaccatgcagtctgttggaactaagattgagtctatctaaagtgtgcaagggaagaacagatggattattttccaagctagtgaacatgttgttagagagtactaacacggacaagctattcttccagttatcccatatccagcttggtattactccatttattctgttgtttgaaaggtccaagtaagacataccttttatatctctcaatgcgcctggaatttttgtaaggttgcaagatgctagtcccaggtatttgattgtagggaagtaatgaaatggatagccatcttctcgatctatcaccgacaacatattgttagagataattaatgattctagtttctccatcttccaaagaaggttaatttccagtgtaccattcaattgatttgattgaagcacgagatttgttagtcttctaagatcaaagaacgatttgggtatgtagcctgtaaggtggttatagcttaagtcgatgaattctaacaacgaggaaaacgggtctgaaatgtcttctagatgtccagaaagttggtttgatcgcagatctagcatttccaacgattgatgagcgaaaagaagcttcgggattctacctgtgtggatgagggacagagagagaacaacagtcaaagtttgttcaaaaaagaaaagcacagaatgtcagaagtcctgatatatgtactcaaatgtgtgttcttaccgctgaggctgttaagtgaaagttccaaatagataagcttagtcaagttcccaatccatgatggtattggcccatagaagctgcaattaaagagcactaaagattccaaacttgtacagtttctgatccaagggggtattggactggagaaattatagccttcgagcatcaagtctctcagtttaattgttccaatccaagataacagtggcttctctatgcctgatccagagagccataatgtatctagagatggaaggctaggtatgaaagtagcaacctgcttgggagatcctacgttgctaaggcccaaaaatttcaatgatttgaggtggataaacgaggctggcatgttaccagaaaagtttgtcctctgaagatttagtgattccaaatattttccaggtgggaaatccggaagttggacaaaaagagtaggattgaaagatacatcaagagacctcaaattttctacctggaatatctttgtgggaaattgcccttcaaaattattgttcgagagagcaaggtcactcaagaaaaagaagtctgcaaagaactcaggaacccttccagaaattccattgtagttgaggttgatcaccactagagagcggagttgggaaaatgaacgatgaatagttccacctaggtcacattgggacaaactaagattctgcagcagagggagagagtgtgctaaagcaacggaccaggttggttcactagtaatgcgcacttgatcaagatagagctctctcaaattgctcaggtttgctacaatggtttgaaaactccggtcttgaaaaaacagatatttgaaggaaagatcaagagcacgcaaattcttgagatgtgcaattccaatgggtatctgaccaaagaagcctgcttctgacaaatcgagcctgaggagtttggtgagccgctgaaacccgaaactaggaagaacggtccggttgaaatcgttaccagcaaggctgaggtttctcagagtggtgaggttgaagaccgctgggtctaggccaccggggctctggagattatagtaactgaggtccaacgctgttacctgcccagaggatgtgtcgcaggtgacaccctcccagtggcaacagtcggtgttcagtttccatgacgagaggtttggattaatgaaggagctcttcagctggagaagcgcttcagcttggtgaggatggcaatgaactgggatggtggtgttggcaacagtttggatggagcagtacaatgtgagtagcagcagtatgaggagaagctgtggtagtgtggatgccatctctgtattggtttgccactacacataaccacttgggtgggtggttctcaaggtaatatatgtaggttaattacataggaaaaacagtaggttttaattaaaaagaaaagggaaaaggctggcctgtacatcattaaatttttatatttgttagtatttcctcaatatgttgcgttcaatcatcaatataacctttacctgttagtccaggtctccaagatgacagttagtgtgcgaccgtcatgtggctaacgttgtttccatgtccaggccggcatgttttgctgtcttttctaaggctaactgagagtgagagaagcacttgccttagggcaagtacaataacgtgaaattaccggctaatttggattttatatctatgtggcggagagagagtaccatgaatgagaaacgtcgtcgattaatctgtcgaaggtcatgcacaggcaccaatgctcctatcgccgacttgcaggggcggatccagcgtggttgctggggggactcgagtccccctaccccactggatcaccattgatagaaggggagatgaaagggaaaaaatagggagaaaatgaagagtagggggactgaacaaagaagcccccccccccccccaaaaaaaatcttattctgaatccgccccggctggcttagcgccttcctatcgacaacaccatggacggaacaagaaattagcatgaatgatctttccttgatcggcttggaggaaagagaaaagctgggaagaagtgagggagaaataattaaaccatgattaatatgagtgttgcagtaaatatgaagagacaactattatatttattatctattaagttgcctctaaatggcgtgtataaagattaagagtaagcagtcgtcttttctattgcccttgcccttaggcatgtccagttgccacaccttggccgtgtaagaacagtctcgagtcttttgataggtgcccagtttttctcactttttccaacttcacctccctttttgtatgcacatgtttcccaaattgctaaatggtactccctccattccaaatttatctacatatagttttttttaggttattcctaaatgatctacatattagtgttcattcattaagtctattcgttatttgtgtattggagtaaatggatattgatgcatgcatccatgcacacaagtatttataacccacatgcaatatcttgatttgctattggctaggaaatagtagggatggggcatgcatcgagtttgttgctagagtaaatatagtatgagagagttattagcttttcttggtcttggtgtacatatgaaatatatagatcaatttagaatggagggagtacattttttacaaaaaaaatttataggaaaattgtcttaaaaaatcatattaatccattttaaagctttttagctaatatttactccctctgtcccaaaatataagcatttttagcatagcgacaagtcaaacatttttaactttgactatcaatagcaaaataataataataataataataataataataataataataataataataataataataataataataataataataataataataataataataataataataataataagatcaataatgtaaaattgatgttactagatttactattaaacaaactatcataatatccaactctttttatttaaaacttttttacttttacagatattattggtcaaagtagcatatcagagaccgtgtcagagtccaaaaattcttatattttgggacggaggggtaattaataatactctaatctgtcacttcgtttttcgtgcatggaagattagttcccaaacccatttgccgaacatcttgatgtctcaattctcagaaactttgatgagaatgctacaaaccaaattgcatggcaaatgtctctgcactttgcagtaggttgtcacttgtcgggaaaatatcgacagttcaatggggtttacactgaacagaactattgagagggcatgcactctctctttttttttgaatggaactagcacgagagtgtgcttttttattaaatatagaaggagaaaaatacagcccctagagacaaagaaaaggcgaaagccaaactctgcacactatacaaggtgcgggataagatcgcgcaatcgcttagcgcctgccaacgcccacgtgctagcttcttcttttatttttgcggtgagatataatgttgtggcctccttgtgctcgaagattcgctggttacgctccttccatatttcctaaacaacgatgaggatcagggtgcgcaatcccttcttgaggatgccagccgaagtggctaacaattcccaccaatctttgaccgtctgagtcgtctcccaatgccgaggatggagctgatgatatcccgagagggcatgcactctcaatctcattgtgtgctacgatatgattgtgatcaggtctatttgttgctcagtttgagaaaaaaatgttatacatactcggcagagtgcacggtctctgatttgctcatttgaccaataatattcataagagtaaaatgtacgggcggtccttaaacttgta

SEQ ID NO: 2470 - DNA, 7290 bp, Oryza sativa
  unsure (1)..(7290): unsure at all n locations
agtatttggtccaagtttccgctttttggctataggtacatttaccttggccaaacagccccatgttcgtaggtatgagagatttaatttcttcctttcccattcctcgaatggtgttacttccttatgcttcattggaattttattcaggacatgataggtggtcaaaactgcctcaccccaccattccttggaaagccctgaagtgtctaacatggcattcaccatctcagttagagtacggttctttctttcggccaccccatttgattggggtgaatagggaggtgtcctctcatgaataattccaaactcttcgcaaaatgatgcaaactcattggaaaaatactccccacttctatcagacctcaaccgtttgattttcctttcaagttggttttctgcctcagctttatagattttaaagtaatgcaatgccttatcttttgttttcaatagatacacatagcaaaatctagtgcaatcatctatcagtgtcatgaaatatttctttccccctttagtcaacacgtcgttcatttcgcacaaatcggaatgaacaagttctagaggtgccaaattcctcgcctcagatgacttgtgaggcttgcgaggttgtttcgattggatgcaagtatggcacttggaacctttgaccaaagtaaattttggaattaaactcatgttagctaagcgcgtcatacaaccgaaattcacatgacagagtcacgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacccaatagagccgctaacaagattcttctttattgaagggacatgctgcacgttcttcagctgcacggtctttcccgaagtaaacttcagatcgaccgtaccaacaccatgaacagccgcaagcgaccccgtttccatcaacaaggaggaacctctcccgacctgataagaagaaaacagagaaatgtcagcacatacatgaatattagcaccagtgtccacccaccaatcaggtaagtgaagaacagagagaactgtaggtaatattttaccgtaccccgatgttcctccgccctcgctaatgaccatgttggcagactttctgtctttgcgctcaggacagtccttggcccaatgccctgacttgccacacacaaagcagtctccctttgcctttcccttgcctttcttcttaaagttggttgcagccttgggtttgacatcaggtttgactttcttggtgttgtgggatgcatgagggttcttcttctgtaccatattggcactagaacctncctcaacctttttgccccgaacgtncttttgcctcgccttcttctcaacacccaaagagccaatgagatcagaaacactgaactcttgtctctgtgctttagagaagtggcaaagtccgaccaagaagttggcagtttggcaataatgccacccgccacaaacttgtccggcaactcacagttgttggtctcaagtttcttagccagcatctgaatctcatgaggttggtctactacagaacggtcatcgacatcttgtagtcatagaactggtccatgacatacagctcactgccggcgtcagaaactccgaacttggcctcaagtgcatcccacatgtccttcccggaaggcatgtgcatgtacacgtccactatattgtcagcgagtacactgatcaatgctccacggaacaggcaatccaaagcctcgaacttagcctcttcctcaggagaaagaggtggttcacttcgtttgccccgtgaaacatagaagtactgcatcgctgtcaaccacaatagtgcacatgctttccatctcttatagntaagaccatcaaaagcatgtggtttcagtgcagcagcaaagccaactaccgaaaatgacctatcacggttttgggattgtggaaatatagtcatgaatcggcatattttaatcccaaatgtaaaacaataatcatggcataagcggtgtagggtgatcttaacataaccaggagcatactatgcgtatcatgaatgtcaggaacaggaatattacagggacgcaataacatgctagaggcatcatgaagtagcatactatgcgcattatgaatgtcagaaacaggaacattacagtgacgcaataacatactagaggcatcatgaatgtcacgaacaggaacatagcgcacataataataaagcgatagcgctaacaaagggaacaggagaagatataccccaagaatggacctccgctggattgtgaggcagaattgtctccgttgatgttgtcgttcgcggcaccggctccagctcctggcgcaccacctatgccatcttctccagcagcggcggtggcaactccagacatggcgagcagtcgtgcgggaggcactccccaaaaacctgatcacccgcctacccggtgcagatctcaggcgaagatgtggtttcggaggcactggtccttccaatctctcgtgcgcgcaagagatcagaagcgaggaagcgataacagcactggcgcggaggaggaggaactaacaccgagaaagaagcaagcgtgtgcgcgcaagagatcagaagcgaggaagcgataacagcactggcgcggaggaggaggaactaacaccgagaaagaagcaagcgtccggaaccgatcggactcgcggcctccttatctatcaggagagagaggcagtcgtgggaacgtggacgcgctgttgcggagacagtcgtgggaacgtggttagtggctgtaaaagaatagcgacgtgacgcacgccagcctcggcctcggcgcgcgcgcgcgcaagtgtggcattccgacccccacctcaaccagtcaacatggggcctccaataactccctatttaggttgagatattcctcgcttaaatcctgaggtggtattattatgcttaacacttattatgggcctttgagatttaatagggtaagttgggcctagcccaattattctaacagtcagatccccattggaattggttccctcaagaaacttgtcactcttgatttttcccgtaattatgggttatattttgttaagccaagctttcaaactgttatggcaaatctaagcaacctaagggagctccatcttgatgatgtgaacattttaagcagccgatcaagttggtcacttattctagcagacaacactcctcagctagagattcttagcttatctcagtgcggtatatcttgttctattcactcttccttctcaaggcttcgttcattaaagataatcgatcttagcgtcaattgggaactcaacggtaaagttccagagttctttgctgaaatatcttctttgagcattcttgacatttcggacaattcttttgaagggcagtttccaacaaaaatcttccacctaaaaagtttgagaacgcttgatttgtctatgaacacagatctttctattaacctaccagaattcctagatggaaataatctagaaacgttatctctaacatggacaaatttaccttatcatacaccgtcctcatttgccaatctcaagtctctgaagagtttggctattagcacaacaggaacctccaaggagcttcttccctctctaataggtgagcttccttcattgaaagaactggaaatgtggggatcggaatggagcatggagaaaccggtattgtcttgggtaggcaaccttaagcaactgacagatttgactcttggctcgtatgacttttctcagtcaacaccctcctggataggcaatttgacgagtttggcaactttggagatgtggggctgcaatttgtctacatctatacctcatcagattggtaatctcgcaaatttgacaagcttgaggttcgaggattgcgacttctttgggcagaaaataccgtcgtggatcggcaactttacaaagttgagggatttacggatagacaactgtggcttatctgggccgataccctcgacaatagggaatctgacccaactcgaatatttgattatcaggtctaatgaccagctgaacggtaagacaataccacgactgcttttcttacttgattcatatatggaatttcagttaaatacatccataaaataactcacaaatatatctctccacatattatcgtatataaatatcttacattatggctatatacatccactcgtaaatatagagatcggatttttatacattatcttaaaaatttatatcttatattagtgatatacatacatgagtcctgtttacgtgccatatctcctagaggctagagggccttaaacgcagtacgtaaatgataggacatgcgacttctacaccaggtatatatagattgcaagcatatataaaatacaaaaccttatattttgctatgctggcattatttttatacttcctctgtttcacaatataagtcattctagcatttcccacattcatattgatgtgaatgaatttagacatatatatctatctagattcatttacatcaatataaatatgggaaatgctagaacgacttacattatgaaacggagggagtacaaaattatcgctccaatgctgatatcacaccttccatctacagtaaattgatggtgtctattttcgcacttctgaacaaatttcaatctatcatgtgcgtgctgacttatggtctcttggagctaaaacaacatcttttcgactagtattatacccttgcatgcaggaaaaattccacaatcgttgttcactcttgctggattgaaacacattgaccttagtgcaaatcaactttttttgttctctggaagacattgcttcccccttcaacttcacctttgcaggtagagatggcaatgggccccgttcaccgttttcccgcggtgaatttacctattaggtgacggggatggttcatatatatccaccatagtgaatgaaatggttaatatgtattcaccatcggggatgacgggggcggggacggtgcaccattccctgtccccacccccgtggtgacccgacttcactgtatagaggactgattttagactttttagatattttggcccatagtattgaagcccaactaacaggggtatataaagccaaaccctagtcaacatccaatccctccaatccagatcgagaaaaaccacgccgtcggctcctacggctctccgctgcagcctgcagccacgggcgcgctggcccgccgctgtctcaccccttccgtcgggcgtcgacgcgccgcgcgccgccacctcctctcgcgagcgccgccgctgtcttgctccctctgtcgcgcgtcgacgcgccggccccgccggcgtcgcgctgcccggcgcttgcgtccgtcgacggctcgacgcgggcgtggcgccagcagccgcactcgcgcggccgggagctgtcatcgccgggagcacgccatccgccgggagccgccatcaccgggatcacgccatccgccgggagccgccatcaccgggagccgcaacgatgcaaggtgaggaataatagttgatccatgactattattccacggggacggggtcaccacggggaaaaaatcaccgcacggtgatcggggctggtgaaaatataccaccgtagtggttgacgggggtgggacggtgaaattttttcacggcggtgacggggacgcggatgtgacccccgaggtgaattcatcattgccatctctatttgcagggtatcctgttaaattatagtcaactgacagacccgagaaccaaatcatttttccagcttacatatcgtaactatcccagccttaagtcaaataagttgacagccacaatgcaacttagctctatctggaggatcaagagtatctcttacctaagactgtcaaataaattgatatcactcatggatgataaaggtgaaagggtcacatctcttcctaacatcaactacttgtgccttgcatcttgcagccttacaaaattccatgcattaaggtatcttgatgcaattttggaacttgaccttgagagtaaccaaaacactcgaaacgctcgaaataatggactcgtatagtactcctggttggactgttgacatggaaaaaaaaactgtcatcacgccccatttgataaaaaaggatacccacgagtaatcccatttagtcaattcacaagttgctgcattaaatcacacccactcgtcaagtttgtgtactaatgatgcaatttactctaagattcattttagggttaattggatccatgccgctgcaaatatgccaattcgaaaaaatgccactactattcagtatatcggctacgtgccactggaatttggggaaattggaaccatgccactcccatccagttttttttgttaacctccgtcatctctctccctcttcctttcttcgcttctccgccatggatgccggcgagccctccacctcggactcgctggtccttgccactgtagctagccagcgatcccccctctccatctctcgctgctcctccgccagcagccgctgcgacccatctgttcctcgttgtccccgccggcggacgcggcaccctcgccgccggggagcttctctaccatggacgccggcgagcctaggagggcaacggctgaggggaatcggcggccggggaaccgagtgcgaagcgcggtgggacgagcggcacggaggaaggagatggaagcgagcgtgttagggacgacgaccactggtggagaagtgctttttagtcccggttcgtaacccccctatagttccggttttcaaaccgggactaccaatccgggactaaagatcgctatctttagtcccgggtgaaaaaaccgggactaaagatcgatctttagtcccggttgatgacaccaaccgggactagtcccggttggtgtcatcaaccgggactaaagagagggtagcggcagtccatcagctagtccttttttcttttttattttctcccgaatcgagtggtatgcatatcatcaaatcaaaccccaaatccacatcacaactccacagcacgattcacagattcaccacaaattcattcacaatatccattcacatattcattcacaacatcacaaatatattcacaatattgattcaaaggttcattgacaacatcgagtcacatact

SEQ ID NO: 2471 - DNA, 34947 bp, Oryza sativa
  unsure (1)..(34947): unsure at all n locations
ctaaagatatcggggggcctgacaaggcctgacagatttagaaccgggactaaagatcatttttagtcccggttggtaacaccaaccgagactaaagatcaaatatgcccgctgtagccaccaaccgggactaaatatcatctttagtcccggtttttagtggaaccgagactattgtggatttcgggcgaccgaccaaagatggtttctccaccagtggacgcggcgatgggcggggtggcgaccggcacgggggcagtggccaggggcctcgccgggggagcggacgacgacgatgcaggcgtagcccggctagccagctccgagacgaggcgctcaacgaatggtgctacgacagtctcctcatcgagcccccgtggcttggtgctgcgaatcaccttgcgcaggcacgatgggctcgtcggcctcactgcccacgccgccaccgcagcgcggccatgtcacccatcgccgcgagatcgacgagatgatggcaatgacacctcttgccgcatctatggtggtggagagagaggaaggggaaagagaagagaggggagggaggtggggcccatgtgcagttgcggggtaacggggatttttgtcggaaaatatgatggagtggcatggttccaatttctccaattttcagtggtacatagccaatatgctgaatagtagtggcattttttcgaattggcatatttccagtggcatggatctaattaaccctttattttaagatgttttagtggatatagctagcattgcgctatataaaatacaattgtatctataaaaaatggttgagtgtataaatattttaaaataaattttaatctagcccgcgcaatattacatggaaaatctgccttagttcggttaactcaaaagaatgaactgtcttggttaaagtgttccctaacttatagttttgatgaattttgatgaatgtttgcccatgcatgcaggaaaaattccacaattgttgttcactctttcggggctgaaatatgttgaagttattggaaaccagctatctggttctctagaagacatcccttctcctttaacttcatctttgtcatcaattgacttaagcgacaatcaactatcgggcccgatacccaaatcatttttccagcttacaaatcttaattatctcaatcttggatcgaataaattcataggctcggttgaacttagctctgtctggaagctgaagaatcttgatttcttaagcctgtcaaacaatttgatatcactcatagatgatgaaggtgaaacagtgtccccttctcttccaaacattagatacttacacctggcatcttgcaaacttacaaaaattccaggcacactaagatatcttgatgcgatttcggaccttgacctttcaagtaaccaaattaccggggcaataccaaggtggatatgggagaatcgaacgtaccagctcaatagtctgaatctctcgcacaacatgtttactactgtggagcagtctccttctcttgttaatatcgcatatttaacttatcttgacctcagtttcaatagacttcaaggaatcataccaataccagtaaccacatccagtgagatcgcattggactactcaaacaaccacttctcttcaatagtaccgaactttggcatatatcttgaaaacgccagctatattaatttctccaataataaactaagtggcaatgtaccatcttcgatttgtaatgcaagcaaagccattatcacggacttatctggcaacaactacagtggatcagtaccagcatgtcttacaggaagtgtaaacttaagcgtattgaaattgagagacaaccaattccatggggtgttacctaacaatagtagagaggggtgcaatcttcagtcaatagatgtgaatggaaaccaaattgaaggtaaactacctagatcactatcatactgccaagatttggagctcctggatgctggaaataatcagattgttgattcttttccattttggttgggtaaacttccaaatctccgagtccttgtcttaagatccaacaaaataaatggtacaataaggggtcttaaaagtggttaccaaaatagtgattatttcacaaggttgcaaataattgatttggcctccaatcatttatctggcaacatacattcagaatggtttgaacatttgcaatcaatgatgaatgtaactgatgacgaccaaatattagagtatcgtacgaaagcaagtataaaatcgctctatcaggataatacggctgtcacttacaaagggaacactcttatgttcactaaaatcctgaccaccttcaaagcaattgatctctcagacaactcatttggtggtcctattccaaagtcaatgggggaagcttgcttcactacatggatttaacctgtcccacaatgccttcacaggacaaattccatcacagcttagttctttgactcagctggagtcattggatctctcttggaacaagctctcaggggaaatccctctacagttaacctctctaacctctcttgcttcgttgatctttcatacaacaacttgactggaagaataccgcagggcaaccagtttgggtcatttagcagcagctcgtttgaaggcaatgccaacctctgtggaaagccgttgtctaaacaatgtgatactccaggctcaacatctcgaaatgcatcagctacttcagaaaccagcagtttctggcaggacagacttggcgtgatccttttgttcttcttttctggcttggggttcacagtgggcttcatattggcggtctggttccaatcattcttccacatagaacgatggactcacaagcattgatgactgttagtatactgtatacactatgtatggtgtttatccacccaaggacatgatatgtgtgtatgtgtgtactcgtaattagtgacaggtgaagtccattctctgttgataataatgcataattttgtgtatgtgattaccaaaatagtggggtagtggcgacatctataactgtataagaaatgtgctctttgcactgacctatgcgctggcacatttcctcgaacacctggtgccctggtggtggtgatggaagaagagcgcgacgacgaggcaacgagcagaccgacggacagtcggacacgctgttcctgggacatccccatggcgaccccattgagagccgactgcaagatctcaatatctgcaaccctggataccatcatcctctctgcttcgtctccgcctcatcctcacccctgacccctaaccattccggcgaggtccaaccaagaggtggtggttatctcggattgggatgtacggcgtgtggggggagcgggattggcagagtactccgagtgggatgtggtggaggagaaggacgacgaggggtggaaatctctcggcagctggcggcggcggcgtaggcgcgtagttactctaggacggcgcgcgtgttgggcagggggtgtgtagcgggagagagatcgagagagtatgacgcccgcggcgcactaccttcggcttcaaagcagatgcggagatgcatgctagaccgggctcagagcccgtccgttttcagccgctactgccttcgatccgctgtctcacgtcttcaattcgtacgtgtcgccgtcgaattgggatgaagatatagacaaatttgataatgtaccacgtcttagagcaagtttaatagtatgagtctcgctccgatgctttttacttgagtagaaattaatccgtgccgttgatcgtatttaatcgtagggttaagatctaattctactcccactagattttattagagtagaaatgtggagggctatatttgttcagagataataatttgcgtaggggtattatcgtaatctgtcattatctaactgttcaccctctctctatcctatcctaatcgacaccattcctctccattcgccgtcgaagacgaaggcgagcgtgtttatcgtctgcgtgccagcgacgaaccgatcgatttggagacaatcgtcagatatgttgatgagaaaaatgtttactaatctctgaagattaatctgttcttacttatgatgaccatcgtatcggaacgtctttgtggatggtgctgatgacggcggcgtcgctggtgaaaacgccgccgccgaactacatgccagcggcgaggaaggccgtcagtccagcgccgaggacgatggcgagctacagcacgcgggcagtagtcaccgccaccttgtagtgatccgcaaacgcgctggcaagcaaggcctgaggttgattgatcaatttaagcaaagttaattaagcagccatgcatatatcatcggaatgtaggctaagctaggtaggtaggtaggtaggtagctcacctggccagcgacggcgaggccgtcggcgaggagcgatgtggcgagccagacctaggcgcagagctggaacgccgccatggccgtcacgccgtggcgcgtcgccagcgacgccgccagcgtcacgcagaacgtcacggccaccactctcgtccggatattaggagattacttacctgccctttaaaataaacggtctagattaattctattcggagtagaatacttcaagtatattgcaccagagcatctctctaatagtatagccaactactagctccaaatcatctatagtcaatttaatagccaattcatacaatagttacatactacactattaatatctggtcccacctgtcatacacacactgtgtcttggtgtccgtgctacagctggctacaaatctatagcccgctgctcttctctcttctcttttatctccttaaaatatatttatagctgatttatagcctgctactgtacctgctcttactgtcttttgtttttttaccactctaattctctaaaattactcctttgataatatcacccgccatcaggatcgcgattttttttttcaaattttgtgccactttctcgttgagtaggaaggggatgaacccgtcgctcccctttgcctgtcgcacagcacgcgaccaccaccgaggtccgtcgccggcaccagctttatctggccaaaatagtactccatccgtttcaaaatgtttgacacatttgactttttagcacatgtttgaccgtttgttttattaaaataattttgtgaaatatgtaaaactatatgtgtacatgaaagtatatttaacaatgaatcaaatgatataaaatgaataaataattacttaaattttttgaataagacgaatgatcaaacacgtactaaaaagtcaacggtgtcaaacattttgaaatggagggagtattagtaaggcctttacattggctgcggcttcactgttccgttgttgtgtttccatccgtgttccgtaccacgtggagggcatcggtttgtcgattctttttggtggtggggtcggcttctatctgccgtgcagaatatgacgccgtcactactccgtcaaaacaaaccgggtactagtacttttcactccgcgctgcacaacttggaaaaccactgcatccttatctcttgtccccaaatcagagagttcatctgaagttctgctcatctgctactctcctcatcttcctcttggccgcacgcaaccatggttgctctcgcgttgtcggcggccgggctcgccggcttggcgtggtctgcactccgcatactcgtcggcttggtgtagttcaatggtcagtaccaaatgtggaactcccttgctgctggcaactactgtttgctatggtgaagaagtgaagaattgaagatcgaaacttttttcaccatacagctgcattaaggtagttttatttggtaagttcatttttgcaaacacctcttgtgttttgatgcttctaaattattaggatttttttcacatgagccaaacaacatgtttggtgggaaccatatatttgatgctaatacaagagaaagtactagtatgatttgacagcttgaatcgacatgggaattcagattaagatccaaccttacaagttgtaatgtgattggaaattggtaaaggtgctaattaatatgaaaaaaaaggtggggattttaatttaaatgggcaaacatgctatagggatatgtatcaattgtctgtgcagtctcttcatgctgcatcccttgactttgttcagaagttctgaaataaccagatgactgaagtaatgaagcaccttcaacatgatagtagtctggcatttgcatgtgattgtagttagtgggaatctctgaacgaccctgaatctgtataaggcaaataataatcagtagcactaataagagagtctcttttgccaagtgtgtgtgtgtgtgtattttgaatctactgacctgcatcatggtgtatggcagtgatggtgttaccacctctgcttgtactggacactttgatgtgtttgaatcactctttttctttttactccgttgtgttgccttgtcaaaaccaccaattggtctcctcgacccacgaatggctttctccttaacctttatgcctcttgctttactcgggccaacattttcctctgtgcctatgataaaatatttttgagatagctgatttagattataacatagtagtcactagcataagtactattcaactcagagtagcatacaaaccagatttatccaaatctggatcatgccttatactcaagtatttctccacatcttctgctaacttttgtgcattgttggcagccattaagtatgtttcatcagattctgcagctcaagatgctattttaacaaacattctgcacaagtctctcctgcgcgttgataactttattttaggatcttcatgagtactacagttgctctttatatgtagagattttgcatcaatggtccatctttgtagtatgtattgcttatgaatttcttttatattgttaacatcaagtatcttcaatgcatggcaacataggattccgagaaattcaaacttcttgcagctgcacctgactttaccttctgttggagaaaattttacaacatgctcatggtgcttaccgtgaacttttaatttgtacaccatttcagcatcaatatcaccacagtagtataggtcacagttcaatgtttgcaacacttgttcctgaaacactttaaatattgttggagtataaattcttgttgcttgccttaatattgtcaaatctgctttcggccatggtgtactttatgttgtcttaaagtcatttttgacttcctcatatcttttgtctgacaacaacctgtcaaagtgttccaagaaggtaagtatgtcatatttcacactgatatagcccttcaattcattgttcatgctctcacttctctgtgttccactcatatcagtagaaaatgtgtttctcccatacactaatgcccattgctcttttttttttgaaatagcctctcaagccatttgttctcctgcagatcatacttttcaagcattctattccatgcatttataaattcatcttcctcctctttgtcataaatacaattctgaaaatcttcattgaatttcttgtactccttcacaactccagcaaggtgtttgcaggcattctggttcatatgccaaacacaaattctatgatgactttctggcatgactaacttgattgctttggccattgctgcgtcttcatcagtcaatatagtctgtggcttctttccagacatggcttttaaaaatgtcttgaaaagccaaacaaaactatcagcagtttcatcatacaaaagtgcagcaccaaaaacaacgcttttcttatgattatccacaccaacaagcaaaccaaatggacgaccatcatttagttttctatatgttgtgtcaaaacaaagaacatcaccaaaaacttcataatcagcaatcattttagaatcagtccagaaaatatttgttatcaagtcatcctcatcaactagaatggaatagaaaaaattaacatcttccgatgattttttctccatatattccaagactccccctgtgtcaccttcgtttaccttcaatgacctctttgaatataatctattcttcatgtcttcacgagtaaatccaagattctcatatccacccgcttcttttgccattaaatcaatagtagccttattagaaatgcctactgattttgcattttcagcacttgccatctgtgcttcagttattttcctttgagatcttaagtagagggcctgacttccagtagcaagaatgtggttatgctcgtgcaagaattcatatatgcaatacaatccatcatccctaagacttattttcatgcatgctcggcacatacatcgtgtttctggcctactaaaacactgaccgtaatttgaaatttggtcttctcttttatcatgaccacgagtacctattgttaaataaaactaactcagtatatgaattctatatgaacactaaacattgtaaatataagttggaactagtacctgcacgagaacaacaaaatgtccgattctttattatggtggaatctttcacataatggtaactgcttcttcgaatgctaaaacccatgtctcgagcataggcattatagaaatcatatgcctcttgttcactgttgaatttcataccgatgattggtgccttccctttggagggatctgcttgtggagtagcttcaattttactaggatcttgattaatatacccgttttttatctgagacaaattagaaaaaaagaaaaactttcatgaaacttacagaaaaaaaagggctaatagaaaagaagcaaaacttctatgagatttactgatatgatgtgcttgtagtgatcaagtctcaatgattactaataaaagaaagtgaaaacattatgaagtcttaccgtctctaattccccttctaggttaccatgaaagcttgtccctggatgatgcagtacaaacgttccagcagaggcagctggttccgtcggcatggttgtcacttgttcatgcagtgaatcggtgaccttgattgaccttggaagattagatagagaggccattgttgttgcgaagaagatgattgtgatccgataataatgtgccatatgtaaagcttaatctattttctgaaaaactgtctaatggtttggcgtcttaatttttatttggcgcctttgtttccctggagggccacgctaattaggattaatcgctaactgcgtaatctggtgattgacggagagaataatcctgtaatctccgtttatggtggggccacacaaaaagaatcgacaaacggatgccctccacgtggtacgaaacacggatagaaacacaacaacggaacagtgaagccgcagccctttacattggccaggatttccacgcacgtgccgaaagtgtccaaatggcatcgaccgagaccacagggaacaaagccaccggcgaacgactccacgccggagtttgactccctcgctggacacagtctggtcccgtgcagcacgcatgacagtatccagtatttcaacacaacaatctattcgaattatcgagctggaaaactgattagaaaaaaaagaagtacagaaaacgagaatgagacaggaggatagataggccaacgaggatagaagctgctgaactgaggcagtatgaggctggcagcaagtttcattgtcgcttgcatcactgtctatccgtttagagtatagacactctctccacaattccacattatcagggtttgatatttcggactgaaatttcgatcattttgcggacccctccgatacgatattatttgggccaaaattttgatttttttaattttttatgaatttcggtaatatttgttcaaatttgactaaattttgttctaaaatttggaaatttcagaaatttcgttatattggtactgcccgatacaaaggccgaaaacgagaaagtgaaccctgatcatgactcgtgagactaacctgagttgttctctgaattagtccaactgtccaagacaatgaaacttgctgcttctgtgatcactgatcagtcatcagtctgtgtacaatttcctgcgttcataatatataacagaataaggcaggtggaaaaatgctggccatatcaaggcaacaggctggcatggaccgacgaaaacaacactggtaacaggatatgaatgggcatgcaggaatggtgcaaatttatgtccgctcctggagcttttatatgtgtgccgagcaagcatatatacatctgcagtacaattggagcatcaacccaagacagcagcaaaatgatgatatccaccaagcaacgcctcctcactcccattctcattctcctcatttgttgttactccatagtcactgcagccaacaatgacacaaccgtcccttgtctcccagagcaagcttcttccctcctacagctcaaaaattccttcatcaataatgcaaacttatcgtcatggcgagctggatcggactgctgccactgggagggcatcacatgtggtatggcctccggcagggtcatttcccttgacctcagtgagttgaacttgatgagcaatcgtctcgatgctgcactctttaacctcacctctcttacaaaccttaaccttgcttccaattacttttggagagccgaactcccagtatctgggtttgagaggctcacagatatgatccacctcaacttctcacacagcaacttttatggtcagatccccattggacttgcttgcctcatgaaacttgtcactcttgacttttctagtaatgatgggttgtatttcgatgaaccaagtttccaaaccgtcatggcaaacatgagcaacctgagggagctccatcttgatgagatagaaattttcggatcaacttggtcagttgttttagcagacaacattcctcaactcgagattcttagcttgtttgcgtgccgtatatctggtcctattcactcttccttctcaaggcttcgttccttaaaggtgatcaaccttggatacaattttggactccccagcaaagttcctgagttctgtgctgaattatcttctttgagcattcttgaaattgcaggcaattcttttgaagggcagttcccaacaaaaatcttccacctaaaaagtttgagaacgcttgatttgtctcataaccccaatctttctattaacctaccagaattccctgatggaaataatctagaaacactaggtctagcagcaaccaatttatcttatcacataccgtcctcatttgccaatctcaagtccttgaagcgtttgggtatgagcacggcacgaacttccaaggagctgccctctttattagataagcttccttcattgacagaactggaattgcaaggatcggaatcaggcttggagaaggcggtattatcttgggtaggcaaccttaagcagctgactgctttggagcttgtatcgtacgatttctctgaatcggcaccctcctggataggcaatttgacgaatttgaagtttttgtggatctgggactgcaatttctctgggtcaataataccatatcagattggcaatcttgcaaaattggagaccttggactttagagggtgcgagttctttggacagcaaataccaccttggatcggtaattttacgaagttggcaaatttagagatgtatagttgtggcttctatgggtcgataccctcaacaatagggaatctcacccaactggaaagtctgcggatcacatctaatccccaactcaacggtaagtctttatacgacggctacttcttccttcattcatatgcattttattatatcatcatggaataattttattcaaaatgccaccaagagagtgctgtagaacactccaaagcttaagtagtaatatatatatttctgtattttgatttggatcgtgaaacancacatagtagatacatgnatagnctggtagtggtgagcaagtttccacgttctgtttgatanttgtggctcgcatctagatattacatcccacctacagtaaatcaatggcgtctattttcaaaaacttacnacattttcctatctacactanntctaggagcttaganatctattgctactanaatattataatagaatgctaaaaggagtaacatgtttgttttgagagcctagaagttaccatgttaattggtgaaaaaagagaataatgcacacggattaatcggaacgggtccatattatattataacaactagcatggtgcnccgcacaaattgcgcggctagcattcttatattatagtagcatatattttttttcttattttttattaaaatatcataaataacaagataatttaaaattgtactaacttgaataaactatcaatgtgcaatattcatattatgttgtatatatgtgataggtattaattatttttttaataccgaattttagttatttctaaattatattgctagatggactctagactcctcttccaacattctttaattttttttaattatgaatttctataatttataaattgtgttcctatatttttattttaaattcaaatttttagttatttctaaattatactcctatatgaactctagactcctcttccaatatttcatatttttcaattccgaatttccgttatttataaattgtgtttctatatggactgtagactataattataatattgcttttttaaaaaaaatgaacttttcattatttctaatttaatttctatatagactctaaactcatctttcgatattatttattttttaatttcaaatttcagttacttcggaattgtattcctatatggactctagactattgttccaaattttattttctaatttctaattttagttatttgtaaattgtatttccataattactctaaactctacttttaattttattatttttattctgaattttaattaattctaaattcctatatagactttatactcttcttccaatattccttattttaattcctaatttttattatttctaaattttatttctatatagactctaaacttatctttcaatatttcttttttttaattctgaattttaattatttttaaattatatttctatatggactctatattcttctttcaatattcctttttttaaatttcgatttttcgttatttctaaattttattttctatatgaactctaacctctatttttatttttcttattttttaattccgaatttccattaattctattgtatactggttgtatactggtacagaccctagtcttctcgtcctatattccttatttctaattctgaatttcagctatttttaaattgtatttctatatgaactctgtctatttctttctatcctattaatataagaatttttagaccatgagagtgaattttttttatttcaaattttcgttatttctaaattgtatttctatatgaactctaacctctacttttattttttttcttatttttttaattccgaacttccattagttctattgtataatggtatggactctagtcttctcttactacattccttctttttaattctgaatttcagctatttttaaattttatcttctctacttttatttttaaattttattcctgtatggactctttttttcctatttcttcgattaatatgagaatttctaggccataagagcgaatatggagccttcttttttatttatttaataagttaaagggaagatgcttattggtccatggttttattatataaaagggaaaagctaaacgtatgaacaatttgttaccaacttttttacaaacgttgatgtgacacatccactactgcaaaattgatttttggacgagaccccctccaagttgtaggtggaccataactactttcgcctgtaaaaattgctcctttgagtacggttcaagggtcgcatgcaaaaatatattttgcagatgacccttaagaggcctgcctgcaatgttgcaccttaaggggtctcttacgaaaatagattttcgcaagtgagcaacatggagagcaagtgggccacacgcgtcaccgcactacattttttcatatttttttctcctctccactcacgcacactacttattttctcttctctccttggctccacctcccatcactcctctcctactccctctcctcatctctttcccattccctcccttctcttcttcagcgactgagatggaggcgacagtaggctcactcaggtgcgatgttgacgcgcgtgacgacagtgccggcgacagcaaatacagcaacgacctcgagggcagctgatccggtggcgccgccctaggccccgggaggggcgacgacaatggcgggcggtggatccgacagcgccgtcctcgaggggcaacgacgagctcaaagaggatgggaagctagagttttggccgaaattgtttttgtggaacttttatttgttttctccaaaatcattttcgcagcggttggcataggtgaccacgtgaacatcatgtttttgcatgcggttactcaacatgcatgggaaaatgttgattttcgcatatacctaggttcaggcgggccgtctagctgcctgcgaaaattgattttgatcacatgcaaaaaatgattttgtagtagtgatcatggttaaatctttattagtgccttccaagtaactaaatcaaactttgttagtagaattttataaaaaatgttttagtatctctagcaaacaattatatatatagaaccaaaagcaatgcttctttttatcaaatacaatattttaaataaatgttaatgtaaccatgtgcaatattacggaaaatcagcttagtttggttaactcggacgaatgagttgtcttggttcaagtgcgtcctaaggtaccagactgtcagttcagtgaacattcatctttgaactttttgactagtatactgcacttgcatgcagggaaaattccacaatcgttgttcgctcttccgaggctggaaaatgtttaccttcaagaaaaccagctttctggttcactagaagacattccttaccctttaacttcatctctgttatgtattgacttagccaacaatcaactatcaggcccgatacccaactcactttttcatcttacaaatcttaattatctcattcttgaatcaaataaattcacaggcacagttgaacttagctctgtctggaagcagaagaatctatttatcctaagcctgtcaaacaatttgatatcactcatagatgatgaaggttaaacagtgcctccttatcttcctaacatcaagtacttatacctgtcatcttgcaaccttacaaaaattccaggcacattaaaatatcttgatgcggtttcccttcttgacctttcgagtaatcaaataacgggggctataccaaattggatatgggagaattggaagggccaccttaatattttgaacctctcgtgcaacatgttaactactttggaacaatctccttctcttgttaatatgtccaatttagcttatcttgatctcagtttcaatagacttcaaggaagcataccaataccagtaaccacatccagtgagatcgcattggactactcaaacaaccacttctcttcaatagtaccgaactttggcatatatcttgaaaacgccagctatattaatttctccaataataaactaagtggcaatgtaccatcttcgatttgtaatgcaagcaaagccattatcacggacttatctggcaacaactacagtggatcagtaccagcatgtcttacaggaagtgtaaacttaagcgtattgaaattgagagacaaccaattccatggggtgttacctaacaatagtagagaggggtgcaatcttcagtcaatagatgtgaatggaaaccaaattgaaggtaaactacctagatcactatcatactgccaatatttggagctcctggatgctggaaataatcagattgttgattcttttccattttggttgggtaaacttccaaatctccgagtccttgtcttaagatccaacaaactcaatggcacaataaggggtcttaaaggttgtcaccaaaattgtaatcacttcaaaaggttgcaaataattgatttggcctccaaccatttctctggcaacatacatccagaatggtttgagcattttcaatcaatgatggaaaatgacaacgatgagggacacatattagagcataccacaaacacaaaaataccattgctctatcaggatattacggttgtcaattacaaagggggcactcttatgttcactaaaatcctaaccaccttcaaagtaattgatctctcagataactcatttggtggtcctattccaaagtcattggggaagcttgtttcactacgtggacttaacctgtcacacaatgccttcacaggacacattccatcgcagcttaattctctgactcagctggagtcattggatctctcttggaacaaactctcaggggaaatccctcctgagttagcttctctaacttctcttgcttggttgaatctttcgtacaacaacttgaccagaagaataccgcagggtaaccagttcgggtcatttagcaacagctcctttgaaggtaatgtcaacctctgtggaaagccactctctaaacaatgtgatactccaggctcaacatctccaagtgcatcagctccttcaggtaccaacagtttctggcaggacagacttggcgtgatccttttgttcatcttttctggcctggggttcacagtgggcttcatattggcagtctggttcgaatcattgtgccacatagaacgatggaatcgcaaaaaacgatgattgttagtatacactatatgtatggtgtttatccacctacggacatgatatatgtgtatgtgtgtactcgtaattagtgagaatttaaattcattttctgttgataagaatgcagccttctgctttgcatagttttgtatatgtgattatcaggtctagtggcgccatctataagcaatgtgctctttgcgctaacctgtgcggtgggccggtggcgcattctcttgaacacctggtggccctcgtggtgtggtggtggaagaagagggcgatgacgaagcagacggacaggacgggacatcccagtagcgatccattgattgccgactgcaatatctgcttgaaaagtgcaacatctggaaccttggataccatctcaccttcctctccgcccccctcatcctcacccccttacaacctcatgccccattccggcgaggtccaagtggtggcggttatcacggattgggatgtgcgggaccgcctgaggtgggggagaaggacagcgaggggtggaagtctcgccgcagctggtggcggcgccgccgcaggccctccagggcggcatgcgcttcagccttcaggcagggcgtgcaccatgcaggagagggagatcgttccgagctcgccaggaggatggccgggagagatccccgcccttgtgcagacgctgccgcctctgacccgccgctgcacatcttcaatcgccggccgggtcgccgggaaagcagccggaggcgggacatggccgcggccccgtctggtgttcgccgcaacataacaggctttccgtgggcctccaaacatctcggcccgtacatgtcgaagtagttgacctagtaaacggcccactgcctagacagcacatggacacatggatgggccgacaacatcacggcctgttcagagaccgcaccatcggtctatcgcgctcacccgcccagtcacggtctcacggaggcgtagaagtgatcgaagtgttaaatcctagatttcacactgctaattgtatttcttttaatggtagatgtacacgttgacggcaaggcgcatgtaataattttattaatcttaagatataccgatccagtcttccggaggtgtttatagggataggatgagtatgtgcgcgttgtgagcgcttgtgtttgtgctgtgttttttaaaaatgaaaaatggttttgcgactaaactacatgttggtgacgtgacgctggcaaagtatgcacggcagctagctggccagctggtgctatcggatttgtatgtttcgtggtacttctgtgttcatcgtctgaccagggcacggccgcgacaacgacgcatgtacacttgttcacagccagttcaatctctaagtgcgattgacgtctcgcacgattacgatgccaagttgtcaatggcttcgtttcaacaaaaaaacatttgccttgacttgaataatctacctttctggccataggcagatagccagatatgtaggaagtttttaaaaatcgagcttacaaaagggcattttccctaagcataaagtccaatcgaagattgtaaatcttcttgtgctcaaacaaaggatctctgtctgagtcagacagtcataaaattagttgtttcaagcatacaacaatcaaaggcgccaaaatgtgtaccaggcaagctcgacgacggtactacgagacatcgttactcgtactgatgctcctcctcctcctacaagctaggctcgcgcaatcgcttcctccatgctcgccggaccaggccacggcgctgctccagctgaagcggtcgttcaccgtgaacaccgcgtcggccaccgccttccggtcatggcgcgctggcaccgactgctgccactgggcgggcgtccgctgcgacgacgacgacaacgacgccgccgcgagcgggagcaccggccgccgcgccacttccctcgatctcggcggccgcggcctgcagagcggcggccttgacgctgccgtcttcagcctcacgtcgctggggtatctcaacctcggcggcaacgacttcaacgcgtcacggctcccggccgtcgggttcgagcggctcaccgagctgacccatctcaacatctccccacccagcttcacaggccagataccggcaggtataggacgcctcaccaacttggtttctctcgatttatcaactcttttctatgtgatcaatcaagaagacgatcgtgccgatatcatggcaccttcgtttcccaactggggcttctggaaggtagattttctgaggttggttgcaaatcttgacaatctgagggagctctatcttggctttgtgtatatgtccaatggaggggaaggatggtgcaacgctctggttaattccactccaaaagatcaggttctgagcctaccattttgcaagatctcaggtcccatctgtcagtctctcttcagcttgccatatctctgttgttgacttgcaagaaaatgacttgtatgacctgagttcttcgccgatttgtcctcccttggtgttcttcaactctcaagaaacaagttggagggtttatttccagcaaggatcttccagaacagaaaattaacaaccgtagatattagctacaactacgaaatctatggcagttttcccaatttttcacccaatagtagtttgatcaatttgcatctcagtggtaccaagttctctggtcagataccaacctccatttctaatctcacaggtctgaaagagctgggtcttagtgccaatgatttccctacagagctaccatcttctctaggaatgcttaaatccttgaacttattagaggtttctgggcaaggcctagtaggatcaatgccagcttggataacaaatctaacatctctgacagagcttcagttttctaattgtggcttgtctggatcattaccatcttccataggcaatctcagaaatctcaggagactatctttattcaagtgcagtttttctggaaacataccattgcaaatatttaacttgacacaactgcggagcttggaacttccaatcaacaactttgtggggacagtggaacttacctcattctggagactaccatatttatcagaccttgctcttcaaataataaattatctgtggtggacggtttagtcaatgactcagtagtgcgttctcccaaagtagcagaattgagcctagcatcctgcaacatatcaaagtttcccaatgcagtaaagcatcaagatgagctacacgtaattgacctttcaaataaccaaatgcatgggccaatacctcgatgggcatgggaaacttggaaggaattgttcttcttggacctgtcaaataataagtttaccagtataggacacgactctttgctcccctgcttgtacacaagatacatcaatctcagttataacatgtttgaagggcccatacctatacctaaagagaattcagacttggagttagattactcaaataatcggttttcgtatatgccatttgatttaattccttatcttgccggtatactatctctaaaggcctctaggaacaatatctctggagaaatcccatcaacattctgcactgttaagagtcttcaaatccttgacctctcctacaatatcttaaatggttcaattccttcttgcttaatggagaattcttcaacaataaaagtactaaacttgaaggcgaaccaacttaacggagagttgccgcacaatatcaaggaagattgtgcatttgaggcattggatttcagctacaatcgatttgaagggcaactgcccacatcattagttgcttgcaaaaacttggtggtacttgatgttgggaacaatcaaattggaggctctttcccatgttggatgcatcttcttcctaaacttcaagtccttgtcctgaagtccaataagttctacggacagttggggcctactcttaccaaagatgatgactgtgaattacagcatctccgaattcttgatctagcttcaaacaatttctcgggcatattgcctgatgaatggtttaggaaattaaaagctatgatgtcagtctccagtaacgaaatattggtcatgaaagatggagatatgtatggcacatataaccatataacatatctttttactactacggttacatataaaggacttgacttgacatttactaagatcttaaagacctttgtactaattgatgtctcaaacaataggttccatggcagcattcctgaaactattgccacactaagcgtgctcagtggtctcaacatgtcacataatgctcttacaggaccaattcccaaccagcttgctagtctgcatcaacttgagtctttggacctctcttcaaataagctttctggggagatccctcaaaaattagcatccttggacttcctatcaacattgaacctatcaaataatatgctggagggaagaataccagagtcacctcatttcttgacactccacaatagttcatttataagaaatgctggtttgtgtgggcctccactgtcaaacgaatgcagcaacaaatcaacatcttctgaagagaaatctgtagacgttatgctatttctcttcgttggattgggttttggtgttgggttcgctattgcagttgtagtttcatggaaaccttgcattggcaaataatctttgaaggaatccaccctttttttatatttatctgttcaggagtctgccagtctgcttccccttgtaattttagctgtaattgtagctagcatgtatataatactatgtgcatggacaacacttttccatcatgcatgcatcctataagattagttgtttattaccttgaaaattttatacaagccaacaaacaattgttatgtctgaaacaagaaaggaattgaaatgcatgacctgtatgtggcattattagggtcagtttaacttgtagcatagatcagtgagctatatatcatgatcttgtgtttgaagtacatacttacgcagaacttactttgagtaccaaacaaccatactagaacaaaattttctgtgtgaagaactgaagtctgaagatcacataattacgcgttggaatgaaactttctgtgaaaagatcacttgcaatacaattgtaatcagagttatatgctgttattcttactagttgtgtaatactagcccgaatcttgtatgtggaccaaattaggtaaacatataggaactaaaactaaatgatgtcatccgagaacaatgcacaagcaaagcttaaaataaactgaaataagaaaacgaaattcattaataaaaactaaaactacacgattctttattaagtatcagctctacatctatatctaaaactaaaacggcgtcatatatcaggtcgcacattgaactgctagtctcctaataggccaataccacagcagagcaggaaaatcaacaccggaacactaagctgcattcgtaatttggtactagaatcgtagtaattccaaaatgggttcataatattcgagaaatcctagatttcacacactaacctgtgcaatgcagctgatggcagggacattccatcaaacacctggcgtgcagagctcctgagaacatcgccatatggtgaccacattggttggtccaattggttggaatttcggtgtacgggctgcggtggtgggaatgggataggggagttcgccgagtactccaactccaaagtgggatgaagcgtaggagggaacgacaagggaaagggctcgcaagtggtgaccgctcctctctctctctctctctcgggtagttaactcatcatatcttcctatatagttgtacccactaaggagcatttacttgtataaagcaaagcatataagaaaccacatcatcaataattctaagccatcgagttgtattagtacatagttatcagccgttggataaagaagctactcatccatttaatttaatcattgattactcatccagtcacctccatttaactcataatcacgcgtgacattgttatccattttgcgcataatactatgttttcttctcccaagtcatccgagataatgcaaacttatctttttctaatataacttaaattattgtataagatgcgatttttgttttgttataaacaattggataacataaggtaattagacatcattaacataaacctatttttgaaacaagcttgatataaagcaaagaggtgcaggatactctaatagacgacatccagattgtgcatgaaaataactttcgtgcatcataagaaatcacaataacgtttaaaaaaataaaagatgaatggtattgtaatagcataggctatatattaagccacattatcatttattttgtatatatacagagttacatctaatcatttaaaatattgattttatttgacgataaaactagcaaatcccgcggcaagacgtggggtgccaactagttcatcatatgacaaaaccaatgaacatgcaaccaataagtactaaaatgatttcttgggttccgataaaaaaaattaatatagcacatagtgactacaaataaaatgacttcttgggtttcgatcaaaaatttaatatagcacagtgactacaaataggacttagacttttggaaaaaccaaataatgaaataggactttggcttttagaaggagggagtacatcgtaggcgtacagccgtacacggcgaccggctacatcctgtgcatatgtgggtactatgaagtgtcatgtagaacgaaactgctcccgaaataatggaaggagtcgattttcagtcctttttgtttcgggttaaaattattataatctagattattaagtcagataataagctggattataataagggactatcatatatctgttgacagaaaatcccatcttctatctttcgaattttggaccattggatatgctttcagattcgtgcagaacccttaaccataactcctctcctcctcccccgttcagatcgcgccgccaccactcctcatcccgtccctcgcgcgattccccggcaccaccccaccgtacctttgcccgcctcgccgactggccggaaagagtcaacggcgccggcgaggacccctggtgagccctctccccttnccctctcccctctcccctctcccccttctcccctctctttcttctcaacaccgcgacggcgaggatgtgaggtgccccccgcctcgctgtcttccccgtatctggtggctccccgccactagatccgcaaccatcgtccaccgcctcctaaccgcacgcttgcttttcccctgccaccaatgccagcccacggtcatcctccatccccgcggctctggcactgccgccggcgcctcgccgcccgcccgatccgccacccaccgccaggctgccgcctcccacggccctccctctaaagccagtgagctccccctcttctccctccccctcccacccctcccacctccaccacgtcctaggaccctaacccgtagggtcctttgctggagtctagggtgtcgccagcgctggagaagaggaggaggtcaccagagtcagaggagaaggcctggagcacgaatcgcgcagctcatccgatggtccaaaatctgtaagatttggggatatattttttgtcgacagaaggttagcaattccgttataattaactaaagtagaataatctaaaagattgtgagggtatatctgattttgcaattaagtgagataaaataaacttaaattatggaaggagtcggtttccactagttttaaaaggagttttttttagaaatagtacaactttaatggaaaattagagtgaattgcactttgggccatgttttattaccaaagtttcactttggaccaccctgtacgtaatcttttcgctttggactaggtaactttgcctttgttgcacagtgaactaccctaactcttttcgcttgtgatgtctagcgtctctttagacaaaagtatgtcatgcatataggtatgaaagtttgctggcatgccgttaacaatttgctcgaagttatcgaagaaatgaaaatgtgttttggggtggtccattgtgcactagtccaaagtgaaaagattagataaagggtggtacaaagtgaaactttggcaataaaatatggcccaaagtgaaattatctcggaaaattataaaagtaaatgctggttgataaaattacaaatttagcatcttgtcaaacaagcattgttcaataagcatacctgtcaaacaacagcttgggccgttcgacaggttagttagcttgatttacccccctaaactcgaaaatcggacatttgacaccctaaactcttaagaccggacaaattaccaccctaacatggttcgaagcggttttcagcctacgtggcacacacgtggcgatacagtcagcaaagataaataaaaaacaagtgggacccacttgtcagcgtttttttcccttcccttctctggctctctctctcgattcgcagagaagagagcacacggctacggcgaacgtgacgcgctttgccttcggcttcaccaccgaccgccgaactcgcccgcttcatcgccggttgcccgagcttgctctgtgttcgccggcggatgtggttggacggccacgatgccaacgaccaggacgacggaccgttcgccgccttcacctcgtgaacaagagaagcagagaagggaaggggaaaaattgccggctttcccgacgacctctgcctcgccggcccgcatggcgtgttttgtgacgacgacgacgatgatggcaacgcgtcccatgttgtcagcatctcgctcggctacgtctctgacttctctgccaacccgagctgcgcgggcgccctccgcctcagtcaccgccacactcctcacgtccggcctcctcgccgcctccttcccgcgcatatgcagcttcttcgtctacgactgcttcgttggggacgataacacgcgaccgctcccgccgctcaagtggcagctccctcccacgcttcagtccaggacctcgtgctcgtcaataaccccacgctctccggccgcctcgccatctccaccgctagcctcccgctcctccgccgaacgcgaaggcggagggcggagctgggaggcgagtggcggtgcgcatggctaggtcgctccggccggcggcgagcagctaagcatctaggcccccgttgtgaattttggtaattaatgacaagcgctaattgtggactaaccgttatctttgagatattcattgtgagttaggttcacttattatgtacgcatggatgatcaccgaaggattaaaattgacggcgcaaagcgaaggaaaagaagacggtaaaactagtgctttagttttaaattgatcgaggtgtaaggcgatcaaatttgctagtttatctttagcttcgccgtactattaagaggggtaatgacctagcaaagagatgattttaattgccacattaggtcatttgcatgtagacttgtgctcacattttatcacacacacacacacatatgtattcactgtgtctcggcctgaccaggggcggtcagaccggccacatagtggcggtctgaccagagtgccctggccggtctgaccggccccaagtgcgcggtctgaccggtgcataaggccagtctgaccggaggcacttgtgcggtcagaccggccccctggaggccgggatggtgttgctcggggtggccgatacaaagccgacggagtggtattcggtcagaccgagctaacggcggtctgaccgagccgaggccggtctgaccggccactcaacgtcggtctaaccggccaggccgatggggccctctgatagggctacaacagctagttttctagccgttgcagagtagcacggtctgaccggccacatacctccggtcagaccggcggcacacagagttgggggatttcgcccccaacggttagttttggttggtgggagtataaatactccccctccagcatcaagggggctttcttggcacccaattcaattgcatacaccccttgcatctctcatacacccacttgagctttgtgttcttccatctaagtgtttgagggttgttctagccaagagtcaagtgcatttgcttccattgtagagctagtgtggcacttgatcatctccgagccgcgtcattgcttgttactcttggaggttgccgcctcctagacggcttgtgaaggagttgcccggtgacctctccgagaagattgtggaggaggcccggcgccggtttgtgagtggtttggagttcaccaccttcggagtgaaggaagaactaccccgagtgatcgaggcttgggtagtcctctccgtgggccggctcccgccttacccaccccttgacgaagggggcgtgcggtggctttgtggttgagcggtggagttgggctcgcctcaacggggagtaggaaactggcgagtttccgaacctcggtgaaaaatctcttgtctccttgtgtcatttgattgtcgtatttacatttgtgcaattacattcctagagacatacttgagatcatatcaccctaggattgcaaaacattgacataggagtgtaatttactttcctagagaattaattgagccactatcaccataggtttgcaaaacataacctagttgcttagttagacttaaccctcaccgagcctagaaacttaggttagttttgattaagtgtcatttaggttttaaatcgcctattcacccccccctctagtcgacatctcgatcctacagcagcggcgggcgcgacggccgggaagaggaaatcgttggcgcggctgtgtggctccggttgacggcgacgacggttgatggggatgacatggatggacggcgaactcgtcgccgtagcgcaccgcctcngatgccctcctaggcgcctcccaccatgccctccacgatacgcgcgccactcgccgcgccaccccgaggatgattcatcgccggccgcctgcctgagcagagagagagagagagagagagagagtggaaggaagggaggaagcccgtgcatcccgctgactccccgtcggaaccgagaagaggctccgcacctctttccgccgcctccaacaccctcctggcctcctcggcatcgcccgttgcctgccacgtcctccctgcgttctgccgccagcccgcgcgcgccgaccacccgtccgccccagcacgccgccgcccgccgctcatcaccggcccccgcgcaccgactacccgtccgcctccacgcgcctccactcaccgtgctgcacgctctgagcccgagagaggggaaaaggatgaggaagaggggaagataaggtatgataggcgggtcccactattttttaaaaaataaaatgctgactggattgccacgtgtacgccacgtaggacaaaaccgctctagattcggtcgaagggggtaatttgtccggtattgaaagttcagggtgagcaatgtctggttttcgagtttaggggggtaaatcatacaaccgcgatagttcagggaggtaattcgtactttttactttttaaaaaagaaaatagtacatgtgcatgtgcagcctaccgaactccacaacccactcgatgcatgtgcatgcatacacatcccaaattcccaatattttaagcccaatcgaacaatctgttcttcgacagtgtgctaaatttgtaattttagacaaccaatatctaattttacaattttcgttaaatttgtattatttctaaaaaagttcttttaaaagattgtgagggcacatccaattttgcgattaagggagataaaacagacttattccttctcaaataacagtatttccaacggtaaatctaattggagaggcctctccaattagtcttaaccagagacacccacgtgctagtactttaggagttttggttgctattagtatatccaatagtgcatatcttgttttcttcttatagaattttctcttaaactaattatccaatctacaatctgattacaccattactttcgttgcaattaaatatttacaacaagatcttacatgattatattacgatgaaaaatatttatatttataaattacttttattatatacgtaagttacttttatcatatatatataagttacttttatatttgactaaattacttctatacattcataatactctaagttgattatttttattattgtttttagttaattctatattttgtggactttataaatcttctctactttactcgtgaatttactctacatagtttcttatttcagttcactcacaatataattatttctactatagagagttacttcctccgtttcataatgtaagtcattttagcattgcccatattcatatagatgttaatgaatctagacatagttctaaattaaagttactttcttttttgttataaattacttctataatatatgtaaattacttttaagctttactaaatttacttttatatgtctaagaagtaacttagtgaaatctaaaagtaatttagacatatcataaaagtaatttatgatttttcatcaaaatataatcatgtgagatcttgttgtaaagatttaattgttacgaacacaacgatgtaatcggattataaatcgtttgagtaatttaagagaaacttctttaagaagaaaaaatatatagatattgagtgtattagtagctttttttgaaaagaagggtgtctctgtttagtactatccagctagcactctcggtctcagtgtagttgtgtactatttccaaacgtagcacgattagtgtccgaggtgaattggcggatctacggctacgcgacgtgtcacgtgtgcggcactacagccatctgcaaggagcggatatgctctcggattaatctgttttcgtccgtaagtgctacagtttgtgatttgtctgatcatgacaaaggtctacacgcatgtacacctgttcacataatgacacgatcaaaacatgttaagtacgtcccatgtacgatacgactacgatgccaacggcatctttgattgatttgatattagtatatatcaccatcacactatcacaattcacagtcacacaagtcaggcttggagtattgaacaggctctctctagctctacatgtatacaatagtcattcactcattctcactcagccgccacccgccaagatgtcccctcgggtagcccaacgagagaacgagccattgttacttgtactcgtcctcctcatacaaaccttgatcgcgagctcgcttccatgcttgccggaccaggcctacctgaccatcttgcaccgtcttcatctcattttagatctggtctacttcctaactttttcttcaaactttcaactttttcatcatatcaaaactttcatacacacataaactttcaacttttctgtcatatcgtttcaattttaatcaaacttctaattttagcgtgagctaaatacaccctaaagcttagcgtacatggcaggacacgtcctcgaatcttttctgcatcttcgtcaggccaacaaacaagagccacagagaagatgctcctttttccttgacccggagagcaagtttaatagtatagctaactactagctccaattcacctatagtcaatctaatagcttatttatacaatatttatatattacactattaataattggtcccacctgttatgcaaacaccgcgttttgaagtccgtgctacagctggctataaatctgtagcgtgctactcttctctcttcttatttatcttcttaaaatatgtttaaagctaactttgatcctgcaattgtacctgctcggataaattgataatgcggtttaaactttctatgccattgcactctctctgccctaaaatgatcgaccaatgaatttcaacagagacatatccagattcgttgatataggatgaatcatatctcatctaagttaagttattttagggcagagggagtacatctcaagtctaaataatctaagtatagaaaactcatggctacacttattttacgatgaagataactcatggctatacttattttacgatggaggtagtaggtccgtttcgttccagatattcaaacagtctgtacgcaaaaagccattcaacggccgcgacagtacatgggttgaacgttaagcttacgctaccacaccgcgacacgggctcatatttcattttctaaagactagccatgcagtcatcgacaacgacaggactaaaacagaggcgtcatttcacaacagaaaaattcacatgtaaggatcaacggttcaacaccatcttcagaagaaaagaatatgataaaaattaagtttttttatgtaaaataagatgatattaacgtataattaatttaagttttaattattataaacttaaaagatcaactttcatactgaaagttttcgcacaaaacacaccgtttagtagtttaaaaaacgtgccataaaaatcttaatcttcatctaacttttattggagaaaaatgaaggggttccaacactgcatgaacagtgtcattggtttttcttcttgactttaaatgaatgagcttaccttgacttcgcccgccattcccacggagacggagtgaactccacgtccattgatgggttgctttaccagatcgtaggaagcaagatgttatgtaatctcactagccaacatagggtgcgtttagttcacgttaaaattagaagtttgattaaaattgaaatgatgtgacgaaaaagttaaaagtttgtatgtgtaggaaagttttaatatgatagaaaagttaaaagtttgaagaaaaaattgggaactaaatcaggccataggccatagattgtacagaaacaggcctggatgacacgggatgtcaagttttcacacggagaggaatgaaattcgcgatatatatgcatggtcaggagccaggatgtcaagttttcacatgattcagtaagcaagcaccaagtgaactcgcaagatgaactacacgcatagatgcctccacagccacaaactccctcttctcatcctcctcattgccatcgtcgtcatactcatacagccatactccatccatgctgctgccaacagcagcaacaccaccatcagatgcctgacatctcagtcatccgccctcctccagctgaagagctccttccacgacgcgagccgcctctcgtcctggcaaccggacaccgactgctgccgatgggagggcgtcacctgccgcatggcttctgggcatgtcgttgtgctggacctcagtgatggttatcttcagagcaatgggctgcaccctgcactgttcaacctcaccttgctcacaaacctcgccctcagtggcaatgacttcatgggagcacaactcccagattctgggtttgagcggctttcgaaacttgtcagccttgacctctctgcgaccaactttgctggccagatccccattggcattggaaatctgagcaacatgcttgctcttgacttgtctcataaccccaatttgtacctcacggagccaagttttcagaccttcatagcaaacctgagcaatctgagagagctctaccttgatgagatggacctctctagcagcggggcaacttggtcaagcgatgtagcagcttctgctccacagattcagatacttagcttcatgtcatgtggcttgtctggtttcattgatccctccttctcacgactccgttcactgacaatgatcaacgtcagactcaatgtcatcagtggcatggttcctgagttctttgccaacttctctttcttaacaattctggagctatctggcaatgcttttgagggtcagttccccacaaagatcttccaactaaaaaggctgcagtttattgatttatactggaacaataagctttgtgtgcagttgccagaattcctacctggtagtcgtctggaagtgttggatctcatattgaccaaccgttctaacgccataccagcatcagtggtcaatctcaagtatctaaagcatttgggccttacaacagtagaggcttcaatgaattctgatatccttttgatcagagaactccactggctggaagttctccggctctatggaggatcaggacaagggaagctggtgtcgttctcttggataggcagccttaaacatttgacatacctggagcttggcaattacaacttctctggattgatgccctcttcgattatcaatcttacaaatctgacaagtttaacgctctacaattgcagcatgtctgggcccataccttcttggattgggaacttgatccaactcaataatttgaacttcagaaacaacaacctcaatggtgagatccctacaagaatttgaaatctcaatcatagctcaacagtttctaatggtacagtagtacagtacaggtggtaatactgaatagaacctactccttactttaaaaggttattgatgttttagtattttgccgcattgactaggaaatgccctagatcacaagtaacttaaaaattagcttctactccagtgagtccagtccatttgcactgctacttttatttatatttataagagagcctacaaattatagcttgttgactataactagatgtgtatgcaggaacaattccaaagtccatcttcgcacttcctgcgttgcaatcactatatctagattctaatcaactttctggtcatttagaagacatccctgttccattatcttcatctgtgtatgacattgatttaagcaacaattggcttcatggccccattcccaaatcatttttctgtcttccaaatcttgagtatctcaatcttgagtcaaatcacttgaccggcatagtggaacttaggcctttctggagactaagaagcctttattttctgggtttctctaacaataagctgtcggtgattgatggagaagattctccatctcaatatctccctaagattcagcacctaggactagcatgttgcaacctcacaaaacttccaagaattctgagacatctatatgacattcttgagctagacctttcaagtaataagattggtggagttataccaggatggatatgggagatttggaaggacacccttggatcattggacctctcgaacaatgcatttactagcctggagaactctccctctcttgttacatttacacatctaagccatctaaatctcagtttcaatagacttcaaggagaaatacccataccagccatatcattgccttatggtgtagttgtattggattactcaaacaatgggttctcttccatactacgtacatttggtaggtatcttaacaaagtagcctatattaacttgtccaaaaacaaactaaaaggctatgtacccatttccatttgtagtatgaagaaactccaattcctgtacttatctgataacaactttagtggtttcgttccatcttgtctggtagaaggcagaagcttaagggtactgaatttgagggggaataaattcaacgggatgttgcctaagggcattaaagaaggatgtaagcttgagactatagatttgaacagcaaccaaattgaagggaggctgcccagaacactatcaaactgcaaaagtctggaactcctcgatgttagtaacaatcacatcctcgatctgttccctttgtggctggggaatcttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2472 - DNA, 680 bp, Oryza sativa
aagtgagcagtgcaaatattttggttgagtccctcgcgccgccaaggatcctgtgccatctgctccattgcaccgccaccggaaccctctccaccgtgctgcgaacaaggaaatcattgcttgattccgttccttcaaccattacagttcaaatgcaaaattatgaaattagtggatgtgattgtgaatgatagtgtcacgtctcttatgtatgtgcatcccaatatcaatggctattatgcatctcttcgaaagttactgaaatagagagaaattataaaataaaaatgaatatatacttgctgtttaattttcctccctcgcactatagcatacactactcagaaaattgaaaataaaaatgaatgccaagttattgtttcacactgattttagactcaatctatatgtttctctaactcaagtgattattttctggataacctgggagaaaacaatttattatgtgaatgtgtgtgagaaaattattgtctgcatatttttctctaatttagatagcaggcctaatcttttctcaagctaggataaggcctgagtcaggaaatgactgatgatggggcaccatgaaggatttgtcgccatgttcttcctctccgtccacggccgcaagctctccgaccaagtcactggaacccctatttgtagggttgtttaaatga

SEQ ID NO: 2473 - DNA, 419 bp, Oryza sativa
  unsure (1)..(419): unsure at all n locations
gaattcgagctcggtaccccaagtgtttatagagctgaaaaaattagcaagtcataatgatagcatcagatagcagaaatggtctattcaagttgtggtgttctggatagagatgcgcatttgtcttccaaacaaccctggctagctagatgaaggcataagattatgctggtatatgctttctattctcatttgataacatatatattctttggaaatcatggttatcagtgtctgttcagaaaagggcacaccaatacgagcatttcagagcaaccgaggactagaggaggatcttgtagcccatgaatatagcaaagtatgttcctagtcgtcattgcaggtaagctacctcgccagcatcgcctaaagctgccttatttnnnnnnnnnnnnnnnnnnnnnnnnnnnnnnnnnnnn

SEQ ID NO: 2474 - DNA, 2511 bp, Oryza sativa
ctctacttctaatattccttatttttaattccgaatttctattatttcctaattgtatttctatatagactctatactctacttctaatattccttatttttaattctgaatttcatttattcctaattgtatttcaatatggactctactctcctcttctaatattccttattttttaattccgaatttcaactatttctaaattgtatttctatatggactctagtctactcttctaatatttcttattttttaatttcgaatttcagctatttctaaattgtatttctatatggactctgttttttctttttcttcgattaatatgagaatttctaggccatgagagcgaacgtggagactcttttttctattactttaataatataatagatttatatatatatgtattttcaaaaaaaacaaataaatttatttataaaatttacaatggataatagttcattaattatatgctaacgatttatatctttttcgtgcatctaattagctagtcgtctttaagtgcttatacagaacacgccctgagccagcatagtgtggccgatctgctcacgcatgcagtacagctgacagtgaggctgccacgagtgactggcagacagacagctccagaggcttcatctccaagcctgctctgcaatgaaacctcgattattcttctcctccttccctgaccccgtccaactccaacctaccgctttcttattttttccccaaaggttctccaaccaaatggatcgattattgcagcatcagaccagagtctagtagagtacttaacgctgcgaattgccagggatgcagtagctacaaacaaacaatctggttatcgtctggtggccatgattagcatcgctaatcaaaacaaagcatctgagaggggcctaattgatcaggaggagatgagatgagatgagattccttgcccttgtttaagcaggggagagggagcagtgtaggggccacgccgtcgtcgtctccactgtccagtgtccactcgcatcgcatctggctctctggctggcaggttgtgatctggtcgagtactggatttttagccggttttgctttgctcctgtagcttgctcgctgctgcgctgctttcatgtgcgcaccgttgatcgatcggtggagttactgagagagacgagccgtcttggcatcttgcaggcttgcagctatgggcaaatcgtggagaccatgccggtgtaccgcaggagatggctacttgttgccttgtgcccttgttggcaatggcaatacctggctctgtactgggtctgggactcatcagtctatgattagttctcttccaaaagttaaaatcagcaacttgctcgtttttcatttgcacgtatttcgaacagttaaataacgtgttttgtgtaaaagttttgtatacaattttttaaaagatcgatttaaaccatttttaaatataataattaatacttaattaattatacattaatgatttatttcttttcgaattgctctaccaaaaatctaaaatgctatacatggaatctgcgttggacttcattctactgggcattttttttggtaaggcctatttaccggactattaaaaatattttcgccggactgtaaggcctatttatgaatgagttcagttttgggttcggtttgggcttaccgtgtgcactgggcctcaaagttgtctagtccaataatcaagcccttaattatctggccggggttgtacggttcgtgcggcctaattatcctccctgtgcgtgtgccggtgtgccctcacgtccctcacgtgacacgagtacacgacgacggcccgcgcacgagtaacctatatactctctccatactctctccatactcgtaacgtaaaggaagtcgtttagaacagtgacacggtctccaaaatacaactttgacttcttatatctataaaaatatttattgaaaagtgatatatatttttataaaaatattttttaagacaaatctatacatatattttttacactttcaaactcaacaatttaaaagttatttatgatttatattttaaggtttgacttaaacattgttcttgcaccgaaagaaagctttggcgtcagattcgtcatctgttcatctctacgcaacggcgatgacgatggcggagacagacgccgccgacaaattcgtgctcgtcaccgccgccgccgccgccgacgacgacgaaatcacccacgagccgcgggtgcgcgttcttgccggtggctacagcgagaagtccctcaacgcgaactacttcgccgccgccgccgccgtcgcaagtcggcgcgacgcttttgacaacgacgacgaggtggacgatgctgtcgcgaacgccagcgagggatcgggtgatgcagataacgacgaggaggtggagatggtgcttgtggaggatgagcaagggggaggaggtgatcacaggtggcagcagcatgtcgtcggcgtgctctgctccgttgggctca

SEQ ID NO: 2475 - DNA, 2844 bp, Oryza sativa
ccgccagaaaccggcggttgctgtcaacttccgggcatccgccgattacaaggtgcagatgagatcatcataccatgaatcgtcaatgaccgtaacaaaactgcgtgcatttgacaatgtcattcgctagcttttcacgtatttttcccccttttttaccgcaggcggcgaaggttgcggcgaggagagacttgcaagctccggcgccggcggtcatctcatttgggggttgcaagacttgcaacgagggctgccatgccttttcgcaatgagagaaaattcgtcgacttgatgcaatcagagtaaagtcgtattgtaggaagcagagactctttcgagcaagtgtaaccaatcaagtttttgaaattcagttcagaacacagagtactccctccgtgctaaaaaaagacaaagcttggtttccgtatccaacgtttgaccgtccgtctttttcgaaaaaattataaaaaaaattaaaaatataagtcatgcataaagtattaatcatattttatcatctaacaacaatgaaaatattaattataaaaaaatttcatataagacggatagtcaaacgttggcacggaaactcagggtttgtctttttttttttaaggacgaagggagtagctcgcaggcagattatcaatgagctcaaaattagtgacaagactaaatcaaacattgtagccggaggttcttcattaacgattcacttgcaaagtcgctcaagtagcctgcattaaggacaacgaattctttttttttttcgatattggaagttgaaagacgcatcatcacatctccggcctttgcacaaatgcacccggggcacatctgcggcaccaataccccaattaaacaacgatataggagtgctactactttaacaacagttttagcaggtagttcttgattttctttttcgaaagatccatttgatgaaagcacaaacatagtgagatgcagtaacaattgctggaaactgaagcagagaaaaaacttcagctgtcaaacaacaaacatgcaaccaccaactaataacatgttagatcgatcatatccacatcctcctgcgcgagatcatccggagtttgtgagccaagaacaaaacggccgtcgaacaagaagcgacatccatgcttgtacctacttggcatcatactcgagcataaatccatcaagccctgcagcttgtcagtccttcgtagggtgtgtgcgtgctcgatgttcttccccaagcttacgaacccgacggtgacggtcacgaacatgctcgacatccgtttgatctgatcgccgtcctccatctcgcaatccgccggcgtcttctcgccttcgaccgtcttcccgccgtacacgacctgacactcgccgtcgcaatacttatcggcgggaaccatggcgtcgtagaaatcgatcaggtcttgcagcttgtccgtcctgtgcatggtgcgggtgacgctagctgcggccaaccctgcccttcatcttgagggtgacgagcatgcttggcttgctgatcgggacgaacgtgatctcgtcgccgtcctccatgtcgtagctcgtcggcatcagctcgccatcgaccttgcggccacggtacacgaaacatggggtggtacagatcgaacaagacgttcagcttctcgatccgacgcatggtacgcgtgaccgtgcgccctttgctgtccttgacggtgagggtgacaggcaagctcatgactctatcggggaagaagctaacctcgtcgccgtcgtccatgtcgtagtccgccggcgtctcatagccggtcaccctcctgccatagtgcatgaaaacaccaacggggcggcagacatggccttgcgcgacggcggccggcaccaccatggcgaggtagaaatcggtcaggtcgcgcagcttgtccgtcctgcgcatcgtgcgggtgatcctgacgccttcgctgtccttcacccggagggtgacgaggacgctcggctcgacctccggcgacgggctgtccgcctcccccctggtcgccgacgacgacatgcccgatcagtgatctcttcctcgtcggaaatggatggatggggcgctgaggctgggattatatatagaatcatcgatcacctagtgcatggtggatttgtatcgtcgcggcggcgcactgggcgtttcgattgctgttccaccgccactacactacgtgagcagaagcatgtggcgcttgagagcaaggtcaatagaagagctaactgctagctccaaaaaagtttcatgtaattaggagttcacttagagctaactcatacaacgaatggctacaagttaagctgcaagctatccttaattaaatcattgaagtatttaatatttgcatgatcacagtaactagtatgatcaatacaaaccatcatctctgtggccattttggtgtgctgcactgattgaccaagacttcgttgccgcagctgtgtggcgtatgaaacagactcacgggatcggctgggaaagcgtgggccccacaaaacgtgttttctatcgtcaagaacggctgcacgcaggcggtaacgcatagaaagagctgctaacgcccggcgctagaacaagcgctcgctcgcttgtttctctctctcttccattctctgccctaaatctaagattaggatggtgtgagaaattttggagcctacttactcatcctattgtaccctgctctgatatgcatcgtagtgatggcacggcgcgtgattgcgtggaatcgatcgaggagggtggttggccggatcaacaagtttcgtgcgtacgtgacacgcagcagtcgatatgatctctcttgatcacgtttgtttgaacat

SEQ ID NO: 2476 - DNA, 3620 bp, Oryza sativa
cgtcatctattaaaaaacagaggtagtagcatatttgttttctcactatattattcaaatatattaaaataacaatataattttaaattttgcaataactttataaaactaataatgtgtaatattcatattgtattttatatacgtgttagttattaattatttttaataccaaattttagttatttgtaaattataaatattactatatggactctatactcgtcttttaatatttctttttttttaattctgaattttttgtaaattatatttctatatagactctatactcttcttccaatattatttatttttatttctgaatttttattatttctaattgtatttctatgtggactctaaactcatctttcaatattctattacttcctaattgtatttctaacctggactctatactatacttctaatattccttatttttaattctgaatttcagttattttctaattatatttctatatgcactatatactcctcttctaatatttcttatttttaattctgaatttcagttatttcctagttatatttctatatgcactatatactcctcttctaatattccttatttttaattccgaatttcagttatttcctaattgtatttctatatggattctagtctcctcttctaatattccttattttttaattccgaatttcagctatttctaaattatatttctatatggtttctgccttttctttttctccgattaatgtgagaatttctatgccatgagagcgaatgtggaggctcctttttctattcctttaataatataactagctgggtggcccgcgcaattgcgcggctagcacccaaacaaaattatatatattttttatgattttactaaaaatttattaaatagctatctcattgtcttaagagtttgaaagaccaaaccttatcatccccatgtttctaattatatagttttctaaaagtcacaccagatactaccccttatgttatctccttctttatttgcttgctcgatctaccactatttctattcattctccttagaaacttcaaacattggatcttataggttttagagtttattttcacattgagtttcatttttataatttctagacgtcccgtcaaacgttgccattatactcctctatgacccgtctactgtctcttctctttattgtcattgagattttaaaattcgaacataattatcgtttgggttcattttttactttctagaagtcccgccaaaccgtcagtgactttgccattgttcttctctacggctcgcccgctgcctcccttctttattgtcattgagattttaaaatcgaatatgactatcattgttttttttactttttagaagttccgaaacttcaaaaattgaaccttgtagtttatagagtttattgtcttgttgggttttatttttttataatttttagaagtcttgtcaaactatgccactatgctcctctacggcccgtccgccgcctactctttattgtcattgggattctaaaaattgaacataactatcgttggaattcattttttattttctagaagtcccgtcaaccgtcggcagctctgcaactatactcctatacaccccgtccgctgctgctcctttttattatcattgagattttaaaaatcgaatatgattatcaatggggtttattttttttactttctagaagtcccagcaatcgccttgatcgtttgctttacggcctccctgtcgcccctccttttagtcgtcattaggattctatttggtgtttcattaacaatttttttatgtcatatcaaccgccaccactctactcctttatatgcatgttacttaatttatctcgtcatgtattttagatggtcttttatttcaatagtctttatttttatcacaaattttagttatttataaattgtattcctaattggaatcttatttttcttttttctaatttcagatttttttaaaaaaaattaattaatatcgtattatgttcttttaatatttttattttttattttcaatttcagttgtttcaatattgttttcctacttgaaatctcatttactttatctaattttggatattattttattttttattctgaattttaattaatttcgtatcgggttcttatatggattcttctttcaatattgcttatttttaattctgaatttcagctaattttaaattgtatttcaacttgagctcttcttttgttttttttttgctaatttcggattttatttttatttttattcccaattttatttaatctcgtattaggttcttatacggactcttcttttaatattccttatttttaattctgaattttaactattttaaaattgtattcctacttggactatcattttcttttctaattttggattttattttatttttatttcgaattttgattaatctcatattgggttcttatatgaaaacttttttcaatattccttatttttaattccgaatttcagctatttttaaattttatttctacttggactctcttttttttttctaattttagattttattttatttttatttcgaattttaattaatctcgtattgggttcttatatggaaacttccttcaatattgcttatttttaattccgaatttcagctatttttaaattgtttttctacctggactcttcttttcttcttttctttttttccgattaatgtggcaatttctagccccacagcgaacgtgatgcctcttttcaaagctgttttaataatataatagatagataatagatagatagatagatagatagatagatagatagatagatagatagatagatagatagatagatagatagatagatagatattatttcgatgtaagcatagaaacaaaggagtataatgatatataaatggtgcaaaaccgaaacagcaatagaacattgcaaaccagataaccaccgacccttacctaatccaggaaataattgtattacactcggcaataaaagtaactagccccaggcccccagcccataaaaaagtgacagcatgtcccatagaaccaaacgacgaaccctccagcttgagattatccgaccagattagctaaaacgtggatggtatccccaaccctcccgcttgagattatccgaccagatgagctaaaacgtcgatcgtatcaccatccttcagctcgagatcatccggagtttccgagccttgaacacaggccgttgtaaaggaaaatacaaccattttggtacatgcttgcaggctccctgcttaagcataaatccatcagaccctgcagctcgtctgtccttcgcagggtgtatgcgcgcttgactcccaccatggtcaccagattgatcgtcacgaacctgctccgttcggtcgccggagcaaggcggagctggtcgccgtcctccatcccgtaatccgccggcgtcttctcgatgtcgaccttcctgccacagtacgtgacgtcgaattcgccgcgctcatcgtcagtgggcaccatggcgaagtagagatcgatcaagtcctgcagtcgttcttgggtcctgagcatggtgcgg

SEQ ID NO: 2477 - DNA, 6512 bp, Oryza sativa
ccgcgtcgtcctctccggtggccttcgacgacatggctgatcgagatctcttcgacatggtgatggcggatcgggaagctgacatggagtattgggtggaagggttgagtttttgagaaaaatcttggaaatgagatgggattatgtagaatcactatccgatatggtattacttctatatattagtgcgcgcgtgcaaggcggaacgagcttgtgccgtttgctgctgcatgctttcccgtgctctatcttctcctagattgtctccggtttcggttatcacacaacacgcgacggtatgtgcacggtgcaccagtgaaatcggagttgtacattcagaatttttcgggtttgaatttgaaaatacaaacttattagttcgagattacttggatgagacagaagtactggaaaaattacaagcgtcgcatctgcttaacaccaaaatgaaaaaacacttatcatccaaacctagtgtactctggttctccacaaccagtacacaattacaagtccacaactgccaggaacaagctacgacgcgatcatcgacgatggagcaggagcccatccggatcaagcggcgccaccgatcagctcctcgaagaagtcgacctcatcaccgtcctccatgtcgagctccgccggcgtctgccagccgctcagccggcggccgtcgtagaggaaccgacccgtgccgcgctgcacccggccatgcgcgcggtcgtagtagaagtccatcaggccctgcagctgctccgtccaccgcatggtgcggtagacggcgcggccgtcggtgtcctgcaccttcagcgtgacgtactctccggcacgcttggccgccggcgtcttcccgtcgtcctcctcctccaccttcaccgccgccgtgatgccagaccggccgaacatctcgtctccggtgagctagctctaatctgcggttaggtgtacttgcgtagttgtgttgctgttgccatagattgcaccctgcgtgtgcttatatatgatgccagtgtgagcatggtttaattagccatcgatctgtgtaatctcagtgctgaacctttcggttgacgcagtaattgcacggtgatcgaaggggttttaaatggttttacgcatggtgcatggcaatcgagtagtcatgtttaaataaatttaaattaagctcttttttttccctaacaaagagcaccaataaatacttcttggaaaaagatgtgtgttgcattttgattacatttgtgtattgttttttgtgcagtttaaatttaatcgagtactatgcgtgagcatatcttgtttatgtgaagaagtttgtgtggtgtattacttcgattgaatttgaaagttacatacaaattacatgtaagttgtaatgtaattacactactaatttatcatatattcatatttaatttgacaactttttaggagaacatttattgacaaatgtatagatagtcctaaaagaatttgtaatgacgatatccgcacaccacgctagctcatccattttttttgaaatgactcgcaccaaacatgcgaagttaatattgatagagcagtaaaaaaaattacaaaatcacaatcctaggaggacttaaataggaaaatgaagaaaacaccacccacgcactgacaacaccaatatacatactcgggagaaggccaacaccgaaccggccaccgctaggccaacaaaggaactacagccaagatcacccaaaacttaatcctaaaaacccgacaccaagccccactctagcgacctctttagaattgagggtgagagagtagaatggaaccgctctccccctaggccctcagacgtggccaacttgcataagttagggccccgacacaaaaatacattgatggagcgtggggctcctcaccgggagaccgcgcaggcccccctttgccggttcggccgggggcgctaagtgaggttcttcgccctcgatccgaggaacgtcagcgagagaggaagtgcacgagacacgggctacgtagacaggttcgggccgctgagaagcgtaacaccctactcctgtgttctggtggatctgtgtgtgaaggaatacagagaggcggagagcgagagaaagttcaggctctagaaccccttcctccttttctccccttttcctcctctcctaggcctgggcctcctttttatctggtcaggggtcaccacatgggccttcagctgcctaagaaaggaaacatgctttttacaatgagggctagtctacagcaggaagtgacctctgacaagcagagcacacgcctcctgccccgctcgccagctttcccggtggacgcccatttcaaccttcattcaatggccagcgacttccttgccatgctcgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccacgaccggtcacggaccggataagcgtgcgctgcgccgcattaaatgcggcgtggcgcgctcgtccaacccgctataaatgcggttaggtgagccccgctgtgctcacctaacccacacacgtggcgccaaaaccacaaggggtcggggcgccccagccctcggggctgaaacgggagcggcccgacccctcggggagacagagggaggggtggccatgtcaccctcgggcccgacccccccccccccgagggggtcaggccacgtgggtgaccgcggctacccaatcctctagtcacgatacccccggccccgtgtcaccgacatacatgcatctagagagcgagcttgcactagttgtctagagggattcggcaaggggctgactagacgacatctccagggagaagagcggtgaagacgtcgccgccaccatccgtcaaggtctcaaagagaatcgagactgggttttcacttggcagccccacgagaggagatgggatgacacgacaacactctcaagaagggatcggaagagacactcaaacgccattgttgccgggcccggtcaaggctaagctaggttttcacctgccgcccaccgcttgctagtccacagttgatgcacgatgctccaatgctgtcaaagcccctcgtcggttagtctcagcatgcctccagcgctgcatcgccctccgccacctgctgaccgcgcctcctcgtgccacgatggcctccgtcaccaccggtcgcaccttctcgcgccacggcggcctagattgctactagttgctgaatgcgctgatgaagcctagagggggggtgaataggctgtccctgaaaacttaaaaacaaatcgaagcggtaaaattcaaacagacccggaaattcctggtaagaaactccggaacttccggcctcccaggcccggaacttccgatgttctaagacaggaacttccgagtaacagaacagagatgaaaatcaaatttcgaaacaagagactaagccaatcttcacaagatggtgcacaggtattctaagcagaggatatatcacagaatcatccacagaaagagacaagagcgattttttcccgaagttcgaatcttgcgatcctactctccgttgaggagctccaaagagctgggtctcgattaaccccttgcctcacttgtgcaaaaaccccagagaaaatccacagccttcaacaccaaacacccctaggcaaatttctagaattgagtgaccaccaagatccaactcaacctacttctagaaatccaccacaagtgtgggttgctctacttggaaagcctctagaatctcagcacaagaacttcattaacttacctcgttccctttcggaggagaggaaatcattcacaaacttacccgggacatccacaatatgcaacggattctcgcgagtgacacctaaccgtctaggagatcatctccaagagtaataagcaccgagatgacagccacgagatattccaagtgctcacccaagatcctagtcttcacacatctccaaatcttcttctctccctctcaatctctctttctcacaagaattaggctctagattgagtggagaaggtaagaaacacttgggagaggctagcaatagctctaggtttgaaaagtgaaagtggaatggccaaggaacgagctggaaacgagctgtatatgtataacggctaggtgacgtcatctagccgttactcacaaatttgaactggaaactagacaggaagttctggacctggaagaccggaacttccggactacacttaggaaaatctttttcacaagaccggaacttccggacctagaagacaggaagttccggacttgcatttttggacagatggagtatttgcaaaaatgactcctagagaaacttgacacttggttcacactaagagcacttgatatatctcagagcatcacctggaacccctcttaatagtacgatttttcctaaaaactcgatttcaaaagataaactatcctatgcacttctcgagttccggtccgctttgtttttatactttttggggtctccaagcatctatcttccacaccttggactaatgcacctgaaagtcactcaatgaactcattagtctcttaaccacatttgtaattaatcaccaaaacccactagggggattaatgcactttcagttgcatctctcgtgtcatgccggcctccgccacccgccaactgctcctcctcgcgccgcgtcagcctccgtcgccgctggccgtgtcggcctacggccatgcctcctcatccgcgtcacatactcacaccggctccttccccgaccgcgccggccaaccgcagtcgtcgcccacgcctcatgctaaccagccacccatgtttcctgtcgcaaccgcttgtgcctcctagcaccatcactgtcgcccgcatcccctcgccgggctcctccttactcgccgccggtctccttcttccttgcctccatctccagctgcccccgtcgttgacgcaccggcccaccacgtctgctccaccttcttccgtgtgccagtctcgacgccgacgttgttccagctggcctcacgccccgtcacgtatgccgggggcttcaccgccgccaccaccattgaacccctccacagacaacggtcgtcactagccaccatcctgtcatatccggcgatccacgccgctgtcgccgccgcaatcattaagccccgccagatatggtcggaatagcgcggatcttccggccagatctggacggttgccacaattcatcatcccagaacaaccgatacaatgctaatatcgattgctggtgcatacgatgaaagaaaggaaaacactgcacattgttcgttcaaagaaaaagaagaaagaaaacactgcaaattgcaaactacagtagtacgtactagtagcataagagcaagtataatagtgagctataagcatactataagcttaggtgtaggagagaggtagtgaaaaattaaggatgttggctctcatgcaagagctaacttatcacaaggttcaagacaaatacattaaatgtataagtgagagatagagagaggagaagaaaattgtagccaaccttataactaatttattatatatgttggcttttaagatgagctaatagtagaaagttagctatattattatccttgctctaaatatagcaagtcgcaaaggataaacaattaattctaactacgacgatacagaaaccgatcgacatcgagtatttggctggattggagatatatgggcatgggaatggccgaatgggattatgcatagaatcaatatccggtacggtgtttttgtttctacagagattagtgcgcgcgtgcatggcggaacatgcatgtgccgcgtgcaacagtttgctgcatgcgctgctctatcttctctagactagttagcgtgtacgtgccaacatacattgaatggagtaaaagaaatatatccttcgcttaaatcagttgagttaaaagttcttgtacattatgcccaaagaagctacaccattaccactggtggagaaatgctttttagtcccggttcgtaaccgcctgtagtcctggttttctaaccgggactacgaatccgggactaaagatcgctatctttagtcccggttcaaataaccgggactaaaaatcaatctttagtcccggttggtgtaaccaaccgggactaaagatgggatgggagcatctttagtcccggttgataacaccaaccgggactaaagatattttttctttttttttctgcttttaatattgaatattgatttcacaccgtccccttccatatccaaatcatcacatattacataacatctccaaatcctcaaacaaatcatctccaaatacatcacaaactcttaaaaaaattacatcacagggttctaaaaaat

SEQ ID NO: 2478 - DNA, 1540 bp, Oryza sativa
ttttagtcccggttggtaacaacaaccgggactaaagatcttcctcttattaaccgggactaaaaatcatttttagtcccggtttttaatggaaccgggactattgtggatatgggtcgaccgaccaaagatggtttctctaccagtgtagattctctcctaacaatctttattcgaaacgccgagacaatagccaacatcaactttgcatcatggaatacatgacacagccgagatttgtctccctgtagcatccaatcctaatgctatggaatacatttcatcatggaatacattattaaagctcactctcacatgtaccgatgaaaatggaggttctataagtacgtactacctttaataagattactgtgaccttggctcctccaccagtttggttgaataataaaagcatcaacagatagccaatcaatggtaaataaaataatagaatttcttcgaccaccttatagcgcttgttcaaaaccgaaggcaacctaacagatgatctattgctcttcattccgtttatttacagcttgtaagcttgtacacttcctgacggttttttagcatgcctatatggcaacctgcaaacataagacgaaaaagaactgttagtggcacaaaattagatatacttttgattcataaagtttgcaactttgtgttttttacgaagcgtacttttatacatgtaagctttgggatagtggctcaagagcaagaaatgtgcaaatctagaacatgcaaactggattccccaatatgtgctcggcaaatttggaaataacgtaggctaagcagtattcagttcagatagattgttaaattgcgaatccatgcaattaatatttagactaaagaattccgatgtgtatagactaatctgatgtgcatggacaactgcaatacatgatgacgatgcatattttaagaccattccaacattaacttcataaacattacgtttgacaattttcaaactgtacttttagtcaaaagcatgtcatagctcatatttgataaacaaaatggtaaatcacttgtaagcaacaaatcaaatcatgctcgaaccatctacatattatgcttaaaaactcaaagttactttgtataatgcaataaattatcgatgtgctgcaataatttatcaaacacatggtcaattaagaatctttcattgatgaattttaacatctggtgggcagccatttataggaatcatacagtataagaatcaaattccttttgcatggaggctgtaggcatatctataacctattatatactgccaaaagatattggtggcataattttgtaacacacaatacctgatagttccagcaacaaacaaaatgactgtttggtataaacatgcttgctcaataaccatctaataggatagcctatttgatctacatctgaaataggagatggaaaaaggataaaggattactatcctgatgcataagcagaaaaatcaaaagctttataatatgcagagtgacatatctatccattcaatccaagcttctat

SEQ ID NO: 2479 - DNA, 1417 bp, Oryza sativa
  unsure (1)..(1417): unsure at all n locations
nnnnnnnnnnnnnnnnnnnnnnnnnnnnnnnnnnnnnnnnagtagttctccttcatcagcatcaaaatcttctgcctttgatctctctgacctttctcttttcctggtagcgctggctataataacattttttatctcatccgaaacagctcttacttggttttcatcaaggagtcgaccagagagctgctcaattaaaaagaatagtgagcgataaaaaaacccaggcctttcaaaattgaggaacggccaagtatattatcgcagtgtagaaagttgaataaatagattataaaccatcagtgaatatcactcagctatactgcattgatttatcaattcagcaatctttttggtgtaatagtgtcaatgaaaaatgcattcaatgtgcaaaaggtgccagtgtcaacttccaagcaaaatcattctggctttggtataagtccactaacatagcccaatcaatgatgaaaattagtaatctttttgcacagtaatgactgcaataaactttcaacactaatagcaaataagtccaccatgacctttggaaagtgatttgttggatctaactctaatgtggtcttagtttcttccatgtcatatatgaaggtactgcgattatccaactgttcctcgacagaagctaactcttgaaaccactatctattgatggcaattttggaccaaacaatattccaaccaaacaaaattcatggtgaacaaactggtcatacatggttcatccaactgaagatatttcagcttcatccaatagataactaaaaactcaacaagaaaagacaccaggtatacgtttctacagctgaatgatctctctaagatgcataggcagacaacaaacataacccagttagctgtatacaccagtgcactgcctcaatatgctccagaagcattacaatttcatagaaaaataccatcccattcaaataaaaatatgaaaaggagaacaaacctgcatgcactcatttaatgaatcaagcatggatgaacacatctcagtttctggttcctgtatagtaattcaaaagaaaacagctgttagcgttgaatagaaaaaccatccacatgtatagagaagattttgcatagaccttgtgcagcgcttcaacaagagctggaattatgtagtcagataattgtttaacataagattcatcgcgtccttgagccagccccttctcaacagccaattttgcagaacgtagtagttcaggcatagctgcattgttgttggaactatacttttaaaatgcaaatccataaggcaaaagataaaatcatactaaaacatcaaatacctgcaacagcagctctcctcacttcctcatgaaagtaaaatttaaggagtggaaccaatgtaggagcaacctacgtggaatttgaccaccaa

SEQ ID NO: 2480 - DNA, 647 bp, Oryza sativa
  unsure (1)..(647): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgtgttgtcatcaggtatgacataatcgtctctctcatcctcaactatcatgttgtgcaaaataatacatgcatacatgatatcagctagttcatccctttcccaaagccatgctgggtggcgaattatggcccaacgtttttgcaaaaccccaaatgctcgttccacatctttccttgctgattcttggcgttgtgcatacaatttagccttgtcactttgaggtctagtaattgatttggcaaatgcagcccactctggataaatattatcagctaaatagtatcccatgttatattctgtcccattgacagtaaattgaacactaggagctcttccttgtagcactgcagtaaacaatggtgactgatccaacacattgatnnnnnnnnnnnnnnnnnnnnnnnnnnnnnnnnnnnnnnnnnnnnnnnnnnnnnnnnn

SEQ ID NO: 2481 - DNA, 473 bp, Oryza sativa
  unsure (1)..(473): unsure at all n locations
nnnnnnnnnnnnnnnnnnnnnnnnnnnnnnnnnnnnnnatgctgtttttgagccctcaagcatgatggctaagtgtgaccctaggcacgggaaatacatggcttgctgcttgatgtaccgtggtgatgttgttcccaaggacgtcaatgccgcagttgcaaccatcaagacgaagagaactgtccagtttgttgactggtaagctgtcttcatcactattttagttgcgcttattttaatcacaggcaacctatccacttgtttatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2482 - DNA, 1172 bp, Oryza sativa
ctggcataattattcacatgataatgataatgataagagggactatatacctaaaggaaaagtctatacgtactaaattcttactaacactgatgtgtcaggctatgagtcactggtggagaaactgtcactcccggtttgtaaaccccctgtagtcccggttgaccggaactacaaatccaggactaaagatcgctatatttagtcccgcgtgaaataaccgagagtaaatatcaatctttagtgctagggactgaagatcgctatctttagtcccgggtgaaataaccgagagtaaagatcaatctttagtcctactaaagagagggatctttagtcccggttggtgttaccaaccgaaactaaagagaggatagagacagtcccggatggtccccttttttttttgttacttttttattttctcccgaatcggatggcatgcacatcctaaatcaaaccccaaatccccaaatcaaagtaacatcctaaatccacatcacaaatcttaaagttacttatacacacaaatataatacatcacaaatcctaaaaaatttacacataaatcaaatacaacacagattatacatcttaaatctatacaatgaatcacaaaattatacatcttagtgaatcacaaaatatcaaaaaaatataaagagagagaaaacaagctgccggatgccgctactagtgctactactcaagaaatcaatcccacaaccactcaagaaatcaatcctactactcaagaaatcaatcccacaaccgctactactgctacttctcaagaaatcaatcacaaaatatcaatcccactactgctggctgctgctaccgttactactgcgcgcatgtgcttcccttgcaacaatcccacaaccgctactactgctactactcaagaaatcaatcacgaaatatcaatcccactactgccggctaccgctaccattactactgcgcgcatgtgcttcccctgcaacacacgtctgcgccgcacactgcgcgtccgtctaccgcgtccgcgcggcgcggccttctccatctccaggtgagggaagagaaggggaggggaaggaaggaggaatgggaggatctgtgtaagatctatctccaggtgagggaggaggaaggggaggggaaggagaaaggggaggatctgtgta

SEQ ID NO: 2483 - DNA, 2488 bp, Oryza sativa
taatcccaaaatgaagatgtaaaaaaaaaagttcattttgcaactcgcctagatgatccctaaggaatatacttatatacaaggtacaaaatgccatccaatgttgttgctagacaataagaacttcaaggtgagcagtgaaaaggactagatggtgattcagatcctctaccttcaaatgcaccatgcttttgtcactgacaagtgggcccatggtttattgggtccacatgtaagtgacaaaggcacgtacctttgaagatagaggatcctgagcctcgcttccatccaatgctacccctcctgggtaatccgatcaatcacttgcaacgccaaccccgtatcatagctcatggatgaatatcggtttcattttaattgagcacgtgtaaatgcacaatgttatttgagaattcgaagttctgaatatgaagtcgtgggtcacaattcctgacttttctttcattgagatctgaagctaagcactagttcagtacataatccggttaacgaacagctcctgaatgtaagtttaacatactgaaattcaagtgcctgaagttaagtcctcaaggtttgagtattgccctaagtacggaaactacaatgacagcagttgcattgactgtaggagtactctagtcaaactttttaacttctgtcaagtgcctgaagttaagttatcaagatacgaacggtgaaaacggtatggaaattttccgaccataccgataccgtttccgcaaaactaatataataataatacttttacgatggttactgtttctaaatttagttttttttaaatttctgttagcgtggcattgaagttgacacttaataaatgaatttataaatatggaaattttccaaccatttccgttcgtttttgaaaaaacaataaaataatgatattgtttccgatcatttccgaccgttttcatccctagatatgatgttgttgtccatgtgaattttggcaatgtcctgaaatctgatattgccttctgaaaactgaaattcttaatttattttttaaactcaagtgcaaatggtttttagaactcagttctgatttaagttctgaaatcagtcttagtatattgtcaaaaacaatttttcgagctttagcactagtgcttgttctgaatttttgaactttaattctgaaatttgaaaatgcggtagtgcttgttccaaaatctcaaatctgaagttgtacttgtgtttgttctgaaaaattgaactttagttctctgataatatagtagtgcttgttctgaaatctaaaatctgaagttgtacttgtttgttttgaaattttaaactttagttctgaaatctaaaaatgcagtagtgcttgttctgaaatctcaaatctgaagttgtacttgtgtttgttctacaatttgataatacagtagtagggcttgttctgaaatccaaaatctgaagttgtacttgtgtttgttctgaaattttaaactttagctttgaaatacgaaaatgtagtaatacttgttccgaaatctaaaatcttaagttgtaattgtgtttgctctgaaatgttaaactttagcttttaagtctgaaaaatatagtagtgcttgttctgaaatctaaaacctgaagttatacttgtgtttgttctgaaatctgaaaatgtagtagtgcactactagtgcttagctcttgaacagcacagtaccgagaagcttgtagcctgtgggccgggtcgagtgagtcgtgcattcgtgtcgtggcttggctgacccgcagctgcttgacccggagcagcatgcacgctgtgaagagacacgaatgtccactccctttgcccatggacgaggcagcagctgaacacaagatggaatcttgaccactgttcgcgctggcacttggcaaatcccccctgaacccaattccctgtcggttttctcccacagccagtgaaaccaacagcatcgacgcctctatggaaccaagagccttgcaacctttctcttccttttggtcatttccataaagtaaaacgcattaccgcacaaatacacaatctcactgcgaccatcacggatacacgcagtgctcagttcagtatagctcacgcatttagttgcctcaccaaaagcgtccaaaattccttgtgcccccgatggagaaaaagcagccaagccttgttcgctttcgcttcgcctcatctgcttgttcctctcctcgtgtcgtgtgatcgtgcccacactctcctcactgccactgcacacgccgctctcctctctagctttcctttttggagctctcttcttgtcaccacttccacccgtgttgcctttcaaaaatctctttactttccccgcgcatttcttcttctccttctcctcctcacctctgctataaaaactcactcactcgaatactggatcaatcaaccactgctctctctcaaacagcagctgccaacgatggcagattcccaccattgctgctg

SEQ ID NO: 2484 - DNA, 17635 bp, Oryza sativa
tatcagtagcgcagtacccagtacccagtagcctttatcttcctgatatcagatttggaaagagcgaaatctgcaagcgttcagacaaaaaaaagaaaaaaaaagaaaagaaaaggagaaacactcaggggtcttccagctggggtcttccagctggctttacaagatggtgggctaaacaacctgggttcgagtcattccctaatgttcgcgtcaaaaaaagaaaacctatcggcaacaagtctgatctcaaagatcaaagaagagtcaaatattcagatacgtcatgatctgataactaacctactcctatatcattccgtccgaatgacatttcattatatagcatccccaaaaagaaaaactaacaggcaatgacttgagagttttccttctagcagcccaagtttgggttgagaaccatttgatttggtagtggcccggcccatagctttgcaggtctcactctgctgggttcactgggctgtgcgcctactaagcaaggtttagaaaccagaacatactagtaatttgtccgtgctaacgctacggctatatttaataatacaaatctaatatatgatttcagacaataaaaagaatggtttaatatattaataattatatagccatgtataaatgcatgtttcccacaatatatattgcttgctaacatttgcaaactctatacacaatgcaatccatttgcatgtatagaagaataaataatcaagcttcattgaaattgccattcaaacaggaaacgaaacaaaagtaaacactttagcatcactcatcttgctggtgttgatgcttccgacaactgcatcacatcgctgaactctgaacaaagcagaatctaaagcatgcatttgcagcaaagatggcaattacccagggcctcttctatccagggtcttcctgagttcatccatcatgctcgtcccgttggtgttgacgattctgacagctgcatcacactaaagacaatgttaggtgcaaactaatgtgcaaagctacggatgaatcatggtcatctccagctagctttatgtcaggtggtcagatgcagcgtttatatgcagcggctatcaaatatcaaatatgtacaatacagaaagcaatgcaaacttgggtttatatgcagttggttcatttaaaatctgccgccatcgaattgttgcccttggaaatgattatatgctactgaaggagaacatggaagcaactcatttaaacaaccctacaaataggggttccagtgacttggtcggagagcttgcggccgtggaccgagaggaagaacatggcgacaaatccttcatggtgccccatcatcagtcatttcctgactcaggccttatcctagcttgagaaaagattaggcctgctatctaaattagagaaaaatatgcagacaataattttctcacacacattcacataataaattgttttctcccaggttatccagaaaataatcacttgagttagagaaacatatagattgagtctaaaatcagtgtgaaacaataacttggcattcatttttattttcaattttctgagtagtgtatgctatagtgcgagggaggaaaattaaacagcaagtatatattcatttttattttataatttctctctatttcagtaactttcgaagagatgcataatagccattgatattgggatgcacatacataagagacgtgacactatcattcacaatcacatccactaatttcataattttgcatttgaactgtaatggttgaaggaacggaatcaagcaatgatttccttgttcgcagcacggtggagagggttccggtggcggtgcaatggagcagatggcacaggatccttggcggcgcgagggactcaaccaaaatatttgcactgctcacttttatcaattgagaagaacatgccttgcaaaatgcttttaaatgataaagccaatgagtgttccctgttaaatagaatgttccacttaattagagaagatgttatttctcagaatcaaagcagcactatatgttgaaccaaaataattgtagtatgaaaagatgagaactaaattcatgtgccaatcctgaccactatccaaagatgatcaactgttgtaatttttattggtgcaaacaaatatattgtcaaccttcatcataaaattaacaggtcagcatatgtatatctagcattttaagtggtttatttacctctaattcaaacacgtaacatcccttggctctttcttttcccttcagattatcatcatggtatagtccagcagctacaacccttcatgcgcactgcatagaggaaacttgttgcctatataagcatggtaagaaaaagaaaatgaattcgcaagctacaaccaattggaactggtacattcagaccaaataaaccagcaatgcgtaacattgtttcacaaaccaatcagttgttcatgtcatgatatgaaacaagtcatcattcatcttcaaaatactgtaccgactgctcaaataaccacatgaatatatttcttctctctaaaagaactcattgttttcttcaagtgacaacaacagcaactcagatagagtatttttgcaagtgtttcgggttactcatttataaatatacttctgcattgcacaacacataatataatatatttaaaaagaggtggtaaaatcattaatatattaaaaaggaagtgagaacttgttaatataaaggaatcagttagggcatgtttagttcgtgaaatgaaaatttttgagtgtcacatcggttgtttgaccggatgtcggaaggagttttcggacacgaatgaaaaaactaatttcataactcgcatggaaaccgtgagacgaatcttttgagcctaattaatccgtcattagcacctgtgggttactgtagcacttatggctaatcataaactaattagactcaaaagattcgtctcacgatttcccccttaactgtgcaattagtttttcttttaatctatatttaatactacatacatgcgtacaaagattcgatgtgatgcttttggaaaaacttttagggaattaaacggggccttactattctcgagcatctcctttaccaaatgagcacatagtacttttgaatgttgattcacattacctacaccatagagatgagagccccatgcgtcaaataggctgagcctgtcaaactgccaccgtcagtgcgtccacgtctgctcctgtatggatggctcagcgtccctgtgtggacgtccggcgcagccacaagtggctggacaatgccggcactaccgacggccaacggcagagggcttcttcttcagtgtcggcttgggctcccagtggatgcatcggtcggctgaacttgtcagaccaccaccatcgcacgccgactaaatcatttgcgctcgtgccaggggccgacaactgcaacacgactactcccccttcttcccggccgacgcgatatgcggcggagtggggggataggccacggcactcgcagcgaaccggagccggagaggcgggtggtacgtaagaggatagcgatctagcgacagaggagacagcggacgcgaggtcgtgggttctcggagaagaccggcgaggcaggggacgaggcggagattggtggcgacgctggcgacaaggaccacgccgggtcgtgcctatgcggcttgggggcgacaatgacccaggcgactccagatcggtggcggcgcgatggtgacggttaggggaatcggcggccggcaaggttggaaaggaagacagccggcgatggtgaggggagtgatgggtgcggcggttagggccgggatgcgcggaggggatgggtgcgatggccggtaggggagcgagcgtgatttgggggtgcgggaggggcgcgctcttgggggagcgacggagggggtgcgagcgtcgtggggccgttggattcaatgcagataaatatgagctgttggatctgtaaggcgtaagaatgttagagtgtaagatgagagatgagtaaaatgggttggtgaattatagggtagatgccacgagcctacgaggaagacgggaaaattcagaagaggcgatgacccgacggaaaagcagcgctggctgtggttcaatgaaccatccacggttccacgccagtacgccacacgttgcctacttgcctgtacggtacggtcaattgcagtgaacctgacccattcggctagcttcaaagaaccacattagaagttaccatcaatcttcagagttcagctacatcacgccagtactaggctcttcagaaattttaccgagaaacagaacacactgcaattcccgggcaggtcggccagccgccccggttctgccgctgccatcttcattgcggttagccgtcgacacgtataaaaatcacttgtcactgaaaaacgttactggtcgcccgtgctttacggcggtactagctcgcaattgcatacagctgcaaaactctcgagcatttaactgtactcgtgaaagatgaggagtctgaatctttgtttggccttttgcatggccatatctgcaacaacagttcctttttttactgtgcacgatgcattaagcctagagaacagttaggctaagtaaaaaaaaatcaacgaagttaaactgtgtttaccatggaatcgtacagttggtagccggtacagctgcgctaccactaagacaactcatatgtggaccactactcaacaagatgcacatgggcaaacatgcttcaatgatttcggcctttggatccatcaccgaatcacgaacatctctccaggccagcattacgatttaacagctcgcagtttgaaactttgaatgcaataatttgcgtccagccttactgccactcgctactctttggtcattcagaacacaaattggagcgctatgaccacaaattggagttctttggtcattcagagcacaaattggagcactgaacattgtatgctactgttttttttaatcgtaactacgaggtaattacaatcttgaagatgattgtactaccctgtcgttcatttaacatagcacagtttggagtggtgaacgtttgtgcaggagagattttatatttatggtctgaattgttaatctctcgttagttcccgtatgatatattttaaacgataggccaatagatgacaatcaacatcatacaagtgtcaccatgtagtacgcgatactcatgttctttaaactgaaaagaatcaaataaatcatctcaattcatacaaataaaaaaaaaagaagagtaagtacatggccgccgccacagagaaatggcgcgaaaccacaccctccctccctcacaccaccgccgactcattaattacatacacaaatcccccccacgcgacgaccacacgacgacggagacacgcacacgacgacgacgaaacggatcagcccgaggcagatcgaaggggatcgatctagcagaagaggtagccgaacgcggcggctgcgagggaggcggccgcgaggggcaccgcgggggcggcgtcggagacgggcgccggtgccggcgcgtggtcggctgccgctgacgcgacgagggacgcggcgatggcggcgaccgcgagcgccttcatcctgagaccggccattgtcttcggaactcggaagaggattagggcttcgacttctagatctttctggcgagaagcagagagatgggtagtagtagtaggaggcggcttgtggggaggtggaggtggaggaggaggcgggggtttatataggcgggcaggttagggtaggtcgtacgcgtaggggtgatggggtcgggttggcgggggagaccgacggggagaggcgcacggcgcacggctggccgtttgttgggttccgcgggtttggtggtggggcgttgcggttgccgacttgccggttgggatcctctctggccaatgcacgcgcgtctcgcatagtcgtcgtatgctctgctcgctcgcgtgaacggtggccaagtttgtggtggtcttcttttttccaggcttttgtagtagctgttcatcatcaatgtgcaccacgagtgcacatgcttcgttctttgctgtcgatgtgaatcttgttttttttgagttagagaatactgttcacagtccattgagaggtgagaactatagtttcttttagacacgttgactataacggacgcttaagcaacggtaacatgacaactagcaaaggcctttttttaacccttttagaagtctttgcaatactataacgtagaaatcatttggctaacaaaaaagaaatcacgtgttgatttactgtctcctttttttcctagtggaataatcaacaaacacacattctttatcgaacttctaaatggtatttttaaaaaaaactatatatgaattctttaaaaaaatgttttacattcttttctttcaacttttataatagttaatgcattaagttttttttaatcttcaaacaattatctcaaattattcatgtatttaaccattccgcataaaaagagcgcgataagggcttattttatcgtttgctcttcatcttgtcattccaatcatattttgaattttaaaattgatttttaagtttttcatggtattttatttttcaacattgatttctatgtcattaagaacatatgtacaacataatataagtgattttggatgatgtaatatatcacagtataataaactaacatggtggcctgcgcagattgcgcggctagcatcattatattttctatcatataatagtatatatattttctcattatattatttaaatatattaaaatgacaacataattttaaattttgcaataactttacaaaactactaatgtgtaatattcatattgtattttatatacttgttagttattaattatttttaatatcaaattttagttatttgtaaattatatatattcatatatagactctatactcgtcttttaatatattattttaattccgaattttctgtaaattgtatttctatatagactctatgatcttcttccaatattatttatttttatttctaaatttttattatttctaattgtatttctatgtggactctaaactcatctttcaatattctttaatttttaatttcgaatttcagttacgtctaaattgtattcctatattgactttaaactcttcttcccatatttttcttaatttcgaattttagttatttgtaaattgtatttttatacggactctaaactctacttttaatttcattatgtttattccaaattttagttagttttaaattcctatatggactctatactctacttctaatattccttatttttttaatttcgaatttatttttttcttaattgtatttctatatggactctatactttacttctaatattccttatttttaattctgaatttcaattatttcctaattgtatttctatatggactatactctacttctaatatttcttatttttaattccgaatttcagttattttctaattatatagttatttcctaattatatttctacatggactctatactctacttctaatattccttattttttaattccgaatttcagttatttcctaattatatttctatatggactctagtctcatcttctaatattccttattttttaattccgaatttcagttatttataaattgtatttttatatggactctagtctcctcttctaatattccttattttttgattccgaatttcagctatttctaaattgtatttctatatagactctgttttttctttttctccgattaatgtgagaatttctaggccgtgagagcgaacgtggaggctcctttttctattcctttaataatataatagatttagataaaccgtttgtccaaattctctgtactagaatgcgtcacatctatccaaaatcctttatattagggacggatggagtaatagtcattacaactttttatttgagagaaacatgcattacaacttataatcaactgtagcggaacaatgagactatacacaacaaagaagcaaaacccagctcaggttgcacgaagatggattcagaagatcaagagtgaaggggggcaaggactcatgggggaagaaggccagcctagtgggaacagctggcgtgacagttgccaaatggccccccacgaaattagctgtcaaagctaaattcagcaatgcggccggccatccttccttccttccttctcttttgtccattcccccattcccctccccctctgaaaattccaagaaggccaacgattttttgctttgctgcgatcgcgacactctcgtgtagtacattcaccagtagttcgcgcatggaattcagagtgaaatccgggtctaaatttgatttaaccctgattgcaacgtgctaacgaacggacggacgcgtcgaaaaactacaaaatagacgtcagttttttctacgagcagagcggaataatatcctaccagaccaccagcacaacacaatgccgtcctccaactccaagatttcgatccctctggaaggtcgtggacgaagaacaattcaattcttcggaagcaaaaagtctgcggcaaccattacgaacacgcgttaggttcgtcgtataagtaccactcctgctgccgtccagttgcaattgcgttttctcctttattactcctatttttctctctttgtccgttgcttttgcggcgtggggtgacgcggggtacgcgcgtggttaaccgcctttgcatttcctccttcgactggacgcacgccgaggccgtgaccgtgaccggcgccagatggagggaggggaaggggaagctcgtgggagtcgtagtgattctgtgcttgggttggatgttgggggttgaacgaaccgtagaaagtggtagaacgcgttgccattttggacattgccaatgcaacacgaatgatcggtcgttgtggaatactacgcatttttggttaggaaaacacggtacgatgtcagatgctcgtctagtcgtgtgatactgggattaggcaagttgtgcattgcaatttgtacgttgccaacacgagtgatcggtcgctgtggaatacgcattttggttaggaaaacatgtcagaaactcggtatacccgattttgcggttgagtgacagtcatgagaaagagacgaggaggtaaaatagacttgttattttgcagtgtacaaatactcaatcagttgcatacttgcaatgggctaatggtcaccagcccattcatcctcgtatcactgggttattaggcctgccaagttgacagatgccaaggctggctatttgggccatttcgtccacccggcgcccgcagccgcaagcgcatcgccaacgccgtgccgtggccgagccaccaccaagcggcaaccagacgaggcttcaccggcaccgcatcgcttcactccgctctcacagtctcacgcacgcacgccagcaggcggcacgcaacgcctcgcttcacggcctcggctagagagacgcgtgcacgcgaacgcagatgaagcccttgctgctcacgccggccgcgcggctcgcggccgcggcgccgtcaacgctctcgcggctgctccgcctacaaagcggtcgccaccatgcgcacgcctcctcctcctccaaccgcctattgccccctctcctccgtcctcctcgcgacggtttccgcggcggccgcctcatcgcctcctcctcctcctcctcctttcaggtctggcttgcgcgccccagctcttgtttggcctgtcttgtgggggtggttgcggaccaggtgttcgacggaatgcccccgaggtgaatatggctgtgactctggctgatgccgctttttccctgcgttgcagatggcggcgcctgccgatgcaccgggcggatccgcggacgcgttcgaggtgatccgcgctcaccaggtgcggcccttagcatcgtgatcgcccttttattccttggacacctcactccttgtttgtgatgtccccgaggagcgaggaacctaaccaggcagtagcttatgcaactaggggtgaaaacgattggaaacggttggaatcgctagcatctcttcggaaacgatgcttgatcggccggtaattgaccatatttatcatttaaactacacagtatcgacattaatatgatgcagaaagaaattaggaaaaaataaaatttaaaaatagccaaaaacggtacggtcggaaacagtacccttaaacggaaacggcgcccggtcgatcggtaatttctgtgaccgttttcacccctatatgcaacatacaaaaaacacaaattgacttgttctgggtcagtagtgtcccggagattccacaaatttaggacaacgtgcctggtaaatgtacaaatgtaatacagtcagtttctttttaagaagtcaaacgtcaaatatattcccaggaaggattagttatggtattgtgaaacagggttggaggctgtctgctactctgctgtgtgtgaatgtttcaacaaattaatgttgcaacaagtaggcatcgcatcaataattaacaattacatgaagaagtttccataacaagaattagacctacagagaaccaattgtttactagccacaacaccaccaactgagcttttgcaaacctttcccttgtcaattcctgcaagagtctgagcaatcaacttgcggaacaagtgtggaactgtcagaagggaaaccttcaacttcaatgatctatcttttagtttttatcattatcatttctcgatggtccatactcaaacaagatttttgttatcgtaggaaaaagctgctcgacttcctccggttgaagaaatacggaccattctggaccaaagtgttaggggtgtccttgccacccattctcaggtattctgtagactaatgagtagtggttgtattgccatgtacagggcaatcctcaagagcatggaataacatgctattttgttacagggtcatgttggctatccgtctggttcaatggttgattttgcatgtgatcaggatggttcccccatattagcagttagtagtttagcaattcactcaaaggtaagatataattcgcttttatgatcttgaatacatgataaaactatatactcactgtttcccatgcatggatatccctgtacatacacacaataacgctattactacattggcatagatgtttggacatgcaaagtaaataactaaatatgcatacagatgtaaaatgcatgaccactagcagtgatatgaaaatagtactgcaactctacattcaccaccagtccagctggaaaatttttcattgtcatgtttttcctttgatgcaagcttcttggattctgatacttttttttttttttgcagaatctctctgaaaatcctaaatgctcgcttctggttgccaaagaccctgaggacagaacagatactgtgattactgtatatggtgatgccacacctgtaatgctccagatactggcctgcctatacccttgattcttttctgtatgacactttcctatatcatattgttcatgttacgtaacaaatatagatctgttggtctttgtattatgtttgaaaggtttcagaccaagaaaaagatgcagtacgaagtgcatacttacgaagacatcctgaggcattttgggtatgctatgtggacaattttattattttggaagcacatgttgttttatgaagtactgatttctgatgaaaaaaaatgccaaataaggttgattttggtgacttccgttttctgcacatcaagccaaaagccgtgcgatatgtgtctggggttgcaactgccatccttggttctggaggtatgttgccttcttcattgccctagttgagccactgtttgaaaagtgaaggttatcctttataagaaccaggtttcagggttcgatatctaatcaaccttttatttgctcatttatttgtgaatgctgagtagccatgctcctctattgtgtttccacttctagtatttgtacaagaatagaaaccatgacaaatggtttgatgataatggtgcctgattttaatgctattgtgaaacatccccagaattcagtgctgttgagttcaaggaggcaaaagtggacccaatatctcaattctcaacccctattacggtgtgtccacattctgtttcctttttccatcaataaggggcatcaccgtagatatgccaatcgttagtgtaattatgttaaattttaattccatgcagagccacatgaataaggatcattctgatgatacaaagcttattgtgcaatactcaaccactgtcaaggcaagtaaacaagaaaatttatgtacagtttttagtcgcaaatgttatttggcataaaattttaggcaaatcacatttgctgagctattgttccgcaactaactatttaagttattactgaatggcatgtattcagtcatcttggtgtgtttagtttgggaaaaggaaaacactcttgggttcaaacatactgttgctgttttttttagggaagacctactccgtaactgagaaaccatggctagctgatgtaggatggattcacaagagtgctgtctataacctcacccagaagttcctcaagttaagcgcgacctgatgacctgatgtcctgaacccacacgaccacaccctatcacctatcctggtgttgcgcaatgatcagatttagcaatgcatagccacacaactagatgctctcaatttttcatgggaatggaagccagggaggcgttgagagttgagggggttgattacccagttctgtagtttgggtccaacaaatttataccatttattttgtagcctagctgatatttttgtgtatccagtttagtgttagcaacaagaactataattctatagcatgcacatgatgtgcacacttttgccagcaaggcctgtaaacatcactttgccagtactcttgaaccatatccagatcacaatagtgtggagtagtggaacaggagcctgtcttattttcccccccaaaacacacctatttatgctttatgttactcttatctgttgtctttttagtttatacactattataccttatatattagacagaatgttctttttttttctatgtactgtgttgaaaaagataaaccatctcaggtggactttgcttacatgcttgatgtggatagtcttggtttcaatgtgaaggtaactctttaaattccttgtcctactcttatactatatgaaattacatagatgttatgctggaatgctgcaagcctgcaaccaaagaaccaaatatatgaaatactgatgttacatttgatacaatgataacaatgcttcaacgacgaacaatcaacaaagcaataagatttagaacttgataagattctgaaagcaaaggttatgcttcctgaatcctgatagcattacagtttaaggaaagaatacctatagataccttgaattttggagcccctcattggctttataacgacacacttagttctatacatctttgaacatatctcgttgaaccttaatgtgctgcagtgtccactcaatcaaaagccaaccctgaacttctaatataagcttttgcatttgtccaggcgggctatgatggaagtgttctgaagctgcgtatccccttccctaggcgtgcacaggacaggaagtgagtccccgcagtcctgcactgcgttctcttaagccttttatctaaacgtccgaatgatactttataattaatgtctatgatatgattatttcaaatatagatatcttgagactgactacattgttttttctgttcttttatagggatgttaagacacttattgtggaaatgctccaagctgcaaaagcctcatcgtcttctgctgaatgaatgtcctgttctagaaagggacgtctttgtccttgtaaatgaaataaagatgtccttttcgatgagttttttctgatctaggaaatgtcatgtttttacacatgatatatcacaatgccacagcttaacaccgaacagatgccaatctacttgtatattatttacactgaaacgctccaccgtgtgtacatttcttacttgtcttaagtcttattggaactttggaagtctgcagatgcagctaccatcatctctcataaatgctagcgaaatgtgtttttgggatagcatttcagcaaaactactttttgaacatggccaaatgtccattttctcgagtttgagtgattgctgccttgctggatctctactgctctactcacccacatcgctcctcccatcacggaattgttgctttgttgcttgctggtattccgcggcagctaggaatgaaaacggtcagaaatggtatcattattttattattttctcgaaaacgaacggaaacggtcgggaaattttcatatttatgaatttatctatttagtgccaacttcaatgccacgctgatagaaattaaaaaaactaaattttaaaaacggtaaccattggtaaaaatgttattattatattagttttgtggaaactatatcgatatggttgggaaattttcataccgttttcacccctagccggcaacgatgtttacaactagtactctctcttaacaaggcaacaatcatattcatacaacagaaatgcgagtgttgctacaagtgatgccatgaagagactgaaaagaaatgaaactgtcacaaaggattcatcgaagtgatcatattcatgatccagcatttaatataaaaatgacagtaagaaatttccaataaatcagcaagatgtagatatgaggcctcataggtagaaaaagccccatagaggatgtttagatccatgagtgtaaagtttctgacgtgtcacatcggatattatatagggtgttgcatgggatgttcggatactaataaaaaaactaattgtagaatccgttagtaaaccgcaagacaaatttattaagcctaattaattcgtcattagcaaatgttttactgtagcaccatattgttaaatcatggagaaattaagcttaaaagattcgtctcgcaaattagtcgcaatatatgcatttaattattttttagactatatttaataattcacgcaggtgttcaaacgttcgatgtgacaatgtgtaaaattttagagtgggatcttaacagggcaataatcacaaagaaacatggaacatgactactgcatataacatgtcaaaaaacttttcttcaactcaaacgacaggatagagcttacaattacatactatgaattccattggagcgcagacaaagataacatatgtttcagcagcctctaatactcaattatcaatagcagcccgaaatttttgcatgcaagagaaggtgcaaatcagacgatgatacgagcagcggccgtcggtgtcagcgaacagagcgcagccgtggagccgaaacccccgaccggatcaaggactgatttgtaacatatttggatctctaccaattttttcaacccaaaacaggagattatgtgagaaacagcagtaccgctaccattagaacagccacgtatatgaaaaatgtaaccttaaaacaatgattacacttgtattaacttaatatatactccctccatcccaaaatatttaacgctattaacttttttaaacatgtttggccgttcgtcttattcaaaaaatttaagtaattattaattcttttcctatcatttgatttattgttaaatatacttttatgtatacatatagttttgcatatttcacaaaagtttttgaataagacgaatggtcaaacatgtttaaaaaagtcaacgacggcaaatatttagggaaggagggagtatcttatgcttaaggtctaacacaagctttttctttctccttcacctcaaggcccaagatcaagagctgaaggaattttatcatcatcttacaagcaaaatgggatttacgtaaataaattatatacaacaggggcttatgtgaaaaaaagtacctcttgtgggtcccatctgctacctctctcctcagccacgccgtgctcctttccctcactcgccagtcgccaccctcgcggcctcgccgcgtgctcctttactgctctctgctcgcgcaggagggcccacctttcagcctccgtcacgtcaccggctccgcctcccgccgattccttcctccccgtggaagcaacccgcagcggcggcgacggcagcggcgtcggcggcggggacgaggtggggagtcgagaggaagagatggagtacaggagagtgaaggaccaggtaagcaccaaccccaagtcccgcccaaccctaatggagagagagagagaggaatgccactcgcgctgatgcgtccgcgcctccagattagatcgctgcaacgggtgttccctttttgcgattttcgctggcccttttctgttcctcacttagggttctagaatttccggattttcgggcgttttgcggctcttgatgtcagtgagacggtggcttttgtaatccaatcgttttgaactctgaaaaaaatgtagcaaatgaaacaggatagtgactactagttcatattgttattaacaatgtagcggtcattcaaccgcatttttagatttaagacaatttatctgattactggtactccctccgtcccataatataagggattttgagtttttgtttgcgctgtttggccactcgtcttattcaaaagtttttgaaattattatttattttttgtgacttattttattatccaaagtactttaatcacaacttttcgttttttatatttgcacaaatttttttaataatacgagtgatcaaacagtataagcaaaaactcaaaatcccttatattatgggacggaggaagtagtaagtagtaaagtgaccaatgcttaattcctgtattgtaaatagtaaactgaagatatagataacggcaagtttggtgattgtgatttgggaaactggtggtgctttcaatcacctgtcagtggccaaacctggcagatgctctgtggtttaaacttgaaattcgacttagatttgcctggtctttttagttctgttgatgtttggcaagcaggtgctgataatcatcaatctggcaaatatattcaaccatatatgtttggagtcatgagcattgcaattaagcttgtacttcagctgttgttctgtttgctaacaagttatgtatctgctgtactgtctaaaggagagctatgatgttgtatctcagaaagacatagaaagccctggtgagaggtctctttctagcagtaagttgtcgattcctcatagaaactttttcttttgatatccataaccaggactccaatatccttatgatcttaccatttacagcttcagcaacctccagtcttagcacagcaggagcttcaaagggcaagatagttggaagttaaagtaagacttaattattgcaatctttgtcatcaaatagcatacttgtgaaaatcaattgatttattagtaatgcgttgtggcaggtccattgttacacttgcattgacattactaacaagttctcaggcaatac

SEQ ID NO: 2485 - DNA, 724 bp, Oryza sativa
  unsure (1)..(724): unsure at all n locations
nnnnnnnnnnnnnnnnnnnnnnnnnnnnnnnnnnnnnnnnctccggccgcgacgctgccgacgcgtgcttctctgtctcgtctgcgccacaaacttgaagctgctctcaaccatcagcacctactagacggtcaccgccctcaacttcgcctacatcgtccgtgagttctgcgttagagacaaggtgattgattccgtggcctctccttttccgtgttgtggaatctcttcttgcttttggtttgcccggtgattaaatttatatctgtttgtgcaagtgctgctgctgctacgattaaatttgtcatcaaatatgtgcaagtgctgctactacagattctttttctgtttgtacgtatgcatcatgtgaatcgttgatttcgatcccgatggaattttcatagtgtttagttgtgctccaacagatctgaaattaaaaaaaaatgacaaaaaaacatgatattttcaatatgacttgtgcttgactaattaaggcaatggtactggtacattactcttagtgcatgaaaaagtaaagagtctcagttactaataagaataaattggacgactgaaagaaaaatggaaaaaagaacacaagtttcataacacaaataaactctagttttgttgttggtgaccaccatatttctgccaaatgtgctccatcaaaactgactttagacgtcgatgggttgttcgatcgcgaatattcatgtctgcg

SEQ ID NO: 2486 - DNA, 1375 bp, Oryza sativa
  unsure (1)..(1375): unsure at all n locations
nnnnnnnnnnnnnnnnnnnnnnnnnnnnnnnacccgcacggcgtcgcgccggctccagcgtgcggcgttgcagggggcacgcgggaagcgcgccgaagcggaggagaggagaggggaagcgggcggcggcggagggccgaggaggcgcggagcaggacgcccgctgcggctggcggtggcggcggcgcggcaggggagaggaggggaggcgagggaagccatggagggagagaggggggaaggggaggaggcgtggggtgcgtttgactgtcagccacccatcatcgccattgatgacgtggcaggaaggagctcctggaagacctacggatggtgtcggtgagtgacgatggaagatgagaaccgtgcgtttgttatcctatggctgcggagaggaaggtacagcccaatcatttagcttattcggggaagaagccaaacaatatatttatacaaacgaaatataatttataaataaaacttttatgtacgtgtttttagtgatgaaaaataaaattcgatgaaaaacccctaaaatcagcttcagattaaatgttgaaaaattaaattttggctaataagtataagcataagttgcgtcaaaatgagaagaaaaatataaaacttacttaaaagtgaaatttaccagaaattacatttgttttcacatattactagaaatatgatatatttacaatacaaatacaccatcgtaaagaaagtgaactgcaagttcgatatacacatttgaaagaaaaaggaaaaaaaatatagatctatttggtcgagtttgacttgaaattttgtacaacggtactttattcaatcataaatatttgatgtttaaaaaatatttactttttaagatgacattttgtattagaatttttttagagtaagtttacaaaatacaataaattttatgatattattataggagttcttatggtgaatctatgtacagtatttttttaaaaaaccaaacatttgagaaacaattgtgattggaattttaagtttgattaaatcttatcttaaaagaatatatttcaccatgcactctgtcatcgtttttcagaattgctccgtaacaatctgatttgaatttgagaaaccccatataataaacttttcactcgtcatcaccgcgtgtcgtcgtctgaaatttgagaaccgccaaaatttttacttggcctccctctcgtcgtttctccagctgcccttcatcctcggccccgtcgggccctcgccgacgaagacgctctcgacgagcttccgcagccgctccctcgtcgaccgcggcagcagcttcgccacgcggttgatctcgcggccgatgtcgtactcctccttcggcccccactcccggtcgaac

SEQ ID NO: 2487 - DNA, 4301 bp, Oryza sativa
  unsure (1)..(4301): unsure at all n locations
cgtacaccttcgcgccggcgaggtcgcccttcttgacccgctccctctggaagttgtccaccggcaggtcgagccagtacccgccgtcgttgccgccgccctgcgggaggttcgacccgtcggcggcgaccggcgtcggggtctggctacccttctggtacagcagcgcgccgttctggaagaaccacgtcaccgacgacggcaggtagggctcgtcggggtggaggaacagctgcggcgcgtaggcggcgaggagcgcgttcacctgggcgaggtcgggcatgcaggacgtgtacgccgcgccgttgttcttgaggcacgccagcgccgacgcgctacccgccgtcgcgtcgctcctggcgaggacgaacgtgccggcgtgcacgccgcgggcgtccacgccgcgaaccgccggcctcagggcgacggcgctgaacccgtccttgtcccacaccgtcgcctccgcctcgcacgcgtcggtgaagtcggcgcggacgcacgcgacctcgtcgcgcggcggcttgtccggcgaggccgtgaccgcgacgccgatcgccctgtagccatcgggaggcgtggggagccagaagtgggcggcgtcgtcctggctggaccagacgggcgcgtagtccagcggcggggcaaggagcccgccgccggagacgtcgcgggcgacgaggacgtggccgaagagcggcccggtcgttgcgctgcgcgtagtggccgagggcgctgaagccggcggggacctgctccggcctgaagaaggtggcgccgccgccgtcttggccggtggaccagaccttggcaaacgtggtgacttggcgcacctctagaccaccaaggtcaatgctaccctttgcaaatcctccatctgaaactgaaaattcagaaaggccagtcagcatctcgaaaagaaaaagaagcaagcaagcaagcaaacaaacaaacgccagtcagacaaagatgttacagagttgacaaaaccacaaaactgggcctatcaaaatggcaggccataactaagaatagaaattcgtttagccaagtgtttatagagctgaaaaaattagcaagtcataatgatagcaacagagagcagaaatggtctattcaagttgtggtgttctggatagagatgcgcatttgtcttccaaacaaccctggctagctagatgaaggcataagattatgctggtatatgctttctattctcatttgataacatatatattctttggaaatcatggttatcagtgtctgttcagaaaagggcacaccaatacgagcatttcagagcaaccgaggactagaggaggatcttgtagcccatgaatatagcaaagtatgttcctagtcgtcattgcaggtaagctacctcgccagcatcgcctaaagctgccttatttgcatttagccatataactcctgcatttgccatgcatgtatttttctctggatatgttccaatcatattggacttgtagtcaagaggaaaattaatgatgaatgcgtgatcaggacaagattgaaaaaaataataataatcagaatttgctaagtggagctgtgcgtgagaagaacagtaaccgagtatcgaaaggcaaaccttagtaatttagcaaaagaagcgaagtgctgtaatgatcaggatcaccaagttttgcaagaaatcaattccattcgagaggtacacaaaaccattcgtgcaaataataacataataaccagaagaacaaaaaaaaacacgaggtatgcacaaatatgcaatacgtacctgacgacggccacgacggcaacggagccggaagagagaacgccgtctcgatgggcagcgccgccgtgctggccatgggaaaacaaggcaaacaccacttgctccttcgcatagcacacacacaggacggggactaaccggagaaataattcaggctgttcctttcttccttcacttgcacagctatagagatcggagggaaagaagcaaaagagaggcaaatttaacgggcgagatctctgtccaggagacccttgtccctttcaacggcacagcgacttggcaaagacgactcgactccttcacagtcacaggcttggattagctagctagcttatcgtctacttctggcctatggttacttgcaagaaaccaatgtgctcctaagctctcagctctgcctgtgcggctgtgcctgatggcaatgacttcacttctagtgatccctacccgcatagcttggccgtctttaagaaggtgtggcttggcttgacggctcttccatctcccacgacacaagtctaatgcagacacactataattaatattgcatcgacgcatgtcagcgtcacttccatgaggaaaacacggcgatgttgtttagtgtttcttgcctgcctcaacttgtgtggatgcatgtgtgttagctggaggtcagcgtggacagacaggagtacatgacagtatgataggttcgttgtacaattgtactcttcctgaactgtagtatgatgtaccatatcattggaacaggagagaaaaaaacgtgctgcaaactgaacgttggtagcagcaaccagtaaccaccactacgcgccatgagctgcggttgttgcagactcgcggcaagattggttgggtcagataggcacaagtgacaaatgtggcatttctctaagcttctactatagataccgtaccatggctattggtcagataaggacttggtagtagttcacacgaatggcacgaggggaagctgaagctgacctgacctgatcagagaggtgtgctcggagttgaaaaattccggtgctgatgtggtggaggggagagctagcttgctgggacaagaaactgtgtcgagcaagtggattgcagttctggccttctgggttatctgcactctccagttgaacaatggaagtattcagattcatggagcaagaacagcagcatgctgctgtagactgctaaaaaaaattcagaaatgcttatctcgtagattgaaaggcaagggacattagaaacttgaaaaggatgtacaatgggaatatccgtttcttcgacatgcatatacatttagtcacatcaacttgggcattttcaggattaataactaactgttggtgacagactgaagaagtggatggcatgattttattctcatgcacaattatggaccattttctaatcattgagatgaacggatgtatgttccgtgaaaaacagtgcagaactttagttggaccgatccagaagtcacatgctgtagatcgaacacagtttatatattcccagcaaaaaatatgtaacaagagtagtttttcaactatctaaaaatattcccagcgaaaaagatatgaactttcatccctcgagggatgttccctcgttgtttgcatgtcatctaaatagttatcaaaaagtttaaaaaaatttgacaacgtagattaatatgaaatatatcactccacaaacatgcaagaccaaatttaacttctacaagttgcaacaaaaaaaacaaaaaaaaactgaaaatagttatcttacattcatagctatatttgttatttttgttacaacttgtagaagttgacttttaacttgcatgttttttgagtgatatatttcatattaatctatcttaccaattttttatgattatttaggtgacatatacgaaacgagaggatatcccctcaaggtatgaaatcactttctgagtgaaaaatccatgtctcatgtgctgcaacgccgttgcccaatttcgctgaccaaaccctcacgaagtggttggtataaatatggaaaacaaagacgaatgcataggataatatagagagcacaagttgtcatgtatgatggagataggcatggccaaaacactgggaaacattgtctccagataagatgagtatgagggacactagcccatgcagccatgctacagtgactttcagttcaacatcttttatccatcagcaaaattgaaatcatgttattcctttctttgggacattgaatacggatatttcctagattatgacaggcatactgcagatatacattgaataagcgcaaattaagcattcgattttgaagtatttggttttcattgctggtttattttggacaaacccacttggctagcatgcaaaatcgtgaactgaaaagagcgaagatttcagggtggccataagagaattaatttactgaggggactgctaatactagtggcatatatatnnnnnnnnnnnnnnnnnnnnnnnnnnnnnnnnnnnnnnnnnnnnnnnnnnnnnnn

SEQ ID NO: 2488 - DNA, 7018 bp, Oryza sativa
  unsure (1)..(7018): unsure at all n locations
acatcttttatccatcagcaaaatgaaatcatgttattcctttctttgggacattgaatacggatatttcctagattatgacaggcatactgcagatatacattgaataagcgcaaattaagcattcgattttgaagtatttggttttcattgctggtttattttggacaaacccacttggctagcatgcaaaatcgtgaactgaaaagagcgaagatttcagggtggccataagagaattaatttactgaggggactgctaatactagtggcatatatatacatactgtcagattacaagtaagaatgattgcagagagaatagtggaaatttcacatttatgaacttgccattattttcgttataacttaaaaacagaataaaacctccatgctgctggtactaacccctctgctttgagaagacaggttctttgttccctccaataagtcagattccttcgtcatcccttgaaattcaatcagtcaggtgtgttatcaccaatactcaaatgcaagtactgcaaagcacagtacaaaactaaaattacatttccatttcccagagtcagttacacacaaacttgcgactgtatggctaaagaaacacttaccatggcctacaaagaagggaccatctggtatcctgagataaaatagttgttcccgttttccagcaaaccagattttagtgggtcaggggctttaatacaaagagaaagcagccccagccatgtgctaactatggcgtgtaacaaatgattcgacaagtggatttacaaggtcaggtgcttcatcctgcaaggaaaattataaacaaatgattcagctgccaacttatcaaataaaatatagctaaaagcaaagcaaattgcaaaaaagaattaatcaactgatttcagctgttacaggacctgtgggcagtgtccaacatttggcaagacaacaaaatcttcaacagtatcaaaagatgcgtaagctcttccaagctccacaggctcccatgggtccttctcaccccaagctaccaaaactggacactgcaaaaaaaaaaaaaaatcatatatagttgatataaccgaaataagttctaaaaaaacaaagtgaataatcactcacagaaccacaggaaacctaaccttcactctgggaagtaattcttcaggtagaggacctcctgagtagcagatgaactcaaggaatacatccacagcaccagggtcaagccctggctgcagaataaactgaactagctcatctgtcactgcggatgtgtcatggtagcactgaaatgaattccatcagaactaggagaaaaaacattgtggaaaaaaggttacagttatgttacaaactaaataaagggaaaaaaacaggttctatacttaagatgatgaattaaagattttctttctacagaatgcagccattggagcaaggtcatgtggcttttacttaatttgggacgttaagcctgaatgttgtgttaccatagatttttgtatatgcccaataatctgcttatgctttgattattttccaagatgagaggattaaataaatatacacctgacagagaatatttttcacagattctggtgtagcaacagcgctgaagaacagcttcccaataacagtattcctaaaaaccagaaaagggattgtaacaaggaggtaacaagtatgtggatcccgcaacaaactatgaaattctgagttaccgtagcagactttggaatgatttgatgaaaggccttccaaaccatggctgcttactgatatgaagcatcctcaatgaaatattcaataaaaagatacccttgcacttctgtggttccatagcagctgcctgtagaccaacaagccctgaaggacaataataaacacattacaagtgcttgttaaattctttttcatgcgtacaaatactcatcagtgacatgtatcactcgcacctcccctcaaaatttagaggtacatgaagagaacttgtctcatcttggacactactccaaatatcattctggagtagttactaggctaatacactctagtataatgaaaatcaatttccattgtgaagcatgagcgcatatgacatatctagttgatatcaccataattttgaacagcatcatgcacccactcactacagaaatactccctctagtcattaatatatgatgtttatatattaatgaccggagggggtaacagataggaacaacactactaaactagcatagacatcatttacggtcttcctttttccctactcaaatgtgttttctgaaataacaaagggaggaatttgaaaaatgttcttttggcagagtaagcaattttatggattacatcgagcgacatgcattcttatgctcgtccattagttacacatacaacatatgatccattgcatttcatgtatgatgtatgtaagcatggagctgagcatacctccaattgaattgcatatgaagaaagcttcgctcttaataacttcagcacaaaacgtattcagctgttctccccatgtctcaaaagtataaaagctctcaccaagctcacgtggattaggcttatcagaatagccataaccaataagatcaattgcatatactctgtttttcagagcaagaacaggaatatttttccgccaatggtcactggaaaaaaaaaagaggggagtctgtacatgattgctaagcaaagtgatggggtgttttttgacgcagaaaagtgatgtagtgtgataattaaaaaacaaacactagtagtccccattattgtatcaaatcaaactattggaaaagtaatgcagcttgaggtttcatcataaaaccaacatttaacacagcccaagatttaacaataactaaggattacatgtgatcagtgatcactaaccaaaaaattctcaaaatattaggtccaacatttcttctcctaaacctttacaacatagaactacagaagcatctaaaaaacagttgcagcaacagctactgcactgccatggccttaagctaactccccattggcatgataactgaaaattttagtttggttgcctgcagatatgaaacagaaagtccacgcacctgtttgctccgaaaccatgaattagaaccaatgcagggccagaagttcccgcgtactggtaccgaatgttgtagcccttccaattccacatgctacgcaaacaagatggtaatttagaaaccagaaatacgagaaactggaactctgtaagcaaggtcacacgcaaaataactcagggtaacacttgaactatagactggagtgggggagtggagacttgtgcctacctggtgcgcacctggggctgagtctccaacggagcatccgtggccgtgtgcggcgccgcggggaggctctcctcgaccgggtcggccatggaggaggcctcgacacgcagcagccgcgcccgcgcccgcgccgcgttccccgaggagagcctcgccccggcctccaggtagtgcgccgcgccgactacgcggggcagaagtcggcggcggcggtggcggaggaacccgtgccacggcgcgcggagagggtggtggccactggaggacgtgccgccgcgccgctcgtcgccatccccgacggccgcacgcaacgcaactacgcgggggcaccgggctgtgtggagcgtggaggagagtcganacgagagagtaagagaaagggatcggtgacggtgagaaaaagcgtgacttgtctgcacggcgtttcgccgcgtgggcgaaacggaacggaagaaaaagtgcgcgcgtgcgtgtgcgtgcgtgcggcccaggtggtttcgctggtccgtcacgccagtggacgcgtgggccaagaggccgggacgtatttgggccgaggcagtaaatcactccgcgggccgtagggatgcggcggctaacgtatttggtctgggctacgtgcacgggcgcacggctgctctattgtgcatgggccatctattattaccaggtggcccaatgtacagacgcatgctactactaccagagagttataagaggggaccacctatacatttggcgacaaattttctcctaaaaatttgacagatgtaattgtagtacaatcgtagtataattacactgtaacttatatgtaattacactgtaacttgtatgtaactacagtgtaacttgtgtaattttgaatcgttatatctattacaagatttgttttggtgaggaagaaaaaaaatcacggcacacacatatgtataaggatttgttcccacaacctccattttaccgaaataacatattacagaaagatttttgaaagttacatacaagttacactatagttacagtgtaattacatgcaagttacagtgtaattacactacgattgtactgtaattacatctgtcaaatttttgggagaaaatttgtcgataaatatatagcaaaatcgtataagagttaagaccacattgaagtttgaacacacttgaggtgtgtttggataatggaaaatggagggtgggattgggattgggaaataaatgaagggttagattaaatggaagagggagaatgaatagttaggatttaaagatatcttttgatggatggaaaattatttccctatcacattatccaaataatgccttgatgtggtatggactcatagcggactcggattacaaacagatcggatagttcatacatgtataaataagacgttttaatttttttacaatcaaatttataaaaaaaaattagcaaatttaaacattaaattagttttattaaatctaacgttaaatatatttaattatgtttgttttgtattgaaaatgttactatattttttcataaatttggtcaaatttaaaatttttttactacgtacacaataacttagaaacaacgaaacaagctactctcaagtctcaacctagcgaaagagtctctcaaagttttaaaaagacagattagtcatttgaatagactataatggtgtatggttcaatcatagggtgtgatgatatgcccttacaaatatcagattatcttaaatagcactttgtcgaataatccgcgtaaaaaaattaaacaatccacatccatcggattacagtaataccatatctttatctatctccgtcaaattttagatacctaccatatatcctcatttcgggtacggatgggatcgaaaagtatccgatttattttcgtcccttatcattgatgaggttgactgctggacctacaccaataatccaactagaaaacgagcagtggccagtggagatgtggaggtacaggcgtaagaatgacgagcaggtgagcgtgcagccgtcaggtggctgcgcactgttcgtttgactattggctagggaatctcttcgactaatctttcttcccgtctcaaacaatcactgacctgaaacaacacacgactagttcagctgaaaacgcagccacgcaagtcgcgcggaataatagaattgatcacactttgttcagagtcaaaattgtcaatcattggacattccagctcgttcatgagctggtcgtgcatcttgaacatcagaacatgcccttaatttacacgtagcttaatcaagtttggagatctcatctgacctgagcatggtgtgattcgtttgtcacactcacaatgcaactccacagcaaaacgatgctcgttgtgttcatcaatatcgtgttcatccactgccttagcgtgaacattggagcggcggtggccaaccctgcagccagcgatggccggttcgtccaccacggcttcacggcggaggacctcaccatggacggcctcgccgccgtcacgccgaccgggctcctcgcgctcaccaacgccacgtaccaaacgaaagcccacgcgttccaccctgcgcctctccgcttcctcaacacgtcgtcgtccgccgccgccaccgtgcggtccttctcgacgtcgttcgtgttcgccatcgtgtccgacgaccccaggttcaggaacaacgtcgaccatgggctcgcgttcgtggtctccccgaccaagaacctctccacggcgaacgccggccagtacctgggcctcctcagcatggccgacgacggcaagccgagcaaccacgtgttcgccgtcgagctcgacatcatcacgaaccccgagttcggcgacatcgacagcaaccacgtcggcgtcgacgtcaatagcctcaggtcgctgcaggcgaagaccgccggctactatgtcgacggcgacggcgcgttccggagcctgcagctcaacagccagaagccaatgcaggtgtgggtggactacgacggccaggccaagcagctcaacgtgacgctgtctcccgtgcaagtgcccaagcccaagaagcctctgctctcccaagccatcgacctctccacggtcatggccgaggagatgtacgtcggcttctcgtcggcgacgggcgtcgtgttcacgcaccactacgtcctcggatggagcttcagcttcgacggcggagctgctccctcactggacttctccatgctgcccaaggtgccacgagtgggtcctacacgtcggtcagtaatgctgtatgttgtgttgccgattgccagtgcactactgtttcttgttgcgtttgttctgggtgtcttcttcgtgagaaggtggcaccgccagtttgcggaggtgcgcgaagattgggaggttgagtttggtccgcatcggttcacatacaaggatctgtttcatgctacgcagggattcacagacaagaacctactcggtgcggaagggtttgggagcgtgtacaagggtgtgcttcccgtgtccaatacagagatagcggtgaaacgggtgtcacacaattcaagacaagggatgagagagtttattgctgaggtggtaagcatcggccgtatccgacaccggaacatcgtgcggctcctgggttactgtcggcgcaagggagaacttctccttgtttatgactacaagacaaatggtagtcttg

SEQ ID NO: 2489 - DNA, 2493 bp, Oryza sativa
ggatcatggagccaatgcaaagaccacatacgtggtaggaactatgggttacattgcccagagctcatgcacacggggaaggcaacaccgttgacggacgtgttcgcgttcggtgtgttcctcctcgaggtcacctgtggacgaaggccgattggggaaagcgatagcaacgagattctattaatagattgggtgctgaagcattttcttagcggatccatccttaacgtggtggatccccggcttgcagggaggttcagcttcgaggaggtgaatcttgttttgaaactaggactaatgtgctcacatccattgcccaaggcaaggccaagcatggacaaagttgtgaagtacctcgatggtatgcttccagcaccagagctatcaccgacgcacatgagctataacatgatggagttgatgctacagaatggggttggttcacatagtttacccgtgtggtcctctttgttagataatagtgttggtacaatgtcatctgcttcggttctctcggacgggagatgattctgaagcttgtacccgatacttgtcagtgggctcggtaatcctttgtattttgttgttagtgaatgcaaacaattatgcacttttagagttcctatttttaatcatttttttcttgatagaagacacatatatactacacacgcatcgtaattgtgccctatttaacacacgaccagtagatatcagaggctgcgacaagcctaaggcagctaagacttgagccctagttttttttttaatttctattagattctataaaaaaaagtgaaattttttaagatacaagatgtgtaaacaagttgaaccggagtctcaagaagcataaaattcctatgctgatttagtactgctactgttgtattgcacatttatatgcttaaaagatgatatgaaattgacacatggtgtgggcaatgaagggtgtcacatttgaacttatgtgatttttatggagtttaaatttgactaaaatggagtggttcacaagtaagtttcattataaaggcattttgtagtatacgcaaaacgaggtgagccattagctcatgattaattgattattaattattttaaatttcaaaaaaggattaatatgatttttaaagcaactttcctatataatttttttccaaaaaacgcaccatttagtagtttgggaagcgtgcgcgtggaaaacgagatgtttttctctctcaatctcctagatctcccaggaagaacgaagcctaaggtatttatgggatttttctaggttatgaaaagaactagctgggttgcccacgcaattgcgcggctagcacccaaacaaaattatatattttttttatgattttactaaaaatttattaaatagctatcttattgtcttaagagtttgaaagaccaaaccttatcatccccatgtttctaattatatattattttaaaagtcacaccagatactaccccttatgtcatcttcttctttatttgcttgctcgatctaccactatttctattcattctccttagaacctttaaacattggatcttataggttttagagtttattttcacgttgagtttcgtttttataatttctagacgtcatgtcaaacgttgccattatactcctctatgacccgtctactatctcttctctttattgtcattgagattttaaaaatcaaacataattatcatttaggttcatttttactttctagaagtcccgccaaaccgtcagtgactttgccattgccattgtacttctctacggctcgcccgctacctcccttctttattgtcattgagattttaaaatcgaatatgattatcattgttttttttttactttttagaagttccgaaccttcaaaaattgaaccttgtagtttttagagtttattgtcttgttgggctttatttttttataatttttagaagtcttgtcaaacgatgtcactatgctcctctacggctcgtccgccgcctactctttattgtcattgggattctaaaaatcgaacataactatcgttggaattcattttttattttttagaagtcccgtcaaccgtcggcagctctgcaactatactcctatacaccccgcccactgcttctcctttttattgtcattgagattttaaaaatcaaatatgattatcaatggggtttattttttttactttctagaagtcccggcaatcgccttgatcgtttgctttacggcctccctgtcgcccctccttttaatcgtcattaggattctatttggtgtttcattaacaatttttttatgtcgtatcaaccgccaccactctactcctttatatgcctgttacttaatttatctcgtcatgtgttttacatggtcttttctttcaatagtctttatttttatcacaaattttagttatttataaattgtattcttaattggaatcttatttttcttttttctaatttcagattttttta

SEQ ID NO: 2490 - DNA, 12579 bp, Oryza sativa
  unsure (1)..(12579): unsure at all n locations
aannnnnnnnnnnnnnnnnnnnnnnnnnnnnnnnnnnnnnnnnnttagacatttcggcttataagttggcttataagcataaacaaagagggcctcagcactccggttattatatcacatttccaggttttaaagattgggtgaaattgacctgatcgcagcgcgagcagctagcgcaaattgttggactcatgacccatccatgcatgattattcagtcagtcagtcagtaggttcccagaattttctccctgcaaacagggacaaaaagcctctccaaatcgatttgctgttcagaaattcagagatcgaattcagacagtcgaatcgacaagcaaacaagctagctgcgccacggcgaagtgatgcaaacaccatgcttcgtgagcctttccactgtttcactctgctcctgctcctcctcgcggctgccgaccgctgcgccgcggccaccggcggcagcggcggcctgcagttcgcgtacgatggcttctcgggcgccaacctcaccctcgacggcgcggccacggtcacggcgagcggcctcctcatgctgaccaacgggtccatccagatgaaaggccacgcgttccacccgtcgccgttcccgctccgcgcggcgaggtccttctcgacgacgttcgtgttcgccatcttcgggcagtacgccgacttcagcagccacggcctggccttcttcgtctccgcgtccgcggacgcgttcgccgccgcgctgcctggccagttcctgggcctcttcaacggcaccggcgccaccaccggcaaccggagcgccgccggcgtcttcgccgtggagttcgacacgcttctcaacgccgagttccacgacctgaacagcaaccacgtcggcgtcgacgtcaacagcctaacgtcggtcaggcccgcgacgccggctactacgatgacgtcaccggccagttccggaacctgaccatgatcagccggaagcccatgcaggcgtgggtggactacgacggcgggagcacggaggtcaccgtggccatggctcccctgggcacggccaggcccaagaagccgctgctgcggaccaacgtcgacctctccgacgtcgcgacgggcgcggcgcacgtcgggttcgcgtcggcgacgggcatcctcttctcgcgccacttcgtgctaggctggagcttcgcggtggacgggccagccccgccgctgaacatctcgtcgctaccgccgttgccgcgggcttggcccaagccgcggtcgaaggtgctggagatcgtgctgcccatagcgtcgacggcgctggtcgccgccgtggccatggcggtgtacgccatggcgaggcggcggctcaggtacgccgagctgcgggaggagtgggagaccgcgtttgggccgcaccgattctcctacaaggacttgttccatgcgaccaagggattcagcgacaagaacctccttggcacgggagggttcgggagcgtgtaccgaggcgtgctccgcaagcccgacatggaggtcgcagtgaagagggtgtcacacgaatcaagacaagggatgaaggagttcgtcgcagaggtcgcgagcatcggtcgcttgcgacaccgcaacctcgtgcaactactcggctattgccgtcgtaaaggtgaacttctcttggtgtacgattacatgccaaaaggtagcctcgacaaatacctttacgatggaagcaagcacccactaagttggcctcagagattccacatcatcagaggagtggcgtctgggctactgtaccttcacgaggattgggaacacgttgtcatccaccgagacgtcaaggcaagcaacgtgctcctcgacgatgagatgaacggtcgactaggcgactttggcctcgcaaggttgtatgatcacggagctgttgcacagacaacacatgtggtcggcactatggggtacctagcccctgagttggggcacaccggcaaggcaaccccatcaaccgacgtgttcgcgttcggcgcattcctcctcgaggtcacctgcggaagaaggccaatcgtgcaggatgagcacggcaaccgtgccgtgcttgtggactgggtgactgagcagtggagcaagggtgcacttgttaacgtggtggacgcgaggattccgagctgttttgatcctgacgaggtttctctggttctaaaacttgggctgctctgctcgcatccattgcccaatgctaggccaacaatgcggcaggtcgctcagtacctcgacggtgatatggccctaccggatttgtcaccgacgtacctaagcttcacttcactagagcggatgtacaaggagttcaaccgcaattccatttcatacatctcatcagcaagcatgggtgccatttctgatatctcgggaggaaggtgacaaaggaagggagctcgtgattttgagaagcagttggtgaggatatgaaaaatcgggtttctcagtttattacttctagtttattttctgaattataatggactgtttagggggctaaaaattcaaaaaaaaaaggcacacatcagatactcccaaagtagggccaaaaatggtgcttgtagcattgcagttaagagtatgttaacggtgtaactagatgctttaactatcttgttctccttgtactatgaaatcgagattcttctgtcttgattatgttcatagtttgatacagcatcgggatgcactaaacagttaagtagcaatcttgaaaagtatcaaaaggtttttttctaaaaaaaaagtaatacctagttttataatagaaagtacataaccaagagtataaaactactcttgatagaaagaaaaactagcgctgctatttttctttggcgaacacgcaaaaagacttgcgcatcaataacacaatatgttattggaaggaagcagattgtttacccaccgctactgactggtagccatcgccgaaggaggaggaggtaacggctgtcgggctattacaactaactagtactgccaatacaaatattcatgcggactcttgcactctacagtaggacttgtcatgattaatcacaagttttacgtgcatctacaaaaatttcctgtcaagagaaagcaaggtgctagttttcatggatgtagtctttaggatctagctaatccgattggtggtgttgtgcagcagctgcttctgtttctttcatgaacttaaatgaacgcatgtgatccatcttcagttcaggccattgaacgcccttcagtacctatcatacaaagactaaacgtataaattgacaagtattaattgaagcggcgccggccaaatgaatttatcaaactatggaccgccatatgacgatagctagaatctcctccacagtgcttgtcaaaatcattcgcaaattgagacgtttgaaaccaagactgatccttgtgaagtagaaacatctcactgtcaggagtcaaaacctcatcttctactacttcgttgaaactagaatagtagcgtagaacaaaggcaccagcatccaaacggcagctagcagagcagtccacaagtccattgattcttcagaaaagttttcttagagagagagagagagagagtcctttgaaacaggtaaaaacaatctctgaataataatctctggtctctttgaccactatattgctcaagtgctactacttctcgatcgatgtgttcgacagaatgcaatttttttgtccagcaacctagaagagtcaccgtcgaaagtacgaaaattaaatcgatctatgcgaaaatcaggacggcgagagagtagtcgtcttaccctgcagggcacggcgcctaccaaggcacacgcctctgaaacttgcagccgccgacgttgatgtttgccgatccagtaatcactattggacaggatgatcaacgcatgcggagtgcagccatcgctagcaagatactccctctgccccctaaaaaaaagacaaacccttaatttctgtgtccaacatttaactgaataagatggacggtcaaacgttggacacgaaaactcagggtttgtctttttttaggacggagggagtatctccgtgaagacagtgttgttgctgactacttgacattgataacaaattcaataatccatccaccaaagtgtactgggttaatggtcgccggccggctgatggttgtctgttcgtgccaaaacatgtccttgtcgatctgaatctttcagctctcatcgctcgacacccaaccactcgatcataagccaagcagtttatgttagccaattgctacaatatccttaagaggcgtcaaggcgaagtgtcacgggaaaaaaaatgggtcgtatgattgccaaattttctgcacacttcgttcttctcctcgtgttcagcttgagcaacgacgtggtggtggcctcggccgccggcggcgatggccagttcacgtaccaggggttcgcggcggcgaaccttaccgtggacggcctcgccaccgtcacggcgagcgggctcctcgtgctcaccaacttcacgtaccaggcgaaagcgcacgcgtttcacccggcgcctctccgcttcctcggcgagtcctccacggcggcggcgggggcgaacgccagcggtggcgccggagccgacgtggcgcggtccttctccacggctttcgtgttcgccatcgtgtccgggtacgacggcctgagcgaccacgggctcgcgttcgtggtcgcgccgacggcgaacctctcggcggcgaacgccgggcagtacctgggcttcctcaacgcgacgaacggcacggcgagcggccaaatcctggccgtcgagctggacaccatcatgaaccccgagttccacgacatcagcagcaaccacgtcggcatcgacgccaacagcctcatgtcgacgcaggcacggccggccggctactacggcgacggcgacggcgccttccgtgagctcaggctgaacagccgccagccgatgcaggtgtgggtggactacgacggccaggccaagcagctcaacgtgacgctgtctcccgtgcaagtgcctaagcccaagaagcctctgctctcccaggccatcgacctctccacggtcatggccgaggagatgtacgtcggcttctcgtcggcgacgggcgtcgtgaacacccaccactacgtgctcggctggagcttcggcttcgacgggccagctcctcccctcgatctctccaagcttacccggctgccacgcttcggtccgaagcctcggtccaaggtcctggacattgagcttccggtggccaccgcatttctcgtcgctgcggtgctagctgccgtcttcttcgtcgtgcggcggcggcgccgcttcgccgaggtgcgggaagattgggaggatgagtttggtccgcaccggttcgcatacaaggatttgttccgcgcgacggatgggttcaaggatagaaatttgctgggtgttggagggtttgggagaggttacagaggggtgctaccggagtccaatttggagattgcggtgaagagggtttcacatgattcaaggcaaggtataagggagttcgtcgcggaagtggtgagcattggccgacttcgacatcggaatctcgtgcagttactaggctattgccgccgcaagaatgaactcctgttggtgtacgattacatggcgaatggtagtcttgacaagtacttgcatgagagaaatgttacaactctattttggcccgagcggctctggatcatcaaaggcgtcgcatcaggtttgttgtacctacacgaggattgggagcaagtagtcatccatcgagacataaaagcgagcaacgtgctcttagacagtgcaatgaacgggcggctaggtgattttggcctggcaaggctgtacgaccatggcaccgaccccaaaacaacacatgtggttggcaccatgggctacctagcaccagagctcgtccgtacagggaaggcgtcacccttaaccgacgtgttcgcattcggggtgttcttattggaggtgacatgcgggcggaggccgatcgagaccgacgagcacaacaaacgggtggtgctagtcgacttggtgcttgagcaccaccgcaatggctcgatcgttggtgcggcggatccacggctcacggggaagttcgatgtggaggaggtggccctcgttctgaagctgggtttgttgtgttcgcacccgctacccggtgcgaggcccagcatgcggaatgtcatgcaatacctggagcgtggcggtaagtcggctcctgacctatcgccgagctacgtgagctatagcatgatggcgataatgcaaaacgaagggttcgattcattcatcatgtcgggcggcccccggtcggcgacaagcattggcaccgtgtctggtgcatcatctatgactattatgtcggagggaagataaaattcagtgcttgcaataagtcttttgattcctactgactcaagttcttaagtgactttctttcttgttccttgaaatgacaagcatttgaaagaggagatagtagtgtgttaagttacctaccaaattcacagtaggcatttatgtttacactacctattagctatgcttcctcgagcatcttaagatagttgggtagaatggtgagttgcttggctgcttcaaaatttctctgtgaactaactctgcagcctgcttgctttgttcaagaatatggcaacttgttctgggtttatcaacaccagttgcttggaaccaggttattcatttatgcaataaccaaacattctctaaccatcaagatgttatgaaatggaaatttgataacaagaatttaaatgttcgataaagctagaatatgtgtacatttctaaggttgtgtttgatacttggggttgggaacccaactccaccacacgaaaaatagagcggtccattagcgcgtgattaattaaatattagctatttattttttccaaaaaggattaatttgatttttttaaaagcaactttcgtatataaatttttttaaaaaaaacacaccatttagcagtttgaaaagcgtgcgtgcggaaaacgaggcagaggggttagaaaccccctcatccgaacgcagcctaagcatataatggatagatatttctcaggtatacaaggagaaccagagattctggcctactaggtactacaaaacagatattgtagttacagcttacaagctagagactgagggtgtgttgtgatggatgataatggatacaaaatgtatattcatagctctatgatatatactaccaacttaaaagtgtgatgaattttttcttcatctccgtagtggttccggtttagggaaaattggttatatagcatcgaaagtttacatttttggttttatagcaccaaaagataccggttcactttaatagcacccaaaattcattccgttcccatttttaacacttccgtcaattctcgaccgtttttcgttcgccttgatcgctattgacctagccacacacgtgatataacgtatctacccctcacaagtacaagtagaatgcatgtcaatgagggtagaaacatcatatcgtgtgcgtgactgggtcaatagcgatcaaggcggacagaaaacgatcgagaattgacggaagtgttaaaaatgggaactgggtgaactttgagtgctattaaagtgaaccagtatctttgattcttcaagaatgtccttacggatataatgttcattgtttagcccaccaaaaccaacctgacggcctgttgcggcatcaagagaagtgtattagatctagtctttcaatatttaaccttctttatcaatgtggttatttcctcttccaagcgtaacgacgcgctacaagaagaacacgttgcagaaaattgcataccttctttaaattgaagagcttggtgctataaaacaaaaaacgtgaacttttgatgctatataaccaattttgcctttagcttatgctcgattgagatcggtcgtgtcctcgatccccagttagaactacatttacttattattaatatttgatatatttctaaatattgtgtgaaataactcatattaaagttatatatataattgagtataatatgacttatttatattaggcatgattattttaaaaattttagggccccatcgaactagtccactgcctgtgtacatttctgagcgtacaaattatcgaacaaataatataaccccggcagctggtgggctctccactacctgttctaccgcagcaccggccggcaatctggcatcctctcaagcgaatgattatacgaacacgtcaaacaaactcaaaaatctcctggattcatttataagatactacaccataaagctccatcaagcaaagctaaacggcatcataaattacaaggccagcatcgtatgaaacgcaatccaaatcccaagatttaagaaacagattgttggacagaaagaggttgaggatacagacgaatgctagagacagttatccatgaaagagcgccatttggatctttgtagtaagcagcaggccgtccaatatacgatacccagtacctttcactacatggcaatacacgaaacaatgtaaaaatacacttgtatttatacaaaaccatatttatcatcagtctagtacatgtccaccaatcagggggtgcagctccgattagcggctcaagctaaggcagccatggcaaccaagaacggtggttttgttgcgttgctgctgctgctgtcgttcttgctgagctcgccgctgccggcgcgatgcgacgcgccgctccccgtcaatgtctggcccaagccgacgtccatgtcgtgggcggagccccacatggccgtgcgtgtctcgagctcgttccacgtagtcgccccgttcgggaacgcgcacctcctctcggcggcgcggcgctacgccgcgctgttcctcgccgagcggtaccggcccctcgtgacgccggcggtgaacgtcaccgcgggcggcgccggcgccggcgcgccgggaaggggagccgagctggggtacctgacgctcgccgtgtccgacctgcacgcgccgttcaagcacggcgtggacgagtcgtacgcgctggagatcctccccgccggcgcggcggccacggtgaccgcggccacggcgtggggcgccatgcgcggcctcgagacgttctctcagctggcgtggtggtgcgggcgggagcgggcggtgctggtggccgccggcgtgcgcgtcgaggaccggccgctgtacccgcaccgcgggctgatgctggacaccgggaggacgtacttccccgtcgccgacatcctccggacgatcgacgccatggcggcgaacaagatgaacgtgttccactggcacatcacggactcccagtcgttccccctcgagctcccctccgagccggcgctcgccgagaagggctcctacggcgacggcatgcgctacaccgtcgacgacgttaagctcattgtcgacttcgccatgaaccgcggcgtccgcgtcgtgccagagatagacacacccggtaagtactccatccctttcatatttcaagtcgctttaatttttctaaaatcaaatgtttcgaaagtttgatcaaacttgtcctatagaaaaatagcaatacttgtaacactaaattagtttcattatgtataactaacattgaacatattttgatagtttgtttgttttgtgttgaaaatatttctataaatttattaggcaacttaaagaagtttgaaaaaaaaattggctcggaagtaggaataaaccttctaattaagttctaggcccagtgctaatacggcccagttaatcccaatttaattacgaggcccaattactttctcactaatcgcttcagccacacggcgtcgtgggccggagcttaccccgagctggtgtcctgcgccggcgagttctggctgcccgacgcgtctgactggcccagccgacttgccgccgagccgggcgccggccagctcaacccgctggagcccaagacgtaccaggtgatgtccaacgtcatcaacgacgtcacctccctcttcccggacggcttctaccacgccggcgccgacgaggtcacgccggggtgctggaacgccgacccgtccatccagcgctacctcgcccgcggcggcacgctcagccgcctcctcgagaagttcgtcggcgcggcgcacccgctgatcgtgtcccggaaccggacggcggtgtactgggagcacgtgctgctggaccaggcggtgaacgtgaccgcgtcggcgatcccgccggagacgacgatcctgcagacgtggaacaacggcggcaacaacacgaggctgatcgtgcgcgccgggtaccgggccatcgtctcgtcggcgtcgttctaatacctcgactgcggccacggcgacttcgccggcaacgactccgcctacgacgacccgaggagcgactacggcaccaggggcgggtcgtggtgcggaccgtacaagacgtgacagcgggtgtacgactacgacgtcgcgggcgggctcaccgccgaggaggccaggctggtggtcggcggggaggtgacaatgtggacgaaccaggtgcacgcgacggtgctctccgtcagggtgtgcccgagggcgtcgacgatgtcgcagtcgctgtggtcgggcaaccgctacgccaccggccggaagcgctacgccgaggcgaccgaccggctcaccgactgccggcaccggatggtggggcgaggggtccgcgcggagcccatccagccgctctggtgcaggaaccgcccgggaatgtgtaacttggtccggtgaaccacccggcaaccgacccgtatacgtgcgctcaactatcacagcaactgctaccatatcataacgatgtgttggagttggagaaactaaagtgtgagttctggattttttttttttggttgggtttatttatttgcattgtgcgagaggggagaatacttctgctactgctgctgctgctaccaatttatttgtttttttattttgagtaatgtgaagtggaccgcatgttatgttattgggtaccttgaaagccggcttttatgttatcatggggccggttccgaatttccaacgcattggttgtactgttcgatttgattaaagtagtattatagaggagagtgttgatgcgagctagtagcctgaagaactctttgtgcttagaaggatctgttctatatctgtggctctgtgtcaagtgctcgcttttgcttgtggaaaaaactatcacttgactgctatctgttgatttgtcagtgatatctcgtgcggaaaaatggagctttcttggggtaacatgaatgagatgatcagaatgagatgcttttcatattggagtgtaactgcaaacgacacacccaggacacaatacggacaataggaatgctagcctctgcggcagaactggccatatttgcccacttgcttcttgctcatcgctgcattgccaatcagactatcttatttgacagtgactaggctaggttcttttcagatgttcccctagattttttgcacgcgttatttgctccacacttcttaaaaaaaatacaatttctcaaaaaactttcttctattacattgatgaaaccacccattctaaggtatttgcaaatcttatttctcaaaatattaatttatcatgttaatcaaataaataaccctcgttaataattaagggaaaaagctatcgctaacagtacctagagtttcgatatctagtgacggattgttgtgtttggatcctgcgctccacggccaccagaacatcatgtaattgtagcctgcctcgtcaaaattatcagcgtttagtcttgattcttgacaacatgattatcaacagttatttataagttgtgatgtctgaccaccaacttctagatggaacagacaacagagaattcttaaaggtttcatatattggctagcatggcctatttagtcccaaaaaatgatgccagtttttgggtttgggcgacctatgtgttgctgcctcctattttggattggtgcattggaaagcttacatccatgcgttccaaaaggacagacaagtgagaataaaacatccaaatcctacgattcagcccaaaactttagaaatgaaaaatttcgggaaaaaaggtcaatagccccactagtattagtaatattagaaatgaaatttcaagcatttcagtctttatctcaaaacaacttcttcgaaaagaaatccaggaatttcacagccaaaagaaaaacaaacggaccagagttacagctcaagagtcgagtcaatagccacaagcttgcaacaatcgtactgaggtgtcttagcagtgatgtactgatgtttaacacttcaacaacaatgattgaagtgagccaaagactagaacaacttcaaaacagcacataagagcaatgtcaataatatagtccgctgttggcttcaaaaaatagccaagtcatctacagtaagcagtatagctaatgtttataatagaaatnnnnnnnnnnnnnnnnnnnnnnnnnnnnnnnnnnnnnnnnnnnnnnnnnnnnnnnnn

SEQ ID NO: 2491 - DNA, 1564 bp, Oryza sativa
  unsure (1)..(1564): unsure at all n locations
gctccaagacgacgacggctcctagtgcccgtcgtattggacaaggacaacatactccgacgatggctatggtgaacgaagtcgtggcgatgaggcttgctgccatggatgcggaagaaacgatgggcgtttgagcatgggcgggcccacactctcgggtcgcgcgtagagcccggcgactaattagtcgcccgcccattctctctccacttccctctctcctccagctcatcgcaaaatctgacatggagcacttgtcgccgattattgtacccgctctaatggttataaggctgcgttcgttcctccatcttcccaacctactcctcctcattttccgcgcgtacgcttcccaaactgttaaacggtacgctttttgcagaaaatttatacacgaaagttgcttttaaaaaatattaatctatttttcaaacaaaatagctaatacttcattaattatgcgctaatgagttgctccgttttacgtgcactgcacaccagttcccaaccactagtatcgaacacagcctaagggcatccacaatgtacactgaaagtaaccttagacattaaatactgctacagtacaacgcatttagcattgtggagtcagaccacaagtccgatgcaaccaaagtacaccttaagcttaaggtgtagcaacaaagctataaaatacaatacctttactgtttttctgtgcacaccaataaaatatacatgtcagttactaaacacagtaacgagtactactagccgttgctgctattccatttgagttgctcatttggtcccctagccgttgtcttcctccagcattcttctgctgcctacaaaaggaggaacaagtgagatgaacaacaatttttgatctattcagtttccccacatactaaatggagcctttcaaaggaaacttctcaaacctcctcaaccaaggttcctcaagccaagcaacaaatagtgaggcccaaaactccctttctacccaatttcccacaagttatccccaaaacttcagacctagttttctccaaaatttccatccttttggtcctccaagcaactaccaaccatatcgacaccctccaatctttcaaggtgctcagcaacaagaatattatgggcaacctactccaggaagcttggaaggttttcaacttcaagaaaatctggtgcactcatttaaccaagcatttggatttgcagccaatagatcacagtttggtatgcaatatagtacttcaattggggctacagccaacacttctttcatggatcagcttctccatgtcatacaagacataatgagaaagaagtagttgaggttgaagaggcaagtgatagcagtgaagaaggaagaagagggacacgcatcaattggactgaagatgacaatatacgactaatgagttcttggttgaacaattcagttgatcccatcaaaggcaatgacaagaaatcagaacaatattggaaggctgtagctagagagttcaacagcaatatnnnnnnnnnnnnnnnnnnnnnnnnnnnnnnnnnnnnnnnnnnnnnnnnnnnnnnn

SEQ ID NO: 2492 - DNA, 3768 bp, Oryza sativa
  unsure (1)..(3768): unsure at all n locations
tgtgtattacagctatggaatgaaactacaatatccttagtacttgagaaatcaccttttcacatggatctagttggtgttgatggttttccttccatccatgaccaatctgttttttttctccacctgaatacatatgagcaataattaatagagaacaaaagcaagagggatgttgacaaaacctaggaaaatatagctgttgtaaaagactgacaaaagcaagagctagctgttaggatattgacaaaacccaggaaaatatagctgttgtaaaaatctgacaaatctagtcgttgtaaaatgtatcatctacaaataggtaatgtagttcagcagaacaacacccattctcattttgttcaacttcatctcaacagccttcccactttcaaaaaaaaaaatgtccagcaagtcaccacatcaatctagtgagtcagatgattctagctctagtgactaccttgaagagctgattttggaagaaatcaatgatcctatggaagctgagattgaagatgagattgaagctcaacttcaagctcaaatgcaagcacaacaagctggtcattctaatcgtcgtgggggctacaaacgaaggtacatcaatagagatcaccaagacgaccacaacagattgtttgcaaaatactattctgacaatcctttatataccgatgatcagttccgtagaagatttcgcatgagaaagcatctatttttgcacattgttgaagctcttggcatttggtctccatatttttgtttgcgaagagatgcatttggcaaggttggtctatcaccgttgcaaaaatgcacagctcccatacgcatgttggcatatggtacaccagctgaccttatggatgagacttttggggttgcagaaagcacagcaatggaatgcatgataaattttgttcaaggtgttagacatatatttggtcagcaataccttcgcaagcctaatgaacaagatatccagtgtttacttcaacaaggagaggctcatgggttccctggcatgttgggtagtcttgactgcatgcattgggagtggcaaaattgcccggttgcatggaagggacaattcacacgtggtgattatggtgtacccactatcatgcttgaagcagttgcatctgctgacctatggttttggcatgcatttttcggtgctgctggttcaaacaatgatatcaatgtgttggatcagtcaccattgtttactgcagtgctacaaggaagagctcctagtgttcaatttactgtcaatgggacagaatataacatgggatactatttagctgataatatttatccagagtgggctgcatttgccaaatcaattactagacctcaaagtgacaaggctaaattgtatgcacaacgccaagaatcagcaaggaaagatgtggaacgagcatttggggttttgcaaaaacgttgggccataattcgccacccagcatggctttgggaaagggatgaactagctgatatcatgtatgcatgtattattttgcacaacatgatagttgaggatgagagagacgattatgtcatacctgatgacaacacatatgagcaatcacaatcttctgtacaactagtaggactcgaccatgggccaatccatggatttgcagaggtcctagacgcagacatgaatattcgcgatcgaacaacccatcgacgtctaaagtcagatttgatggagcacatttggcagaaatatggtggtcaacaacaacaaaactagagtttatttgtgttatgaaacttgtgttcttttttccatttttctttcagtcgtccaatttattcttattagtaactgagactctttactttttcatgcactaagagtaatgtaccagtaccattgccttaattagtcaagcacaagtcatattgaaaatatcatgtttttttgtcatttttttttaatttcagatctgttggagcacaactaaacactatgaaaattccatcgggatcgaaatcaacgattcacatgatgcatacgtacaaacagaaaaagaatctgtagtagcagcacttgcacatatttgatgacaaatttaatcgtagcagcagcagcacttgcacaaacagatataaatttaatcaccgggcaaaccaaaagcaagaagagattccacaacacggaaaaggagaggccacggaatcaatcaccttgtctctaacgcagaactcacggacgatgtaggcgaagttgagnnnnnnnnnnnnnnnnnnnnnnnnnnnnnnnnnnnnnacttcaagttngtggcgcagacgagacagaaaagcacgcgtcggcagcgtcccggccgaagtagttcgcgcatgcagcgtcatctatgggtgagcccgcgcgcggcaacgtggcaccgaagccacggcacagcgaggtcacagcccaaggaggggaggccgggaggagcagcgacgtttgcgcagccacgggaggagcaatcgtcggagaaattggggatccagtgcatgcgctgtgggagaatttggggatcgagcggagcgacgaagagaggaattggggatctgaggcggaggaaatggggatcgaacagagtaacagtggatgaggattttttttcactcgcgcgaacaagcagatggttaggagtgatctgtattctttttctcccgtggggcccagcgggacccaccttatttccatcaaacaagcagtatcattgtagagatttccttaactattgctacctgtagatgggcccactcttgttatgcattttaccatatacattggccttgccctaagaggtttataaaccctaggaaggaaaataactaggctgtcatacttagggttagttcgttttagcaactcgggtaagattttccatagtgccgaaaacatggaagatcattgattaattagctattacaaacttgaagaatgagtttattctatttttttaaaaaaaacttttatatacaatttttttatgaaacgtgccgtttaaccgtttgaaaagagaacgaggaagttgctcaccaaagttgctaaactaaactaagccttaaatatcttaacaatgcgagatggaattgctagcgccagagtttacatgtttctaatgctacacaaataacatgatgagttgatgacatacggtttatatattacttcctctgtcccataatataacaatttagtaccggagaagacacttcatagtacaataaattcggacatgctttttatccagattcattgtattataaagtgtcttatccaatccgagattgctaattataggacggagagagtacaatttatacttaatcgaaataaatatacatgtatttgttacacttgtactactagtactaggagtgcagttactactactgcaggcaaggataagatggggagcagatgaatgatccccgcacataggactcccctccacgctgctccctgtccgccaccctgcagcttaatcatgacgtgggcgagatgtcgcccggccgcctgcctgtacccatcaatgcccaatcatacccccaccaccaggtccaccaccaccaccggcgtcctctccttccatcccacacatccatcacgcggccgcacgcacaccagctcacgctgcctcgcctcatccaacctgtaaaaccccaaaaccactctgagggcaagtattatggtatatgggcatctannnnnnnnnnnnnnnnnnnnnnnnnnnnnnnnnnnnnnnnnnnnnnnnnnnnnnn

SEQ ID NO: 2493 - DNA, 2251 bp, Oryza sativa
cgctgaatcgcttctagaccatctgatgacaatccacaacctgctcgcctccgccctggcgcacccgacatctcctgatgtgcgcatcgccgcgttgagcgctgcggttaacctcgtccagtgcttgcccaccaacgctgaccgggataagatgcaggatttgcttcctgcaatgatgagggcgctcacggattgcctaaactctggtcaggaggcctctgcacaggaggcgctggagctgcttgtggaactggctggtgcagagccaaggttcctgcggcggcagattgcagatgttgtaggtgcaatgctgcagatagctgaggctgcacagctggaggatgggactaggcacctcgctgtagagtttgtgattactctcgctgaggccagggagcgtgcaccaggaatgatgcgtcgcctcccgcagtttgttggcaggttatttgcagtgctcatgcagatgttgcttgatgtcgaggatgatcctgcttggcacactgcagagacagaggatgaagatgcgggtgaaggaaataactatggagtagcacaggagtgccttgaccgtctagccattgctattggtgggaatgcaattgtgccaattgcatctgagctgctcccgcagtacctttccgctcctgagtggcagaagcaccatgctgcactaatcacacttgcacagattgcagaaggatgtgcgaaggttagctaaataagttcatgcttattgtgactactatgcaatagaatcactacaaaaaccagttgaaaagctgaaggtattttattttgctgcactgggtaaaataaaatatacaatagctcgtttaattaggtaattcgaatcggtgtgatgtgataatgaatcaattgccttcattgatttctcatgttcaagtgattataaacactgaattttaggtgcacaagagcttttggcgagtattaagacacaaaaatgctacccattgtttcattcatttgcaagaagcagccaaaatagctatttactcaactgtttgttctttgcaggtgatgcttaaaaatctggagcaggttgtttcgatgattttgaatggatttcaacatcctcatgcacgtgtgcgttgggctgcaatcaatgcaattggtcagctatctactgatttgggtccagacttgcaagttaattatcaccagcaggtgctgcctgcattggcaaacgccatggatgattttcagaatccacgggtgcaagtgagtgttcaaatattagtgctagacttgatctagcacacccttttacacatgttctttgctttatttataacatcttttgtggcctacaatgttcataaggacaacgcttattgactcacttacctgttagactttatgaagaaaatgcttcaaagtagatagtgggctttacataaaagataatgctccattgatctacttagacatctaggagtgttcttcaattagttaaattattttatctatccatgttctagttgggctaagtttactttcgtggggttagatgaacatcaacacgaactatccctgtctttcagattttgtttctatccttgttaaataagataatttggcattatattcaaaaaatatgtaacacgtcaatggcatgaagtatgatttataaacacattaattcaggttttttaatgaacttttgttccatatacaattttcaagtgttactttttgatatacagttttcaaggttttggcagttttggggtgcctattatacatacaaacttaacctacttttattatgcttattaggaaataatatgtctggctgtgttactatcattcacaggcacatgctgcatcagctatcttgaatttcagtgagaattgcacgcctgaaattctgacaccttacctggatggaattgttaccaaattacttgttcttcttcaggtatccacctccctcaccagttaaatatattttattgtcttttagtgttatttttttgaactagtagaacatgtgctaatatattgtacttatgctttagaacggcaagcaaatggtgcaagagggagcattgacagctttagcatcagtagctgattcatcgcaggtaatttgtccatgtataagttagcttaatttcttatagggggagggggacgcaacattaccttttatacttatcttgatggttaatgagagtttataatattgtgttaaataatgatgtacttgtcttgcaggagcacttca

SEQ ID NO: 2494 - DNA, 678 bp, Oryza sativa
  unsure (1)..(678): unsure at all n locations
gagctcggtacccattacagtttaaggaaagaatacctatagataccttgaattttggagcccctcattggctttataacgacacacttagttctatacatctttgaacatatctcgttgaaccttaatgtgctgcagtgtccactcaatcaaaagccaaccctgaacttctaatataagcttttgcatttgtccaggcgggctatgatggaagtgttctgaagctgcgtatccccttccctaggcgtgcacaggacaggaagtgagtccccgcagtcctgcactgcgttctcttaagccttttatctaaacgtccgaatgatactttataattaatgtctatgatatgattatttcaaatatagatatcttgagactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2495 - DNA, 674 bp, Oryza sativa
tttattggaaatttcttactgtcatttttatattaaatgctggatcatgaatatgatcacttcgatgaatcctttgtgacagtttcatttcttttcagtctcttcatggcatcacttgtagcaacactcgcatttctgttgtatgaatatgattgctgccttgttaagagagagtactagttgtaaacatcgttgccggctaggggtgaaaacggtatgaaaatttcccaaccatatcgatatagtttccacaaaactaatataataataacatttttaccaatggttaccgtttttaaaatttagtttttttaatttctatcagcgtggcattgaagttggcactaaatagataaattcataaatatgaaaatttcccgaccgtttccgttcgttttcgagaaaataataaaataatgataccatttctgaccgattcattcctagctgccgcggaataccagcaagcaacaaagcaacaattccgtgatgggaggagcgatgtgggtgagtagagcagtagagatccagcaaggcagcaatcactcaaactcgagaaaatggacatttggccatgttcaaaaagtactttttgctgaaatgctatcccaaaaacacatttcgctagcatttatgagagatgatggagcttcatctgcagacttccaaagttc

SEQ ID NO: 2496 - DNA, 2753 bp, Oryza sativa
  unsure (1)..(2753): unsure at all n locations
nnnnnnnnnnnnnnnnnnnnnnnnnnnnnnnnnnnnnnnntcattatgtactgaactagtgcttagcttcagatctcaatgaaagaaaagtcaggaattgtgacccacgacttcatattcagaacttcgaattctcaaataacattgtgcatttacacgtgctcaattaaaatgaaaccgatattcatccatgagctatgatacggggttggcgttgcaagtgattgatcggattacccaggaggggtagcattggatggaagcgaggctcaggatcctctatcttcaaaggtacgtgcctttgtcacttacatgtggacccaataaaccatgggcccacttgtcagtgacaaaagcatggtgcatttgaaggtagaggatctgaatcaccatctagtccttttcactgctcaccttgaagtttctattgtctgtaacaactttgtatggctttgttacctgtatataagtatattccctagtgatcatctaggcgagttgcaaatgaactttttttttctacatcttccattttgtattataagtcatttttattttggtcaaagtcaaactactttaagttaaaaaaagtttttagataaatgtggtaatatttacgacatcaaattagttttattaatctatagttaaatatattttcataatatagtaatgggttaaaaatattactattttttcttataaactcagtcgtactttaaatcagtttgatgttggctgaagacaaaacgatttatagtataatcttttaaaacggagggagtactaatactagtactaggggagtaccaacgtggaaagcttttgcctgcgcgtttgaaaaaaaaaaaggttggtgcgacgggcggacggggccagcggcgtgctgtttcggcagcgcaacgggcgggcggggccatgggcccatgcgccgtgcaaagcgcgacggtatgcgcggttaacgaaaggccgatgcgtgtttttatccacgaacggagggagttggtatataagcagccaagcagggcgacggcacaccgcccacatccacacacacacccacgattccccacaaactcaccggccatgtcgacgacctcgccgagggcggaggaggacgcgaaggagacggtgaagccgatcttcatcacgctcaaggtgatggaccaggaagaccggaggatccgccacaccatcaggatggccgacaagctgcaggtggtcatggacatgtactacgccaaggcgcccgatgtcacctacggcacggggaccttcctcttcgacggcatacggctgaagggcgacatgacgccgatggggctcgagatggtggacggggacactgtcgatttcttcccggttatgatcggcggcggaggatttttccaatgcaatcttcttcccagttctcactagtagtctacgactgtcgccgccgagcgtcgtagactcgtagttagaattgttcatcctctgcgatttgccgatcgtcgtagtttgcaatttgcagtgttttatttcctcatggcagcagcaatcgatgttaacattgaatcagttgttctgggatgattaattatggcaacagtagttgatcttggcaagtcactagcgtcatttaatccactcaattgccatgcaatgcatccgctgatccgccatagcctataggaaaccccttcgatgatatcaccgtgcaattactgcggcaacatcaaggttcagttctgagattacgcatatcgccagttaattaaaatcatgctcttacattggcatcatatattcatatatgctgattgaacagcaaaggaagagaaatattatgaatatggatcacgttgtattgagtcctcaggagttggtaactcggtatatatatagcaaattacaaggataaagataaggataacttcgagatacaaatcaatcctatcctagctaatggagtactatctctagttagaacttaacaatatactacataagagtacgtagggtgaaatccatggcaacgcaactactcagatagctacgcaagtacacctacgcagatagctaaaacaccggaggcgatgtacggctggtctggcatcccagcggcggtgaaggtggagaaggagaacgaatggaagacgccggcgacttgggaatggaaggcgccggcgaccagggtggccggggaatacgtcacgctgaaggtgcagggcaccgacggccgcgccgtctaccgcaccatgctgcggacggaggagctgcagggactgatggacttctactacgaccgctcgcatggccgggtgcagcgcggcacgggccggtttctgttcgacggccgccggctgcgcggctggcagacgccggcggagctccagatggaggacggcgacgaggtcaatttcttcgaggagttgatcggtggcgccgccggatctggatgggatcccccatcgtcgatcctcgcgtagcttgttcctggtagttatggatttagtcttttagatatgaacactgctacacatactatttttttcttactaaatctttactaacaatcatctcaaccgtttaatttagatagatagaagttataaaaaatctagatacacttactggtggagaaaccatctttgatcggtcgaccaaattccacaatagtctcggttctatttaaaaccgggactaaaaacgattttttagtcccggttaaaaaaagtctcggttccatttaaaatcgggacccggttaaa

SEQ ID NO: 2497 - DNA, 1199 bp, Oryza sativa
cggatccacttttgtttctgagccattgatctgcgagatcctacgaacgatattcctttcacgatcctcccacgcgcgacccttccctcttcctcagcgagaaaaaaccgctcctcctcctcttctccgcgtccccaccacgtgctccacctccggggccccactctcttcgttgcgcccccaccacgccccgcgtgcgcgcctcccctgcctcctcaactcctcgtcatcgtcggttcccctgtgtgcctccctcgccgccgccgccgccgggggcggttccctactctgcctcccccaccacgccttccacatcgcgccgcccccatcgccgcgcccccacaacgcctccaccgtcggcacccccatcgcgacacccctgagctctgcatcgccgccgaccgccgctcctgctcgccctcatctacgacgccgccgtcactaccctctcttcgctgcgctgcctccctccccggcgtccccatcccctcctcgccgcgccacttccccatctgccgccccgcctgcttacctccccggcgtccccatcccttcctcgccacgtcgcttccccattcaccgcccccgctgcacgcctcacgccgcaaccccgcagcggaacccaccggcgagctaaccgccgtcccggcaggtcgccgtcaatcgccgtcgccccgcaggtcggcgttgcactgcagagggatttccccgccgaacggtcgccgcagcaggtctacgccaccttcttcccacgccgactccatgtctaatccctacctcaccacaggtaggcggcattgcttctgctaccatcttcctcttttgtgtttcaatcaacaaccgtttgatttatttctgaatcaaatttcctcttatgtttttcaatcagcaaccgtttcttgatttatttctgaatcaaattttcttcatgttaatcacttcacattcctgttaatcacttcactaatgagagttaaaaataagattctgagattaactctgagaacagcttaggaaagttgatattcacattaatttcagaacatcatgttccttgtgaataaatagtatgatcttcaagcacttcaagcaactattatgacttgtttgttttccgcattgtagtttcaacttgtggttccagctgaagcaattggagatttattaaatctaaggctacatgctaggctgctatgagg

SEQ ID NO: 2498 - DNA, 816 bp, Oryza sativa
  unsure (1)..(816): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagacttgcaagttaattatcaccagcaggtgctgcctgcattggcaaacgccatggatgattttcagaatccacgggtgcaagtgagtgttcaaatattagtgctagacttgatctacacacccttttacacatgttctttgctttatttataacatcttttgtggcctacaatgttcataaggacaacgcttattgactcacttacctgttagactttatgaagaaaatgcttcaaagtagatagtgggctttacataaaagataatgctccattgatctacttagacatctaggagtgttcttcaattagttaaattattttatctatccatgttctagttgggctaagtttactttcgtggggttagatgaacatcaacacgaactatccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2499 - DNA, 750 bp, Oryza sativa
  unsure (1)..(750): unsure at all n locations
nnnnnnnnnnnnnnnnnnnnnnnnnnnnnnnnnnnnnnnnnnnnnnnnnnnnnnnnnnnnnnnnnntaaagggccgatttgaaaggttttccctatcaaaatttttacaagaactaaaatgcaccggtagtttctcgtttgaaatccgaccaaatcttttggctgttcctgaaatttataaccaatatcttcaattccaactggggggaaattactgataaattatgaggtcagtccaaaagttcagtttaacctgaattattaacgatttatctgcaacttgcagctccaaatggctgagctccacgagagcagaagaaatactgctgttgcttacgacactggaacatacaaacgcacgcaccatgacaagaagaggagagattttctattgcaatggtcaggaaaaggccacagaactcctggacgagcctaatatattcagtaaagaatgcanagcaggtgagaactgaaaagagcangtgacaacctcatcttatgaaaaagaaaaggtgctcagctactaataaacttgctcagatatgactcgaatcaattggtagttatttgaagcatttccggttgttttgcttttgatttatatccttcgacaagacgggactcgaaagacagaatcagggtttgcaaatgcaatcggacaatcggtagtcgaaaactgcttcatactggtttcgtcgataaccatgataacaaaccgttactggccagaatcagacaaatttatcaata

SEQ ID NO: 2500 - DNA, 701 bp, Oryza sativa
  unsure (1)..(701): unsure at all n locations
nnnnnnnnnnnnnnnnnnnnnnnnnnnnnnnnnnnnnnnnnnnnnnnnnnnnnnnnaattgctccgtaacaatctgatttgaatttgagaaaccccatataataaacttttcactcgtcatcaccgcgtgtcgtcgtctgaaatttgagaaccgccaaaatttttacttggcctccctctcgtcgtttctccagctgcccttcatcctcggccccgtcgggccctcgccgacgaagacgctctcgacgagcttccgcagccgctccctcgtcgaccgcggcagcagcttcgccacgcggttgatctcgcggccgatgtcgtactcctccctcggcccccactcccggtcgaacagcagccacgtcggttcggccacgccgccgccgccgccgccgaggtactccgccgacaccacctcgcaccgcccggcgccgccggtgtccagcctgctccccctgtcgcagtcgttgcgtatcccgacgcccagcctcgcgtcgccctgcagcaccagccctgccctcgggtacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttttcca

SEQ ID NO: 2501 - DNA, 1029 bp, Oryza sativa
  unsure (1)..(1029): unsure at all n locations
nnnnnnnnnnnnnnnnnnnnnnnnnnnnnnnnnnnnnnnnnnnnnnnnnnnnnnnnnnnnnnnnnnntgttaaattttggtgtacttgtcttgcaggagcacttcaaaaaatactatgatgcagtgatgccatacctgaaagctattttaatgaatgcaactgataagtccaataggatgcttcgtgccaagtctatggagtgtataagtctggtcggaatggctgtaggcaaggataagttcagggatgacgcaaagcaggtaattgtgtcttctccactgtaattttgctctgtatgctatgttctatgcatgcacttttctaatctacacattgattgataggtcatggaagtacttatgagtttgcaaggaactacaatggaaaatgatgatccaataacaagctacatgcttcaggtacacataaaacctattatgaattaatcataataaaattcagatcctttgtaacattttctcctttatgtgacaggcttgggccaggttatgcaaatgtctcgggcaggattttcttccgtacatgaacgttgttatgccaccactgcttcagtctgctcaactgaagcctgatgtcacaattacttcagctgaatctgatgatgatatagaatcagatgatgataggtttgtgcatcttcttcaattgctatgttttatccactgaattaaatatgcccttaatattgatgctgtgtcagaggcattctatttaaatttatctatggttcattctttcttaagaagtactatttgtttctataccatactgaatgtaattacatacacttcgttcatagaaggttcctttttttcgtgaaactcgtgcctgtttatatttccgttatcaacctttttttttttgggttagtgggactgcaacttgcaatagctaccttatgcttgtaatatgtttccctattgattatcttttttcttttgcaatttgatttgttcagaaatatatcatccttttttatgtgaggtgtggtggttgtttttagcttc

SEQ ID NO: 2502 - DNA, 3355 bp, Oryza sativa
  unsure (1)..(3355): unsure at all n locations
cactgcgataatatacttggccgttcctcaatttgtgaaaggcctgggtttttttatcgctcactattttttttaattgagcagctctctggtcgactccttgatgaaaaccaagtaagagctgtttcggatgagataaaaaatgttattatagccagcgctaccaggaaaagagaaaggtcagagagatcaaaggcagaagattttgatgctgatgaaggagaactactcaaagaagagaatgagcaggaggaggaagtgtttgatcaggttcgtgtatctcgtgactcccagcggctgggagtcatgtaacattaaaagacttaacttttgttagatgaatatttatattggacaaaaggggactgtatgaataacttcttttttactggatggaatattagtcttctaaaagttgattctgttaacactagtttttaaaataatttacaggttggagagtgccttggtactttaattaagaccttcaaagcttcttttctgccattctttgatgaactgtctgtatacatcacacctatgttggtaagtcagtggaatcctgcatttaattgtgtgtttggatttgatttatttttacacatacaagttccttgttagatctcactctagtatttttttttagttctaccactacattagttaccactactttaatttcttgatttgtgcctgttagcatgatatttcatccaactcttttcttctatcctgaaagttcctgattgttttagtggtttacattatatcacaacgcttcattttgaaagattttccatatgcccgacagcctctcaatattcattttgactgtttatcatcagtttattgtgaaacaaccaaggaagacaatgacatgcatatcttgatttgaactgttttattcatgaaaactcaaaatggatatgccaaataaaatagtatgtaagaattgtttccttggatatggctatcaaattatcagtgactgcgtggacatttttcttctcacgtgttaacgaaaagattaatggttattatcacttgtgtttaccagtattatcacttgcatgttttctagtcttagttctattgagctgtgttgattatttcttgttttgttgtttactgctcattcatttcttgtgtcattttaatttggcagggaaaagataagactgctgaagagagaaggatagctatctgtatatttgatgatattgcagagcaatgtcgtgaatctgctctcaagtatgttcctcaaagctatttggttggatgcagggcttgtatttgtaactgaattatgtattttcctatctgattaggtattatgatacatacctaccttttctgctggaggcatccaatgatgagaactcagatgttcggcaggtataaatatttatgttttcctgtcccttcatccatgtcctattgttatatttggccactaatgttgtgttgaactgccaacttattctttttaggctgctgtctatggtgtgggtgtatgtgctgaatttggcggtcatgttttccgcccacttgttggaggtagtcgggtcatgcttacatcactttgtagtttgtagtactttaccatgcattttcaaaaccaacccactaatttggtgctttcaaaatcagaggcgctgtcaaagttgaacaatgttatcacacatcctgaagcaaagcatgcagacaatataatggcatatgacaatgctgtttcagcgcttggtaaaatatgccaattccatcgtgatggtatcgatgcagctcaggtaagcatatctcacatagtcacattcagtcagttaaaacaactgtcattgttttgttatatatattctgtcttctgttttctatccaaccatattaacatgtgggctaccaagtgaatggaaagggggaaaactactttcctttattgagggaggatgaaatcctgctagaaaatctgtgcaaacttagtaggaaaaatgaattgaaatattcttgacagatattttctgtttgtggagcaaactttacaaacttaaatgattacggagtaggtcctaaaatttgtatatgcttttcaagattcaaaaaaggtccaaatcttgtttgcttgtatggatgaactgacaccttaatagatctaaactgttctttcatgccgttcatcaagtgaaatcaagcctttggatatagaaggaagatttatgtctttcgtcagaatgtactacccttcaatatttcctagcaaacacacagtcaagcttttagttatatgcaatcaatattccttggtccttgccatcaattactaatagctaagttggttttggatctgattttgcattcatacaacttggcatccttaaaactgcaaaacaaatccaaagttctactgaaaatatgctttgcgtaaactgttgaagaacttggcactttattgtgtctgaatgtttttcaaaatgaaactgctctgttcctgctagtgttgtgtgtcctaatggagttatggttgtttagtaaaaaaagtagtagtgattttccaaaggaatagttgagaaacctgctgcagagtatggagttcaagctgaaactgaaccaattaaataaccagtgtaaaaccagtagttgtgcttgtccctagatttagtctgaaccttgttttcagctcccgtaagaccatatattgctaaaaagatacatgttgtattatcctcatccaatgtattcatgctctttaggtcattcctgcctggcttggttgcttgcctataaaagatgacaagattgaagcaaaagttgtacacgatcagctctcctcaatggttgaaaggtatctgctctctatggatgacatgccaacaatcataactttttgttgcagtttataatgaccttgtctgtgtgcagatcggatgcagatattcttggtcctcatagccaatatcttccaaaaattgtttcaatttttgcggaggtaatttctgacttgtttcctatattatggtgtggggcccttttcccaaaggaaaacagagacatcaagacggattcctgtgttcctggtttagtttggttctctgtgataatttgtcttggaccttttgtgtactattagcatggcaatttcaggctgttactgctatagcagcaacatagctgatcctaggatcaaaactactatttattactatgtgcattttgtttttcatttctttgactcagatgctgtaaaattcataaatgaatgctgtcttgggatttctactgcaggttttatgcaacggaacagagnnnnnnnnnnnnnnnnnnnnnnnnnnnnnnnnnnnnnnnnnnnnnnnnnnnnnnnnnn

SEQ ID NO: 2503 - DNA, 1147 bp, Oryza sativa
  unsure (1)..(1147): unsure at all n locations
nnnnnnnnnnnnnnnnnnnnnnnnnnnnnnnnnnnnnnnnnnnnnnnnnnnnnnnctatgtgcaaatacatacttcattttccatggacacacagtaacatacaaaaatgacaggatcatatgattgataataattcataagtagacaggccatgatttgattaaacccatttttagataatgtataaaatcgaacatttgcttcaacagaaactacaacataatttgaccaaacctggaagactgaaactgatactctgaaagtaaccccacaggggcactaccattggcatgatgcccttacaatatttctcacaaatcctctataaattctcacctttgccaaatgccaaccatcaagccatcaagcagagagcaagcagttggcacacagacacctgtgtctcctaccctaactctctcaaaccaaaacatcaaaaaaaccaagaaaaaagcacaagctcacacacaaacacatggagctcaacttccaagtgcaacctccagtgttccagctgcaagactactgctactactacagccaagaggtggcggcggcggcgtcgccggcggcgaagccgacgaagccgcgggggaggaagaagggcagcacgagccacagcaagttcgtcggcgtccggcagcggccgtcggggcggtgggtggcggagatcaaggacacgacgcagaagatccgcatgtggctcggcaccttcgagaccgccgacgccgccgcgcgcgcctacgacgaggccgcgcgcctcctccgcggcgccgaggcgcgcaccaacttcgcgccacgcatctcgccggactgcccgctcgccgtccgcatccgcggaatcctccaccacaagaagctcaagaaggccaggtccgccgccgcggccacggccggctcccccggcgccgcatccaagaagaggtccaccacggcggcggcggcggcggccactccgacgatcacaaccacaagcaatagcaatagcgatggtgcgggtagtgcttgtggtggctcgagcagcagcagcagcagcacggacagctgcgacggcgccgtgaagcaaggcggcgggggcggcggcgcaccaacggacgccagcgaggtgtaccggccggacttcgtccacgcgggcgccgaggagtt

SEQ ID NO: 2504 - DNA, 8118 bp, Oryza sativa
  unsure (1)..(8118): unsure at all n locations
ttttaagtgcaatgcagataataaatactgttgcattgctataaaaaaaaccctgaaacttgtgcaagtttattgtgcactgacaagttaaaacatttgaaatattttaccgcccacaaaaataaaagggccgatttgaaaggttttccctatcaaaatttttacaagaactaaaatgcaccggtagtttctcgtttgaaatccgaccaaatcttttggctgttcctgaaattctataaccaatatcttcaattccaactggggggaaattactgataaattatgaggtcagtccaaaagttcagtttaacctgaattattaacgatttatctgcaacttgcagctccaaatggctgagctccacgagagcagaagaaatactgctgttgcttacgacactggaacatacaaacgcacgcaccatgacaagaagaggagagattttctattgcaatggtcaggaaaaggccacagaactccgggacgagcctaatatattcagtaaagaatgcaaagcaggtgagaactgaaaagagcaggtgacaacctcatcttaggaaaaagaaaaggtgctcagctactaataaacttgctcagatatgactcgaatcaattgttagttatttgaagcatttccgtttgttttgcttttgatttatatccttcgacaagacgggactcgaaagacagaatcagggtttgcaaatgcaatcggacaatcggtagtcgaaaactgctccatactggtttcgtcgataaccatgataaccaaacggttactggcaagaatcagacaaattttatcaataatttaattctcgctttgggttttattgaaattgtaggcttaccaagcaatttctaaatctaaacaggtcaaataagactagtaaccatgataaccaaacaattatcgtcgcattttggaagtgcgcacgtttcctaaattgctaaacggtgtattttttaaaacttttctataagaaagttgctttaagaaatcatataatttatttttcaagttttctttaactaatacttaattaatcatgtgttaatctaccactccattctaagtgttgaggggaaaaggttccttacacgcttacacgcttgttcggtacagaaaactccatgttgaacagttctaaaatgtctccagcctcctgttttgggtgaagagagcaggacaaagaattagctgcttcagccttcaaccaccgcaagtttgagcctttgatttgaatatttgatccgccgtgtcagccagtaatctcggttgctgcgtgcgtacgcgcgggaaatagccggccgaatgtttgcggcccagcccagaatgttctcatttcgactcgtgggccgtggcttggacacgtggttaggcggcccaaagaacacgtagatatatatgactttgggcttgggccatgacgcactgcctgcctgccgagtggcgactcgcgagggaaaaagatagttataattaactgtcaaaaccaaaaatactccatccgttctaggaggttgttttctttggacttattccatccgtcctataaaaaaaccaatctaatactggatcaggactacctatatatttatcgataaattttcttctgaaaatttgacaaatgtaattatagtacaatcgtagtataattgcactgtaacttgcatgtaactacagtgtaacttgtatgtaagtttccgtaattttgaattgttagatctattataagatttgttttggcgaagaagaaaaaaaatcacaacacacacatatgtgaaaggatttgttcccgcgatctctattttaccgaaataacatgttacgaagagatttttgaaagttatatacaagttatattatagctacagtgtaattacatgcaagttacagtgtaattacactacgattgtactgtaattacatctgtcaaatttttggaggaaaatttgtcgacaaatatatagcaaaattgcatcctaatacaacaagtttagacatacatctgtccagattcgttgtactagaatgtgttatatctagtcctagatttaaatttttttaggactaagggagtactaactatcagaacaatactgaaaatggtattcgcgacgtgatagcccggtcatagaaaaattaaaaatataaagtgaggcccatctgtcatcctacactatttctctccttccttctctaccggacttccgcggcgccgcaaaagtacgaaggcaatgagtagcggatgtacgcgtgcgccgtcactggcctctacatcctccaaccactccgtcggcttccacggcaacggtgaccaccgaccaccgcctcccgcttcatgcccaagtacccaatctggagactggagccactggacctcaggctcatctgtgacgaggagccagtcgagagagttggagtccgggagagcccccatgagaaggtattcgagcggctaagccgggatggtgccatctccaccgtcgccgccaccgtcaccgtcaccgtcaccggcgctgccagtgttagcctcgacgttgcctgggtgtccgacctcatcaactgaggctgtatgtctgatgtcactattggagcagctccaatgtgtgcagaaatcgaactgagtatatcggagacagcacactgggagagtcgattgttgtgtgtcagatagcaaaatcgatctccaaaattgagttagtgttagacaattaaagtattatttgttgctgatggggttgaacatattcgagcccaatcaaataatttacattttccccttaacttttcttgctgtatgtgagtcctataaatcgatgtgcacactgcagccaccgaaccaaagttgcattcgttgttcacgaactacagtaatcgaacatacactggagctgcccttggaagctccttttgaagtagtactaaatagcaaggattgtcatggaaaagtggcggtaagaaggtgagtatgaataaaatcgtttcagacctacggaaaaacggtacggctaaaaaaaatgatctccatcaccgtcctttaatgaaatagttaaacccatgctcgttcccggagacgaaagtgaggagacacagttaatctactttaggttcgcatcacccaccgataattcacctcacttgatcctatgacagctaaactacacagcgacaatggctaagcataattggtaccatgtgatcgtgactacagaaaaacgggaacaggccggccttgggaggcttgaatatgtgacaacctgtttcaggtatctcgaggctactacctgaccaaccaaagtcccgtactcccgtcccaaccagcagatatccactggcgctgcggtgcaccagccagccgccagatcgcttggttccaatcttctgtagtgcagatcaaggacaccctattaaacatgtaacggtgatacaggcatatggagacaccacattgggacaaagggaataccaccagctatcttcctgcatttgcttgctaattaccccttgaaccgagctcagattggtcctgtgaacgtatggatccaagttgctgatctctttactcgagctcagatttgtagctcagagtatcagatatttaggacctagaagcagtagatgctgccatccttgtgtttcttcagcatctcatgtttcacaattcacatgcaactaaggagtaaacgcgcagagagattaatagaagaaagcatccatagctccattggaccatgcatagagagcatacagttttgcaattcagctcagaatggcatatgtaccaagcttgggggggagtagcaagcaatgcacagcaaaatgggaagatatgaacaatcatggccaacgaggggctaacaacagtttagcacagtacaaaaagtaaacacacataacaggaatatgcaatgcaacggaaccggagtatactgacaaaccaatcattaaccagagaactacttattaaccagctactaatagtcttctccatcgtcgttctcgtcgtctgcaccctcggcgccgacttcctcatagtccttctcaagggcagccaagtcctcacgggcttctgagaattcaccttcttccattccctcaccaacgtaccagtgcacaaacgcacgcttagcatacatcaagtcgaacttgtggtcgatgcgcgagaaaacctcagcaacagcagtgttgttgctgatcatgcacactgcacgctgaaccttagccaggtcaccaccagggacaacagagggtggctggtagttgatgccacacttgaatccagtagggcacctttgtggaggaagagaagcaataaacagttggttagccaatcaggtgttgataaacaagtggataggttgcctgtgattaaaataagcgcaactaaaatagtgatgaagacagcttaccagtcaacaaactggacagttctcttcgtcttgatggttgcaactgcggcattgacgtccttgggaacaacatcaccacggtacatcaagcagcaagccatgtatttcccgtgcctagggtcacacttagccatcatgcttgagggctcaaaaacagcattggtgatttcaggcacagaaagctgctcatggtaagccttctcagcagagataacaggggcataggatgaaagcatgaaatggatgcgagggtatgggacaaggttggtctggaactcagtgacatccacattgatagcgccatcaaacctcagagaggtggtgagtgaagatatgatctgtgagatgagcctgttcaagttggtgtaggttggcctctcgatgtcaagggatctccggcatatgtcatagatagcctcattgtctaggagaactgccacatcagtgtgctcaagcaaggagtgggtggagaggacactgttgtatggttctacaacagctgttgagacctgcaaaccagagtggcataagacgagaagataatgatatgatgaactttaaataattgtacaacaactctacccaaattgtccccacaacagctaagacaaagcaaacccactcatcacatgaacaagctgaaaggcccacatcacatggaaagttggtacagtacactaggataatgctggctcatacaatgcatggtattacagacttcgcgaagaagactaatagtccataaaagttcactaaagagtctacataagatagggatattgtatagccatataggtagatccccaccagccaggcagccaggccagcagtttattagtccacatactaattagagaatggttggcagatccaataatcaatatattgccatgcacaactcacaacaacaagaaaaagaagtggctgataacatggcccatatctaagcaggtgtccaaataaattaattctacaccagcctgaaaatttcaagtttctggtatagagcattttatttaattttttccctcagagtacaactaacatggatcagattaagttatacctggggggaagggtaaattgtgaagccaagcttggacttctttccataatcaacagagagacgctccaacagaagagaaccaagtcctgatccagttccaccaccaacagcattgaacaccaagaatccctgcagcccagtgcagttgtctgccaacttgcgcacacggtccaggcatagatctacgatctcctttccaactgcattccacaaacaatgagaacaagacacatgcacagttgcaatagaataacacttgtatgaactctaagctgaattaccagtgtaatggccacgggcaaagttgttagcggcatcctccttcccagagatgagctgctcagggtggaagagctgacggtacgacccagtgcgcacctcgtcgatgacagtgggctccaggtcgacaaagatggccctgggcacatgcttgccagcgcccgtctcgctgaagaaagtgttgaacgcatcgtgtgcgacgccaaccgttgtatcactgcaccaagagcaaacagcacaatgtttagaaatcaaaactgactgataattctaatcattagcctatgcagtaccaaataaattacagtctaccagagctgcctacaaaaagcgggctacatccatgataatataatggaatctaattctcaggcaaggcagcatgagcacaattgtttatgattcaataatctactcaattcttacaccaagcaaagtaaaaccaacaaaacaaatcctcctcgatagtggaggatgccgcttttaatagtaacccagattaaactctccaatctaggacgatctacgtgctcagtctgacactcagagcttccatgtgacattatttactaagcatcaccccacaagtaaattcgcagatctagaaccgtaaagaactctggaaactcccaattgccaacttgtaaacatgcaaccagcacgcaaatctacagtctactccggagaaaatcaaacgcattcctccatataattccaaacggtaaaaaaaagagcgtaaaaactacggctaaaattcccttcctccgagacgcacggtgttcgtcctgtcccttgcaatcccctcaccaaccggcaaggagatgcaccaaccaccaagaaggttcggccaaaaccaatccgcagagtccaaacgagaagtacaagcggaaggctgcacccatcgttcgctccgccgaagcaaacaatttccccccaaaaaaaacacatacacacaaaaaaaaacagacggcgaaacaaatctggcatttcggacgcaactcaaccggggctaccagatcaaacgaagccggggaacgcggggccgcctcccgagatcaggaacaggaatgcatctacggatcaaagaaaaaaaggttgggggagggggagggggaattcatcgtcacctgggcatggtgccatcgggctcgatgccgtgctcgaggcagtagagctcccagcacgcgttgccgacctggatcccggcctggccgatgtggatgctgatgatctctctcattttctcctccctcctcctcctcctctcctctcctctcctctcctcgcctcgcctctcggttggtttccttcctttggtctagactagagaagcggcctctctctctctctctttctctctctcttctttccaaaatgtgagagatcgggagataaaagggcggaggagagagaaagagagagggggagggtgggaggagtggtggaccgggaccacggcccgtgggctgggctgggctggctgagcggtttgcttttttacgtggaccggcgctctctggacccggttcacggtgagccctcgtgagcgaaacggccatggacgctcttgccaggctgccacatgaacttgacgtttggagtaacggcaaatggagccgccgttttttgtcaccttcttttgcgatttaaagaagtttccataaattgttttaagcaggtgtcatggctataaatgtaaacatgcttttgaaaattatatagggcatgtacagtttattatcataccaatcacatcccaccatgccataaaacatatttaagaaagtaacgaactaaacagcacctgaatttttttaccttgccaattcctgggtattaccaaattgtgctgaaatttactaattgttagaatttggtagcgttgaaaatgatagtaaaatgaacatgccaaatagactacacggttgattagttttttttagaaatttcaccggggggagagcttccccacctgaatttcattaagcaaaataggggggaggtacagtcattacatattgtgagaccttacagcggaggataggagagacttccaggcataaacaaccggcctatcgtctctacgaatacgctcggcccatagagaagcatcttcaatacatttcttaactacacggggaaaagaaacagagagagaacggaatacaacatcatgacgatgattcccagaccccataagcaaagaatgtaaaaaatttggaaatgctgctgaggtagacggcttggagggcggagggctgaaatatcttgcactgaagcgacggcaggggtgacatcaatnnnnnnnnnnnnnnnnnnnnnnnnnnnnnnnnnnnnnnnnnnnnnnnnnnnnnnn

SEQ ID NO: 2505 - DNA, 1580 bp, Oryza sativa
  unsure (1)..(1580): unsure at all n locations
nnnnnnnnnnnnnnnnnnnnnnnnnnnnnnnnnnnnnnnnnnnnnnnnnnnnnnnagagagaacggaatacaacatcatgacgatgattccacagaccccataagcaaagaatgtaaaaaatttggaaatgctgctgaggtagacggcttggagggcggagggctgaaatatcttgcactgaagcgacggcaggggtgacatcaatggacccccaaaaatgttgagcaaactgacagccaaataacagatgcatcgttgtttcatccgcagcatcacagagggcgcatcgcggggattgaacaatctgcttcttgtgagccttagtagggaggcgttctttgatgaggagccagagaaagaattggactcggggaggggcacggttgtgccaaatgaatttccaatggcggcattcatcagtcagggcttgggagtctgagtaaattatcttggttgtgagaattccggttatagctaaacactatgcgtgcgcttgaaaacgtaaagtacacaaataggaaaacgatggactcactgggatcaatttcgatactaccagcaagctagcactacagtgtaggctagccaaccctagataatgtgttgggaatatgcctttaatattttacatgtgttggcatatatttttctgagtgaacagctctttaatattccttaccaaataaaggaaaaccatactccttcatagaaagtttaatgtttattatctccttcagaaaacaatgcacatcagagatgcgatcttggtatatttttgggctttgcttcatgtaccacattttcttctccttaggcttaggacatgtgaccaagataatcaaagataattttacgaatagacttttgtacatccatcctaggctgcgctctattctattcggtgtattttacaaagagtttcaatatataagtttctttttaaaacataaaataaatatattttatttttttaatagttaataatcatttaatcatgtgttaataacacgtcttattttgtgtgcaacaaaaaaaacaaaacctaacaaataaatcgaactaagcccttacggtctgttataaaatgagatggatcattagtgaatgattaattaactagtattaattattacaagctaaataatatatttattttatttttgagataaacttttatatataacttttttacaaaacgcaccatttaataattttcaataggtgctaacgaacaacgaggaagtgaatgtttagagttgttcaaaataaatcagccttaggctacattctactatttaacttttggctttagctactttatcgtttgagtaaacacacattccggactattaataatgtgttggttgcaaaaaaatcctatataaaagtttttttaacaagtcaaataaattcatttttcaagtactataatgttttatacttgattaattatacgctaatgatatgttttgtttcacgtgcaattgaaggacttatttactttgctactattttcaaccttaccaagttttggcattgccaaattttagtaaggttgccaaaattttggcaaggttac

SEQ ID NO: 2506 - DNA, 1647 bp, Oryza sativa
gttcctcaagccaagcaacaaatagtgaggcccaaaactccttttctaccaattttcccaagagttatccccaaacttcagacctagttttctccaatatttccatccttttggtcctccaagcaattaccaaccatatcgacgccctccaatcttttcaaggtgctcagcaacaagaatattatgggcagcctactccaggaagcttggaaggttttcaacttcaagaaaatctggtgcactcatttaaccaagcatttggatttgcagccaatagatcacagtttggtatgcaatatagtacttcaattggggctacagccaacacttctttcatggatcagcttctccatgtcatacaagacataatgagaaagaagtagttgaggttgaagaggcaagtgatagcagtgaagaaggaagaagagggacacgcatcaattggactgaagatgacaatatacgactaatgagttcttggttgaacaattcagttgatcccatcaaaggcaatgacaagaaatcagaacaatattggaaggctgtagctagagagttcaacagcaatatgcctagtaatgggaacaaaaggaaccccaagcaatgcagaacacattgggacaatgtcaagagagatgtcactaagttctgtggattttattctaaagctagaactactttcacaagtgggtattctgatgatatgataatggagaaagcctgtgaatggtacaaaaagcacaacaaccaaaaacctttcaccttggagtatatgtggaaagatcttaaagatcaacctaaatggcgtagagtccttgaagagagtagccataataagaggaacaagatttctgaatcaggagcatatacttcatcgtcgaaccaagacacagaggaggaaacagagcgcaaagagaagcgccctgaggggcagaaggcagcaaaacagaggcaaaaaggaaaaggtgcaccatcacctttaggggataagccaagtcaaaatatggttctctttcacgaagctattacaactaaagcagcagcattgctaaaggcagcagaagcaacactgattggagcagaagcaaaaaaagagaaggcgattgcaaaaaaagagaaggcaagggcagaaaaataccaaatgtatttaaaactgatggagaaggatacatcaacctttagtgaagcaaaactgaagagacatgaaaatgtgttggaccaattagctagagaacttgctgaggaataaatgactagcaagcaatgttagcaattatgcttattttataatgtcagtattcttgtcatatattaaaattatgtactgtgttgatgcttgtactgtgaacctatttgtactgtactatgttatggtaatttgtataaatattgtgtattacagctatggaatgaaactacaatatccttagtacttgagaaatcaccttttcacatggatctagttggtgttgatggttttccttccatccatgaccaatctgttttttttctccacctgaatacatatgagcaataattaatagagaacaaaagcaagagggatgttgacaaaacctaggaaaatatagctgttgtaaaagactgacaaaagcaagagctagctgttaggatattgacaaaacccag

SEQ ID NO: 2507 - DNA, 699 bp, Oryza sativa
taccaagtgaatgaaaaggaggaaacctactctccttattttaggaagaatgaagtcctgcaaacaatgttgtgcgcccttagtaggaaagaagaattttaattattctcgacaaatattttctgttctgtgaagcaaacttacaaagtgtacatgatttcggagtaggtccaaaaatttgaacatgctttcgaagattcaaataaggtacaagtcttgtttgcttggatggatgaactggcaccttaatagttctaagctgttctttcatagcgttcatctagttaaatcaagccgttgaatatataagcaagatttacgtctttcgtcagaatgtaagacccttcaatatgttcccagcaacacacagtcaagcttttagttatacgcaatcaattttcgttggtccttgccatcaattagcaatagctaagttggttttggctcttattttgcattcatacaaattggcatccttaaagctgcaaatcaaatccaaagttctactggaaatatgctttgcgtaaactgttatagatcttggcactttaagtgtctgtatgtttttcaaaatggtgtgctctgttcctgctagtgatgtgcgacccaatgaagttatggttgtttagtaaaaaaagtagtagtgcttttccttaggaatagttgagaaggggatcatatagagtcgacctgcaggca

SEQ ID NO: 2508 - DNA, 503 bp, Oryza sativa
  unsure (1)..(503): unsure at all n locations
nnnnnnnnnnnnnnnnnnnnnnnnnnnnnnnnnnnnnnnnnnnnnnnnnnnnnnnnnaggatgaagggcagctggagaaacgacgagagggaggccaagtaaaaattttggcggttctcaaatttcagacgacgacacgcggtgatgacgagtgaaaagtttattatatggggtttctcaaattcaaatcagattgttacggagcaattctgaaaaacgatgacagagtgcatggtgaaatatattcttttaagataagatttaatcaaacttaaaattccaatcacaattgtttctcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2509 - DNA, 1560 bp, Oryza sativa
  unsure (1)..(1560): unsure at all n locations
nnnnnnnnnnnnnnnnnnnnnnnnnnnnnnnnnatctataagttatcctatgtttatttacacaattgattagttatttatgtagctcataaatttcttatataagggactggaatttttgtgggatagtaaacgagatctactcctctggtgttcttctagtgtttgaacgggtgcatctagtgtttgaacgggtgcacccacaaggagatacggtcgaggaagaagatctggcatggtcgagcgtttgaacaggaggcaagatctgattgacatgtatgggttacaagaacacaatgtaaatctagagaaaaccacgtaaaaaagaacatcaaagaacagagtaactctagataaaatgatgcgacttaagaacctgtaacgctggtgccaactaaatgacttaactcagatacaacgtaaatttagaggaaaccatacaaaagagaaaatacgcaaataagaacctataaagctggtaccggagaaatgttaactcatacggtagtacctacgcagtactgattctaatttgggagataattctaccctttttctgtactagtaaaattatatttttatccttagtacttaagtatctataccaatacttaaataccttttacatgatacctgtgattgagtagcgttggatctatacctttttttggaatgcaaacatcgtaaaagttctcttcgaactattgttcccgtaagctctagaagtacagaagtactggttttcgtagttcgtacagatatagtactaaaaacacactgggacggctgctgtcacagttttccttaatccttatgtctgtagaaaagatgctccggaaattgaaaggtatccaacattgaactagcagagaacgactgcctcatccagtgaaggagaaagacttggctgatggggaagttgtcaaatgacctgacaatacaaaaacacaagttgagcggcgttgatgaaaagttgatgtttagtagtttgtattttcattgtttgtaatcattctctcaaattctgccaaatggcacattttcatgcaatggaagacttggtctcatgttagtggttttggttagattaattgattaaatacatacccaccaattagggaagaactagtctaactagtggcccaaatgcttcagttaagctaatgctttccggtttagaccttgtaaaagaacattaagaaatgcaaactccttgacttttgcttccaggttaatttgggagcatgttcgttctaattcctattgattaccataacttattgctcgcatgcatgtaaagtttaggagatactgggaaaaaaactggccatattgactaaaagcaaaaataaatatactttttatattttcaaataattgactaaactcggtagagatatcttcagatatattggataagttcatccaatcactgaacagatcaaatgaatcatgatattatcttaaagaatcagaatcacagaaaatacaaaggtcaaatttagnnnnnnnnnnnnnnnnnnnnnnnnnnnnnnnnnnnnnnnnnnnnnnnnnnnnnnn

SEQ ID NO: 2510 - DNA, 428 bp, Oryza sativa
  unsure (1)..(428): unsure at all n locations
gggcgaattcgagctcggtacccatacatgaaattagatgtatagtcacctctatcagagcaaaggttaataatacaggcgacctgttggctataaggttctttgtagccttctcagcctaaccatataatagttagctctttacaattaatatatggcccattttatctattcattaacattaatatgaatgtgggaaatgttagaatgacttacattgtgaaatggagggagtagtttcttgattattgtgtccaaaccgaagtttacagtccgtttcttctctctcttctcttttctctcctctatattagcatttagccatgcttaagcatcgacgacgcggggggcttttaactatttgccactcttannnnnnnnnnnnnnnnnnnnnnnnnnnnnnnnnnnnnnnnnnnnnnnnnnnnnnn

SEQ ID NO: 2511 - DNA, 497 bp, Oryza sativa
gcctgcaggtcgactctagaggatccccctgaagttttggggataacttgtgggaaattgtttatgaaagggagttttgggccttactatttgttgcttggcttgaggaaccttggttgaggaggtttgagaagttcctttgaattccttcagctcttgatcttgggccttgaggtgaaggagaaagaaaaagcttgtgttagaccttaagcataagatactccctccttccctaaatatttgccggcggtgacttttttaaaacatgtttgaccattcgtcttattcaaaaacttttgtgaaatatgcaaaactattggaatacattaaaggaaatttaaccattaatccaatgattgggaaagaattaataattacttaaatttttgaaataagacgaacgggcaaacatgtttaaaaaagttaaagcggttaaatattttgggatggagggagtatatattaagttaatacaagtgtaatcattgttttaaggt

SEQ ID NO: 2512 - DNA, 3143 bp, Oryza sativa
  unsure (1)..(3143): unsure at all n locations
nnnnnnnnnnnnnnnnnnnnnnnnnnnnnnnnnnnnnnnnnnnnnnnnnnnnnnnnngaattgatgatttagtgcattttgactttatggatcctcctgcaccagaaactttgatgagggccttggaagttttgaactacttaggggcacttgatgatgatggaaacctcacgcctttaggtgaaacaatgagtgaatttcctctagatccccagatgtcaaagatgcttgtcatcagtccaaaatacaactgttcaaatgagatcctttcaatatctgccatgctgtcaggtatgtcaaacaaaacttcatgtcgccatatggtttgtcagctaaattatatagtgcgtaataataacacccgcacaattttgcttgcatcaattgcacattgtagaaagcttacaagcttcttatcatgagagtttgcatccactttagtgcatttgctcttccaatatgctttattaattctttcagagctgtaatcagcaactgtcgtgcacctagcttcttgagctattgatcaaaatgatcatacagtttaggctgatgcagatagttgctgtttgttgagttattctgacaaagcaaatggtatcgtctcgcctctttgcatctgctgaccaccatggacttcgtctgttattgccgtattctttctctagtacccaattgctttctccggcctagggaggcacagaaggctgctgatgaagcgaaggctcgatttggccacattgacggggaccacctgacacttctgaatgtataccatgcatacaagcagaacagtaagttcatgaccattttcgttcaatctacactgatatccatttcattgcctaacagttgtcttttcgacaatgcagatgaagatccccagtggtgttatgagaacttcatcaatgccagagctctaaagtcagctgataatgtcagacaacagcttgttcgcatcatgaccagatttaacctcaagatgtgcagcacagacttcaatagtcgggagtactacgtcaatatcaggaaagccatgcttgcagggtacttcatgcaggttgctcacctggagcgaacaggacattacctgaccgtcaaagataaccaggttggtattaattttctgatgcccagtctctttgtgtacaggatgatgaaattgcagatttcttactctttgttgtgctcaggttgtccatcttcacccctcgaactgtctagaccataagccggagtgggtcatctacaatgagtatgttttgaccaccagaaatttcatccgcacggtcatggatatccgtggtgattggttagtcattatctggcagacagctagtccttttatgagtattgaagatttgaaagaatttctgacatgtttgtccttcatgtgcaggctgattgatgtggctccacactattatgatcttagtaatttcccctcgtgcgaggcaaagcgcgtccttgagaggctgtacaacaagcgggagagggaaagagctgctaataggaactgaagttgatggcgttttccccttgcgctagccttccactcgagaagattcgggtatatcagcttgtcgtgccggcgccaacaatggatgcttcctcatcctatcgtatgatttggcttgatggatgctcgtcactacgtatgacatgccaaatgctgctctctagccgtacaatctaccagcaatggcctaggatcatatttttgtttcttttagaagttgtagcctgtgacgcaggatattatgtaccggtctcccatattttgatggttctggcacccttttatttcggcatatttgtttcgtgtttggttagtcttaaaagtgaaatgtgcatcattgctaccttagcccgactttctttcgatagtgtcaaatcaaaggaaattttactttaggtcgcattttattaccgatgtttcattttgaatcacctttaaactaatatttttacttgattgggttttcactttggaccaggtaattttatctttgttacactttgcagccaactacaacccggaacacagatttcaaaacgctgagtgtatgatagatacatatttcaaaacgctgagtgtatgatagatgagatcatgtattaatgatgtaggagatatattagttatagatgatttggagttgatagttgactgtaccattcaatttgctctaaagagaatcaagatatgctgcttgttgctttattaccacattagagaagcggaacagcgcaagatgaaaatgtgttttcagaagtaaaatcatgttaataaaaaaacaaaaatgttaatagtagaaatcgtagaaataatagcttgtcagcatgcgaatattcatgagctttattaccacattagagaagcggaaccgcgcaagatgaaaatgttttttcagaagtaaaatcatgttaataaaaaaaatgttaatagtagaaatcgtagaaataatagcttgtcagcatgcgaatattcatgaggaaggaggaaggattgaatagttttcaggctcccctctgtcttaaatttcccaatagaagtatagtttggacgtttggtacgagacgaaatatttggttatcatgtgtacatgattcaatacaaaataacaactcaaaacgcaggcgaacaaaatatttacccagcttgcaccaagctaacaacgttatttcgagaagggtcaaaagaataatattcttacatgtttccactatcctatttcaaatctcaatctcaacgggccaagaggccaagagagagaagtttctatagccaacgagctcgcttacatatgcatttcaattttcaacggctatacaggcatatatctacttcattatattcccatttggggtttaatgctacatgttacactctccctgatcattttttgttctgcatcccgactccttttcaccatgtaacactcataaaaaacgaagctcagggtgaaacaatggaagtctccaagccgtgaaggtaatcaaatcagctttgcagatgccacataaggccaactataggacttgctagtatcctgcaacgccaactataagaaatgataaagaatatagcgccactgaaattgcaattcccgccacaaaagggtaccgagctcggattcgcc

SEQ ID NO: 2513 - DNA, 4113 bp, Oryza sativa
  unsure (1)..(4113): unsure at all n locations
nnnnnnnnnnnnnnnnnnnnnnnnnnnnnnnnnnnnnnnttgttctgcatcccgactccttttcaccatgtaacactcataaaaaacgaagctcagggtgaaacaatggaagtctccaagccgtgaaggtaatcaaatcagctttgcagatgccacataaggccactataggacttgctagtatcctgcaacgccaactataagaaatgataaagaatatagcgccactgaaattgcaattcccgccacaaaattgtacgagaggcgcttgttgtcacgactaggcacaaatgcgatcttcaaggtgttagtcaactcaaatagcctatgggagacctgtaggaataagttataacataagcaggttgcctgtaaggtctaaactcttcaaagtcacagggaagatctacttactgcaacatatatagcagttgtgagcatgaaattcagcattgggtaatttgggattattgtcaatagccatttaggttgcccattgggcacttttgatctgcaggagtaaagacaattttcagtcattgacaagaacaagaggaacttctagtggcacgaaccacggaggtaatattgtagagacagcagctggttacctgagccaaatatggaactgtgatatgtacgtttctaaggtaatctttccgagccagctagcacagatgaagagtacattaattgcatattcacaatatcgcattacagtaagataaagtccaacataaaagtggaacatgcttcacaaacacaaaacttacgcaaatagtgtgagagagcagcaccggaattcttgagtgaagttgcgtaagcagatgtacacacttttgagtacaataagcattgagcaatcagttattgcagtacaccaaggatttttttttataaaaaaaatcgatatggaaaaaatacatacgttatggggatccaggatgtatagggatggtatttgttgtaggtaatcttgtctagcttataaatgtactcgtaccacaaacaaccagcctgtgatcacagtaaagcaaggtggtcttaccaaaagatggatatgcaacaataagtggcttattcagttatttgataattaccgttaaagcaattgaaactatcaaggccttaatatagagtttagttttcgtttcagcttcttcaagcttctccatccacttctcaacctgcaacacaaacaaatgatttattgatgtaaaatactattctctcgtatgcccacaattttacaaatgactcaacaccctcaaaactgaaagaaccagaaaatttatatcagcacatttctctcacacatgcatatgcgcaggcgcgcagagacatgcactcatacaaacaacttttatgcgatttatgaaatttgataaaactaaagaaatagaacatctataactgaacactatgtaaaagtatagcacagttggcaggaaacatacagttggatggtaataagcataaatcatccccacaatccatatgtagcgatccagtccagatcggaaatgccactcatgcaatcgagggagatcaggtttagatggatcagtatagcctgcacacaaggtaaattacattgatcatccttactaaaaatatatatataaactatcaaactcactaaaagtttacagagaaaacttaccgagaagaaacgtgaatgggctccagacaatctcgaagactcctgggatttcccatatcaggataaccaccaaaaagcaggcaacaaactttatagccatcactgatccaatctcgttatacttatttagtattccaagagcaccataaaccataagggtaaaaagtgtgtgcatagggcaaatataatagagggtgtagtcattatttagcacaatacaacagaatgccacgaaaaaattgaggcgccacatcatctgtcaaggtgaaaacatgtcaggaaggtcctacttatggaagaaagaatgaaggggaatgaagggtctaagaatgaacctgagcaaatcgtgcaaggctgaaatccttccgcacataataataggagaagttaccaaatccagtcatccagacatatgcagcaatgaacacacgaattgcattgtatatctctttagcattgaagtagtggtacatcaaaaacagcacctgaatgagggaaatcaatgctgaaaacaagtgatatgcatgcacttgaacatagatgaaaaacttactaaccacacatgtatgctattgaggcattgagcattgactaattaacttactaaaactaagagaggttcattaatgaagactaggtaagcatacatgtagaacaatatgacaaaagatgtttaataatgaacacatttatatcctctttgcatagttctgagttctgagttctgataaattagtattatgcacaaacggaaaccaacaatatgacaaaagatgtttaatactgaatgcatttataccctctttgcatagttctgacttatgataaattagtgttatgcacaaacagaagccaactagtataagataccccataaatatatgaaaaggaagacggagttttttttccccaaaaaagatacctgcatccaacccttccattcctcagtttggtgcctattcagatacagtatagatttccccgtgaatgacgacttgtcttggtggaccttgaaagaagtcatagctgctacgataataagaagaaagtaaaggaaaaggaacatatctcggctgtaattctgcagatacaggataacagaaaaggtcagaacaaaaaatgtcccattgaaagaacagcacattatataggcactttccatgaaatattagtaaggcttagaatgtattcgtaaaagatatctcaactagatacaatatttttgcaactacttttcaaacgtgaaatcaggcttgtaataaacatcaatgtaatagcaccttcgcagactctcccagtagatttgtgcgatcacatatgtaaaagtaaagcagatgacctccaaactcagatctgaaaaaataataactgctcagccaaataatgcaacatagaagaacacgtgaatgcaagatgcagctgtagcttacattgctctcaacgtcaatcgattctctagaataagtgcctggtccaacaagaaaagtctgtgcaacagattatctttgtcagtgccttagtaatgttgatatctcaacgtttatatacaacatgaaggagaaatcatacatcacaaacaacctgaacatttgtgatgtgagagaagcataaactggcttttgcactggtgcttggacaccctcctccaataacatcacttgatcctctcctttgtttgagctagaatccattactgctaaatttacatccgagtgtctactaacaaagataaagaaacagaaattccaataagtggtacatttcaagcaaaataatggtgcagcacacattcagtccagacgaagtacgactcttgagttatgcttcttgtaacataagtagatatttcaatctcagtggcaacatgagagtatatcacttagcatatacgaaaattaaaatgcatggataccagaactgtaaatatagctgtcacaattacttacgctttaatagaagcagcattcttcctataatagagaacctccgcatatgcccaggcggtgaaaacccaaagaaatcccagaagagcagagacctgtcagaaagttgccagctatctcagatccagtgattgaggacccccaaaacaaaatcctactattagaagaatatcactcagtcatctgtatagtagacaatagttctacggctttcaagttgcaatcaaacactgtaattgtgttatttgaacttgtggggtaaaagtagctcatcatagtccggattcttgcaatccacaccaatatgtatttctgcaactaaattactatctagttttagtatttttaccaacctgaacttcctaacaactaccaaagtaaggaacaaccgtgcgctagaaaatcaagcagattgacaccaattctaacaggttggtcagcacatcgatactgctaccatctcttagaaaatataacagaatagcccatgctgccagatcttaatga

SEQ ID NO: 2514 - DNA, 3828 bp, Oryza sativa
agtaaaaactcaaaatcccttatattgtgggacggagggagtcaaacttagaagtatttttttaaaaataacttctatataaaaaaactttcacaaaaatacgcaatttgataaacatgctaacagaaaaaacgagtaagttgtagtttagatttggagctttagaacgggaccttcgtctatttgtggtgatgcagtgccaaacaagtattttccctccatgtcaaaataagtagctgtataattcaaatttaaactacacaactagatttatttttggatagaggtagcatgatggtaacctgatggtgatagtaaaaaagagagaaaatgacttgtgtgaatattcctttgaacttgtattcgtggatacaatttatataattgatcaattgttgataatgaaacttaattagtgcttcttagcaataatatacttggcatgagcatgtgtatgccactcttctccaaaagaaaaaaaaaagaaaaacctcaaaagtcatacccacacaaaacaaaccttttaaagtacagaaatttaaaatgattttcatgaaaattagttagaaaagtgtgaatccacgtaaaagagaataaagggcctatagccaagtggttaaaagagtctcagtagtaccttaggtcctgggttcgactctccatgagagtgattttttcaggatttaacggcttttgtgctttcagtggtaggcgacgcccagtcttcgaagatgctcataggggtagggatcaccagtgacaagttcttcctatgagacggaggtgattagggagttgatgtgcggtaggcgcaacatgccgccaataaccaacccaaagctacctcgccacgagctcgtccccaaccatcccctccgcaatgccatccacaagttacatctccgtcacgccatgcgaaacaagtagcccgttggcggccacccttttccccacctctcattaccctctcgttattgctcggaggcctagtgacagataggaaagataggaagatgaggaataataccacttacgaccctttcagtttgcaatggtcgttgccctttctaatctaccgtggcctcatcccatcgatcgccacccctctccaagtcgttgccctttctaatctaccgtggcctcatcccatcgatcgccacccctctccaagtcggtgactgtccttcttcccaccacttgtcgcctcctcacagggccagctctaggtctagacaagttgtgcaaccgactaggacccagagtgaatggggcctatcctaatgtaatgtaggtcaagagtaaatagctgagcagtgtgccttcaatcaactgatgtatggacttcttgatgacctatcccattccagtcgtctcatcccgaggccaaaggcgtcgagcgggagcaactcgccgtcatcgccgacgactccttttcgacagacaacagtaaatgtgtctcttcctttgatcaacaattcatctcagttctctcttctactcttgcctggaccgtacgctcgtagcaggcagcagtgtggcacccagccggccaggccaaagagcgcaggaagcaaagtagcggcagccttgattgaagactatgtgcataggtacatttacatactagcagtagattttatttctcaatttataaataatcatagaagatgatatatcctactccctctggtttcattttaattgacgttttggagaatgacacagtctatagtttatatgtttgaccttatttttctattataatatatatataataaataaatatatgcttacttttattatagtcctttgaaagagaaatctatatacgttattctagtttctttaaactaaatatttttaaacttatttatggttaaagttataaaagtttgacctcaatcttgtccaaaacgtcaattattatagaaccagagggagtatctggttaagatgatacatcctatcgggcttttaggtcaagatttttagtgttcttgccttctattttcctttctaattgcagttgtaagattttaatccgttagatgatgatgataattgtgatgtgttgtagtgaaaagaatattttggacaatattgagcacaatattgttcttaatgattttgaataaagaaatgagtaaatttcacaatggtctgccttttcttaccaatgttttacattgggctagggttaggtcaaaattttcactaacaccatatatatttgccaagagttgcactttgggctaggctccaggatttgagcccatctggatgagcagacatcttctccctcccacaagggcatgcgcaacctcgccgccgccacttctgtcgctggtcgggagttgagtgcaaggggacacgatgggggttagccaaggagaagggcgatgcagcaggcactgctctgttgttgttttcccttgctgtccagtagttcaaggggctgacgagattggctagaggatagagattaagcgcgccggcgaagtgagtggcggagtggttattggaaggaaaagcgttagagttggggacaacggccatggccatgaagctgacagtggcagaatcaaggtcaatgaaacaacattaggggacaagtgcttgttcttcttctccagctctagcatgggattgacatgaagctcgtttcgcgtgtgattgacatatccagttgaattaggggcagggcatagcaaacggtggagaagctgtgctccagagttggaaggagagaggaggctcccagcttgcccatttatctcctaatctcgctgacaagtgagccaccggtccaaactgaaattttttgctgtaagacctagcctaaagtgaaaacattgtctataggatggtccaaactagaactttggtaaatataactagaccaatgtgcaatttactctaaagaaattccagaagttcttttttaatcacatattggatatttgccgttttctctttttgaagcatcgtcaataaagttgttggagtttagtggttatttgccgttttctctttttttcaatttttttcaatgaagcatcaacgctatttatcgatattaagaccatattgcaatgtcacgttaggggattaatggattataatgtgtcttataactaaaaggaaatatctagtctaagggactattgtttcgagtttgcatagggtcctagaaaacgtagtagctttgccccctagtttgctacatctctatctatcagacggcttggtgttttccgtcggctgccggtcgaaggcttggtgagaatgtgagagatgggaagagagggaagagggaggatagaggaggaagaagaggtggttgttgacatgtggggcctattggacacgtcagtcaaaatcgggtattataaacctcggatacactgttttgcaagttaagagacgtgctacaattggtatcgcggtacaagaatgtaacttgaactcggcgtcaagataagggacctaatatgaacttattccaccataaaaaaaagaacttattccacgatggaaagctcttcttgcgttcagcagccagtagcccaacaaggcccattgttcgggttaaacgaacccaaaaccgtacgaaagcccgagaaaattgccttcgtctgcgccccgcgggctctcgtcccaaccgctcaccggcttcccgcggcggcggcggcggggctccatgctcacggtgaccctcctggacgcgcacctcgcgcggtgcagctaggcgcgccacctcctccagatccacgcccagttcgtcgcgtccggtctcctcgccgacgccttcgccgccagccgcctcat

SEQ ID NO: 2515 - DNA, 6889 bp, Oryza sativa
  unsure (1)..(6889): unsure at all n locations
atgaccagtcctcagaggcactcactattttcaacaacatgcaagcccaaggaatcaagccagatgaggttacgcttgtaagcgtcatctctgcatgtactaatatgtcttctctcgagcaaggcaagtcaatgcatgagtacataagggaacaccaatataccatcacagtcatacttgggactagcctcattgacatgtacatgaagtgtgggtgcttagaatctgcattagaagtcttcgatacaatggaagaaagaggaacaccttgctggaatgctgtcattgtggggctggccatgaatggtctggtgatgaagtcccttgacatgttttcggagatggaatcatctagcactgccactccaaatgagataactttcactggagttttgagtgcttgcagacatgctggcctagttgaggagggccaacatttcttcaagttgatgcagcacaagtatcacattatcccaaacatcagacattatggatgcatggtggatcttcttggacgtgctggatatgtcaaagaggcagagaatctgattgagagcatgcccatgtcaccagatgttccagcatggggtgctttgcttggttcctgctggaaacatggtgataatgaggttggagaaagggtggggaggaagcttgtcaatctagatcctcaccatgacgggttccacactatgctatctaacatatatgcttcagaaggaatgtggcaacatgtaaaggacctaaggggctccatgaaacaatggcatgtcccaaaaattcctggttctagtgtggttgaatcatcactacctttgtgagaatatatcatatgatggtacttgaaatcagaatacagtgcttagagtggtttgactcaagtttcataaggtactgagccgatccttaattccttatcagcagaactagtgttctagctatcttatgagttgctttggtagcttgtcattcaaataatctttcttctgtctattttttcacatgtttttagataatgtatatttttcacataagctaaaagtttttgtctgccattaattttcacaacattcatcttttgatcattcacctgaagtcagatataacctcagtcgctccctcctcatttctgcaaaggtaacatccatccatctggcaccatgaataagtagccacccactacatggtcatgactccttttttgcatttagccatgcataatggtgcttatgtattatttatttattaatttgtaatctatggtgaattcaatctatgatggggactaatacttctgcattattgaaggcatggagcacatgagagtgagggtggtctacttcaccaaattaaggagagtaactgtctgtttatatgaatatatcagggagcttggtgaagggaggagggaagaataaggaagcaaggatggcctgttatttatagttagcagatgacagattaacgcaggcagactacccaagctcctaaatggtacgatttttgcaaaaaactttcttcatcaacatttcttagataacttgtttaaatcaacttccaatatttaattatgccctcgaataattgtcatgaactctgtgtcatccatcacccatcatctatttagggtgggatcttaaggggtgcaataagcttgcaacctttattggtatgtttagctttgtcgttggaagttttgaagttgggacaacatgttatcacacttattgcactggaaaacaataaagagaagatctgtagatgtttttttttccatagagaaaagaggaatgtaggtcaattccgttgttttgtttctaaggcatttgtttgttacaaaatatgtccatgttaattattatgaatttatgatgtacaagttgcagccgtacaggcagctagctnnnnnnnnnnnnnnnnnnnnnacatttctggttcagcgatcttattcagtattaaattcaagtctaaagaggcttatatttaaggtgaacaacactcaaaatttactgttgtgcatattgacgaaactaagtaattccaaacaaattttgcaagaagataatcattttgtattgactttctaacaaagaagaatttacggtgtgaaatgtgagatgagatccaccttgacaaagtgatagatgacctgctaaattaattattggactgaggggatttcattatatgacaaagtgaaagtgactggcctatcttaaaactgcacgggcaaatactactggaagagtttttctgtcagttccttgcatatgactagaaaaatatggaacactcctccctattttatattttaaaatgaagtagagatcaaatgcagaacaactttggcaccaccataccattatctcccttgaggggaaaaaagaattcaaagtcttattgacttttgactaacataacaaatgcatggagaaataatacaggtttaattgacagaacgataatcatagctaaagggaaaaaaagaatacaagtctaattgactaacatagctgacggagcgtggggctcctcaccgggagaccgcgcaggcccccctttgccggttcggccgggggccctgggtgagattctaagctcctggtctgagtgtggaaggttcgcgagagtggaaacacacaagacacgggcgatgtatacaggttcgggccgctgagaagcgtaataccctactcctgtgtttttgtggatctatgtatgaagaagctacaaaagagctggagaaccagagagctcttactctctccctctctagtccttctggatccgaaaaaatcccctttctaagtgggcaaggtcctccttttatacctcaaggggataccacatgcaccatctctctctttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacgtgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgaccggtctgtgactggtcacagaccggataaacgagcgcgctgcactgcgttacatgcggcgtgacgcgctcgtccaaaccgcaataaatgtggttaggtgagccccgctatgctcacctaccccatatacgtggcgcaaaacccacaaggggtcggggcgcctcggccctcggggccgagacgggagcggtccgacccctcggggagacaaagagaagggcggccgtatcaccctcgggcccgaccccccccccccccccccgagggggttaggccacgtgggtgatcgtgtctgcctcaagtctctaagtcatgatacttccggtcccatgtcaccgacaatagcaaatgcatggaaatgataatcatttgtgcaagagaaacaacatttcaaagatgaatccatcccccaaaagactaataatggttttgttgctgttgtgaatttgtgataatgcaatgaaagctcgattgcatcaaaatgttgcatgatcaaccggatcatctttgctgatccacaagttgtctgcaactcattgcacatcaaaataaatgaaaggtgaaactcttcatgcaaaactacaaagccatgtcatcaagcgaatatggagcagatgatttttgcttcgggtgttatacgctgtcggattctctgattggcaaaatatcttctcaatcctccaggatacttcttttgaatgtacgtcacatctatacacagttcgagtttgtttattttgtaaagagtaaatttcacaaaactacagatattatgaccaaattatcacaaaactacagatataactcggtgtatcacaaaactacacatttaacaccaaatttatcacaaaactaaacatttaagatgaagtgtcacgaaactacgtgtttagtaactaaattatcacaaaactacaggtttagaaacaatttagtcacaaagcaataatgtttatagcttcaccataacaatgttgctagggatttaaactccaaaagttgtagttttgtgataacttcaatattaaatacacatttttgtgatatttaaccttaaatctgcagttttatgataaatttggtgttaaatctgtggttttgtgatgcaacaccttaaatctgtagttttgtgataatttggtcaaaatacatgtagttttgtgaaatttactcttctgaaaacctcattgcatattagtctatttccgttggagcagttggggatttatcaactcaaatgccaaaataatttcaaaaaggaaaaaaaatcattgttgagaaggctttgatgaaagctgaaaggttagcctgccaaattatacagttctggaaatgggacaattaaattgaccaatctgttattgcttcctagaatgggttgccaattttctatagttccaactttctcaaatgagaaagtctagtgggtttaggtcagtaaatgactcatacccagaaacaaaaatgagcagacatcccctatgtaacgcattgtcctgcaaaaactgcagcatgtttacagatattctaagagcaatgctacgctgtatggagcattttcactatgtcaaatgcgggtaaatatgcgggtgcaaacccaatttaggtgaaaactagtgtaaaccctgagtttggaaaagatcttttacatggttgtgtaaaataatctcatctacatgtatgatttttttggggtgaatttagacaactgtttggtcagggttcacatgagttttcacctaagttgcggtttccaccatatatttacctgtcaaatgcagctcaagtatttcaactattctattatagataaaagctaccttttggtccctcttttggtcttatcttttccatctgttatcttaagaaggatagtgaaatctgcagattattaaaattaaattatttagaaatccatatcctattgaatgtgaaactataatcattttatctttgcaactgtgggttcgtgggccttatagaccttgaggtttatgatagtcttatagtcccccctcactgtcctttcaccaatcagctttctttcaccttttgatatgcagcccatatttgcagggattgttccccatatcaagcgcaagcttatatgcatatgttttcatttccattattccattgttttcttttactcctgaatacatgacaacttggccccttttttaatcatatattagatagctaagtccttacacctacccaaaaaaaaaacatttcttgtgcgtgatatctgaacccaaaattgtatgcgcctgccacgtgcttggttttcatagatgtagttatggacctctgtattgaatattttcattcatctgtaaggacattgtagtttccatcattttgcaaatcaaaatggataaacatgtcgcatgatgcatttcgcttatttcctattggcagaaatcctcagaagtaatctactggcagagtgtagagctaagggcatgcaagtgcattagtgaaatccaagcatcgttcacatggtcaatcctgccctagaatggtccaatccaagaaatccattaaaaccagtaaaagtgatgtcaatagatgggctaaaaagagctttgaggtatgaagtactatcccagctgccagctttgcaactttgcataatgttctgtttgttcacatttttcctgttctttcctgacaatagttaacttcagcggtgaatgaaacgatgttgaaaaatggaaatgattgtattacgattctcctcctaaataaagtacgcatacttcatttgtagctagctaaaacttttgaaggtcatgtgtggcatgaaatggaatataaatagaactgttctaggaaataattcttgtcttgaactatgatatctagaagaatccccaaattaatggtttagaatgatggtagattatcagctacagttacacactaaatagtttatttattaattctagttttattttgcagcaatgtagataaagtagactaccgatcttatcgttgcctgattaatggtattaaactaagattaaatatcaagtacaagtaaggaataactaaaatttggattaaaaacaaaaataagactagaatttggtttccatgcaaattctaaaaaatatattggttaaccatatttaaaataattttaaaaatgagcgaaaatgcaccccaaagacaatgactaaatttagaataaaaaagataaattctatttgtatatgaattccaaagttatccattttcttaaatgtacatgattttagaaggcgagccttcagatctcggaattataactaaccaatatgcgtggataatattaaatattacattagtatttttgtcattaaaaaatacttttgttttgttaaaacaaggatctgaaatcatgtcaatctgctaatgacctaaattagaaattcctaaatagctttttagaataaaaatagacttaaaatatcaattaacttcatataatatacaaataaaacagagctacccattttgtatattcccaaactaaatacataactactacaacataaaccaataactaaaggaagcacgctaacacaagcaaagtatgaaggcctccgtgccatcccccaaaaa

SEQ ID NO: 2516 - DNA, 7734 bp, Oryza sativa
  unsure (1)..(7734): unsure at all n locations
nnnnnnnnnnnnnnnnnnnnnnnnnnnnnnnnnnnnnnnaatagctttttagaataaaaatagacttaaaatatcaattaacttcatataatatacaaataaaacagagctacccattttgtatattcccaaactaaatacataactaactacaacataaaccaataactaaaggaagcacgctaacacaagcaaagtatgaaggcctccgtgccatcccccaaaaaaaaataaaaagataatttgcctgaactcgaggaagatgagctacacatacattggaacattagaggaagcacaataaaagatgataagggggctgaaaaaattgccgttttagatcacggagtttgtaagcaccacttgcaaatactcctaattcatgatgtactaccaaccaatagatagtcctcgtggagagtcaaataccctacttagagcaagttttatagtagaggtgattgccatggttacggataaggcatatctccaatcctatgacttacggaatatacgaatacggtataccttcatgtatacaatgtgtttccgtatacgataaggaaatctacaagatactatggaaaacgtcctcacgataggcggatgtcaaagtcctatttggagaggattgggcttttactatatcatgcggggtccgtagtcttcgagttctacttggagactaaggagattcacggtataaaaggcgtacccctgaggggtttagatcatcgaatcttactaccaacacacccaccatagtctacaagctggaggacgcgaagcctactcaccgagagatctcgtcgaatcatctcgacaaggatctcaccgataacgccggattcatctattctcattgtactatgtggttttccatatcaatatcatataaattggattagggctatcacatgatatctttgccttcttgttcgccgatgtcgtatcgtgtagatcctcgtaccaacgtaccccaataccttattcatccggtctgcgggtatcacccatcgatatggtcctttaattttattcatattatctactcgttgattagagcaagtataataatgagctataagttagctataaacatatgtggatgagagataagaggagagagaataaaagtgggctacaaatttatagccaattacggtacatgctctaagagattgtgtgtatattagagatgggccagatattaatgttgttctatatgtttatatgaaactattgtatgagtaggctattagatttgttacacatgatgtgttaatttttagatctagcagttggctatactattgggacaatacaacacatcgccaatgcacttatcccaatacaccactttatttattttcacttaatccattagcttatttctctcatctaggagtttgtgtagatattggctcctcctctctttcatctcattatatgatcttagagcaagtttaatagtatagcccactactagctccaattcacttatagccaaactaatagccaattcataaaatagttgcttactatactattaatatatggtcccacatgtcatacacacattgcgtcttggagtccgcgctgcagctggctacagatctgtagcccgctgctattctctctcatcttttatctcattaaaatatgtttatagccggctaatagtctgctattgtacctgctcttatgtactctctccgtcctattttaagtgtagttgtgggtttctgtatctaaagtttgattgtccgcttatttgaaaatttcataaaaagattaaaaaaataagtcatgtacaaagtaccatttatgttttatcatctaataacaataaaaatactaatcataagatatttgaagacagactcacagatagtcaaacacgttggacacagaaaccataactactcttaaaataagatagaggaaatagcatcttccaataagatcttagagcaagtttaatagtacagccaactaccggctctaaattatctatagtcaattttatagctaattcatataatagttacctataaacatatactacacaattaatatatgatcacacctatcatacatgcatgtatattggtgtccgtgctgtagctggctataaatatgtagcccgctactcttctatcttttttttatctcctcgaaatatgtttatagttgtcttatagcctgctattgtatctgctcttaaggtttgtactcgctctttgtacatgacagagtcgtgagaactcaagcgcacccaccaatggatgacgtacccatggatgacgtaacaatgaatgacatatgtcaatggaagattctttgtccaacggccttgatctttcatatacgaaccaggattaatcgtccgtactcgtaagagcaggtacaataataggctataagccagctacaaacacattacaaacacattttaagaagagacatgactacacagctagtggtagctggtctgtctccactccatatatgatagacactatccaactatacttcaaatacaattttctctaaaactgctcatccgatatacgatccgattacaccgttgtgttcgtaacaattaaatctttataacaagatatcacatgattatattttgatgaaaaaatataaattacttttataatatatctaaattacttttagatttcactaagttacttcttagacatataaaagtaattcaacaaagcctaaaagtaatttacatatactatagaattaacttataaaaaaagaaagttacttctataatatatgttaattactttaaaactttattgaatttacttttatatatttaagaagtaacttagtgaaatctaaaagtaatttagatatattataaaagtaatttgtgattttttttatcaaaatataattatatgagatcttgttgtaaagatttaattgttatgaacacaacggtgtaatcggatcgtagatcggatgagtagcttaagagaaaattgtatttgaagcatagatggtaggaatattttttctacttgcttgatcaagtactatagtaaagtaagattcttcaagacacatatctggacaatggttgatcgtatctggacaatggctagcgtcgctcgttatgactaaatcgagagcgctctcgatttagattttgcgtttaagaagataaataaggagaaagaagaacagcgggctaaagatttatagccagctgtagcacagactcctagacgcaatgtgtgtatgattggtggggccagatattaataatgtagtatgtaactattgtataaatgagctattagattagttatagatgaattggagatagtagttggctatactattaaacttgctctaagcagattaattctcatactgcgttcgacatgtgcaatcaagatctcccgtcctctgagttcgacatgtgcaatcaaggattaccttccgtcttctgaaaatttattcttgtacagcgttcgacaattagggtgagtttgaggagaaagggattgagaatattgggaagatatgtaaaacgaggtgagctattagcgtatgattaattacgtattaactatttaaaattttaaaaatggattaatataattttttaaagcaactttcctatagaaatttttaacaaaaaaacacaccgtttagtagtttgggaagcgtgcgtgcggaatacgatgtcctttctcaccctataccaccagaacgaacactccatctcctcctttgcatgtagccatacatgatggtccttatggaatttctttttctttcttttaatctatggtgatgaattcaatctatgatggggactaatacttctgcattattgggggcatggagcacatgagagtgagggtgatctgcttcaccgaattaaggagagtacctgaatatatcaaggagcataggtaaggagggaagagtaaggagccaagaatggcatgttctttgtagctaatggatgacggattagcgcgtgcccactttctaagcttctaaacaatactgtgatttttgctaatactttcttcatcattatttcttggaaaacacaagttgcacaagttgattaaccctgtccctgcctgtgttaattatgatgcacaaatctcaccgtacaagtagctggctagccggttaatgattgacacatttctggtttagtgatctgattcagtaccaaattcagtctgaagaggcttatatttaaggtgaaaaacgttccaaatttactgtacgtgttgcacattggtgaaactaagtaatggcagcagtaattttctagagcaatttactctgcatgattccaaataaattttgcatgaagataatccacttgtattgactttgtaacaatctcacatgcttgctgcaagtgctaatattaaaccgtgtgaaatgtgagatgagatccaccttgacaaagtgatagagggcctgctaaattaattattggacttaggggatttcattatatgaccaagttatgcagatactgccggaagagtttttctgtcagttccttgcatattagtactaaaaaaaatggaaaaatcattttccttttttttatatttttaaatgaagcaaagagcaaatgcagaacaactttggcactaccgtaccattatctcccttgagggaaaaaataatacaagtctaactgactaacataacaaatgcaaggagaaaacaatacaagtctaattgacagaacaacaatcattgctaaagggaaaaagagaatacaagtgtagttgagtaacatcaacaaatgcatggaaatgacaaatcatttatgcaagagaaacagcatttcgaagataagatccaaccccaaaaaactaacaatgattttgccgccatgaatttgtgataatgcaatgaaagcccaattgcatcagactgttgcgtggtcaacccaaccatcattgccgatccacaagttgtgggcaactcactccatatattttgttaaagaattatccacgtgcaaggtctagctggacaaccatctctgcaactgcaactggctaactggtcagtggtcacttgctccaccctaaaatacgtactccctccgtccaaaaaaagacaaaccctggtttccgtgtctaatgtttaatcgtccgtcttatttgaaaaaattatgaaaaaaaattaaaaagataagtcacgcataaagcataaagtattaatcatgttttatcatctaacaacaatgaaaatactaattataaaaaaatttcatataaaacggacagtcaaacattgacacggaaactcagggtttacctttttttggaacggagggagtagaatagtgctccctccgtcctataaaaatgaatctaggatcggatgtgacatgtgctagtacaatgaatctggacatatgtatgtctagattcatagtactaggatatgtcacatctgatactaggttgggtttttataggacggagtgcgtatatatcaatctatatcggattagacacattcactccaatcaaaatcgatttgaatcacttttttttttcattacactatttcgattagacatatttagcactataagaccctgtttggatccactgacaaatttttacaccatgtcacatcaaatgtttggacacatgtatagagtattaaatatagatgaaaaaataactaattacacatattgcgtataaatcgcgagacgaatcttttaatcctaattgcgccatgatttgacaatgtggtgctacattaaatatttgctaatgatagattaattaggcttaataaatttgtctagcggtttatagcagtttataggcagattccgtaatttgttttgttattagattacgtttaatacttcaaatgtgtgtccgtatatccgatgtgacacgctaaaactttacacccttagatctaaacacagcgtaaatcccggtcaaattcatagctttagaatgtatataatctgaaagcatattattatattttgggacgaaaaaagtattagacaagagtgatgctctggtactctttactggttactaccagtatcgtcagaggtaaattagtaatttacaattataatgattagaatttattttatcatttatatttttttggctaaatcaatatatgatcatccattgtgttggcgttgctcatgcttcatcgaaaaagccaaaaaatgagaaaaaaagtagtcattgctaaatgatgattataccctcgatcaccacctacttttttttgatagtaatgtcccttcacgtttctactaccgctaaccgtggtggttgtataaatagatttgaacccttcgattaataaaaataacggttcaggttgatttctactaccagtagagagcaccgtagtgaggctcatttagacaatatgcacagctccatcccaaaatataagtatttttagctatgaatctggataactgtgtgttcaaatttataaccaaaagttattacattttgggacggaggtagtaatttatagtcacatacagtatccactgccttgccctgaaccctataaaacaccctgctgttctgccattccaaagcgccatttcctctcgcttgcaatctcaccattaacaggctgtaccaggaagcatccatttcgatcgcaagaagaataatgggtgagagcagaggcagcattgccttcttcgcgagctacaggccaccggtggctctggacatattctgctgcccagctccaccgtctagcccgaaggacgagctgcacctgacggacggcgactcctacaactacaactgccagcccatcccaccggcggcgctcaagacggtcgtggagcgcctcggcgtgtcccgcggcgacgccgtcgagggcgacatcgattccggccgcatcaccggcctcgtcttcgtctccgagagggagcacaacctcgagacgctccacatcgccctgcgcttcaacgacgacggcgaggtccaggtcttctccctggccgacgcctatggcggcgacggccctgttcagcggcgcccgcatggaggacagcggctgcattgccggcggctacgaggtggatggccgcacggttgaccattacctcgtgtatgtgtccaccaaggagccagtgcgagaacgtcgcagcccgtggaacgtcgcttacaagaccaatcttagaaccggcgagactgaacgcctcacaccaccaggttataatttgatcagttactgaattatatcttgccaaagcttagccttttgccacttgatagccaacagatattactcgcgcttggaaattcttgattttagtgagattaggatgtaccgctggtttcgatatcttaaaatatactttctctattgatatattatagtatttatagtagtaaaatatgtaaacatccggaactaggttgatttttttataagacggatgaagtatgttaggagggcacattcgtaggatatgaatgtagtattgcgtatgtagttgtatgtgtgcgtgtgcgtgtgcatatgtagtgtaatcactgaataaagaaaatttttgatttggtccgtgcaattgaatttggacaggaacatttgatataagcccatctgtgtnnnnnnnnnnnnnnnnnnnnnnnnnnnnnnnnnnnnnnnnnnnnnnnnnnnnnnnnnnnnnnnnnnnnnnnnnnn

SEQ ID NO: 2517 - DNA, 20737 bp, Oryza sativa
ttatagtagtaaaatatgtaaacatccggaactaggttgatttttttataagacggatgaagtatgttaggagggcacattcgtaggatatgaatgtagtattgcgtatgtagttgtatgtgtgcgtgtgcgtgtgcatatgtagtgtaatcactgaataaagaaaatttttgatttggtccgtgcaattgaatttggacaggaacatttgatataagcccatctgtgtcaccatccgggaagaaagtagcggtggcttcgtaccaagggaagaaatgggacggtgagatcaagaacctcaacaccaacatctacgtgatgagcttggagaacccgtctcaggatcgcgagcgggtgatcgagaacggcggctggccgtcgtggggcagcgaggacgtgatcttcttccacaggaaggacggcgacggggagaacagctgctggggcgtgttccggcacaccctgagcaccggcgagaccgtccgggtgacgccggcggcgttcgactcggtgactccggcggccatcgacgagaccagggtggcggtggcggccatccgccagaagtccgagttcagtgatgtccgcgtcgaggcacagtacaggcacatcgaggtgttcgacatgagatcgccggagcagccgatgcagatcacccggaacaccaggccaaaggccgaccatttcaaccccttcgtgatggacggtggcaagttcattggttaccaccgttgcaaaagcgagctcctccaggtacatagccatggctatgtccattgatcacgttttcttgtccagtgaaatggcggtccagccgtatgcccgtatatagtatatcattgcactgatggataactaattttatttagataatgactgagtagttggttgatttatattcaaagccgcagatgatattatattgtttctcgtgcagcacggcgatgatctcccgagaaaatttcacaagctgcaatccccacacgaagatgtcggtgtgttcagggtgtccggtgtgttcccaacattttccaaagatggttctcagcttgccttcgttgacaacgagttcaaatccgtgtggctggccgatagccaagggatgcgtgtcgtcttcaaggtatacctcctgcctcctgctagtagttgctatatactaatatgttaatcctccagaaatgctgtacgagtagtcaatattttttttcaattatgaagtgctaaactgctactgatcattacttaacctgtttgcttagactgatggcccagacagcgtcttctcaccgctgtggaattccaagaaggatatactctatgtgtgcatgggaccttctttcaaagccagtgaaacgttggagatccattccatacacaatgtatccactggtgaccggaagtcgcggcagctcacgttcggaggattcaacaacgccttcccttccaccaatccagacggtaacaaaaaccatcaccaatattcaatcatcccgtaaaatgaacttttcatagttaattttgactgtgttttggacttcttaattaggaacgaaatttgttttccggtcgacaagagatggaggggcaaagtacagcaagaacctgtacataatggaggacgccgacgccggagaaggcgaggatggcagccagtcgacggtgacgcggatgaccgccggcgagtggacggacacgcactgccagtggtctccgaacgggaagtggatcgtgttctcgtcgaaccgggacaggccggcggacgcgccggagcgcgaccacggcctcgacccgggctacttcgccgtctacctgatggacgtggcgtcccggtcggtggtgagggtgatcaggagcgggtacgacgtcgccgggcacgtgaaccacccggtgttcagcccggacgggcggagcatcgcggtgacgtccgacctcgccgcggtgaccgccgacccgatgtcgctgccgctcttcctgcactccgtcaggccctacggcgacatcttcaccgtggacatcgacccggacgacatggcgaggaacgaggacgtggaggggttcgtccgcgtcacgcacagccggtacgagaactccacgccggcgtggaccgtgttctccacgcacgacccgcacgcgcagtggaacctcctcgtcgtggaggacgagcacgtcccgtcgtgcccgtacgcgcatccggacggaggcgagagttggcacatgaccggccagatttgcatccccaaaaggcactgttaattctctcgccattgcattactacgtttcttgtttagaagcgttgttgtttgtttaacgtacgatatttattatctgaagacgttttcagcatttgcttggatgtacaacgtgtgtatgaactgtttgcgatgtaatatttgtttatttgcttgagatgtacttttttcttgtcagtaagacttttgcataaatcgaaaaaataatcacacgagtgtaatactacgaattttgttgttagaacaaacctgactgtgtgtaaaacattaattcccagacagcttgatcgtttggccaatagctgataaactgtaaaacaatttatttagcaattagaaaaataatatgtaggtaaaacttgtatatattcatgtccctagtataaataaaaggcaatactgaaaaaataagtataatataataaccctcaaaatttaaatttcaagaaataagccaaaaggtaaacgatggttatgcatatataaaaccttaaaaacaagaacttatacaaatttcctaaataataaccactgcttgaaagaaagaaaaactcacaagaaaccacaatggaaaggattaagtttgatttacccctctcaactagggtcaaattgagaattacccctttaactatgataccggatattggtatttgatatccctgaattattgaatccggacgaattatcccccacatgacatcctctctgtcttcttcttccgccctccctcacatctggcaaaaaacacacgagaaggaaggacagtacaagaagcatagaatgatcaagtcactgcgtgaactgttcacgatggagtctttgctggcggcgttcttgcagagctcaccgtcaccagactatgtcgtcctgcccatcgcaattcatgttggatacagagttgtggctactcctgtcgtgccgccatgtgttctatgccgcctgcgttgacaggtggctccgcaccaccctcatcatgctcgctatgtcaggccattgtcttgcttccacatctgtcgatctccgtcatcctcaccactagagccaaggagcactctaggagcttccgagtcaagatgggcaatgtcagcgaccgcagctcgtccacagccagctgcggcaacaacctccccatctactcactcgattcgttcgaataccacattgatgaggaggttgaggctatcgtctcctgcgccatgcctatgtcaaccaagaccgcagtcctataaacataattattgaaagccgtatgagtagtttctatatatatatatatatatatatatatatatatatatataaataaatccttctacatagcagaaggaatatattgtaaaaatttgcaggaaaaaaatatttctgtaatttaaaaatagatatcaaataaaaaaactgagcttccatttggtaataataaattttggtgctaccatattttttttatttgattaaatggttggatccgtaattttttttcatttaagatatttcaagcctatcatgtacagaccagttttaaattaatttgttcaaataaaatttttctatttaaaccgctatgttttgagtgtgtatgtgggttggagggaggaggggattgaagggttgttaattcatttggattcaataggttaggggtgtcaaatatccttgtttagagagtaaattacagttttgcaattattgaggagataaatcggacttaaccccaataaaatcggttgaaaataccaaattactttgaagaagaatcataggacttattcttttggtgttgacacaaggtacatgctacatgtatttttttaaagaaaaaaataatcagctgaggaatcaaaagaaaacactgctatctgcagatctgcttattgttgcacagcataactgttttcgcaattcataggaacgtttttcttttttcagggaaaaattaccgacctgagccagaaatttaattgatatttcttccttcgtcaaccgtaacttcgtggacggcacgaagccatcggcgtccacccaccacatcgacgcgaccacactccacacaagccatggaggcgtcactcaccgtcgccggcgccggcgcggccgccttgtctctgcggccgcaaatccgccttcgaatcacccaagcgacccctctgatgccccctcggcggctccaatccggaccctccaagatccagacctccggcgcccgggcccaccttgcggcggcccccgcgtccacgccaccggcggcgggaggcggcctgtactcggcggagacctacgagctgacggcggagaacgtcgaccgcgtcctggacgacgtgcgcccctacctcatcgccgacggcggcgacgtcaccgtcgcgtccgtcgaggacggcgtcatctccctcaagctcgaaggtgaacccctagatttttcttaatccccttgcgcgcgtcaccaattcttggccagaatcatggctgcgagaccaaatcttgctatgcttaccacttactaatttgtggttttgctacggcatctatccaagagcgtgcggcaggcagcccaagctcgacgacgacgatgaagatgggcatcgagcgcgtgctcaaggagaagttcggcgacgccgtaaaagatatccgccaggtgttcgacgacgatcacagccggcggagccaacgccccaggtcataattttgccaaggatccccaagactctgtaaatttggagctaccaatgctcattggctggatgttgcaggcggtgaacggccacctggacatactgcggccggcgatcgccaactacggcgggagcgtggaggtggtcgccgtcgacggcgaggactgcctggtgaggtacgaaggccccgagtccatcgggagcgggatcaaggcggccatcaaggagaagttcccggacatcaccaatgtggtgttcttgcagtgagctatccagaaaatttttacctcattggcatgcatgagttaaaatgcaccagttttcgatggctgttcatgtgctagtgaacttgttccgatgtatgttcaggtgcaatctttacagtgttcgcagatacaatacacaaacagggaaacggaatgatacttgcctattgtcacctcacttgaaatagtatttggatttaggggaataatccatatggatcgtcaagttagatgttcaaattataagttttcgaaggtagcaagtagccaagtaggaaaagcccctaattggccaagtattagcgattactactacctagcaagtctgaaaaatctggctattggggatgatcgaactgttaaaaagtttgtctgaatatttgtctgagactgaaatcttagcgagaagagtccttgaatatctgtctaaaaatcttgatgacattgatcccctttaccaccgaaggagcaccagtctgtctataatctggctactagataggatcaacttgcctgaacgtccgtggatatctgtctaaaaatcttgatgacattgatcccattccatttaattatcgccaaaggatgcatcagagtgtctgaaaatctttcgatgtgtgcagtccaaatacatgtatatgtaagatcgaactgtctgatgcatccttggtgatttcagactcgtgcatcaaagaccacattattaaaccctcgtaatgctacaaaaatcgtcagctctggcccgaacagaaaaccaggatatgttgtattcctactgtagatcaatagagttgtacgggcacattaggacctgttttgaggagttttaaattttgaaaagtagctggagaagctagaaaaaccagtttcttgcttttaagtttattttctggattccataactacaactttttataatttaaactaaaaactacactgtttgaagaagttttttattttgagagaggctgcggttgtcagaatcacaaactgcagaccatcagtgtttccaacatttcaggccggtgtcctctatctcgtttagtacaaagtacaaacaaaggagacaggccaccactagaagcgtgatcagttccccaacccaaagaagcccatgttctccggcccagttttgaccgaactttcggaggccgtgcgatgcgaatgcgacctctacggtacaccgtacacgtacagtcttaccacccagtactactcggcccgcagtgtcactgtgacagaacaggctacagagagcacatcgaccgtggaatgcgttccgggtcgcaaggtcgcatgatcaatccattgtcgtcgctaccaccacatcacgtgacatgtacacatatgttatggccgtgtactagccatgtaggacatgcatgctgctcgttcattccaaggcccatatgcctcgcacagtctcagagatcgagtcccactcgagccccgattgatcactctgcccaattgttcgttcttggccgcaaccagacagcatcaaaccgctaaaccagaaaacaatctttttcttaattagtagacggtgactaaccactaaaattaatggcactagtactactagtgtactgtactgctactggcactggcaggcagctccatcggttaacgcatggcgattgccttggttggagcgtgcgaccgtgcgtgcgtgtgcgtgtgcatctgcaggtcaaaccaagcgaaggcaggcggccgcgcgcccggccgcccggccggctcgcgctcggtgtcctcggtgattaggccccgcgcgagcgatgcgttgcacgatggtggtggcgcgggcggagtagtcgtcgctagggaggatgagttttttttataatcgggtggtgcacgagcaagtggtggtgttggtggtgcacgtgaagccctatgcggttcggcgttgggattccaacaaaatattttcgcgggaatggcgctcggatccgcccatttacgccgcgcggagcggacgggggccggggcccctttatttccgttgccgaacggcggcacgggacggacggatggatggatggatggaacggccggggcggcgccggcgcggctttggtttcactgcgtcacacagcgagaagggacgtttctacagcgggggagggtagtttaggctgtgtttagttcagcgtaaagtttggattttgattgaaattagagatgatgtgattgaaaagttgtgtgtgtatgacaggttgatgtgattgaaaaggactgaagtttggatccaaactttgaatctaaacgcagccttactgcctaccaccggtcaagccgtatgcgatggtttttcgtcggtgactgtattgttttaattaccccggttttagttgcggtgctggtttgggccagatgtgaccacgtcggtgtgttaaggtttctgtatttttttaaacatgacctaggtggagcaatcttaatagtactcccttcattctaaaatattaacgtaactgtgtatccagatttatagttaaacgttgttatattttatgattgagagcgtgagccgtgaggcggcaaatttaacctaaccgtgcccaatccaacgccaaccatatgaccggatcaccccggatcttcaaccgaagcagctgccttgctcggcccttttttactgcacttgcgttgctctcggactattcataccaagtgctcgggaagctcacacgctagagaccactaggccagcgcgagcgcccagctatagcccatcgatctcttggaaaagcctgagatcaaatcccagcttaactccccaaagatttcctgactccaaatctccatccgctccgcagctaccttctccccatatatacacgcgcactccctcccccctctccagcctccatgacccctcctcgctcacctttctctcttgcctgagccaagagctacactttctatatccaccacttcaccgtgcaaaccccatgcacacgccttgacagaagctgagctagcttctcctgcgtcgctgcaagctgctactttggtgcgtgtggtttggttaagttcgtgtactggtgcaacataggttctttcttctaagaagagactacttggttgtagtcaatttgtgtctgcgttttgctaagcttgcttgatgccgttttcctgcaggttcgtgactgaaagccaaatggaagatacggatcaggagctatgcaccgttgcggtaagaacagcgagttatctgctatatctctttatgtttgagcttgcgcactcaagctagcgctagctattattgtgatctcttgtgttgatcttctttttatctgtctatcaggtggagatgatgagttcaggaaaactcaagccatgtagacacttgttgttctatcaagactcccttcaccgagaagcatccataaaaatggttcatgtttagcaatagcacggtgttatcctaactgagcttttcttctagccaccgtccacatccttcttcaaaacctcaacatcactttgtgtgggaattaaaaggaattggtcttcttgaccttgcaagaccttttcttgaccttgtaagacccaacatcgttgtgttgtttttcttgtttcttatttttcaatttcatccacctcttctttctacctcccatctttctcctagttcttgccttctctctcggtctatccctcctgagctgtattgatcactttctatgttattttctcgatgtttaaaagaaaattaattttgtttagcaatatacgaagagattgtgaaattctagtatacctgtaaattgtaatattattgcttgcgtgatataatttgtaatattattattgcttgcgtgatataatgtatttctgcagtcagagtgcagctgatagacctaaggatgtttcctgttaccacatgtgaagctggaaatctacctgtaaggtagcttgacatgtatcacatcatgaacggaataagttcgctgtgtgccactcgataacgatttggatctttgccgccttgctcactgttgggaacaagtactcgtactcgttataacactgcatatgcaatacacggtttatgtgctgtcatttcgtttttgttatgcgccgctacagaaggttcagttctgtctcaaacttttgtcacagcactcgactgtgtactactcgatattgtcctttctcgcccatatacttcgagtttttttttattttgcaattacatggatcatcgctttagttcgcggcttaattagccatttactaaacatctaggcctactgagacgaagtttatatgaatatatagatcgacctagggaacaagtgtactcgcgataaaataaagaattgatcaaatactgatactaccgtaccttcgagatagcagcacaatcctgacctagcagaattatattgggccgtgtttagttacaaaatttttcttcaaaccttcaattttttcatcacatcaaaactttcttacacataaacttttagtgtgaactaaacacagccgattcagctaagagtctaaggaaaaaagaatatatagccattcatgttatacgtacctctagcatgcaaatcattacagggggtcaattgatatagcagtaagatgtatcggaaatttagagtagtcacggtatatcgagcagtccaatctataacctcccgttattatagcaggattacagttgatgaatcaaaacattgccatctagtcatgtatttatccttacaaatcttaaatgccaccacttaattatttggcatttgatctaccgtgtctgctacacaaattctactcccaattattccaattccaaattggttccaaaggatctatgttttagagccgtgcataaacataaaaaaaatttggttaaagttactaacttatcctcagttattacaccatggaaatgataccccataagatgggagttttaattaaatcgtgcagaagagattaagatagttaaaaagtattgtgtcactataatattagaaatgaataccctatttactcataggaacggtataatgcgttcaattgcatgatagggaaaatggtggatatctattttttaagttaaaaatgggggatgagctactccaagttttagtcttttagagaagcgttgattactctaaaattttgaatcaatagggattttgaaggtttaattaattgttgcagcaaaacagggaggtctgaaataataccatgcatgcaagtaatagtgatacagaaagtgtcaagtagctgttctgacttaaacagaagagagacaagatacggacaacttaaacaagaaaccaagcaatatgtacacactcacgtcactttaggaaagaagtggggaaggttgctccacaacacttttcagtcaattcattaatcattgacaccacgaattcttcagaaaacgggaacgcgtagagcaaaatgccaaaaagcagctcttacatctgtactgttggcaatactcaaattagcccattattaattaagtcattatcagtgacaccaatgagtataaatactttcatgcacttagtaaaatttgcaacagtatctgcattcagttctcagaactactagtctgctactctactctactactacaaaaaatgtatcagtaatttggagtctgcccctagtgtactactccattgaagcctggtatcatagtggcagatcagacaggtacgtctaatttggcagggcactctcactcaagtctgtacagtaaatgagccattgaaaggcatgaatgaagcaacctaccgttctttcacagcacaagatgcatgcataccttccattcttgctaccatgaataatgggtgttacataaaatgggaggatgcagaatgctacaacactaacacatgctttattgatgcatgccgttactgcatggactgattgaattggttgaattgtggtgctcttcacatgggtaagattgtagtgtaagagactaaaatagcacagagctcaaaggctatgaaagtatcattgccttagacttcactttcctgtgtggaaaccaccaagagttgtccaggtattcaatcaaaaaataataaaagaagaatgaagggaacaggtattcctaaatacctaaaagaaataggggaaataagaaaggaaaaactttagggttcctttggactgaaataatttcaaagaaaacctggaggatttcaataatccttggaaaatttttcctacgagctcctttggaacaacggaatataaagttctacgaatttgcttcctatgtctcaattccatagaaatctaagcatgagctcgtatacctctttttattttcctttgagaagtcccatgctctctccctacctccctacctccctctctctctctggccgtgtttagttcacccctaactactccaaacttccaactttccatcacatcacatcacatctaaaacttttctacacacatgaacctctaactttttttccaaacttccaactttcctcaaacttccagcttttttcaggaactaaacacagcccctctctcactctctctctctctctctctctatctatctatctatctatctatctatctatctatctatctatctagtatctctcttccacaaaacaatttcctccaaagtttctatattttatttgttatgaaccatccaagcgtataaactgcttgtgttttgaaaccctataggaattcctagtctgtgacatcctattcctacggtttacttgttcatgcgatttagaaatactgcattctaaaaaggagcccttaatctacacattagaattcaaaatacggcaggatatatgtagtctccaggaagcatgcaaatcaaacacccattttcacaaaattcatgtgttttcaatcctctattttgtgcatgtatccctatcctattctattgtttttttccctattcctacgttttttcaattctacatttcaaaaggggcctgaaagttaatgcaaatactcaggctgttatcaaggctgtgtttagatggtggaaaagttgggagaaaattggtagtttggagaaaaaattggtagtttatgtgtgtaggaaagttttcgatgtgatgtgatggaaagttgggaatttgggagaactaaacacgacccaagttatatgaggtctatgatctcaattccatatgtggcacttcaattttcatgtcatatatgtgccactttcagcgacaaacatgagattaggcaaaattttaatggtagacagggattttatccgaataaaaaaaatactccaggaacaatgctcctcagtccaccacttttcaagtttaagcgtcatcaatatcacaaaaggtaaaaacactacattcttttgtacaaatttttaagatgcaagaaaccacaagcaatggcattcctgactgagctttttatccaccggatgcacattgttatagtttgaaagaacaagtttcaaaagtcccaactataggaaaataacagagaacacggagcaaggtaaaacatttagtaaattgaatcaactaatcaaggtcccctgttagatgcctctacagttctttttaatttcatatttttttttactttagagatgaaagattggttgagaacaagtttaatagtaaagccaactatgatcttatagcttatattagagttaatatgtatagtaaatgagctataaggttatctgtattttttttctcctcactctagctctcacatatgcatttaatatattcatcttaaagtatgtgaatagttagttaactcttgcatgagccaaaccttttcattttcaaattctttcttctctacatataagcttgacttatagtctactattaaacttgctctatgaagatagaggctatacagaaacaatagagagaggataacagtgagctataagcctactataagcttatgtggaggagagatgtaacccaaaaaaaatcaagggtattggctttcatgcaagagcttaacacaagctccaagacatacattaaatgtataagtaaggccgtgtttagtttcccccctattcccaactttccatcacatcatatcacatccaaaactttcttactcacataaattcctaactttttttttcaaactaccaactttcctcaaacttctctctaatttcaggaactaaatacagcctaacttttccatcacatcaaaactttcctacacacaaaaacttacaatttttccatcacatcgttctaatttagatcaaacttccaattttgacgtgaactaaacacacctttaacatgacagccatgaagctctatggacatttatgaggtacccaccaccaccatctgtcccctctaaagagaaataacaatcccccctatataccctggcacaattggacagctactacacacagggggtatagttttgtccttaaatgcctttttgctctctccctctgctggaggattgtagacgcagcgacatttacgcaccaaaacgtttgaaggttgtcatgcatgcatgcatgcttgctaagggcgcaaagcctgagttttttcagctcagaagttagtagtaagtagacaaaatggattgaattcaaacagtgaagcgagcagccactgtgcgcaagcaacagataggcaagaatccacgccatgtccagaaacagttgcaagaacaggagcagtgacgagtttagtagcgaagaaaaagaaatgctactgcattttaaactttgcccaacagggagactcagaacaggcattgaaagcatgcaagactctggagggtattactgccgcagcaacccgactagtcaaaatctaatgcatgcatgcaaacggctcgagatttaatggtccatatcttttgcatcttctttgaaaagtgaactcttgcaacatgttctcaaaagatagcctcacactctcttggcagcagacatcaataaggtaggttcagttcatgatcgatttagactaatttacaaacttcaccagcccccaaaacaaaccctcctcaaatgacatcgatttagactaatttatgacactccatgatctatggtttaaagtaggctgtgtttagatctaggggttaagatccaggggtgaaaagttttaccgtgccacattggatatacggacacacatttgaaatattaaacgtagacaataacaaaacaaattacatattccgcttgtaaaccgcgagacaaatttattaagcctaattaatccatcattagcagatgtttgctgtagcaccacattgtcaaattatgaagcaattacgcttaaaagattcgtctcgcaattttacacgcaatctatgtaattagttatttttttcatttatatttaatactccatgcatgtgtctaaacattcgatgtgacagggtgaaaatttttgcaaggggatctaaacatgccattaaatacagtataagtcttgcatcaatgtcttatctttatttttcatggcactagctttcaaagacttaccatactttagtttcttcttcttaacgtcctccagattttgttgaatgctcttctgctcccccaccactgtattcagctgatcctgcagagcagcccagtgatgcatcatgaaatgaccataaaatgggtaacgtatgatcataaaattgcaccataaatattgcagttcctagagtcgctaccattcattcaaaacaaaccaattgcaaagctaaagatcttgcttggatcttatttgtttctgcaagggagacctcgcagttccaggaaccgcctggctcctacgggtgatgtgaacaagacataaatgacagagtagatcagcagggtagcaactgtgccctcccagtgcattttgaaagggtttaccccctatagctagtagtatgcaaagccatgattgtgttatgaacttctgatcaacaaacagtaacaaaacacctacatattaagtgaaagccgtgcaatgtaagtgcatttaaaagtggccaggcagaccagtggtcaccatttgtcaagtcagtttgtgcagaagttaaatgctctatacgcactgcagagaaaaattaagaccgagtatgtccaaagcatttaacttaatgcgattttttcccggaaagccattagattgcagcagcaattacagtaagtactccagatatgaatttttacctgttcttttaagtggcagaggatgcatggagcaatcagggatgttaaagagggagcatcagtgaaaaaaaaaggagcaatttcagatcttgactgcagtcgagtctttactactaaatgtttgaacaggacaggacacacacattagctggctgggaagaagaccttaattggtatgaatatacggacctgacagtttaacccatgactgcttgctcctaaacaatgctggatgcaacagctggacggcatgtctggccctcatcacttctggggactcagtcagctgaaataagaatcaccagctattcttatcagaggcaagagcaagaacactgtcagaaacattctcccatatattgattacaaagtggcaatatttacatcctgtcagtttacaaccggccaatcaacttttgatcggcttttagtgtagtatgcaatcatgatttggtagaatgtacacacaagcgttatcgatggattaaccacaagattgccaaaataaccggcataggtggccaccctggtgaagtaactatgctaactagagcaacgtaaaaaatacaacgaagtagaatgtgcagtgcccatcttggtagtcaagcaccaattgtggtactacacaagaacctgcgaccttgccgcacgacgggagcatttggttcgggcactcttgttcacactgcatgcacacccttccagcagctcgagatcttcctcacaaatcaatatggatgccaattctggacagtctaaaagcattttagagctaaggtatcctgcaatcgtccaagtttgatatagccttgactgcttcccaataaaccttcctgtccttgtgtcataatattctggccacttgtcctctgagagtctcttttctgcgacttcaatggctcgctgtgctaagtcacgcctacccatcttgatacaggctagagtgaactaaattaacaaatacaaatgattaaacatacaatcggtggaaaaaataatggaagcgttaacaaggttagtgatatatcaattttagatttttacctgccatagcaatgtaggccaagatccaccattatgatacgaccagggcctgtatgcaataacaaaggtataaaaaaatagactcaaatactgaagcaatgcaaatctggttaatgctaataatacttcctgacaaatttaggtttcaatatctgcatctgcacataacaaatgatgtagtcatcataaaaaagagtttttcagttgcttacgtgtttttagggtcactgccagtgatgatacgccattcctcatactctagagcagggtagcatatcttgagtggcatatttgcaattatatcctcccatttggcttcaatgaggttcaggataccctctgcttgcctttgagtagctagagaagagataattgcccagagatttccaagagaaaaaaacctgaaatccatgtgagccggttgtagatttcctataaggtaaccacccttttcaggaatccaatctgcaagccaagaaggtatttgttctggatagatattgaacttattaatagcatcatgggagtactcttcagttttgtagcgataaatttcatttatcttcttcatatcaacccaatagtactctcttatgtgaaacgacaaagcactgagcctgtagttgatggcacggatcaaactgttagatccgtcatttacactgaccatttcacgggcacaacgcaaagcagaatagaatagcgactgcaaaatagataccactaggtcaaaaaccactacatttgagttgtgagtaggacttgcagtgaagaaaaacaccagtctggtactgaaagtctgagtttgtcaaaatcattatcaagcattagcttacctggatctcaagaggatgcccatggattcccatccgtcgatcgatcatacatgatccatcagtgactaacaatgttgggaacatgtcaaatccatcagacaagcataaattcaggattagtctgatgcctgtctgcacatcaaccctttcttgtagtgcatagtctccagtaattttaccatatgcccgcaacaggattatccaccaaagaccttataaaaagaggatggtataaaatatccacgtaataagtagtaagagtatattcaaaagtataatatgaacctatctagcttactcacccgaatcaactggtgctacacgtccaatggctgactctccaaagtcagggtcaagaacctcctcaaatgcttcactgtttccatctagaggtatggatctaactttgaaactagcaggcatcaatccctgaccaggactgtagcaatcaactgtcttctcccagctctgataggttaaaccaaacaaaaaaaaagtgacttttctttcaaaaaacaccaatgatcatcataatttatatattttaagaatgatacaaaatttaaaaataaaataaaagaaaagaaagaactcaactcttatgctaccaagcctaccatagatgagctagcagcgtaatgtgatgaatcatgacaaatgaagcatcttaccctatcctgtacatagaaacatagaccatggaaatttggtcgatactggtctcagaggtttggatacgctagtggatctatttttgaagttatggaacatgtttccagaataaggataagtatgtcttttattttcaaaagaacatattcatgttgtgatttattagttagagcttagaacatacttgtcctagagtgttaaaccagtgttaaccaccttacaaaaaccaaccaaagtagtagtgatttttaacagtcccaaagtcagttggtaatatttcagatttagaacaccacacaaattttggtgttcgagtattccagatttgcaacatggtatctctttgtggagccctcactacagaataccatgctctagctgtctcgaagtagtgcagcactcttctttcttttttgatttgaatgggttatggctagcacttgtgatgctaaatggtaacatcatttcttgcccctgtcccttatactgtagtatagacaagtagacaaccatgtagcactacctgtagacagccataccaactgacactaatgattcttgacttcttgagtattggtagcaaacttggtcatgcagaaatgttgtcttgctgtcttgcatgaatcatcaatcctatcgtgttctaattttagatgaagcttagtatgtactactaaatgttatgcattgcatatgaataaaaaacaattaaaagtgtattttaagacaaggctgagaccattatggtcatatcactaggaatgggcctaggaaaagaactagtaaatgataacctcaagtcatgcacccttgccaaaaatgaaaagaaaccatatctgctccaatagttacatttaaataaaccacatgaacttttagatcaacaaacaagaatatgtcatactcaaggtgccggcgctacaagattatagtattagtattataagtataacagaggcatacatcatgacaaatgtacattagtggaaatttagaaaatatacaaaacacatagattcagatccttcaaaatcctcatacgcttaaacaagttgttgtttgaagtcccaccaaaattatgccaggttgtaattgcactaattttgtgttatttaatactcaagttttttaagcaagtttctggtgcaagaataattggcattgttgcaagagatgcaaggatcataatctacttgagggtttattagaacaattgctggtgttatctagcaaaggctaatgagaaacgcctagggttttccggctagctccacaaggtggtgggctagacgacttgagttcgaagcctcaccccttctaattatttgatattaggtccttccctaatattcgcgtctagaaagacataatatgtgctactttgtgcagaagattttctttccacactgaaattgcatcagaatttgtgttatttgatccataataacgttttaatagcgcactgaacattattaccacggctacatttaaaccgaagatgcatagaatgtactactgccacggcccacgggtaacatagcatttattccgatgtttgtttgggcgactgacctggagttgcaaagtgtggagcaggaagttcttcacgatgtccccctcgcccttgaggaggaacgcgatggccgacgggacaaagtctctaatgaacacctgatcgtaattgagcatctggttcgcggtggatgggtcgttcgccgccaccgtccccacggcggtgccgcagtagctcacgaccgagcggccgagcagactccacgcctcattctcctccgtcgactccttcctgctcctcaccgtctccacccaggccttcagaccctccaactcgtgctggcacgccgtcgccaccggatccttctcgggcgcgggtagcccaggctcttcctccgggggaggagtcgcgtcatcggggagctcctcgatggggggcgactccagcggcggggcccacgaggcgaggctggcggcgcggaaagggtcgaaaagcggcggcttgtagctctcccccgtcgaggacgcgccggagtccaccgacgtggaaagaaagcggcgggctgaggcggcgaccgcggcgaggggagccacccccgcggcggaggaggaggaaaagcggcgggtcgagaggtaaaggagcgcgcgggcgtggcgcggcgcaccgcggcgaaggtgggagatgtcggcggccgccatcggtggcgatttggattgcggaagaagaaatctcgctgcttcgatcggattcggtgggggatttgattcgccgacggaggagagagtctctagaacgggtaatggcgactgcgatcaactcgttaacaatggggtagtttcagtttaggagaagtgttaaccttagggcaaccgcgagatcggacggcgtaggagtgaccacgtatatggaggttattctgtccgtaattaacacgggccgcgggacggcgggagccgaacatgtggcgagcaagccgtggcctcgtgggtggcggcgtgtccgcataggaggagaagcaaaattcgcattggaattggcgagcaagcgacactgctttcatcgctggcaaaacaaatagtatcaggttttcttaattaaaacacggaaaatcatccgaaatcaaggcggtatgggtaatgggtttatctaaaatccagaaatacattgccttcaatttaaacaactaacatgtccgtgctaacgctacgacgttatttataatgcaaagcaaacaaccaaaaggtaacaacatatgtttcaaaaagtttctaactcca

SEQ ID NO: 2518 - DNA, 15651 bp, Oryza sativa
  unsure (1)..(15651): unsure at all n locations
aaacacggaaaatcatccgaaatcaaggcggtatgggtaatgggtttatctaaaatccagaaatacattgccttcaatttaaacaactaacatgtccgtgctaacgctacgacgttatttataatgcaaagcaaacaaccaaaaggtaacaacatatgtttcaaaaagtttctaactccatattcaaacaagatcacaagtatcattcccaaaaacattgaagaaaatctaaataaattaccttctggagtcttagcatcgacatcatttttaaataactaaattagctacaatagtattgcatcgcgctggtggaacattaatgtcttccatcttagaaaaaacctacccatcaacactatcatcactaccagcgcaaccatctgcctatcttagtaaaaagcaagcaacctgtccatcgtaatgatgtcttctttgcaatatgccacgtacttcatcaggatcctttgggttctcccaattctctcaagcatcgatcttcttgaatataccgccatcataattctttgggtctagactggagagatgagccttacatgaattcaaaagaaaactaacttacagaggctacacatgaattgtttatatatatatatatatatatatatatatatatttgtaaatttacaaatagttcttcttcatttccttttcacaatctttgccatgtacttccggcacaaattcaatggttaattaatccgggtccaattacataaaagcatgaaaacaaacaatttgcttgaaaagttcagaagtgaaaactggaagctattagtgcagattaaatcggagcacaatgaaaaatccaaatacactccactaaaccaatttaattgcaaggttacctatatggcagccaaaccccttaaatgcttagacagatccctagagagtagtagaaatccctaagaaaacatgcagttgttggttgctaaattatgcttagcatcctaattacatacttacggcaacatgatgatggtgttttaccacctcctgctatttttcattttgcaccctttcactcgtttgcatgcctccccagaaattggtgcagcaaacacgatcccatctacacctccataaagtaagatttggttcttttgacttcttctagagcatggcaacattggtttctaaatttgttaaattcagaaatggtctctctgtatcatgtacttttgttttggtccgataaggccttaaaattttgagttatcagtgtacagaatgcattacccagtgatgatgtagaactggtttaggtgctgcagctatcaagactgaaaattttccattgagcattctagcaatctagcacagctaacaactcattaaatgaacatcactgatcaaaatgcaacagatcaaaggcactggttgatatcgcatcgtactaactcaacgtagccacgcgtagcagaagcctaaaccgcgctgccaccggagcccgtcgcggggggccgccggagcccacaagcgtacgagcaacagtgccttccgtaccaactacatcagccaatggaaccagctcccagaaacaccacaacaggtaaaatctcattgttttttcagggttagcctgatcataattttcagtataatgttctcagcccgaagaaccttaggttgagtattgcatataagtatttatcatgggaatagagtagtatcaaatcttaattcagatgataagagtgctcaggtgtcgatctgtgcaacattattctcacacaatgatatcttcataagcttctgaaacttgaaaatggtttgcagagttcctgccaaggaaaaaataaaataaaattgtgccatcagtaacattggaaacaagagctctatttgatcaaagtcacatacatctagcgccaacagtctatgaaggccaatatctgtagcacgatttaataatgctcaaaatgttagatctgctcaaaattgtggtagcatgttctttccaataaaaattactgaaagtgcatctaggaccccacatttgtttttggtgttaatgacaacacaattagagggtaactaatgctttttgttgagatgtctgcaaggatgaaaaaggagtggaacttaagcatagaaagctttgtggcaatttttgtggtaaccacctctctaaaccttgtgtatcatgtgttcttgagtattagaatgccgtactattaagagggataccacatgcatataattggtagaacactagtgctcaaaatcctttatttgaagtgttcctgttttattcctgtcggactatccgatctagatcagactatccgatatccgatctagatcagactatccgaaatttcacagaactttgccctctgtcattggtctgagtgttggcaaaaaaaaatatcggactatccgatataaggtcggactatccgatacatcggactatctgaaattttcttagaacttcactctctgttttgaattgctttttattcctcttgagtgaatttcaaatcagactatctgatgtgatcggagtatccgatgacccagagactccgaaattcaatggaactttagtctctgtgagaggatgaaattcatgattcaaaaataacggaatatccgatatgacatcggactatccgatcgatcggattgtccgaaattctccagaattttgttctctgtctttggcttgcttgggggtcaaaaacatcggactatccgatgtcacctcggacttttcgaggtgggatgaaaagattcccttctgctaatgaccaaatttggtaaattctatcattattggcatcggagatgaagatcagatcgaagtggaatccaagatgaagatcattgcggaaacagagtaagaatcggctgcagtccaaatcagctaaggtcaggtcggcagagttcgagtcggatggggctagccgatatagctgattctgataatatgactaggtgtacgtcatcgggttcaagttgatgtgcttcaagatgattgccacgcatggatagagtcctgggaaggcaattgtatctattaattaggatattctatgtgatttccttagagatatgtttgggcaaaagtctgccgtaaatacttatggtatcttagagtttgttagagataatagtcgtgtccgttatggacgtatcttgtaattctcgggtataaatagacccgagccctatgtaaaaagtgagaacacatccaatacaatctcggcgcatcgccaccttttttgctttacttttatttcgacgagttcgtgctctcggattgagctgcatcggtttcgatcttcaacaagaggtaaaacttgtcatgacgacttatgttctcaggattagtgcttccatctttatgacactataatcttgtctatataattcgtcgagttatcatatatctcacataatcttcgataatatctttatctaacctataatcggctaacatctgctaatggaaggcagccgattaggttagacaataacgttaacttagattatgtgatatatctaccactctatgaaacctccagcggcttgattgtctagatattgttcttcttttcatacttaatgctgcatcagttgagtttgatctattaagtcatgcttagaattgcaatctctagcctgttttctggttgccgattagggtagtatcggagtttcagctaatcttatttgatttaactacttttatcccatatgcttaatctatatgttaaatctgccctttatgttaagatcttgtcgcatctaagtatattaggcttatgtttggtatattctacttgctttaacatcttaatatagagtagtatcggagtattagccgatacatgctagatctacctgatcggctatgctataaatgtatataatcccactattaatatatatttcgatctaagtgatttatactgtctcggcaaggcgaccgatctatcccaatcacttgatttaagtatacatcgatataaggattatatatcattaatatctacagccgatcgagtagatttagttctgatttgcttattgatatttgccaatcgatgtacgcatgacatcggcttgaaataaatgatatgtcatcggcacctagccgatcggctatcatttataggattaattgcggtttatttgttctatctcttgttgattgcaggatcaaatcaactggcacgctcatacatccgaaagcgagctttggacctgcactggagttaagcagatctcccaggcctcgtgttttctgtcaacaccttcccaacggccacattttgggggatctataaatacccccacctaactcttttctagggttacccaactcattcattcacattcactttgggttgagcttggtgctaaggtgctttgaatctttgagctctttctccctctctcaaatccctcttcgttctttgtgtggtggatcttagtggttgtggatttggtgtttgagggcctagtgtgtgtttcactcgatcttgagcactagggtttgaccaagagttgtgtggtgtttgttactcttggaggttgaggactcctagacggctaggtgtcactcccgagccaccgatctacgtgtggttggccgggagaagtttgtgaaggccggatctcgcctccgcaaggaaagagataccccttagtggaaggaggagtgcttagtgcaacctcttgaggaaagggttagtaaagacccggctcttagtgagctcctcaacagagagtagaatcctctcaaggatttgaactccgggaacaactccgtgaacttcatcgttggtgatatctcttcatcttctctttagctttgcttaattgtgccgctatagatctagtcgctgtttgcgctatactcttgtttgtgtgttagatctgcttgttgtgactctttagtggatcagacagtctgatccaacatcagactatctgattttttcggatagtctgactgtggatcagacttttcgaccctaactcagttttagcttccacataaagttttaaattagcctattcacccccctctaggcctaattgaccctttcaaatacaacacagagatcagttgaagtacaatcgcattaattaaagtacaatcagtagtgccagttagttctagctaaataaaaaattcactaaagtttccatttgaggttgtttaacagaggaaaaaaaatctaatgtgacaaacttcatttagagtaactttaattcactgccttcatttaaatacatttgtaatccattttcaatttcatttagaccgttcatacgcagtttaaagcgggatgatgcaccaacccaacgtaacctaaagtaacttggtttagacggtttgggccaacgtctttcacgagttaaaccgtcttcatcttcctaacctgtacacaataacgaaccaaagaaaatgagaagggacacgatcatgaccgacctcaataagaagattatatcaactggagcaatgtaggcacttagaaaatcatgttacgattctagtagagggctctccgggcggctaatggagtgggaggggccttgcagccgcacaccgcccatggtgctagcttgcctagccacgtgccgtcgctgccaccgatcttagtacaaagtgaggcagatgcgatgtcgatgggtggtgactcgtggctatttgcctacttcccgcatcaagtttattcattaccacgcgcaatcacaacaacaagatcaccttcgtgtacgactgaagcggcgatggtgcgctggcatgggcactgagtgacgacatcatcccaggcttcatccatccttttggcaacatgatcgtcactaaaggctccaatccaagaactctcatgccataaccacggggatggattccaaggtcagctcccagatcatatggttttagtccaagcaaatggttgtacgcgacattatccttcctggttagcgactcacctcattggtcgagagcgtaatgacgagactaacaatgagatgactagctacaatgatgaagggaatgtagagactaagcacacggtttggacgagttttagagtagcccaccacaacccatgtataactttgatctggattggtttaccggtgttggcgatatggcatgaggcccttcgaccaaacctgccgaaaccagtaagaattcaagcccgaaatgtcaaggttagtcagggcgaagcccccctccctccaatggtgaagactaggaagcaaggacggcgagaggcagggaatcacgcgggtacctcgccaagccagaggcctcctaggcgaaggatgtagggcgaagagtatacgccgaagggggtcgacttcgccatagcaagattcggcctcgggaggaccgaagaagccatcctggcccatcaagtctaagggctaattgggtcgacaatcacttgacggcccgttaagggcccatgaaacacaattacactgtgtacccatgtaaatgtccctttcataagggcaaccatgtaaattctcctgtataaccaaaaccctagtagtaagaacctataatggggatataaatagccccatagggccatgtaatagggggatcccaagaaaaattatcaatttaatacactttacttctttcccaactactgttgagtgaccacgtctttcgacgtatgcggtagtcgtttcgacaacagctggcgccgaccatggggatttccgagcgaaaccactgagagcaaatgccaccgaaaagggtcgtgaaggagaaggttacaaggcgaaaggaaagcgaagccgaggtggagatggtcgccgaagagggagcagagccttcggcgccagttgccgaagatggaggagcattgtctgcctccgcacctgcaccatcactactgccttcggctcctgccacctctgcgcaggtgctgaatgcggctgacatggcgaaggcagccgcggcggcaagggcactccagaccaggcggagatcctttcgacaagccaactgctggtgctccaagccgctccgtcgcagctggcagcagcctcgattgcgctcgccgctgtacaagcccaagtcaacccagaccccgaaacacaaatcgaagccgacatggaagccatgcgacagaacatgacacgactccaagacatgcttcgccaaatgcaagaacagcatcaggcgtatcaggcggcgaggcggtccaaggtcgcttcggccccagtcctccaatatttggcaagctacgtcccaccccaagtctatccacaagcaccgatccagccccttccgccacaagttacgcaagcgccagtatacttcaccgggcagccctcgaccgcagcagtgcatccagctcctcacgtgcaactgcaggctcagccggtcgctgcccaagtacaccctcaaccgcctggccaagtgtcacaagcaatggcagaatgggcttcggctctgcaggcgcagctccaagctttccttcagcatctcagctaaccccacagcatttcaggtacagccccttcggtccacccggaggggaatacaagtcaaggtgcacctagttggttgccgtcgaatcagccaggtctgggggcttcgccttggagtcaaagaccgcaattcgacttcatcaatgcccctcaggcaccaaccgttcggccgcaagcaccaacgccaggcttcggagcaaaccaagcaccaaatcaggtcgccatagcatggtcccagcaaacgttcgacccatccatggcggctcaacaagcatcaccaatcagagccggggggccgaatgccatggcccatcctcaggcgcaagccgtgatttcacccttcgccacgccatacccgcagcaaggtgccgtgaacagggcaagagccgaaaagaggctatcgctgagtgggggaatcaagacccatccaatcccaccccagttcaagttcccacccgtccaacgctactcaggcaaaactgacccaaaggaattcctctccatttacgagtccgcgatcgaagcggctgatggtgacgaaaataccaaggcaaaggtaatacatctcgctctagacggcatcgcccgttcttggtattttaatttgccagccaatagcatttactcacgggagaaattgcgcgatgtctttgtccttaactttcgaggcacctatgaggagccgaagacacagcagcatctactcggcattcgccagaggccgggggagtcgataaggtagtacatgcgtcgcttctcacaagcccggtgccaagtgcaagacataaccgaggcgtctgtcataaacgccgcttcggccgggctactcgagggcgaactcacaagaaaaatcgccaacaaggagccacagacgcttgagcacctacttcgcatcattgacgggtacgcaaggggcgaagaagattccaagcgacgtcaagcaatacaagctgagtatgataaggcttccgtcgctgccgcccaagcccaagcacaagctcaggttgccgaaccacctcctctcgctattcgccagcatcagccgacgatctagggacaaccaccaaggcaaggccaagcccccatgacctggaggaagttcagaaccgaccgtgcgggcaaggctgtgatggctgtcgaagaagtgcaagccctctgcaaggagttcgacacccagcaagcaagcaaccatcagcagcctatccgtaagaaggtccgaaaagacctctactgcgccttccacggacgctcttcgcataccacggaacaatgccgaaacattcggcaacgtggcaacgtgcaagatctaaggccgcagcagggagcagctgtcgaagcacctcgtgaagcagctgaagaacaagcacccccggccgaatagcgccaagatgcgcagcgcagagtaatccaagtgattacaagggccgacccgccgatctagctatcgaagtgataaaagaagatgcagctccgaatggtccacaatatgatttcggcgggcgaaggggccccgaagtatctgaaccagcaaatctcttttgggccgggagatgccgaaggagtaatgttcccgcatcaagatcctctggtgatctcagctgagatagctggcttcgaggtccggcgaatcctggtcgacggagggagttcggccgatgtcatcttcgccgaagcatatgccaagatggggttgcccaccctagcccttaccccagcaccagcctcgctccgtggtttcggcggagaagcagttcaagttcttggccaagcacagttgctggtagctttcggcacaggggaaaacagacgtgaagagcaagtattattcgacgttgtcgacatgccgtacaactacaacgccatcttcggccgtgcgaccttgaacaagttcgaagctatctcccaccacaattatctcaagctcaagatgcccggcccggcgggagtgatcgtggtcaaggggcttcagccttcggccgcttcaaaaggcgatctggccataatcaacagagcagtgcataatgttgaggccgaaccacatgaccgggcgaagcacgcgctaaagtccgcccctcacggcaagataatcaagatgcagattgatgacgccgaccccacaaagctcgtatcgctggggggcgacatgggcgaagaagaggctgcgaacattctagaggtactcaagaaaaatagtgatatcttcgcctagggccctaatcaagtgggaggtgtttcgatagatctcatcatgttcacctggcagtcaagccggacgccaagccaaggaaacagaagctgcgcaagatgtccgctgatcaccaagaagcagcaaaagccgaagtccaaaaattgctcaaggctggggtcatccaagagatcgaccatcctgaatggctggcgaatccagtgctggtgcggaaatcaaacggcaaatggtgcatgtgtgtcgatttcacagacctaaacaaggcatgtccgaaggacgatttccctttgccacagatcgaccaactcgtgaattcaacagctggctgcgaacttatgagttttttggatgcatattccggctatcaccagatacacatgaatccggccgacatccccaagacagccttcatcacaccgttcggcacctttcgtcatctcaggatgccattcggcctgaggaatgccggggcaaccttcgccaggctggtatacaaggtcctttacaagcagttagggcgaaatgtggaagcttatgtcgacgatatcgtcgtaaaaagctgcaaggctttcgaccacgtgtccaacctgcaggagaccttcgacaacttgcccgcagcaggtatgaaactaaatcctgagaagtgtgtttttggcgttcacgcaggcaagttgttgggtttccttgtttctgaaagaggcatcgaggcgaatcccgagaaaatcgatgccattcagcaaatgaagcccccgtcgagcgtacgtgaagtacaaaagctcgcaggccgaattgcagcactcagtcgattcatctcaaaggcagccgaaagaggtttgtccttcttcaagaccctacggggcgcgggaaaattcaattggacacccgaatgccaagcagcgttcgacgagctgaagcaatatctgcaaagcccgccagctctgatcagcccagcaccaggaatcgaaccgctactatacctggcagcttcgctagtggcagtcagtgctgccctcgtccaagaaatagagtcaggccagaaaccggtctatttcgtctccgaagaattgcaaggagcgaagacaagatacattgaaatggaaaaactcacttatgccctggtgatggcttcacgcaagcttaaacactacttccaaccccatagagtcatagtgccatcgcagtaccctttgggcgaaatactccgaggcaaggaagttactggccggcttaggaagtgggcagcagagctatcccctttcgacttgcattttgttgcccgcactgctgtcaagtctcaagtgctagccgacttcgtggccgaatggacaccggcattcgtccccgagcccgaacccgtcgaacaaccctggatgatgtattccgacggttcgtggtcgcataagggggcgggcattgcggcagtactcacttcaccaagtggtgtgccgattcggtatgccgcaaggctgcagttcaacacaaccaacaacgcggcagaatacgaagccattcttctgggcctaagaaaggaaaaagcattggggattcggcgcttgctaatccgaaccgactctaagctggtggcaggccatgtcgacaaattctttgaggcaaaagaagaaggaatgaagaggtatttggaggccgttcggtctctggaaaagtacttcaccggcataacggtcgaacatttgcctagaggccagaacgaggaagcagaggccttggcgaaatctactgcttatggtggcccacattcgcctggcatcttttttgaagtactatatgcaccaaggtgcccatggatagcctggaggtcatggcaattgaccaggtgaaactgggcgaagatccatgcgactagcgaactccgtttgtgaaacaccttgaaactggctggcttccgaaagatgaagaagaagcaaagcgtctgcaactcagagccacgaagtataagatggtctcaggccagctatatcgctccggggcaattcaacccttgcttcgctgcatctcttttaccgaaggtgaggaaatggcgagggagatacaccaggggctctgtggtgcgcaccaggccgcaagaacagttgcctccaaagtgtttcgacaaggagtgtactggcccaccgtgttgaaagtctgtgttgagcaagtcaagaagtgtgaaagctgccaacgccatggccgaagtcaaaacgcgccccagtatgagttgcagcccatcgcaccaatctggcccttcgccagatggggattggacatcattgggccgttcccggtggcgcgaaacgggtacaagttcgcaatcgtatccgtcgaatacttttcccgatggattgaggccaaaccccttggagcgatcacttcggcagcagtacagaagtttgtatggaaaaacattgtttgccgtttcagagtgccaaaagagttcatcactgacaatggcaagcagtttgactctgacaagttcagagaaatgtgcgaagggcttaacctggaaatcaggtttgcgtcggtcgcgcacccacagtcaaatggggcggccgaacgcacaaacggtaagatcctagaagcactcgaactcttggaagaagtaagagtcgaagcactcgaacacatgcgcaactatgccataggcacttcggcaacttacaataaaaaagttcgaccgacggagctgttgcctggtcatcttgtcctacggaagaaggcgaacctgactgccgttggcaagcttgaatcaaagtgggaaggaccatacctcatcaagaacaagtctaggatgggatcctttcgactggcgacactggaaggagaagagttcgaccattcctggaacgctgcctctcttaaacgtttctatgtctagaacaggtggcacccaaatcgccaatttgtaaaaacgtatatatcgttatgtaagcccttcggcactatgtaagcctttcggcaaagaaaaaaaagaaaaaaaaagaggaaaatgaaaaaagacaaaaaaaatggatgtagggctattatccatcacggaggcccgaaccagtataaaacctctgtgtcctccgccttctttttatttacttgtgtgattgataatttgtggaaaaactccaaggcaaacgcctgatcagcgaaaaaggccagggggcgaaacgaatcggccgaagcatcgctcgccgaatgttgaaaccgcaacagcttgtttcgggaaacaactaaccgaacaccgttacactcgatcaaaaggaaagcaccaacgcttcctacaacatagaacaaaacggatcgaaatcggaagccgaaagctgaaaagtcaaaacctatttcgctaatatacgcaaaggggccgacacgttccgacccaacgaaagcacgcgaagtgacaatgcaaaaatagcgaaaaggagataaaacacatctttattgattttaaagaaaaatatatcaaagagtacaaacccatcaacatggtgcaagtaaaaggagcaatggcttcacagcccaacttacagataaattacatctccgtccccacaatcactctctctctaaggaatgatcaggcgaactaggttcgtcatcactactaatatcatacacgaccctaagaggagaagggggcgaaacacagactagactataacgacgctggaagattaactcccgccgatcagttctttgatgatttcgccaaaagcgaaccatatcctccagacgtcttgtacgaacaagatcgtagtcttctagggttcgcctggggtgcgctcttagccagccggcaaccttaaaaaccttatagctgcggccgtttatcaccatttcgcgataaacaggccgaaatgggcattgcaccctcggcaaacccttcaacgccacgaacttctcgttgttgtttcgccatttttcagcgggaggtcgaacacatacctttcggccgcaagcctgctagcaaagcacaaaaaaaaggagaagtgcaaaaaaggagggaaatatagacgaagatcagttccgctttcaaacagaacaattaaataagcgaaagggttatactttgccagtagaacaaagactatattgaatacaaggcgaaggcggcttaaagctgaacaaacaaaaagcttatatacaaaaacttaggctacaagaaagcccgaaagggccgaaggaaaaaataaaataaaaagacacgagggcgaagggtctcacacctcagggtggtcttggcctccgtcaccttcgtcctcgtgcccgagggaccgttccgacggcccgggatcctttttggagttgacagcggcggcctcctcgttcctcgctatcctttcaaggttctcgcggagtcgaatcttcgcacagtcccggccgccatcctcccaaaaccgtcccggccgccatcctcccaaaaccccttccgaaaggcccttagcgcagccccggagcactgcgtattgctaggccattcctccttcacgaaatcaggaaaattcccgatgtggtcgcagccgtgtgtgtgcaagaggctgagaacgaatcccgccgaaacacgagcgcaacagtccccataggcgcctgccacttcgacaaccgagccggccgcctcctgcgtccattcggaaaaatcgagcacagtcccgccttcgcccggagcaccttttgcccgagccccaaggtcgttaagggccagctggagagtgtaacaggcctccttggcagactccgtggctggtaccagggtcgcggcggcatctttggcggacacaagacgggcttcgaggcatttaatattctccttagccgaagcaagttgtcggtcctgttcggcgtcctgcttgcgtgctgcttcaaggtcagagcggagagacctattttcagcattcgccttcttcaaagtctccgccacaacgcgtctttcgtcttccttgtggcgaagatcttcttcggatttgcgaaggcgaaggcggtacccatccagtcgctctaaggcggacttcttggcacttaggtgcgcggcaaggccctggtaaaaaaaattacgtcagggaactggcgaaagagcaaaattcgacgcttaacaataaaaatcatacccgcacaaataggctttccacagccgcgcagctttcgctgaactcgttcagtttggtgaagagcccaaggccttcggttggggctatgacctggcacacaccgtccacgaacggagtgatctctggccgcgtggcgaagtcagcggggacaaaatgtggggcggtaagcgtcacgtccgaaacgctcgcttcaaccgccggggcctttccctctcgttgacgaacaggtgaaggaactgcatcaacccgttcgtccttagcaacatttgccccagcggccggggctgagacactcccacccgtcgccgcttcggcatcgctagcaggtggcggagacatgcgcctaccacgggaagctgcgcgccgtaaaaccggcgaagtaggagtcccgtcggacccctcgttgtccgaaaagccattgccgacctgcacaaccttccctttcttcttccttctagcggtcatcaccggtttcgcggctgtgctggagatcgccaagagggtgttcgccacgacaatatcttgcggccgtgtaggcgcaacatgagagcccgccctagatttcgcaggagtaggactggggtataaccatgagagccgtcatccttagaaccagcctccacatcttcctcttcctcctcatccccatcactttcgacggcaaccttcacgctgcggcgagttcgaacttggtcgcctttcacgaccgcacgcttgtgcttcttcgaagtgccaacttcatcatcaccggcccgagagggtttcgattggcttggaaattcgccggtataaacatggnnnnnnnnnnnnnnnnnnnnnnnnnnnnnnnnnnnnnnnnnnnnnnnnnnn

SEQ ID NO: 2519 - DNA, 1785 bp, Oryza sativa
tcttcttccttctagcggtcatcaccggtttcgcggctgtgctggagatcgccaagagggtggtcgccacgacaatatcttgcggccgtgtaggcgcaacatgagagcccgcctagatttcgcaggagtaggactggggtataaccatgagagccgtcatccttagaaccagcctccacatcttcctcttcctcctcatccccatcactttcgacggcaaccttcacgctgcggcgagttcgaacttggtcgcctttcacgaccgcacgcttgtgcttcttcgaagtgccaacttcatcatcaccggcccgagagggtttcgattggcttggaaattcgccggtataaacatggttcacccggccgtcggcttggcgctgtagcaagcgggcgaactcggccgtggttagagctctgatcatcttcgatgcctctatttcggcgtcttccaaagcccgcactgcgaaaagataggaacacaaccgtttagtctaaaaagcgcctccataaaggaaatatgcggcctagagcaaaaacaaaaatcttactttcaaccccggcagggagaacaaggcggggaagcccaagaacttcttcgccctcgatcacggaaacgtcccacacacgagcgagaggggaaatccgaagcagacaaaactcctcacaaaggtcccgggtgcttagccgccgggcaaccttacgaaggagtatgagccgggactcgagagtcccattgatttccatgtttggcttcgcgttgatggaaacggcagaacgctaaaaaaggagccagttcgcctgggcatcttctgcgaagtagggactgctgacgtagaaccatttctgcatccagttcctgtcccacttcgccatcgatgcaggtactagccaagcatctgaacgctccggccgcagcatgaaattcacacagccgaaaacggttttcctcggacccgccggcgtctgcacgtctttggtcgaggcgcatgcagtaaacagagcggcaaatagctcagcggtagggacgaacccacaggttcggcacatccaagcgaaaaccgccagcttcaggaacaccgacgggctaagctggggaagcctaacctcatacgtcgagagcatcgaaggcaagaagttgtcgcatgtgaggcgaagcccagcggcgaagaatgcgcgcgaagacaaccgttcgcccatccccaagcgagggaacaacggcttcgcccccgcatgatccttggccctccgtgagagaaccggatgataccagttcgcccaagtcggcctctttgacaagtgatttgccaaggaagcacgaccatccttcgccaaggttgccaggatcttcgccagttgacccggccttggtaggcttgcgaggagccatcgggctcgtagctcaggaaagaaagggaaagagccgataggctaggggcacgatgatggcgaaaagctaaaaagcaagagaatgaagagagcacgaagcgtgtcaaacggtaaaaaagggagaacgtggggggagtgaaaaaatagcaggccagcttgggggtatatataaccccgtcgcgagaccgttcgcctgccaaccaatcgagccctgacacgtgtccaaggacagacgaaacggtaaattcccattgggacggagccaaacagtaaaaagcccgattacggagaaggaaaagtccatggggcccattactattcatagtaataaaagagactaaatagcccccttcgacgctttgcaaccgatgcgaagaggagattttctcaagaaatttt

SEQ ID NO: 2520 - DNA, 2513 bp, Oryza sativa
ttttggttttttcaatatgtatgtatttacgtatataaagtttttatacgcatatacaaacacaaagttcgtatacaacagtgtagtagtagtactagtagtatagtactagggcctgtttggtacagctccaactcctaaatttagctccaggagttgagtctggagtggagttgtggagctgactaaacccaactccacaactctagttcattttgtgagatagctccacccaactccactcccagttttggtggagctgaaactgtttggctgagcttcagcttcaggagggctggaggtgtgccaaacaggctcatagtaacagtgtagtcgtactactagtagtagtatatgagcagcagtagtagtagtaggtggtatatgagtagtagtagtaggtggtactagtagtatatatagtactgaccgtgcggacggcgggtgcccaatcgtccattagcagtccccaagatctagccctcaagacagaacccactagcaaaacgttttatacttaacctcaatttaccaatatttttgtaccgtgtaaggtattcccgtttggactcggatcgtcacagaacggaaagtctattttcgccttaaaagaaaagaaattgatgtctatttgggcctcaggatactgggcctacatggcccatatactaaaaacatccagcacgcggaaaaagtacactgaaggtccctcaacttgtcatcgagttacaaaatcgtcctccaaccacagaaccagatatccggcgtcccttaactaaccaaaaccagtcacaatagatccttcggtggttttaaccctggttttatcctacgtgacgactgagtcagcatgggacccacatgtcagaccgccacgtcatttctctccccacctcttctctccctttctcggttcctcctctctctcagtctaaatgcctgtaggccggtcggcgggagagaaggagggcggcaccacgacggcggctgctccgcccgcggagacgacgcggtggtcgtccctggcagccacgaccgcgagcctcgtggcgatcggcctcggcggcgccgcgctgctggtgtggtgggtgctcgcgttccacccggcgaacgcacgcctctggatggtgcctgcggggctcgtcctcctcggcacgcccatcctcgcatggctctccctttgcctgtacgccggcccgtgcactgccgtccgcgacgcgccggtgcacgtgtaggatcccccgcgcgagtctcgcgcgcgcgcattttttgctgcttccagctgctccatttcgggatcagatgtacatacatgttcagtgttcactgctaactagtcatactatacttctttctttgatttcttgctgattcatttcgggatcagatgcacctgcacatacatgttcactactattttgatttctttgtgaattcagctgcgagctgcagcgtgttgatgctagagggagagggacatgttgcattgatatggacatatggtatatatgacctggtgtacacagttgctttccaagattacttcctccgtgtgtgtgatatggtgaatgcgaacttggccacctcctgcgcgaagtgctccgcctcgtgcgccgctagcgccggcgggctccatgagccgcactcgaacctctccagcgacgccagccgtgacacgctgctccgccgcggccaccggtgtgtgacacgctgctccaccgctgcatcgccctcgtcgtcgtgcggcaccatggacctcccctcggcgcaggatgcgctacgtgccagcgcgggggcggcagcgcccggcgcggcgacgtagtgggcaagcgcgaccgagtgttgccgcgcgagggcgcgcatcgcctccatggctttggcggtgggctcttccctttcctcgtcaaggatgggaggctagcgctgacgaagttgggctgccggagtggcggcagcatcggcgacgaccgcaccaccacctccctgcgtgcaaataccggcgaggcggacgacgaggcgaacccccggcggcggcgaattgagagagagagagaggaggaagggagagaagaggggaaagagagaggatgtcgtatcgtcgccgccatgtcgcctgcctcctcctcctctcccgccttgcccagcggcctcctccccagccgcacgctgctcctcgccgcctgcgcgccgtccctcgccgtcgcccgccctgcagctccttcccccaccgccgccacgttgcccgccatcaccgccgccatgtcgcccgtcgccggccgccgacgccttcctcctcccgccggctaagtcagagaagggaaagtgagacgaggaagggagagaagagggggagagagagagagaggaggctgacgtgacagcacaacgctgactcagccgccacgtaagataaaaccgacgtaaaaactaccaaaggatttattgtgaccggttttagttagttaagggacgtcggatatctggttttacggttgggggacgattttgtaact

SEQ ID NO: 2521 - DNA, 2750 bp, Oryza sativa
  unsure (1)..(2750): unsure at all n locations
nnnnnnnnnnnnnnnnnnnnnnnnnnnnnnnnnagtaagaggcaacggcaatcccatgagacaacgtgcaatgacgcaatgcaatccgacgttaatctggttagttttaacaaggtactaccatattttaatgtatgacgccgttgactttttacccaacgtttgaccattcgtcttattcaaaaaattatgtaactattatttattttattgtgacttgattcattatcaaatattctttaagcatgacataaatatttttatatttgtacaaaattttttgaataaaacgaatggtcaaacgttggtcgaaaagttaacggtgtcatacattaaaatacggagggagtacaatctaatgagactgggtacaatggcacaatataattcattgaacgtgacaacagtaacccaatgagttctaataacaactcgcccatgcttgacaaggtaaaaggctactttcactctcaggggcggatccagcgtaggtgctgggaggactaggtctcctctaccctactggatcaccattcatagaaggagagagtataaaactcaggtgtatgcaggaaagcgtcacggtggacgcagggtttcgtgttgattcacaatacgcaaaaacgtgctgagtttacagatatatatgcatgcagatgtgttggttcggtgatcctaattacaagggattagagtcctatcctctatctatccgaaccaacatgtatccgtgcatatccatacagagaatgataagatatgataagatctaacactcctcctcagtcctaactctttctaggttaaaattgttcttgaacatctccatttgtcttactggtatagcttttgtaaaaccatctgcaacctgatctttagtagatatatatgcaatttcaagcaactttctagctaccctttctctcacaaaatgaaagtcaacttctatatgctttgtacgagcatgaaagattggattagcagaaagatacttagctccaagattatcacaccatagcttggctgctcgaggcgattctactcccagttcttgcaacaaaatctgtacccacataatttctgctgttgcattagccagagctttatactcagcttcagtactagaccttgatactgtagcttgttttctagcactccatgatacaagatttgggcctaaaaacactgcaaaacctcctgttgatcttctgtcatctggagatcctgcctaatctgcatctgaaaaaccactaacaagcagagagggattcctacagaacttaagacctgtataccctgtatatttaacatatcttaagatcctttttacagctgcccaatgagttgtagttggagcatgtaagaactgacacaccttatttatcgaaaaagaaatatctggtcttgtcaaagttaaatactgtaaagcaccaactacactcttatactgagtagaatcctgaggtccaagcaatgttccctcatttactgataatttttctgaggttgacagaggagtactgaccggtttacactcatacataccaacccgtcgtagaagatccgatgcatacttctcttgactaagcatgagaccatccttcactttatggacctcgattcccaacaagtagtgcagatcaccaaggtccttaagagcaaagtccttgcttagttcctgcagaagtgttgaagttgcatctggtacagaactggccacaataatatcatcaacatatatcagaagaaatatagaaacctgtcctttcttatagaagaacagtgatgtgtctgcctttgaaggtacaaagcctaactcacttaacttagtacttaacctggagtaccaagctcgaggcgcctgtttaagtccataaagagctttatctaatttacagacatagttaggcatagacttcttttcataccctggtggttgcttcatatagacctcttcttctaggactccatgtaggaaggcatttttaacatccaattgtctaagactccaacctctagagacagcaagagacaaaactattctgatagtagcagctttaacaaccggactaaaagtatcctcataatcaatgccatacctttgcttgaatccttttgcaaccaaccgtgctttatacctgtctagactgccatctgctttccttttgaccttatacacccatttacaatctatgacatttcttcctttctgaggaggaaccaaatgccatgtcttgttttctatcagtgccatgtattcagcatccatggcctccttccagtgtttattattcactgcttcttccagactctgtggttcaccagaagaagtaaaatttagccatttaacagttccatcagtatataccttttctttcctgatcccgctttggagacgtgtttttggtctgatcggtgcaacagctgcttctggcatggcctgatcagtttgatcagactgatcagtagtcacatcatcatgcacgccagccgatgatgcaacagatggcgatgtggacgacgctgtttgtggggacgcttgcaccaggtgctcctcctggattggattgccatgctgctcagctgccgacgccgtcgcatcatctgtcacaggcgaagagtgctccggcgacgcatcatatgccacaccatgcacgtcgtcctgtgcaccaccatttgctgctgctgctgcattttcatctgctgctgctgctgcattttcttcaccgtttgctacaatttcttcaccg

SEQ ID NO: 2522 - DNA, 1763 bp, Oryza sativa
  unsure (1)..(1763): unsure at all n locations
gtggcaatttctagacacttgaaccctttatgtaggttactatagcctagaaaaacacatctcttggaacggaaagctaatttgtgtttattgtaaggccgaaggttgggccaaacagcacacccgaatattctcaatgctgtatagtttggtttttccttgaacaattgttctaaaggacatgcaaagttgataaccttgctaggagtgcggttaataaggtatgccgcagcaagaacagcttcgtcccaaaatttaattggcatagatgcatgtgctagtaatgtgagtgcaacctcaatgagatgtctatgttttcgttcagctgaaccattctgttggtgagcataaggacaggaaacatgatgagagatacctatcttagcaaagaaggtgttgagtttttgatactctccccccccccccaatctgtttgaacagcaagaattttgtgaccaaaaaatctctcaacaagagtttgaaactcctgaaacttttggaatacttccgacttatgcttaagaaggtaaacccaagtaaatttactataatcatcaataaaactgacataaaacttctttccaccaacagaaataggagcagggccccagacatcagaaaaaataagttctagaggttgacttgacacacttgaagacttaggatagggaagctgatgactcttgcccttttgacaggcatcacaaattgagtctttatttgctacggtagaacaaggtaaattattcttgctaagaactctagtgactatgggcacggctgggtgtcccaaacgactatgccatcgggagaaggaaggagttgtggcggcatggacttgcttggcaggtgatgtaggaagggagtagaggcgacggcggcatctccccttaagaatcgtgttcctcgtgactcgatcctttatcaaaaaataattggaatgaacctcaaggaaagcaaaattatccatagctaaacgatgagcagagataaggttctttttcgcttgaggaacatgtaaaatatttttgagatgtaattcacgagtaggggtatgaatgacagaatcaccaatgtgcttaatttccatacctgcaccgcttgcggtgtgaatcttgtctcctcccttgtacttctcccgaacatctaacttgtcgagttcgttggtgatgtggtcggttgcccctgtgtcgaggtaccaattggtgtcgatgccatatgcagctgctgcagccgcactcctttcatcagggacataggtctcatcgtacctatgccaacactctgcagcgacgtgccccctcttcaggcacacttggcagatggggcggtcattaccaccccgagtctgatttcctccagtgccgcgcccacgtcctggagcagcaggattgctgcgcccacgtgtgccacggccgccgccgcgaccacgctgaaaaacaccacggcagcgtgcggccgcgttcaccgaagcatgagcttgccgaagagcttgcctgttctcaaagttaagaagctgagagtacacttccgccattgtggtcgactcattgcgtgccacaatagcagatacaacaggttcaaaatcatcatctagcccattcagaacataagcgactaaatcttcctcatcaaggggtttccctgaactagcgatttcatttgctagtgctttcatcttgccacaatactcagatatactcatgnnnnnnnnnnnnnnnnnnnnnnnnnnnnnnnnnnnnnnnnnnnnnnnnnnnnnnnnn

SEQ ID NO: 2523 - DNA, 27557 bp, Oryza sativa
  unsure (1)..(27557): unsure at all n locations
gagagaagggaaaaaaaagggaggggaggggaggggaggggagggggggagtgaatgaggaagaaggagattagttcccatataatgttttttctggaactgtccctattcacatcaattgctcaactggctaggtgagcacttatctttttaaagtagctcactcttttagaactagcaaaggtgttattaaaagtttgcatgcatgtatctcatgggttgggattttaatattctcatagaaattattctctacataggtcttggatcacataataattaattccaccagttaagcctctaatcgttttagactgcacggacccccggccggactcgacgcgcgtgccaaagtgcgtactacggcgacacgttcgagctgttgagcaccgcgaggagatcgatcgattgatgctcctctccgaagtgaagtactgacgttgatatatcgatcactctcgatacatacgtatatgatcaccgcacacaaaactaaacgtgcgcgcgctagctcgatcgtttcagtgagtgtggtacgcgtactgtcaatcaattatgcatgcatggcgcgccgatcccacatccccgaaggccgtacgcaagtcggtacgtggtcaagttgcccacctgagatcaaatcgcatctcatcccatcgcatcccatcgcatggtgccctgctgccgaaggcaaagccatgcaacttcatcccaagcccccaccccccgcgcgcgcgcgcgtgcccgcgcacatttacctcgccaccgcgtctgatcgatctcgcgcgcgcggttgccggagaaatccggcgtgtgtgcgcgcacatgcatgcggtcgacgggcaggtaggattttccttggcgtgtgggaacaccgcgcactgtatcgtggcgcctgaacctactgagatgtggagaggcacatacgagagtattctgcagctcgattgctactccctcctactagtactagataggtataggcgctattagccaaagctagtggctgagaccgcgaggaggccggctgggctcgtgacttccgcgcgcgccaagctaaggccgtaagctaagctaggcgtcgtcgttggcatgtggaacccagccgaaccggagcctcaaattcccatggaagcatccacgaaccttctcatcgcacacctcgctcgatctcatatccccgaaagaacagtatgtgtgatgcgtgctttggggcactttgggcttacgcgagggatcacgagctagtacagtggtccatcaccatcgatcacatgcgtggtggtcgtcacgctaaggtagtttgtagtgtaagactgccggtgccagttgacaagtatactcctatgtcaaccacaattgcatatcgtgccgtctttaggcaaatatcgaagttggatttatgctgatatgggagagaaaatgggcaaaaagatagctttataagtattgaccatcgtgcattatcgaagaaataagatgggagggacgacgatctttctctgcagatgttcgataaaattgaaatggtacatactgatatatgtctaaaactgaagggatgacgtgcacaggtcgaaaaatagtcttttttttacccggcgaaaaattcttgcctagatcgagaagatacaacaagctcatcattataaagcatatagtacatatcgatctcttcatgaattaattagtaatatttcaactaatagtctctgctattattttcatcaaaagaaatattatcctctgttatatgcatgtgtttattgtatttgtaattatatttgcacaatattaattggtgttatttgacaagcaagctgctgctacgcaacccgctgattaccatattgtttgtgctggctgcggcgcagccacaacccatgcagtcgaacaactccatcgctagcaagccttaaaaagatagcacatgctatgctatcctttattgtatgacatggcacatatatatgataaaacaaaaccaattaattaagcatggttaagcagctaactgtgacaacccgcaatgcatggtagctagactttttttttctttttaagtgacaccttactatttacagacgataattaagagaccgctactccctccatcttagaaaacccaactttcccagaagttgtttttttcctaggacggggtgaatacaaatctacaactgcacaatctatgttgaatgcaaaaccgacgatttgatatgtggatgcgtatagctatgaatctatatatttatatacatctggataattgcgtacaatcagttttgctcacctgcccgaggagacaaaaactataaaagtacgtatcaccattcaagggaggcaaaataattccaaaataaacagaaaaacggtggggttttggttgttatcagctgatgatttatccatagtctgactagctatctatagctatagtaactggaatacttaaaaaagctttcacgttgatcagaaaaatctgatgttggttagatatgttgtgttaccaaaaatccatagatcacataaaaatcagtgttaaataaaatatactgttgaaaatagcaaagactcattagtttcgttcctataatttagtaatttataaatttgaaatttataaatatgaagtttctttgtattcattttaaagtctcggcttagtttttcgttgtttagtctcaaattaaaaaatactaattattaagttgtagtaattgatatggactcatttttaatgaccacaaaatagttcctaaaacaactaatgtattcaaatacattaaaattttaattaataattaaattttcttatgttcacaatctggcacaccaacaatattgtccttgcaaaaataagatccaactctcacgagtttacgagtagtactgttaaacacatacatagtatacctataactacttttctttctttttttttttgggggggggggtacctagctagctacttttctcatgttcaacctggcacacacgaaagaaaagggcatatagtacatatatatctggccaatggataaatggataataccatacatccataaggcaattttaaggtaagcgatatgcgcgagtacaacgtgccactttgactagttgcagcagcttctgggctctagctgtggcaacgaaagagaaattcgtgatcaggagatccacaacgacgcaataaggtgcaacttgccccatgaattgtcgatttcacaacctcacagcgactttgcactgattcgttgcggacaagcattggactttccgtttcctgcgcctttctgaagtcttttagtttgagggggtacggggtggagaccccctttctcttgataggcataatgcacttttttgttggtggaaattgatgatgcccatagttgctcaggcacagagagatagagaagaaagaactcagctataggtaggatgacccagcccaattcagagaaaatctaatctagatgattgtgaaatgtatggtgcgaaaacactagccctattgacatgtaagttcatacatatcgggtgctagcttaggtctcagttagttcatttatattaattagcagcacaaataacaccgagtgacagcgattagatggataagatcatgcatgctctttatttagtgctttacatgattggaatggctgaaaaattgagagatctccgcgttcttttaacccacaataatatcaggtagtacactttctgctctcctgatgtcattaattagcaatttactaggtaacacgcgctagtgacagtgagtagtggctaatgtaatgtgtgcaccactaaagtgaacaagctaggcaaacagcgatttcctaattaattaatcagcacattcttcttggctcattttaatcacctgtcagcgcactagcaacggggtgaaatgcataagctaggccagaaagattgatgccctggcatggcctgttttgacttttaacttccctagatgaacaaaaagtctaaacaaagagatttgtctccaaatcttgcctacaacaatctccccctctttttctataaaggggcaggagacctacgcataatctacagcaatctcctgtggtatttgattagggctaatgcgatagctttcgtttcctttctttattactgttagagttgtatggcaaagatctgattcttatgctatggtataggattgtttgaaattgagtaatttgtgctgatcacctattcctaccaaagttttaatttaggcccatcttaaaagtattattttcactttgggctaagtaattctgacaaaagttgaagtttataccaagtaacctacatgtcatgcattgtgattaaccatatatgttactgtccatgtatcaattacatgtggaccacttggttcaaagcgcaacatttactaacaatacctaatcaaagtgaaaaaaaaacacgtcaaagataatccaaagtaaaactttgaaaaatatatagtaaaaaacgtaatttattcaaacatcatctctatgattatttgagatcagtcaaccagtcgaatatttgtgaaactctcaatacaattattttgtgtactattacagttgtctactctctccatccctaaatataagagattttggtttgatatgacacatcctagtacaacgtatctagacatctaaatctagatgagacaaatagtatttcttgatcgtcgaaaatatgtacaagcaccggtgattatagcaacagagcctacacaaccacctgactagctttggagttacctccttcattgtttatggtaccaatcgaccttcccttatgtagactctagacaccttaagttatattcgtaagtacgtttttcaaactattaaatgatacatttaattaagaaacttcaaataaatatatttaattatgaagttataattgttaatacataataattatgtactaatcacccacgtcgtgttattcgtggcatagttaagctaaacctagcatggtgctgagttattatctctactttcccaactaacttcactcgttttttgcacgtacgttttttaaactgctaaacgatgcattttttataaaaattttctatacaaaagttactttgaaaaatcatattaatctatttttcaaatttattttagctaatacttaattaatcatacactaaacactgtttcattttgcgtgctgggacacccgagacactgcattgctcaaaacgtttcgaaatggacgatgtcgtacatatatgcgtctccaaagtccaaacccaatcccatctctattcaagaaacagtaccacagtacagtacaatggtacgggtgctagtgctagtgctagactgcccctagccagccgctgcgcgtgcagaagcagaacagaacggacatgtgcagcttgcgacttccgtcgtcgacgaaacggacagacagagtgctagacgggcagtgtcccagtaggaactagaaaagcaaagccaaacccagggaaaaaggtagaggaaaaccctcggctcggtcggccgctctactgctactgggtgtgaagcctcgcaagcggaaaagcgcgcgcggcgagggagatcggcagcacgagcacgaggaggattgaaccgaactacgtctcgctctcgcgcgccgagtcgagtccgcccgcgttgacccgtccgaacccgcccttgacctgctgacgtgtgtggcgcgggcgctggcaccgccgccgcgtctcgttgctcgccagactgtctttaatttgccgggggccacaccgccccccgcggcggcggcggtgcatcgcgttgcgtcgcgtcgcgcggatcttctgctccgcccacgacgatctccgcatgctccgactgcgtctgcgtgtgctccctaaaccgcacgcaccgtgtgaattgtgatagtctgattagtgatttagatagctcgatcagtgagcatccaacttggcacttggtaatcttacaataataattctccttccagaatgaaaagaaaaaaaaatgaaggggtcattttatacgatttgcgaaaattgacttgctggtactgacacgtcaggctcaggccccacatgcctgaaattccacgtcgctggggccagtgacaatgtccacattggtactacgtggtacgtgattatgcgggaagaaatttccatgcaacgcttccatatttgtctgtcaacaattggctcgccgctcgctgtcttgtgcttgggagttcacagtgagcgtgagagcatgcaaaatgcaacacctactcatgccggcccggcgcctgcgttgagtgcaatcacgcatagcgcggttagtaccgtctagttacagcaacaatctactactcgctatacgtacctgcatgatcactggtcttttgtgaaaaaagaactccatgatcactgatcactagttaagcagtcaggaaagttctaatatgtactctccgttccaaaataattaacttttatacgcaaatttagacacagactatatctagattcatgtgtaaaagttgactttgtttttgatagagggagtacttacataaatattttcaaagaaattatatatacacatgttgatattttaataagggcatctttggagaaaactttaacaagtgtagctagacattttctcgctcccctgaatagtctagatatttcgacttctgagtagatagctacataatccattaaatgattggtgatctaaagttggccaacttatctaggttctcatcaattgtgtattcgctgagtgcttctcgcggaatccagctctccaaatttgagtaaatgaatgtctagatgacatgatttctcaatttaagtactactccttatatctctcaaaatataaggacttttgtcaattttatgaccaattaagcagtgagataaaagttcattatgtcccttattaaacaattaggaattggtggctgaatgttgggactaatccatcctggagtataaattaggggtttaaatctgattgcacatgttatataaattatatccaaatactactatatatatcactaagattgtaggacccaaggtataagttaattatttaagggcggggcttgttgaatttccaaagttcttttataagtaacataaatgatcagtccctaaacttgtgggggtggtgtcatttaggtccgtgaaattgaaaattatacatttagatccgtgaactttgtttaatttaccactcccggtccaatcgctctttgacacagctaactgcttaggtgacgtgccacgcaggcaatacttttgcgcttagacccctccgcatcacagtgcgccacatataccctctttagctacaatgacacccgaatccccctaaaaatatccccaaatccttcctccctctcattcctctccttgcacatacagaaaatgatgccctaattaataatcgtcattgttgtgcactccacaatggtcctcttcttgcacaacgagcactttatcaacggtaccttcttctggcgactataagacgaggacgagtttggagaagccatggggatggcaagtgtgcaagcggcactaccccgcctccccccactaattgatccacactgcgctacctcccgttgctaacctcgtcgtcaaaaccctagccgattcagagatatttgggaggttctgtttggaatgcactgataagggcaaattatgtaagaaaatatatacaaagggggataaagtgcaaaaatgttgtctacgtagcgcgtcatgctggcggtcagccgcggtcaaaaggcgattgaaccgagggtgatacactaaaccaatttcatggatctacacgcgtaatttttaagctcatggatctaagtgacaccactccacacgtttagggaccagtcatgtattttgacatgaagagagtaaaaaaacgatgcaaacaactttgaatttttcaaggttttgttagaaattaattcaattcccgccaaactcctctgaaaattctccattccaaagaactgcttagtcggcagatgaggcacacacttcgccatcaaaattgggttacagccatcattccgttgctggcccaatgataatcatttcccgttccgttttaccagttcaacaatcagcgactagtgtgcttcctttttcttttttggaccaattggcgtgctaattcagagatagatagagaaagagaggagaaaaatatcagcgaatcaacaccgagaaaaccttctcatggaagctgacagttcgcgagtggtgcttaggtcggcccagccacgacaatcgcgcgggggctcttttctcaggttttccacttttccttttccgcttcttaattaatacaagtgtgaaactacgaagaggaaaatgtggctagcttccatgatttattttaaaatattttggttcttttttaaacattttttaggtatacccttagaaaaaattattgtagtaatggatcacttctgacgctagtcaggttagtgccatggaagtggatcagtgatgaatctagaatgaaatttaagtatgtgctcatatttatgtaaattattttagcggcaaagtaaatatatatatgcctatcattttttaaactcaattaattaatacataaacaaaacaaagaaaataatgaattgtataataaaatcatgattcgaaactgttggtgtggtccatggccatgtcaatagtttaactgtatggccaaattactttattggtttttgaaacattaaaaataattcaaccaaaattgacaaattggtattctcaacgtttactaattggcacatcaggtacaatctcagaatctgctcatcaattatgtgataaggattaacaagctaacaagaaatttggttgattaatctcacaacttttaagttttcaccattctcattggctcttagtaatcagtattgcattcttgcttgcagtggctgataggttggagggcagatctggcccttaagccccaactatgaatccgcccgttgagagggccagggggggaggggggttgggttcgatataatgccgttggcggagccattggatctcggtgctaatgaggttggtacctaaaaatgattcatttgttaatacgttttttccctacaatctattcataaaaaggtttttaaaaagatcaagatgtaaacaattcacgctagctccccttttattcttttagagaacacacactctcgctctccattttcactcccttttaattcccttttccttatctgtgttttgaggtgatgcatgcaacgccgcttggctggctgggcccacagctcagtcgcatgcaagagtgtcgtagtgagcgtagtagcagcaagcagtagcagtagagctcactcgctcgccatgcgcgtgccgtgcggatggtttttagtgctggcaattaaaaagcatatgtgctcgacatccacttgggtttcagggctttcagagctgatcactcctgctctgctaatgctaacgttaatcgtcactctcacccctcccctcgtctcgtctaaattatctgaacctgacgaggtgatgagttgcgaaaacaacgtgtgtagtgtcacgcagaaggccacgcggatcatcacatctggggagagcgagccgtgtcgatcgatcgatccgatgtaacagcgcacgcgatcgatctgcaccgaattctcgcggtagaaaacatccgtgtcggcataaacaaatcgaagcgatctctcgcaaaacgctcgctcgcggtcgcgatcagcgtaatgataaccaagccagccactgcaacaaaaaacacagaaaaaaagggagaaggatcgagtgcgcgaggatcacaattagcggcgagaaatgggccggggatattgtgtactagtgtaccactcggctcgacactggagcatgcaaagtgtagtaattaatcaagacttgacgtcggagctttgcttttattaccggtttctagaagtgtacagtaatcctgtcaatcctacagagttcagctcgtacatacagtagtggcagtactgtatttactcaaaaagaatgagtaaaatttaacggacaaactttagtaacagcagcatcaacactagtataacggctacactttaacttctttttttttaccctaggaagtaaaaaaggagaaagaaacggaaaagaactggagttagaatagtctgggagctaggagtccaaaaatggcatcgtgaggcgattaatcttgttctaatcccccagatagcttctctccttcttctaatccgcttctccgctccgctacgcgtccccggcggttgtgcacccgcgggtgtcgcgcgcgcgcgcgctcgctcgccgcggcggattcccatggcggccgtgctgacttttcacacggcggcctgggtggggcaccacagctggtcgtcctccatgctcgtccagaagctatcgacgtcgaagccgccgatctcgaagtccgcgacggcgaggtcggggaaggtgaggccaggcagcgacgactcggacgtcgtccacgtctgcccgccctggcacggcggctgggccagctccagctccgtgtcgcgcatggccacgccgccggtggcgctggaggcgtcgcaggcggtggtgaaccactcggcgccgtcggcctgcgtgggccagctgggctgcgccccggcgccggagtccgtggacagcgacgacgacccggccgtggtgctcgacagctccggtgcaggcgtgccgcccgactgcgcgccgccggccgccgcgcagtactcggctggccagcagctggcatcgggcgccgggagctccggcgactcgtagagcccgtcggagccgccgtgctgccacgacaggggcggcgtgtcggtgccgccttcctgctgctgctgctgcccggcggcggcggcctggatgcgctcgacgaggcggggcatccagaggtagcgcatgacgtccttgaactgctggctgttgacgtcgcacttgagctgcttggcgtgcttctgcacccgcgtgcgccagtagttcttgatctcgttgtcggtgcgtcccgggaggtgctgcgcgatcttggaccagcggtttccccaccgcgagtgcagctccaggatgagcagctgctcctgcggcgtgatgttgcctcgccggaggtcggggcggaggtagttcagccaccggagccggcagctcttgcctgtgcgtttcagccctgcatgacaacaaccaaaaaccaagattaatttttctcttcacgtcacatcaaaatattcacatgtagtacaccattgctaaaacatagtatgcagcaactaatcaattatatactaatgcagttatacgcatacgacgacggcaggatggatgatgtaacgggggagggatgagcaactaaaaatatccctatgaacaatgctagctacgctgctaaccactaaaaattctctcccctttccctctcactcactatagcttctagcttagctggttggctgctagagaactcagggtagactcgtagctatctgtgtttccagaaatcagcatgtagatgcaagagcgactggtactttgcgtcctataattgctcatcaggctaagcatgtacggacactcagctcatggaattgatcgatgtgtgcgtgcatgtaatttatggtggaattgggagctcgatcgatcgagatcgcgatcctacctgctgatcgggcgagcgagttccagcggccctcgccgtgcgcggcgatgtagttgacgagcaggaggtcctcctccaccgtccacggcccgcgacgcaggtcgccgcccatcacctcctcctcgctgctcgcgtccctctcgtgcgccatgtccatcgtcgaccgatccggatcaaaatccctccctttcgagtctcgatcgatcctcgcgggccagtcgattgatcggatagatcaagctagtagctagatcgagctcaggagattctggttgttgtgctttggtagaggggtactatatatgcgccgttgctgtgctctctggatagatggatggatggatggatgtgtgctgcgatgaaactggcgggagacggggagggaggtgtcggggtttatatagacgggaggagcgcgaggagtaagaataagaaagaagaaagaggcgggtaggctgggctggacgacttggaaagaaaggaccatgtgggggagaacgccgcaaccggggagattagtttacgccttttttgaagtttttttttcccttcttcttctttaaaagccaaaagtttaggcgattaacccccatcgtggttaattagggataatcatgcgattaggattaattaaccacgccgctaatttaatcgcccgcgtacgtacgtacacgggttggagagactcgggggacttttgcggtgggtttgacccgttgactcgtccagctgtacaggcgtacagctcactcgcgcgcgctacacgcgctcgcgccgtctgcctacgcgggcctctgccgctggggcccacctgggtccatttctgtcagccagttgggagctacctcagcttctagttccggtgggaaaagagatacggagtaactacgtataccttatagccatggaatacacaactgatgatggtacagatatactgccactagcgtatactactacttactactactagcagtattggagcatctgtggcaaatgggcacaataattgctgctgcacaaatcacaaatactagtacgtatactatcggtagtgtagtacaccggtacggacaagtagtggtattatcgcaaacatgcgtgtacacctctagtacagtgcgtctgtgcatcaccatggttctacactccagtcgtaggtggtagctggagtatattataaaatatcagggcatccacaatagttatctatagactctctataagatatccatatcagtatattttcctacttgaaagagattaaatgaagagagagagagtaaaactatctaataacttggagatagtctatagagaaaaacgaggtaatggatgagagagctatagatatccatgtagacatactattgggatgatttactattagtctagtctattgttgagatgtatatattttatagagagcaccttactttaccattgcgggtgctctcaggttatatatagggttcacataaccgcttgtgaaacttggaggtttcaaagatggatagagttgatgatccgcttagtaagccaacagaagttaataaaattaaaccaaaatttaaactatctgacaattttttgaatttatgtggttttgaaaggactccgtgtgcgaaagggcttgtagcctaatggttacaagagcctcagtagcacctgaggtcctgggttcgactctccatgagagcgaattttccaggattcaacagcgttgtgctttcagtggtaggcgatgtttgtaaacctggttataagtcctatcctatccgaggtgtttggagctagcacataaacttcagctgacaccataagaggtgtatgagattatgtactattttcagtcaagaatatttgatgttaacgttgttatattagtggcactactgtcaaattttatcgactaaataaattactatcttattaaaaatatcgtattaattggataaagaatttgttggattatagtgagtcatgattaaattaattgtgttacatacgtacatctctctaagagttatataccaaatcggattctacacttaaatttagcatagctcaatattgcacacaaaaacaagctacttacttcctccgtaaaaaaaaaagacaaaccatgaattcccgtgtcaacgtttgactgtccgtcttatatgaaatttttttataattagtattttcattgttgttagatgataaaacatgattaatactttatgtgtgacttatctttttaatttttttcatattttttccaaataagacggacggtcaaacgttagacatggaaaccagagtttgtctttttttttttttatgggacggagggattatgtgtgatgtctgaaagaagccagaaacttcagctgccaacccagtagatgagattgcttgtacatattgagcagcaaaattgacttgatcagtctcagaatttcgactattccaaccaggagatcattgttggtggccgaaacgttcggcaaatgttcatctcagagccaccgcctcttcgccgagctttccccgtatgagctccccaggtcccctctgcgccgcgccgccgccttatctatccatcaggaagaagaatatcccgaaagatcttcgcatgatttgcgacgatcgagacgaacaagatcgcctcacctctccagacgcgtgcagctgcagcaaaagcctagctggctggctatagccgctgcatgctacggctaaactgatcgatcgatatcgacagcgatctgtaattcccctgcacacacacacaacaccccctcacgcgtcaattaatacacatcgtccagacgacgttacgtacgtacatatacgcgtttgtcacactagggcgcagcaatgcatttccgctcgatcgatcgatcgatcgattcaactttcgcggtgcaacagtgtgaaaattgctgtacaacagcaggcagcagctaaagttgatatacacagcgccccccgctgcactgtttccaccgtacatcgcgcgcgcgaggaggaggatttttgacccattttgctcggattttagctccgacaaaccgatcgatcgattgacaccgcgagcgatgcgagaaccagcggttttttttgtcaagacgtggaagacaaactccacacatgcggtttgttttttcaaaacaagataattgaaaggtactagtaaatcggtacaagtgttctagtattaattgggcggagtcgtccttgactatttaggctgcgttcgttgtgatgagttatgggggattgggtgagaaaaggacatcgtattccgcgtgcacgcttcccaaactactaaacggtgtattttttgcaaaaattttctataggaaagttgctttaaaaaatcatattaatccatttttaaaatttaaaatagttaatactcaattaatcatgtgctaatggctcacctcgttttgcgtatcttcccaatcttctcaatccccctctcctcaaactcacccttagtactactagtatagagatgatgggagagtcaaccccaactggcaagagtcatattctctcattgatctgccggggtctgtgtgaaacaaatttaaaagtcccaagttgcagctttgtatacgcaggaaaaaaacggatgctgagaagaagagatcggtgtggtcggattccacaccggggttgaaaactttggcagcttgaattggattcttatgtgccgttttttcaacacatggaggtgctgtttttttaaatttattttccaactctctgtttctattttatcccctgttttttcaacacaaatcagtttcaggatggtacacttgctcacttgcttgagaatccggtttgttttttaagctttgacaggctgctgcagcggtagagtagtatagtattgtttttatttcgaacggtcagcagtatagtattgttggtttggattttgtccatgcacttggcgacttgtaaatttgtaattttaaacgagaaaccggaccaaatctgccaatcagatggcgtccacggtttgattcccctgccagcttggcctagtctgttttgtatttgcagagctatgctgattgctgtagttctagtagttgtagtagctcgcaaataaaggtcaaagtgtttgctgagttggactggcgtgctcgttgacccccaactacggccaaggcaaagccacttgtggttaatatattcataatatttctgttcttatgcgagaggtcgatcgatctaatctatgtcgatcactgtcttcatgtgacctgcagcaacgcatatgcgtacaacagttcgtgtccgtgatggtcagtacatcgaacattgctctcgttttggctcttcacgcacattctcatgtgcgtttttttttaaatgttggagtgtacaagtaaatactcgtcctatcttaaaataaaggaaaaaaagttcggataatcttctagaataatcgtggaagtatgaattatccttctcaatttttcatacaggacgaattacccctcctctcactctacagtggttttgattctacatggcacacacacacatagtagtccagtcaacataaaaataaaaaatggtgaggcccacttatcggttatgtcttttctctcgatcaccacatgtgggtcctaccttttttatattttcatattgactggactgctacgtgtcactattacaaaaacagtcaaataaggtgttggttgggaaccggctataggtgtcggttttccaaccgttacctattggccggcatctatgcgaatcatatagttgccggtttaaaggtgccggttctttattttttaaactgtgggaggtcggaaaaggttaataggcgtcggttttaaataaatcgacacctataaaccagtccctatgagggtttttgtagtagtgtgtgtcacgtagaatcaaaactgctctggagtttgttgaggattaatacatctggtataaaaaaaaattcgagagtaaagaatgatttttttaattgaggggggtaattcgtattgccacaatagttgaggggtaattcagaattttttaaaaatataagaatcaagatgtatagattcgtatataaaagttgatttttttccataacaaaggaagtagggcagtttagtagatacggtcaagttgtgtaatgcaacgagatttcaaactttttgttgcacggaattggactctaccttgaaattttctagtattccaaatatagacaaaatatccacactaccgaaccctatggatttattttactgtagcttatattggataatatacaacttttgggattgatattgtgatcatagtgagaaggcttgttgcttagggtaaaaaaaatatttaaaaaggatattacccaggtgtacagcataaccacttctgaccatgatttttccttccaagaacttctagatctgtagtacctccggttcctaaccaaaaaacaaacaaacaaatttgtagccacttgatcagagtttataaacaaatttgtaaccgcaaaattaattaatatcgatcacatcgtacttgccttgaactctcaatctaataattttctaaagttaaaatagtaataaccagcaaattataaactcaaagtggactcactattaataaacataaaatttaatatggtgtgaggtcttaattttattttatttcttaataaaatgatttctatattaaaaatattaaatataaaattgcacttggcttgagtcttgattttagtttaaatttggtaatttcaaaagtcagaatctattatatgaaattgtacatttcttggactataattttagtatgatagtaccaatttaattccaaaattcagtattaatgggcaaactgtaattgagatgattaaattattcttcttttattctaactgtatattttcgaaggtacaaaagccagcgacgaatccttaaccttactgaatccctgctaaatacgcaccctcatcaagtcatctgtgcattgtttgtaccaaccaggatttaatccatcttatataaatgaggtttgtcatgcatatgcatcctttataaatgatccaattaaaatggatgttcaaatttattttctgtttctccgatcaatatgtgattgtgctcgagatttccagttgatatacttcctccatccaactgtccatcttttattatgtatttttataatattttaaaagatgatatattaattaccaaagtgctttgcatgccacatataaccatccttacttttactggataaaaaaacaaatttatttcaactaaaaagatacgcggcgagatttttttagttgatcttatcaagtcgtttcctttcaactttcttttttgcagatgggaaaatgacgagtcgcctgagttgaggaggataagctgctgtggcagcctggcaggaggccggcatcacgtatacaggcacgaccacatgcagaggacaacagtggaacgttgattccgaccacccattttgatgacacgtggaaaatctgcatgcatggggactaataaaaaataaaataatgcatagatatgcactgggggcgatctcagccacaataatcttttcggtgcctaaattatgtaaaaccccccgtttttctcatcaatatcgtttcgcttttcggcgcccagtgcttctttatggactatggtacttgtgatcattgatcgaccactcgccgttagaagaatgttgatgaagtggaaatccggtccatttccccctttttatatatatcgtaatgttttatccactaatgcggcgcattccaacggaaattaaagaaaaaaaattcatagttaccattcttaatattaatctaagaattcatatccatgttggaattttatatcttctcctcatgctactgtagttgaaataaatattcaccgtttgatggttatatgtaggagatagtggtggtagctagctatggtaggagatgataattcatcattcaccattaccacttatctctcccttcgaaaatataatcatttttagatttcgacacggtcttcgagatactactttgaccaataatatgtatagaagtaaaatattttaaataaaaagagttgcatattatgataatttgtttaataataaatctagtaatatcaattttacatgatagatcttttctatttttttacttttaatagtcaaagttaaaaatatttgacttggcactatactaaaatacttatattttgggacggagagagtaagtcttttcaaggagtacaaatttttctagtttatgctttatcgtccatcaaatatttacagaagtggttaaaaaataatgtatatgtagcaatgataatcgaaattcctatctctcaacgctgataaagtgaaggatgatgtaatgtagggtgaaatttatttattttttcttttgtagaggtggggaggacaacgacgacatgggtgagctcgtgatctacctcttctcgaacgtggtatggtcgtgggaaggagaagataagacgataacgttactatttatgcacaaatcttgatgcagtttacaaaatcaagtgaaaatttgcggtatttttgggtgaaactagacagtaaaaaaaaaaaaacttatactgctacgcgctactacctacaggatgattccaagtttgtcgccccattttaatgatcaataacacacagtgagtccgctagtttcttagccttaaactaaggaaagtatcatgtatggcctgtcttttgtgcaacctatagctagctcgtgtgttccattggcaaggcgacagctccggtctcaaaagagccctccaaggacaaggagagccggccgcaatggcgatcgaatagtaccgtccattattgtagagtatacatgtactatctcctaaactactattgctacttccatagctgaagttaaagtgaagccacaattagtttttttttttcatggcaatcgtaacccacgttttcgaatcccagaactaaaaaaaaagtacaatataatctcgctgaaaaactaatcgtcgtggcctcatataaatcaggcacgattgcgtcggcgacgagtaaattaaaataaagagtgcagagacagagagagagagatgcatggctagctcgtgcttagctttttcgtcagtgttatgttgcagctagctataatatatatatatatatatatatatatatatatatatatatatatatatatatatatatatatatatatatagacatacacaagtatgtaacggctaatggcttagtgggagacacataagattagcagcgtgttgttagtggaaaagcgatcgagagctcatgcataattaattagtgacaaacgtgttaatgttcgatccaggaagcactagtttgtgggtcagtatttgtaggcttcaaagggctcaggggtacaaaagctgcaagtataataacctgtttcaggtagtttcgcccgagcactttacgtgttccaatccaggaggcggctgcacatcatcgacaaagtcgtagtagaattaacctgggaagtgttctgttgatcagcttataatatagatcacacgcatatctctactggttttaattttgtcttaatatacgcatgacaagttattgccagttctggtgctagcaaaacagcatatatatatatatatatatatatatatatatatatatatatatatatatatatatatatatatatatatatatatatatatatatatatggtgaaatgttcgtttagaatctcaattcatgggcgttaactaggagatatggaacgaaaggaaccggagaactttccaacacaaggagttgccggcgctaactctgctagccaagataaaggaggaagcaaaaacatgggggttggcgggcgcaaaaaatctcgccgcctggttgacaatgtaactgcctatagttagggccacggccctaggttttttgttttctgtactttatccttgtttgtacagttttcgtctcctctattcaatgaaattgacggcctcgtcgattcgttcaaaaaaaaattcatgggtagatgctacaaattaaacaaaataaaatgcaacagatagtgtcccaaaaggggcactacatgtataggagccattttatatatagatgctgaaaataaggtgttaaaaaatgaaaagaaatccgggatgaaaggaacatccctaagcttaagaacaggctcaagaatatgtcccttaaagcaagcaccacttgtttgatatgcttagcatcaagtaggacaacaattttttttataaaaagtttctatgtaggcacatcatcttggctagctattccttccattttttttctcctactgatgtactgaaacaccaacaaattaaagttgctcatatccttttccaacccttttcctttttcttgtttttgttttcttgcttactccttgattcgagcattttatatcattgcattgaaactaaccaaccgcgtcctacgcgtctgcttgctagtatatgcaaaaaaaaaaaactttgatgaaatctagaagttgcgtttcaaattaagccacagagaacatattccaaactttacacacttctgctttaatgatgtggaaactaaataacaacttgagctctgttttggaccctgcctgagcatatataatcatctgtgtagaacttgacttcttaatgcaatgtgtcagtatcagcacagcatcagctaaaaaaattactaatcagaatgaagaataaaaacatggtgcactgacttttatgcttgcttgcctactcaatgctccatgaagccaacttttttaactattggtgtacaaagctgaagggaactttgcatttgcattgtacatactggtcctccttttcagcaccagtactcctaccactgttggttccaatggtaaagcaagcatataaactggtgcctcccatgatgactaagtttagataaaacatgaaaagctttttacaacatgtgattggatttgtctaaatactctggatgaagcatctgatctgaggatgttctgagggccgggactcctatttcggagttaaaaagcttccaggagagtacaataattggggattctgttttaaccttatcaacattaacatcaaaaagaaaagttttggaggtatacaaaatattatcattattttagctggtactaataatgtggatgatcttttaataaaaatttgtatgtaaaggtctacgaattgcggcagatttagaaagtatatgggacattcttatgctgcaagttagcaagtatgcgcaaaaaaaaaaggtagtatgattaaagaagcccaattgggacaaaactttgtgtcattaggctccatcaagaccgtacattacaatacttgtatatttgcatgaactacgatcgatatggcaacatatgcgtacatgcgaaaatatatttatagacgcaatgacaagtgtctgcacacaatagaatacttggattagaggagtggccactagcatagtgacaaaaagctttagaaagttcttccaaattaaataaatgttgtgtgaactattaattagtttacattatcatgtagatgagagcatacatattcaaaaactggcggaatgccatctacttatcattctgaaaataaaatgcaccaaaacgattttacatcattacggtgcaacggaattcttgcaagcatcattgctgaaagatcagcgagcaaatgcacggtaaatttctttattatgctatagctatatatgtgggattcccctaacctggtgaattaaaatggatcagagagccctcgtagccatatgccataggaaaaggatatcaccaagataaaggacacttatccacacgacatgaagctttcattcataatgatgattctggctgcaaatatatatgacaaattgcagccgttcgtgtatgacagtaaccaacgatatttgcatccttctccctccaattgcacatggatatgtatatttttaggagtcgacgtcgacgtaattagctcagcaaagactcctacatggtagtttttaccaacctactcgagatctcctatcatgagtcgccattaatctagctgatgatcatgactagctccctttgcattttaaaggatgctctctctcaaatctctctctgccaatgctaatggctgccacggcattaaccagcagttcagctgctacttagcacaccttttttcctccttatattactggctctatatatctgatcacacattcacaccaagtgttcgctaatggctagtgttatatggacatatggtccccctcctgccttaattatccattcttttcgagtgattaagcagcaactggaagtaagttaattaagctatataattgcgcaacgagaagagaagaggtctatgtgcgttctagaaccgcactattctcatggtgcgcgcgcgtgcgcgaggcggacagcgacgatcacgcgcgcgcgtcgaacgcgtgagcgcgcactgctcgctctcgccggtgtccggacccgccgggccgtttggccgccgcctccgccttcgcgggcggcccgtatgaacgctccggcctttacatttatcgtgttgaacctgtcaaacttgcattcacgcctcccgcaaggcggcgaggcagtcgtagcaacctactgtcccgtcttaaaatagaagtatttttagcatagtgtcaaattaaatatttttaactattaatataaaaaactcaatcatgtaaaattggtgttactagatttgtcattgaacaaactatcataatatgtaactttttttaaaacatattacttttaataaatattattggttaaaatagcatctcgaagactgtgtcggagttaaaaatatttatattttgaggccccacatgtcagcctcctttaggtcgtctctttttatatcctatacgtgttggaaccggccggctacggatgcgatgcacgactgttccactagtataatctagcgtttgtattagtgcatagttaacggtggctagtgactaatgtactgtacagtacgtgtggtctgctaattgctcatcgctaagctagctcgaccctgacacgattatattgagccgaattagcgtctttgactcgaactgctttcttctacagttctgctgctacacgtatacgtactggtgctggctgccagtctgccacgatcggacgtacactacatttgttttatctgcaaaccattaaaaaatgcgtacaaagtcagtacaagtcgccagcttaattagtttagcttaaccgtagtttaatacttactccggccgtcacgtgccgacctgacgttagtagcttttggactggagatgggtcccacacgtttgactgacggacccgacccgggtcgagtcgatgcgtggcgtcagatttctttactccaagcgacctctggtcaaaatgctgagtagtattatccaaacgtgcaggataattaattagggtgtcaaaactaattgttccatgtttggaagcttttgcccatggcgacaaatggttagggctgcaaagagtgtgcaagtggggatcaagtgacgatcatgcattttggtacaggacaatgcctttgaccttctggggcgttaggtgccaactgatgatgatgcatcctgcaaaaaaaaaaagggagggggactttagtttgttcgatcgatcgtagtgtgccgaattatatttatttagggtttttaagttgtgttgatgtcaatgcaaggtggttacaaaaatgaggacttgttgggagcactcatttggcttctagaagagattttggtagggttagttggtgattttctgatcaaatttgtgcagaaaaggaattaaactgatcgatcgtccgatttaattagttttttttgtgaggattcaactagttagtttgaagcttgaaaatgttcacatctttcgaataaaagaaactagtctgagaattaattatttatgtttacacactgctatatattgatatatatcgacggcactgattaaatatgcagccacaaattttcctcaaaacaagtatgctgccacaagttaagtatatatacttccttttgaaacctcacaagttaatactaaatccactcagaacatgtagtgcttacccattactgatgttcctgtgaatgtatatgttgatctacagactggtcactgtaactgctgaagaaattagatgtactgggattgcatatatgccagccgagaagcgagaatgtattgatcacacgcagcatttcttttgtcaggtagggttacatatataaggctcattggttcgagttgctcaagagtaatgaagaatttttgtgtgtgccactataggacatatagtacatatgtaatatccggagataacaccatttctcttgtttaaactttgaataaaccaagcgtgcaatgaatatactactacagaagtcaaatagtgttgagtatgcaaagaaggatgccactagattgaactggtttgactcaaaacaaattttgttattttatttttacttaaggacaaaattgagtaggtgcatcagggagggagtactaaagttgtgtgatgtggacgaagtaaagtgtgtgcatgattctcccacttagattaaaatcttgtttgtcacagttacacacataaatgtagtatctttagaattttagtgagacctacggaaattatttttcggctccaatcttaagtgtgtgttaaaagtaacatattcatgcatatgctccgtgtgcattttttaatgtgatcgaaaaaaaaaaggtatagcagtttaaaaatatatagtccctccatttagactcatcactattatgatttgattttcttttctttcattgagggggacggagagagtaggggaaaaggtataaacattcttttttttagaactggtataaacattctagaatgttccttatcagcaagcaggtcctagaaaattatagtaccatattttctttggagaatatagttctgtgtttagttgtttaggaaaaaaaatttgacgtatacggacacatgtttaaagtattaagcgtagactaataacaaaataaattatagattgcacctgtaaactgcgagacgaatctattaagtctaactaatccgtcattagcaattatttactgtagcagcacattgtcaaattatggcataattaggctcaaaagatttgtgtcgcaatttacatgcaaactgtgtaattggtttttttattcacatttaatgcttcatatatgtatacgaatatttgatgtgacggaaaagttgaaactttaaagggaactaaacgctccagtactattggttgcaaactttgataaatttagtggtttagagagaaggctagaggagatcctttgactggagcatcgtcatcgtggtcaaactcgacaatgcatacaacaagctatagtaactgattagctagctactactatatatagtacgtactgataggcaatatcagaagttaacaagattatcatggagataagaactaagggattttctttgaccgcatataagtaaacagactgttgggatgcatttggaatgttggatcgatttccatacggttaccatgagaatttcaccccaaaaaaaatcggtttttgctatatatgtgtcgacaaattattttgccaaaatctattgaattttcagccaataatttggcgtggagattagtgtgtgtgactgattagcttggtagtattagtactggattttttttcttgctaactgctgcatgcagtttctcattgtcttagactgtgtttagttccacgctaaaattaaaagtttgaagaaattaaaacgataagacggaaaagttgaaagtctgtgtgtgtaggaaaattcgatgtgacggagaagtttgaaattcgaagaaaaaaagttgaaatctaagcatggccttagcgtaaatttattagactttgtatgtggatttgatcccgtacactcacatcacgtgcacacgcctctccccctaaattttaggtgtttttatgtatttacatgatacttgcatactaattacatatgcaattttgaaacttatatcgtaaatacactaaaattcaataagtaaattagtaacttacagtgtaaatatatcctgactattttcatgaaaaatatgccgtcataaatattggtagtcccaacaaaatctccaattcaaacagaaggttagttcaaagagtgtttttcggtccttgaggagattataccacattttatactaaaagtttttatctctctcaaagaccataaagttcctcatataggattgaatagggatttgagcattttctgtttcgatgatacatggagaaagattagcaaagtcgattaggaccacaaatttaacagtagaagatatgattcgttctttctaatacatgtaaaatacattaattattattttgtgatgagacgtttgtatattggttttgatatttggttagatttaatcgcgaagtgatgctctctggatgcggttggtcagatcggtttgtacactatagtcagatcggacaaatgacgtgaatagtgttttttgttttttcagtgaactagagtttggttgtgcgatcagaccgagctgagtgcgccggtcagaccggccacctgacggtctgactggctagcttctgattggaannnnnnnnnnnnnnnnnnnnnnnnnnnnnnnnnnnnnnnnnnnnnnnnnnnnnnn

SEQ ID NO: 2524 - DNA, 13183 bp, Oryza sativa
  unsure (1)..(13183): unsure at all n locations
agattatcccacatttaatactaaaagttttatcctctctcaaagaccataaagtccctcatataggattgaataggaatttgagcattttctgtttcgatgatacatggagaaagattagcaaagtcgattaggaccccaaatttaccagtagaagatatgattcgttctttctaatacatgtaaaatacattaattattattttgtgatgagacgtttgtatattggttttgatatttggttagatttaatcgcgaagtgatgctctctggatgcggttggtcagatcggtttgtacactatagtcagatcggacaaatgacgtgaatagtgttttttgttttttcagtgaactagagtttggttgtgcgatcagaccgagctgagtgcgccggtcagaccggccacctgacggtctgactggctagcttctgattggaatcggttttgagttgtttctttgattctcaggattactttatgtttattacctctagataatttatgtatatatgttatactgttggtgtgctaatgttgagttaattaagttgaaaaagaacttgtgctcgagtatggtttctcatctatttatgtatagatgtattttaatgcctcgggagagtgttgcctgtgatggattaggagtcgacttagaaaaagttgatgtccgaatgataagaagattatacgagatgcttaggctaaagagaaaacgcatgattttgaaggttccatatggcatacaagagggattttgtgcatatgggatgagaagtcaaatttggaaggagtccaaattttgggaaattatagtttgtattgtaaaggaacaagttgtatactatttattcaagatggattatggcttttgtgtagccaccttagggtacaaatagaagagtggttaaaacctctcggtattgattttgagagagaatagttttgagaaaagtataaacttaacctacagttcgagtttagtcaaaaattgagaggggagtgtcgttggtgtactttgtaaacataattagaaacaataaagttgttatacttccaaagagttattcgatttgtatttttctttgtttcggcgatcaaactagcaaaggtacggtcgtcagaccggtgactacacgatggtcagaccgatgacacctgggcagttagatcagtgacatctggcaattacggctagaaggacaattgaccagagctacaccttcggtcaaacatcgacatcgacactattaggcccgacgtatacacatcggtcaaaccgatttccatctggtttaaatgtatcatttattttgtgaaaacatttgttttttttggtgttatgccattcaacctcatattccaaccctcttaatatttggggaatgctaggggacgtgataccgttccccaacaggatgctcctcctccgcaaacgcgattctcacccatgcgacgtggccgaagccatcaatgcgcgcccgtcccccaccgtcaccacgcccgttccccaccgtcgccgtcaacggacctcgccggcgggcccgtcccccgccgacgccatccccatcccctgccggcgtcaccacacccgtacccaccgtcggcgtcgccgtacctagccacctgtcccgcccgcgcccacgtgtcccatgccccgaacccgggggacacccggggttttgcccgatttctgggcccccgggattccccccccccttttatctacaggggacggctgcaagtggcccgccgcgcgtcgggatgcttctcccccaacgggatgcacagttatatctactaggaatcacctgatacctcgtaagtatcatctgatacctcgtttgtattacccgatacatagtagaaattgtctgatacctaacatgatacctcgcgagtatcacgcgatacgtggtagaaatcgtctgataccttacaggtatcacatgatactttgcaagtatcacctgaaacgtgtgtagaatcgtctgatacctgataggtatcacacctgatacctactcgggatcatcccgttcgaaaacgggattccgttatataacaaccccctaatatatagtcatacttatactaattggacactctgagagagctgctacgttaattagaaatatttagccgttgatttgatcgaccatgtacgttgagagttgacggtaaataaatcacgcagttgaaaacataatggactttgatttaataattctgaaattcctatttaataaatgtgatattgcatccatcttacattctcaatttattgttatttatttatgctcaaattcaaaatcagtaattaacatattgtaattggtgtggactcttcatttaataagcatctatataatttcaaaaggtaaccaacatgtttatcataacattagaatttcaatatttataccaccattaataatatatagctcgtgtaacacttagagattggctactagtagtaatagtaaaaatggctaaaaatttgaagctgtacattatttttcctatatacgcggacctagcctgcgattatggaagagatcgaactgtcagtttaactgatgcaaattgcataaaggatgttaattgttatccctatttcagtattattaggaggccaatcatctcttatgctagtgcccaaggttaggctgaacaaatatttttcagaatccattaagagactgacttaaggaagcatcccatcagacacgccactagcgtcgtggatcgtatacgttccatgatgagtttactccgatattatccggccccgtacagagctagatcctccgaattaatcaaaagcacgtcatttgagatgtctaattgatcactgcattggaagacgacgaacgatcattgacaggcccttcaatgatcagccacacgagccactagctagcaaccgctagtgtcacccgatcgaacaagctaatgcgatatcttattatgggtattatacagttacggtcactaatcgagatattttggcttgcgctttacgaacagttgctcctgccggatacgcttggatcccttcaaatctatccttgctcgatcgactgaaacgcatcatattgcagaaatatctgaatccttacgaagtggcggcacagtaggacgacgggcaactgaacactaagctagctgctactactatatatgatcatcatcatcgatccgatcggtttgccggcactcatgcatgacaccatagtaaattcatttctcacaaacaagcagctattaagatgaatgaataccaatggcatcggtccatgcagatgagagacaagggacctatatctatcgatctatcagtgtactatctacctatctacctactaaaatggcgatcgagctgaagccactgatggatcgatcgatcgatacatatgatcaatccacattaagaagcagtgtgcgagaagaagtagaaaggggggaaggaacgaacaataatgcgtgcatgcagggagagaggaaagggaggcaatggtgcgtagcaccattgggcgcggctgcgtgtgcccggccgacgcaggcatcgccatggacagcgctgatccgagacggatccggccgcgcgcggacttagccatccgtcccactcggacaggacgcgcgcgcgcgtgtcgtgctcgccgctgtcgcgccacgcgctaggcgagtagcagctagctaggcgtgtgtggctataggccttttgtgccagagcgaggcgtgacggcttggggctccggcaccggctagctgggctgggcgctgggcatggccgcgtcgtggagcagtgcacttaggcgtcactcgcagcgctttccgggggcagaaaagtggcaggggcacctcgccctgtccatcgttcctgcccatatcttgctgcaccaccactaagccgtctccgtccatgatcacgcactgtgtcgtctcggagtcggatcatcatgcaagccgtgcctggagctgtcaaagactagctactgctatgttggatatagctaggcgagtagctagctagctagctgctagtatacgaactattggtctatggctataagccgtttaatttggacgcatgctcgtacgcacgcacgcaacgagaatggtggcgagcgatcatgcatcagtgcgcgggtgcacgcacccacgtacgcaagcaagcaagcacggcacggacgacgggcagggcaccgtgtcctcctccgttttgctcgtgtcactctcgtgcgccatgcactatagtgcgaggcgcgcgagcactaactagcagctggggtagtaacgcgcgcttggctagcgctaattaagctgccgggttcgctcgccgatcgatcgaatctttttggcgcggatcgcccacgacgaggcgagccaatccatctcgtcgatcgacgacgacgacccaacgtacactgaactttcgtcgcgcgcccgtgttgcgccgcgcggcgcggcgcggcgcccatcgatcgatcgtacgtacgcccgcagctctcacgatcaacgtacgatccggccgtgtggtggcccgtgcgcgcgcgcggtgcatggtggcgcgtggcgcgatcgagatcgtgcgtgctgatcgggaaagccacggattggttgctgcgcgcgcgcgcctcgcgctcgcgctggggacgactcaactcgatctcggacggaggtcaacgcgatcgggttagatagaaaggagcaacatggcggcattgttggtgctctcgacgtacgtgcttgctgtttcaatttgatcgtcatcgatctcatcacactagctcaccggaaatggtttgcagaatacggataccccggcccgtttttgcttcagattatgatagctaagtctagcaactaagtttaaaagaagcggttaaactcttttttgaggacgttcagaatttctatttctgtaccgagttcgcctgcatatatactcttgttaatgttttaaaatcctgatcagatcttatcataaacattaaatatctataaccgaaaagatgacatggcgtctacttgtttcctccgtcttgaaatataaagaattatacccttcaaatttatcgtataatataaaagattttataattttgagacaatactttataccttatcaaccattttttactagtttattccccactcactatcttttatactggtttattttttcatctatcattttttactactttattcttctaaccatcatatttattattttactattttctgaaattttataaaaaaatataaacccttatatctgtggacaggactggaggagaacggcactatatcaccgcatattgatacggccagaaataccgagagacgaattgaccggctgtccggcctcgatcgtggtgctcatctcggggcgaaatgtgttaccgtatattcgcgcatatatgtacgcctctgcacctgtactgatctgtacctgttagtgggggcagaaagccatggacgccttcgacggcgacccgtccatccgtcgggcccgggcctcgctgtctgtagcgtgcgctcgctgtttgacattcgagttcaaaagtgtgacacaaaattttcccccggaaagaaattcttgcaggtcgatcgacgactcgtacgtcggcgcctccctctcgacacgaacacgtactggtactggattagtactcctaattgtctaggtgcacgctgtgctgtacaattcggcagctggactgactcctgcgtccccaaatcctgcagcctttgcctttttgaactcctgatcgacgatctacttacgcagcaggcaagctagctagctagcattagcgtgcatgctgaaatggagagaggaaaaacaatactctctccgtttcaaaatgtttgataccgttgactttttagcacatgtcgttcgtcttattaaaaaaatttgtgaaatatgtaaaactatatgtgtacatgaaaacatatttaacaatgaaacaaatgatatgaaaaaaataaataattacttaaaatttttaataagacgaatggttaaacacatacttaaaaaatcaaaaaattaacggtgttaaacattttgaaacggagggagtataagattggtgagaagaaagtgatcaaatagcaactgaaaagtgtgtgcctttcttttttattgttttctgaggagtaaaaaagtctgcggctgattacttgcatagactgtatgacccgtatcgttctctgtatgcgtatgttgtgcaatgggacctaatccctcttcggttcctggatgatcaacgtactcaccgtttgtctaatgctaattatcgagcaggctatcatgcaggcaagcagagcagtggcctagctaagctaagctaaactatagctacactgtgcgtggtcaaactaaacaccagccaaagccaagccaattagccatcgctagtgagtagtgacccctggggatgcacagggccgagccaatagcttagctttgtgactgatcgacacggccaggcaagtacacacttgcacggcggctttgagctgacagctactacgatccacacgacgacattgccacgcacggagaaagccccgggccggcctcgtctctccgttgctgcctgcatgatctcgtcgccgtcgccgtcgatcggcctcatcttgcgcggcaagttgcaggcgagagaaggtggtacgtggcttatcctgaattccaacccccactcacgcacgggccggcggatgcgcgccggggggggggggggggggcggcggatacgtacgactgatcggtcgatcgacgacgcgtcggcgggcgacggacggaccgacgacgtgagagcgagcgtgcgtgaacagtaggtccacctgaagatgccattaccggggggaaagcacttgatcagaatcagagagctcaaaactggattgattaatctgcagtggagacaagggcttagaaaaaacgcgccttgggaaagtgactgacaccaccagcagcggctagctcatccatgcttgctgctactggattttttttttatgttttggttttttgaaaatttatttccctacgacaaaacttattttaaaaatggatcctgttttctcaacatcaaggtccaatatcttagcaccgataccctagctctctggatatctaagtcgctaatgtgatgggtgttggaaccgaggacttatttgtaaaaaaagttttcaaaaaggttcaaatgtaaatatttttatagtctctctgtactagcttttttacgtcgagaacctaattataataaaagtatttatgttttgaccattttaaaagatcattgtacaaataggttcacaacactaaagagattagtgttatcccctatatcttggctatagggggcgagggtgttgacaccagcgtcattggtgtcgaggcattggaccactggcgtcaaaaaaggattaatttctaaaataagtttctcatagggccgtatgtaaaataagttttaaaaaagagccaaaacataaaaagttcagcttgctgctatctgtttcagagtttggtagctctcctggtttggtttggttcaggacgcgtgattgagcgtaattgacacaatgacggtatgacacacaccgtacccaagttgatcaaaccggatagatcagtactactgagcatggaggcgaagacgtacgtcaaaatccttttttgagaaagcggatggttaagcagagttgacatgcattttctgtgtggctggccggcttgatagatagctatgctgctgctgtgaggagaagaaaaaacaatttgatgtttggtacgtgagagtgaaaatagtggatggcgctttcagtgaaacttgtcaggtttggcagcttgatatgtttgaacaaattaaagggcgagggtttgcacacacaagcaaacggtttttaagcggttttaaatagtttctgttcctgtgccatgaaaaggaagggtttatccaatgtcaacctgcgaagttacaaaagcgatcgagtttggttctctctttgctttaatttatggtcctctctttggtgaaacagcattgcccttttgtggacacctgggatgacaacgtgctgctgggattgtagccaactaaaacaagtctcctatccctttttcacctgtagggattaacaccagaccgtcttctacaaccaggcgtagcaggcaaacttggcttgtgttgatggcttccgtgaactacttgctgtttgaactttacacaggttacctacccgaaaactggtctacgttgcaaatctctccactgtttgctctccattttgagcagaaatagacgcctaatccagaaaaggctatagtgcaggaaatagagatgctgaactgaaagtccaactacaattgggcctttgggaggcctttctgcaagtgttggacaactttacaacagggaagcaacatccatttctttcagtaactttactttcatacacattgattgatacaagcacagatcgaagatgggaaatggttggaatacaataggtcttcttcatgccttttagatcgtgggaaaatgagttgatgagctaccatcacagctttctactcagacgtaatcttcctattgaagctattcatctgtggtttgcccttctcccgagccctcagaaggtgtgtctgatgataatggccctaagatgccctctgaactgagagttaatccactctgtgaagagatacagggagaaacaatttaattcagccaaatgttactgcagtggcttatgaataatgtcagataaatttcattttgcagcctcaataaaatgatgatggcagtacctcaggctggaatcttaacatatcagcacgagccattgcctctgcttgagctatcctctgcctgaatatctgagccatctcatcagcctgttttgagacagagaaaacagtatgtcagtttgtatacattccagatggaccagatcaaggaatattgctttcaaacttaccttctcaaaaacaagctttggattgcgaatcatgtcaccaggtgtcggctcaagctttttagtagaaagactaacacggcctctttcacggtcatggcttagaatcataacctaatagcatttaaaaaaaatactctggccttagctctataaactttagatagtatacttttctcaagtacgaatgcaaaaaataccttgagcgtatctcctggttgcagaactgtcgagatgtccgcaacacggtcatgactaatctggctgacatggagaaggccattgattccaccaatgtcgataaatgcaccataaggtttcaggctctcgacagttcccaagacaactgaaccaataccaagctgagcttgactatctgccattgccttgcggttactgaggacaagcctgccttgttcctcatcgacctccacaaacttcagaggtagttctttgtcaagcagttcttcagcagttgatttctgatcaaggtcaagaagtggtttgtaaaatagtgggcagctagtgtttacaatgtgattgagaactaagcattggaaactaggatcaaatgttcagttatctgcataacaactttgacctgcagatgaaaggcagctcatgccatgcacatgcacatacacctaaaaccataggatgcaagaaagttttgtagtaactaataagattgagaaccaaccgatgacacttgtgaaaatggaacaaatcccttaaggccctccacaagagctaccacacctcctttgtttccaccaattacctgcggggcaacattgccaaatgaacaagtcaggtaaccgcagactaatacattacagcaaattcatcccaataaaactaagcatacaatcatataagctcttgcaaaaggattttttgatatgttgttacaaagtgactggtctagacttcaggagttcattgctagttgcacaggaacaaaccaacaaaatcacaatagtccaataaaaacaaaaaatttctggtcattgtcgcatctatagacgatctcagtacctgatcagtaagctctaccaagtaaacagcagcacaaatatagaaattatgaaatcatgggttggatgtcataaagtatgtacaccataaattaccacttgaataatttcttttcattaaaggacaatggctgctgctgtgagggatagattcaaggacaaagcctgattgttagaaccgaaacggtgggcaagaagaagtagtgcttaacaaacatttggttacaagtttaacaacagcaagctattaaaggagtagtgaagaacaatagtaatagcacagaaatatttccttctgcaagtatttttactcactttacccgtgacaacaacatcttctgcttgaagctgtctgcacctttcccaggcaaggtcttgctgaattgcttgtaagctcaaaatcaaagtttcatcaccaggattctcgtcaataatcatgaactcttctaccaaacctgcacggatccctgcctcttctatatggttgacatcgagaaggcatgcctcatccaaaggcaagaaagcagtagacttcgattggatatcaacatatgcaccatttgaagtggtcatgaacactgttcctttaatctgtagagattgcaagaacatgatagtttttagatgttaaggatagagtaatacatcgtttcaaaaaaaaaggatagaataatacaatatatgagaaactatacaaaatttgcaatatgaacagtatcttataataccaacatagcacaaaatattgcagcaaagataacagtactgcatgcccaaaaggagatactaacagcagaatcattgctaacagagcaaaattctaaggatcaatgcaaatctggcagctggacaaaatgagtttttgtgtccatgtgcatttgtaacgtataagagatgtatagctgattattgagtataatattggttgataaatagtaagcaattcttatttaaatagacataaataattacagtcaagacaagcagcaatcggtcagtaactgaaatctcatcgagtttggggttaccatggtcagctagttactacagggaatggatcaatggatcaactccagcttactttaactatcatttaatgtgaatttggctttgttttttttttaaaaaaaaggagaaaataactatataaagaagaaaaacagaccccacctgtatgacatttcaaggacatttctatcttttgaaggggaaacccctttttgatggaaattacatgtacatgaacatcctacatgtgctttggaccttatgcatattcatgcttcaaagaaatatctatgccctgatggattggtgaccggtgtgaggccatgagggtgaggtaggcatatgtatgatgttcgtataacttggtacacgtgcggaagcaatcaaagagaggatgtagcaaacacaaataaaaaccacacgcttttggtagatcaaactcttgctccaagcctccaataaggtatcatccccaaggaggtaaaaaagggaattcgccgttcaagtctaattcaccagaattgaatcaaaagtcaagcttaatttaaagtacatcaaattaatatgaactactctagcttacactgaatacatagctatcgtataaatctccagcctatagaggaatatgatatggccatgtattgctcttatttgaagtatcagacctacatatatatttttttagtaaacattattgaaaaaacaactaaattatttagatgaagccacacaattgcgtgagttctagcgttcaactagtttcacaaaaggcaaaacataacaggtaagggctaatgaaactactattcctgattatcactatacctgctaccactatgagcaggtcagaaaatggaagaggtacttgtagtaaactgaacattctttcgcttgtaccttaggggagtaacacattatagacgaatcatgatgcgcagagcacattccaagcaagcaaacaatagaattctagttgggtaactttcagtaaccaatcaccttgttgttgatagcctaaaacaactagcaaaccgaaatgtaacaactagtgacatatacagggcaagtgactccaatctcccgcaagccgtatccaattgagcacaaggtaagactcaagtgacttgcaggaaaacgaggcatcacctactgaaagttaagcctgtttttaagcaccaattgctactatctgtttcacatcatacgagcgagcaaggacgattgagaagaacaggaggaaggttgcggggggtggattacgagtgagccgatatcggtgtcgatgtcggtggactcgacggcggagtcgaggtcctcgggcgaaaggagacgccctccatgggcgcggtgcggcagcgctcggaggcctcgtcgaacagctggcacatccgctcccgctcccgctcctccttggtgagcgcgtacgtcccgcacaccagcgccgacggccgcgtgggcgccgcggggcggcgccgcggcgcgccggagagcggcgggctcgccagccccgcgacgtgctgcgccagggacgccattcgcgctctcggcctacccgctgtggtgtgttgtggttgtggtgtggtgcttcggggcgacgagacgaggcgacggcagcttttcgggttgagggagggtggctgtgttatccggtggccgtgggggtttagccgtttaggataggcgatgggtggttttgggccagcccaggtaagaattccctcgcaaactgtgtgtgttagtattccgtctcggttaattcagctattaatgaggaaaggaccggtctagggtgtgttaggataatagaaaatagaagtaggattgagattagaaaataaacgaagggttaggattaaatagaaaagagggaatgaatggttagaacttaacgatgtcttttagtaggtgaaaaattatttcctattcctattagccaaacactgcctagggagtgacggattcggattaatagaatttgcgcatggccacttaataataacgagaggaaactactgatcaagtggtttcatcgaggatagttataactctaatatattgtaatcatatgaannnnnnnnnnnnnnnnnnnnnnnnnnnnnnnnnnnnnnnnnnnnnnnnnnnnnnnnnn

SEQ ID NO: 2525 - DNA, 3782 bp, Oryza sativa
  unsure (1)..(3782): unsure at all n locations
nnnnnnnnnnnnnnnnnnnnnnnnnnnnnnnnnnnnnnnaagtgaaatatttttcaatacacgaaatagatcaaaaccctatagagcataaacagaacataaatacagatacatcacatgatagagttcccacatagtgaggcacatagtaaatcttgcccatggagtcagaatagcacggagaaaaggcatgagctgaaacaataaaacttaaggccaatttaagcactaatatcgagcaagataaatcggtggaaccttgttttgtttccaatgacttccaaatcggacttgctggaataatgggcaaggagttcacttgcaaggtgaaagaactggtcaatgtagttgccatgagacagcgagaatgcccgatattgctttgttcagactttagagggtcttgtatagaattaaggtgagaaatgaacagactcaataagatggaaagccagtagaagataagtcggtcattacaaaggagaaagaacgtcaaggaagtgaaggaactgctgaggaggaggtcgaacgacaatggcagcaggaatctcaggggacaacatgcagatggaaggaaaactgatctgacggctctccttttgaaagtgacgtggtgcaccaggaagcaggaaaataacttagtggggatgaattgtataggtatatataggatatgtttaatacaaggtataataagacatgtgaatatgtgattgcacaaagaaagaaagaaaaataattgagtacgatgcaagggtggaaaaaagatgggtaaagcaaaagcaagtttacaaatatagcatatctcatacccacttcaggtgtgcaattcacgtcaaatacgtccagattaataaaattggtcttgccatgtcattttggttttagttcacacacgtcaaataaatctgtgtataaaaatgtatgttttataagtttattcactaagtcacacctattagataaatttatacaccaccaatacctattagaactataatataatgtcattattgtttttcctagcaaccaaagtctgcgattcagagaacaataatagaatactattatgtacatacttctatcgtcttttggttggttgaaggatgaataataccaaatatctttttttggttgaaggatgaattatatcaaatattgccgtaatgttagtacgggtatattactagttttgttaaggtgctcacgatctgttgtccaagtaaagatcgttgttgtatttgatctgcttcggaatataacgctgcagtccaacaaggcaacacattcctggcacggccggcccaaattggtgcagcccaataagccctcgcgtccggccctactcgaggcagcgtgttcttggacttaatccgaagtattgccagcccaactcagatttgtggacttgatccaaagttttgccctctcaagcagtggtgccctcggccttcgcgagccccgaaatcgatttcttcttgcacgcgcggcaatactgcgaaagtgcgaatagttcagatcgttattaacttaccacgaaatcacaatcatggtctggaaccacgaaaagaatgtccgagtttacctcgcgacccgcgttgcgataaagatcaaggaaaaacttccgtgagcccatccaaatttccgatctgccgcggacgtcgatggatcgctccgtcattgttgccgcttgtaaggtgacacgtcccgatccccagacagacggacgcgcctacgtagtagtagtacgaggcgaccgaccacaaactccggggccttacatcggtcgccacgaagcacacggccacgtcgccgtgagagcaaaaaatcgcgccggccatacggggtcacagctagcatctccccgtggagtcgtacgtggcggcacgtacgtaccggcgggactcccccgcccccgcgcggccgacacgggctcgccattcgccgagtgctgccagccaagcaggcggtgctgcgcgtacgcgtacagtaccggtacacgtcgcctcggcccggtcgcgagctcacgattcggcgcgactcgagacgaggccatgacgccatgtacgtacgccccgtcgcctcgtagtcgtagcacggtagcagcgagcggccccggcacgagagagatcgtcaggttcagtggatcaccgaccaaccgccaacgggatatttcgcgcggatgaaccgttgcccgccgcgaatttcggtcacggatttgttggggttcggttgcaatttgcaagcacggtaatgcactcgtggtgaccgcctatgaccttttggtccccgttactgaaaatctgaaggtaagtattatcgtatgataatctaattaagtattattatgcttatttattatgttatataggagtacttgcctatgtcaaatacacaaataaaattgtctaaaaatgtgaactttatttcttaaaaagtataaattagcagagtgaatgcagctcaattggttaatttccttatagtgaaaccaaccaatccaagtaaatcgtagaattgatatggtgctcttatttatggtaaattattcttttaatgttagattataaagttacatcaacaacaaggcacctatgcgtcagcctaatattttggaggtcttagcaagaatatgatattggggaaatatcatgtgaaaatgaattaagtgtttaaaactcgtgaaaattatacctaaaatttttgtaaattcatgaaaaaaaattactagagatatgtgtagatatgaaatatattctcaccaaataacaagtcatcaacttcatttgagaggaaaagaaaaaaaagaaaaaattcaggtgaatagtaacatttagccaattttcaccacatatgtcctctatggtattataagcccacctcggtattagaagcccacctcttggttgtcatcgttcgatcacttccttttccactaagtgattgcttagggaccttagcgtacgatctgtgctgtttccctcatgatcaaattagactagtttcatttcgtggattcaaacatgagggagtatattgtatccactttggtccaatgaggtctaagactttcaacggggggcttaacattggctcatttcaaagtaagttgagaccacctgattcttacctagataatatttagagcatgtttggtcaatcctcgtgagggagatattagaaggaatttatttcacacctattggggtgtaaaattattctctcgatcccctctaatcctcttcaatctcctccaaaccgaacaagatcttatctaacttaaaacattctcaattggacttttacaaattcaactagataaaataatatgtttttctttccaattggaaaaatgagggaggtggtacactattagtattatgttacatttgaatcttaaggtcacacttgacttagatggtggtcaattggttatggttgaaaatgagcttgtaataattatttgaaagtacaaatgaatgaccgttaggagattgggaaataaacatattataattcctcagacaactaagtaaacctctcaaaacttggtttatttgaacaagagagatgtatttgtgcgctttgtttctttctgttaatttgagtagaaactttgaaagtttgaagtcacaagtcaaaagtttttttagttttatttgagagttttagactttgaattgaaaggtttactgtataagtttcttaagttctagttggatgttttagatttttaattgnnnnnnnnnnnnnnnnnnnnnnnnnnnnnnnnnnnnnnnnnn

SEQ ID NO: 2526 - DNA, 665 bp, Oryza sativa
catgtctgcaagcactcaaaactccagtgaaagttatctcatttggagtggcagtgctagatgattccatctccgaaaacatgtcaagggacttcatcaccagaccattcatggccagccccacaatgacagcattccagcaaggtgttcctctttcttccattgtatcgaagacttctaatgcagattctaagcacccacacttcatgtacatgtcaatgaggctagtcccaagtatgactgtgatggtatattggtgttcccttatgtactcatgcattgacttgccttgctcgagagaagacatattagtacatgcagagatgacgcttacaagcgtaacctcatctggcttgattccttgggcttgcatgttgttgaaaatagtgagtgcctctgaggactggtcattttgcacacaaccagatatcattgtagtccaagaaacattatctttgtcaggcattacagtgaacaattcctttgcatccttgacagagccattcttaagatagccagctatcatcgagttccaagagaactggtccaaacactggccactgtcaaacaatcttcgtgccgcaacaacattcagaaaacttgagtacatgtggatcaatgcgttctggacgttcaacctcgagccaaggccagctctgaaagcc

SEQ ID NO: 2527 - DNA, 2385 bp, Oryza sativa
cttatgaatcataattcgaattggtttgctagctcatacggagtactatgtagcggtgttatttttatgggagaaaaaaaatgcaatgataaaaacttgaactagtaaatatcagatgacaaacatattagggcctgagcaaatagctaggaaaggtctcaaaatgtgcagggttgaatggtggccttaaattttggggagggcttgtttactagtaattttagttggataagtgacaagtttactatcagaatcatgtgagaacttttagttggataagtgacaagtttactatcagaatcatgtgagaacgctgtcctttctgttaaagattggcttttgagagctttggtccaaaaatggacaagttacaagtgaagggtcttaaccacggtggaatagaatctgcaaaacaagctctaaatgaatctggaggtaaagagcagtccatgctgtgttaaaagcgagcttcataattgacagggaaaaaaatgttacttgaaaagtcctaaatcttcaatccaaacttcaaagttaagaagataataattgcgtatcattggtttaagcagttaagctggatcaacattaattgtagtgtttctggaattgaagaatgctttaaacttgtggagacctcttactttctgcagactaacctctacaatctatttcatactttttgtacaggtacagagcatcatccagcaaatccaggctatcttcaaccaatgtctagcagctcatgataaactggagacctcattacacgagttatctaggtcaggagatgttaaatcatgcaaagtggctcgtaagacagctgatgcacagtttaaggaattagcaaaagagttgaagccattgttgacatccctgcagtcatcctctcagtcttaccagatatggccaaaggtttgctcaacgtcttgtgcatagaccacctagaagagagagatacttactagtgcatctttattcaccatttaatttgaatttgagttctttgcccacattctctaattaagtatatgcgccatagtggttacagttggcctttttttctttaatgcaggtagaggaattggttgccaaggagagagagttgcaggataagctcatgacaaggcattccactgtggttgacagctttgaaaagaagttgcgagggcaagatgtggagaacaggattgctgcccagcagcagaaagttgctgccctgaggcaagaggtcgaatctcttttagagtacatcagtgagatctgagcgaatccggcgctgcatggtatgtcaatttagcaattagactggagaatggatcacctggtttctcattgtgcgaatttgatatgctcgaattcgaatcaaatactcgtagatttcctgttgataacctgtctcagtcattcaggctgggagtttcaaaggaccttgtaacatgataagcacttgtgaccgcctgaaactgattgaaattttgcacttaatagcaaatcacgcgacctttcaccttgtttcatatgtaattttcatgaagatgccataatacctttcacgaacattgcaacgtttctagacagcaactctttcatggtagtactaagctaattgctccattcacctaatagggtcatcatgggaagttgaagatcaggcaaaagaagtttgacagctaatcatattttattttttttcttaataaaatataacgtctcatgtgtttttcgagaaaagaaaaaagccaaagtcatttttcgcagttgacagtctgaaataacaaagattgaccaccgggtgtatcatcttcatgttctggactcctaaaagctcatctaatatgttaaaaccctaataacttgaattaatggattgtacgtagtatcaactctgccacggactggctcgtcaaaacgtccagtgagacatgtgagatctcaaaagcaatattatttctctttacctatggcggtagacggtgctcctaacgaatgaattcactgtgccaagagaaataaacagatgaaaataggcttgtaaacatcagacatgggatcaagccagctaaaatattatcatttttgtttgcttgtattacaagatcaactaggattactctgctgggttaattagatccgtgccattaaaaaatattccgggttttaaaatatgccacgagcatttacatatttgaatccatgccatataatttacacatattcaagatatgccactacctacctcttagatgcatttacgaaaaaatgtggaccaaattgcccttgtttccttcttcctttttctccccttctttcttccacagctcagagaccagtgatgcttagtgtcggcagcagcaagcacaacccgcgataaacatacgagtg

SEQ ID NO: 2528 - DNA, 8842 bp, Oryza sativa
  unsure (1)..(8842): unsure at all n locations
cggcgacgggcacacggagtgcagtgttgcggttgcgacggcggcggctgaggcgactagggcagcgactgctggaatcggatgggctcgagcagcgagggcgatggcggcagcgatagagcaagttgtggctcacaacggcgaggacggcggcggagagagcggagagaacggagcggcggtggagcaagaaagcagcgggaagagagaggtagaagacgagggaagagagagaggtaaaagatgagtgcattttcgtctaatacatgcaaaatacgtatctttgtgggtattaacaccactgagattataaataagtagcagtggcatcgttacaaatacgcaattgaaattacaaataagtagcagtggcatcgttacaaatacgcaattgagattacaaatagcagtagcattgttacaaatacgtaaatagtaatagtatatttcgaaaccagcaaatttttaatggcatgtatctaattaaccctatctattttcatgtatgacataatatcattatattaatatttaaaaatacttttaattgttaatgcttcttgttttgtacctatattaggaagaaattaatgatcaaaatatttattcaatgtcaaagactatattgtacgcctcaactcttgtgactaatgagaaaggagcaagtattcacggctaattatttttttagtagtagataatgtatctgtcgataacgagacacacacgataacttggtcgatacgaaaatttaccaacccagttattttatatgataatagagatgaggtatgcgtgtatgatttcatagaaataagtggatgcgtattgtgatcatgtttgttctttataaaaagaagtattttaaaggaggtgaacaaaatcgtctttgcctttcatcaccctttacaagtttgaccttttcatgtcatgaattttttttaaaaaaatggataaattagcaatgacaaaaacaacattcacccccacctcttcccctgtttctgaccaatcccctctgctctctcctctcctctctccctctcccgcgatctgcagagccgcttgtgcccccgcgccgncttccccccccccccacctacccccgncgatgtcggaggccttcgtcgtgcgcgcggccggcgaggccgctcgagtccaaccggaaggtacctattactctctctcgcagcttgtagcccccctctcccccatccctcctccttccgcgccacttcatcagcgggggcggtgtggactggagatcccccatcccggcgtggattggattcgattggtttgatctcgtttctctccctagcctgtagctttttcttttgttagaaacggaaaacggaggattaaaccccatatgcccccgcgtgttaggtttaggtctgcctgcacctggattcatcgttctagggtgggggatttatgatcgagtaccaaaggatttatgatccgcttgtggtttttcgccttgcgataaagctgaacacagttgacaataattctctctgtagagatagtcgatgggcgatcgtaatcctgactagaaaatttgattacactgccatcccgcactacttgtggttctatataataaatgaattcgttgctcgtcattgcgccgttgctcattctccattcctgagcacgcacaaactattgcgcaccatccttgtagctggtgggtataatatatgcgtattgatgcaagtgtgtctagtggccatcgctaccaaggaaaatcagtgatcactaggtcatggctgacacgattcagcagtggagctgtgttgttgattaagaccccatgaaaagtcagttaacctaagatagttattactaatggttcccttgtaacaagaattggggatggtacccagtgtgcccccacatccattgatgcaggccaaattgtttgtgggctgcaaaacctttctcttatcataacagacaaatgaaaaccagaaaatggtctatatatatatatatatatatatatatatatatatatatatatatatatatatatatatatatggtgttggtttttcttctcagtattatgaaatctacacacatccagaagagtaatttgtgttggatgatgccaatatttatttctatagtgtatgtaacgttgtggcaacatcagcatgtcacaatttgtgtgtgtctgtcttaacacatgctaattttgatgtgtgtgtgtgttgtgcgtgtggagggcaggggtatcctaccccttctgactactatggaaccatcactctgagctggtaggagcagtaaccattttcaccagttaatccatcgctgctgctaaatgtatcactatgtttattttttctttaagccaatagcttgtctcgacagcatactatgttcaaaatattgtggtgctctctccaagctgggttagttatgcatttatagattgtcctgctcaaatatctttattgatcttcagtcactgcaagaccattcacctccatgcacatgatgcactctctaaaaaagttacattctaccagttcattatctcatttgtcatgtgcagaaaattgtttgattaactttgttagtattatgagtcattcgggatcatcaacttgagatgatattaagtcgtgtcgatatgttggaactgggaatttgcacgtgctttcctatcttacacttatgccactgacagttgggctctgttttaatttaaacacaggaatttcacagatatcagttcaattcctacacaaaccagaaaaaatctcacattacatttgggccttaatgttctaatgtttttaccgtatttgcatatctccaactatatgttattatttttctttctggcatcatgcatcatcaattttcctgcatgaaaacatgatgaagccatttaacattatatgactttggcagctttcgtgagtgaggatttctcaaacttcatttattttccatcactgggaggtgttgaagcttaatcatgaggtcaattcttgcttcctacctttggacatatttctgctggtttgcataccttaggcccacgcccataacacgttaccaagaagtatgtttggtaaattctgaggattatttgttattttccagttgctatgatatgtaaattaaaaaaacaaaactcggccggcgggggaaagaccgccccctcatcttttcaagctaagaagaaaccacagacaaagctagtcaagaaaggccacgaaccctgggcccttgacaaagaatcaatttaagcagcacctctttgtttacagttgtttttcctttttttttcctttttaccttacaaaagttaaggttccagccaggcagttattaatatgaggtggtgtaaagattcagcagtttcaatgatgatgaaatcagtggttccattccggattacttcagggtcaaatattgtttagatgggactcaatgttgagaatttagagctgtatgattgtatgattgtttagtaaaatcaaatattactataaatactaaaaagttgagaatttagagctgtatgattgttgaagtatgatgtctcaatcttttaggcccagaaatagtagtttgttgatttatgctgcttggatttcagaacctgatacgttaaaactgaagggatgaaagggcaaacagagcttgtcaaagttttgtgttaagaaaaaggtgacacggctccttttgatgatggtaccatggtggaataacttacaataaggccctaagtgcttagacagatacaccatagctgctgatttgtacatgaattttgtttcgaaaaactgtttgatttttagattaaagaactttatggagttttagattcatacaccatctttttttcttttttggtgtggaaatgctggactgttaagagctagttgaaaaaaaactactgcacaagcgtgagtttagagtttacttaatttgattttactgtttttctttagctctcgtcgtgtgaagtggaatgaagacaacctgtatgagattgaatcaaataaacctgttaggcagaagataactgagcctaagacaccatatcaccctatggtagatgatgatggtacatgttttcctgttctgatctcattatacctttacttgaccatattagttactgtgtcgttgttgaatatgtcttgccattgctttctttatagggtcattgtcaccaacgcgtccttttgacaagtgtctggatgagactgttaatgctgaagctattttaactgctttaaatggtcccctcttcaagcaaaactgatccaaaggatgatggttgggcatcctcagatgatgatgcagatgccatggaacaagatgatggttgtgcctcttaccctgttcccattttcatatatctaccctgcatgtagtaatttgctcttatattttccctgtttcagttaaatgcatttgaagacatcttgtttttgatggaaaaattaattaattgattatcaggaaattacatgaatatgtctgaaaagtcttgtcattggataagtagcgcaaatcttactggaagttatagtatgttaacattttgtaatagtaaagcacatacaccgaccaaacccttagcattgctctactaaagcaacgtacatatctggagaggaggcatttaatagagattctgagaaccagttcaaaataaatcttgaaggttatactttgtaccagctcaaaatgatgatgattaaaacacattttttgagtttgatggtcagaaaagaacagaagtgattatcaatattcatttatttccacatgttaagctagctccaatttatctattaacttccaaagcaaattcaattttgacctagatgcatctgatgacagatgacacagctcttcttaatatatctgttttatataattagacaaatgtttagttcttgcttcctcgttggtaaatttcgtcaattcatcttaaaatcatgttgtatacggagtactttcttttgacgacataagcaagggatacataccatcattacgaattggcaataatctgttattcaccatagggaacctgaaatcttatggagtatgatagttcctgtgggatgtttcctggtatcatcggagagttagttatatgttggtgttcatgtagatccagaagctgaaaagtcaagactgagtttcaaggaacatcgtcgtgctcactatgatgaattcctcaaggtgaaggagctgatgcgctccggatcgctgattgacgatgaggctgatgaggatgatagaggtgcaaaaggcagccaagccaaagctgtaggaaagaagccagcaggctgtgacagcacacccccaccgcaaacatgaagcaatgaagttaccgttcctttttccctgttgtttgctaagctaggaaaagctcaacatagcagaagcatgtggtttgtctaaattgtgtgaagcatgctttgcctgtgtgttagatccttgtattcaaaatcagatgtgcatcctgtaaacgacgcatgccattcatcttccctttgtgtttaagatcttgatgtacctagaatggctttgatttagtttgagttgcctagctacatttacttgctgaacggtgagctcctttgcatgttcatttgagactatttatcaagagctgatactcaaaccacatattggataaggccagatatggcaagatatggccttgatttgtttcacgcataaagtgtttttttcctcaccatatatttctttaatattgtgactttgtatttcagtatttttggcgatactagtttagtttagtagcggcaaatatttctttatttattttaggtgctctgctcatcctcgaagtatacataagatgagtggaggaagacagagaagagtgggttcagccagatgaatagaatgggttggaaagatttggcctgacagggtttagggaattttttccccggattacatggaaacaccactccactacacacgcaccattatattcgacaaagacctacagtaaaatggtacttcctctggcccaatttataaatttctgtgttcagctttaattatctgtcttatttaaaaaattttatgattagtatttttattgttattagatgataaaacatgaatagtattttatgcgtgacttaaatttttaattttttaaaaaaaatttaaatacgacggacgattaaagttgaacacagatactcataactggagggagttaatcgctaagctcactggattcctaattgaaatgcatgtgtatgcctaatatttatgagggttgtgtttggcactcgtatttctcaacttctcccttattttcacgtgtacgttttctgaacttttaaatagtatgttttttaatatatatatatatatatatatatatatatatatatatatatatatatatatatatatatatatatatatatataagatctatttttcaagtcattttagctaaaaacttaatggattatgcactaataaacaacctcgtcttctaagcgagatgaatgagttagcaacctgtactcctgatacacccttgtatttgaattaggtttatggattttgtggatgtagtgaactactggaattaaaagaaattcgacaaaaaaaacatctccataaactcaagataaatccatgaaaaaaatttctacaagctctagtaaataaatccaacacgaagaacaaattaaacgaactccaactcaaacaaaaaaaaaactttagatgagacatcattgattcatgttaactttttttggaaaaataaattgatattattaagctttcttttatgcaaaacaaattgttgtttttggatggtccaaagtaaagcaagcacaaactacaagtcatcggctcgttaaggttcgactcgtttgagctaaacggacaactgtttgagctaaacggacaattcacgagctggcatataagcttacgagctaaatgcctagtgactcattaggagtacggctccgtttggctaatgggttatacccattgggaaatggatataatatcctggtaggatgtggtggtagtttatacgaaggaaaattttatcccatatttggttggatggattggaaaaggaagtttctagaagaatgactaaaataccccttcaaactatgctaaatgagtaaacaaacagcacagctattagctataagttcaaatggtgagggtaattcaataatttttcctagtagtcaatccaccctcaaatcaagcaggattctatatcccactcccatccacacccaaacagtagaaatatgaaaaatggaaataacatccatttcccacactcctcatcccatttgccaaacagagcctacgagttcaggtcgatgtaaactctactcctagccattgcaaaagtgagttgtgacaaatgttaaatttcgtttagatgtatcttctgttacattagaccgttcgcaaaattctgacagcatagtacatgaagctaccggaaaaaaaataccaaattggtaccgcttgacatatgatatgcgcatgacaataccgatgtagcttgagcgcgaatgaacgcatagattcgacacagaacttgacaaaaacacaaaacaggacagttcaacaggcatccgtcacataaaaacgcaaacccaaatcatcagcgtgctcgaaacaaatgaattgtgcacagttcaaaacataaagatttatgaactttagcagttctgttagaagcttgctggtaccattcaggtaacattgacaaaaattgcaagtgctcccatgaagaaaatgcttttgcagcagaggaagaaaacagaaaattctaggcatgggaaaccccagtggcagaatgtacatcatactcattatttgaaatgcttccgcttaaatgctcaaaacattttaatgaaagtaagaaacagtggtccctcagttgacaacatcaaggaccagcttgcgtgacttcaggacggaccacctcatgcgacggtagtatgcggcttgagaagtgcaagtgacagtaggaagatccatttcactcccatctacatcaaattagagtaggttggtattaggaaatattgcgaattgaaagtaatatataaatggacaaaagttgagctgattaccagtttcctctcttccatctcaggttcagctgcccatgacaagaacgaaacgacatccttgcccatctgtggtagaggatgacaacaatcatgcttaggcccttaatgctaacccaacatgtcacaactgtaagagcccaacaacgcattagaaacttacctgggcttcagtggcaggagtaccatcttcatattcaacagctccatctataagcatcttgggcatagctatggcaccaccagggaagtagggattgtaatgcaaaccctcacggatctagaatacaaatcaaccagagagtttactaatgttgcacactgcagaaagcaaataacagaacacaaccagcttgaaaaattacagctagaaaaataacacttcgtgggacaggttaggtttttttcaaaatagagttcaacatcataattatgaacaaaaatagtgattatgtagtgaattccaaacaataactgacaacaaatgagaggctgaataattgtaaattaacagagaaaacactcaaacaacaatgggacaacacaacttgaagctgaacaccttcaagttcaaccagtattgcaattacagagttacaacagtgtcaaatttgatgtcaatatcatgtgtctgtaaaatatgtatccctgtgacacaagtgattcaatccacatgcaag

SEQ ID NO: 2529 - DNA, 4632 bp, Oryza sativa
agtgtaggccacaccaaccaaatctcggtacgaaattaatgacatggaatggcaagaggcacacacttgtgtataaacttgatgtccacgccgaatactgatcatagaagtgttcaaatataagacaatgagtaaacagcaagaatagggtagtagtggttaaaaggattttcttgggagcaaaagaatattgtgattcttttcgctatcctactgggaaactaaattggtgaagtaggtttgaaggattggggtaaccaagagcatggatcaattaataataaccaaataccgtatgcaaagactctgaaatattgcaatgagctaaactctattttgtaaggaagttgaaaaaggatgactcacgatgcatggtcataagagctaagaatgccagcatgtggccagggatattcagctgctgccaaaccatgctcagcttcatctgcagaagctattgtagcaaagcttaaaagaccagaagcaccaactccaagaagagccaatgctctcagtccagcggaggattcttcatgctttatccggaacgaggatagcagagatgagccctgaaaacatgattataatgttttaaaaaaaagcaggtcaccacactaaaaaggagatgatcatgggtactgaaacttatggtgaacaaatggttactgtcagattataaactttgtcaaaattaggataagtagttgatatcatggtctaattactcaaccagaacagcaaaaataagcattgtatgcataatgcaggtttaactgtaaaaagtagaataaagatcaatcctgccaaacagaaacccctaaaaactgtgcagtagtaactagtaagaatgtgaactgtgatttctttccaaaaccccatctgatacatttcacgttatagtgatgtccggtaatacctttctacatgccatttcaataatcaattcaagattggtataccataacatttcatacaggcatcagacagaaaataaatattaaaaagattggtaagcgatcggtttttgacagaagtaatacaaaataaatagttcattaaaattcttactgaggactgattatggagtgttctccgtaggagctggttaatgccccgaccagcagccatccaggatactgcatcaaatattgaaaactgagatgtacaataaaagaggttatggcatcataattagtagaagcaactgtgcatatttcatttacagtatctaaccatccaagtggagtgaatttgagtaataaccaggaggattcaccgcaaatttacaccctccgtcccaaaaagaatcaacttatggagataaatctggacatgcatttgtctagatttgtccccagaagttggttttttctggaacggagggagtatatgtcagaaaatcaacccccaatgtcaaaattaaaacaactgaatggtatttttttattaactcatgaaaagaaataagcatacatttggtgccatgcattacaatctctgaaaaaaactgtttaaattgaccttactgcagaccttaacttactacatacttgctccttgaaagaagtatgtatgctatctcaccacaatgctctacctaaacaagttacacaggtcgaaaaagggaaccttgttattgcatagacaaagcatagatttgattgtctagctacaacccctagcccccttcttatatgcaaaccgtggaagaccgcgtaatagcaactaggccaatttatccatctatgtggttaacacaagaccattatatcaataacctaattagaggatagtgctgttactgcatttgcagaagacctaatgcatgcacgtaaaccatgacggcaacatcctatattgatgtgcctatagtgacatacctgacatatcgatatcatgtaaactaatttgctaaaagtaggatgaagatagtgaaagacatatggtgcaaaacttttatctaacacctcatctaggccataactcacaaattgcagtattctaatcagtgtgtttacaagaaaatatacaaaaagaagtgtaccagatacgccagtgacctaaaacatgatatcaaagaaacaagatgaaacttgcatcgcaaaaagtttagattagtataaatggagcattgcactattgtcgataaataagcacataccatgcgaaatcatctcaattgttaggtgccaactgtaaggcacattgaacataagtagccacaggaataaatcatctcaatttttcatgatgatgtagtgatatctcagccgtgcctaatctatctagcgaaaaagattacttggtacgtgacaagaaaaagggaaaaaaatgggtatgatccatgtggtacacgatgcgtgttcacgtactggaccatatgcccaaatccacagcactagtccgtccctcatccactaggggttccattgttctaacaacaagtaccaaggaaaccaaacagagcgggcagatctaggcggttcacaggcatcaaacaaactagtcaaaatggcatcccatcccatcccatcccatggcggatggtagatccgcgtgattctccaaagcacccatttgggggcagatctacacgttccaaacaaacaaacagaagaatcgaatcgacaggttccatccatccatccaacccacccaggtaacagatctgcgcatccctagcgctcgcctaacaaatcgatcgcagggacgaactcgcaaaagaaatcatgaggagaggggagaggccataccggaaggggaggaggtgggtgccctagccctagctcagcctcagctcggtcgtccgccttaccgggagggggaggaggaggaggaggacgaggaggcgagcacaagtggaggttcccaagagaagagaagagaagagaagaggagaagcggcgcaaagggcgaagagagcgggggccaaccctagcgctggaccctctctcctctgcctgggccagaactcctagcgcggcctggcctactacagagcctctaaggctcggtccacttacggaaaacaaaaaggaaataagtccaattcgtgtccctcaaatatagctccaatcctcaattgatgtcgtttgaaccataataccggatatctttgaaacccaaattattaaaaccggtgtaacttgactctctcaactgtgtttggagagtggtttcgttgacgtgacactttgacttatctacctcgatgagtcttctggtggagcccacatagacctttaaggagggctggttgttgaagttaccgttattgttgttgttgttgcctccttggtagaacgggcagggctggttccacccctggtcttctttgggatgatagccattgttccccatgaacatggcttcttcacgaatgtcggggcagtcgttccccgagtgtccagtgttcctgcagacctcacaagtgatgtgcgagtctagtgccttgacagcggcctacgggttgttcttctcctgatcatctagcttcttcatcaggaggtccagctttgcggccagcatttttgtctccttgacagtatgcatgccatgctgatgggtctggagatgttcttcactgcagctcatgttcgacactatcttctcgatgagatcaacggcccctttgaccgtctttgataagaaggcacccccagcagtaacgtccaagtgattccgggacgaaacagtaagtccgttgtaaaactctgtagaatgagccagttgtccatcccatggtgaggacaggcagctacatattcctgcagacgttgtaaaactcctggaagcttgatattctcctgcggagggcatttgtcttgcccatcaggaagaattttgagaggaacgcagtggagcacttgtcccatgtgttaactgcaacccgattcgtgtaaaaccactgcttcacttttcccaggagtgagaaagtgaacagacgcagcctaatggtgtccgggctgacacccttcatggtgtaggtgctgcagatctctaggaactgctgcaagtgagcacttgcgtcctcatttggcctgccacaaaataggcttgcatgcgccatagtaatcaggctgctcttgagatcgaagtcagtgtctccgaggttaacctgtggcccgacgggcacattgtcagcggacggagcagcgaactcacgaagtgtcttctcagccatattcctgaaacatggtgacgctgggatgactggtttcttagctgaaagtttcttctgcggagggacgacactcggtctgacgctctggaagaaagcttctggattttcgttgaagttttctggcaggtttaccagtcatgcactatcctgttttcataccctgttttcatgacacaaaggttagcctgcaacggacaatgatttatgcagaggtaattatatataaaagattattagcttatagtaatctctttactaatcttccctagaaacagcgctagaaatgctagttggtatttcttaacgacattactacaaatattcattcccagcaatggcgcatgaataatcctggtatatatgtatggtcaaagaagtaatccgcaagcgcacggatataccattgtagcatttcacccaaaagtatacaatcatgtggctaatacccc

SEQ ID NO: 2530 - DNA, 13545 bp, Oryza sativa
  unsure (1)..(13545): unsure at all n locations
nnnnnnnnnnnnnnnnnnnnnnnnnnnnnnnnnnnnnnnnnnntatttcttaacgacattactacaaatattcattcccagcaatggcgcatgaataatcctggtatatatgtatggtcaaagaagtaatccgcaagcgcacggatataccattgtagcatttcacccagaagtatacaatcatgtggctaataccccctaacagtgccctcctggtgtttcgagagaccatcctgggttaccgagttccttacgacaacctgtcatggccgtccaaccggggctaaatacatgagagtaccctccctaggaattagtcttaggaatatatactaacgtggaggaatacctgtattgagctgtcatcatcagtggtccacctctactgtcctgcagcatatatgcccagatagtgataattagtaatctaagcaccatgcttacattaataaatactactctacacctctggacatgatatagagcaaccgataaatcggacactaaacccatgccattgcacctctctggtaggctacccacacaattataccgacgcaaacataaagcaagagcaatactcagactaagcaaagtactgaaagtatataaagaagaatatttcattaatttcgaaagtcttatagatgaaagtagaaaagctgctagagccataccggaactcttccgaagactccgaggactccgagaactattctattctactccacttagcactaaaaatactaaactaaagtatgaagagaaatcttgagcttgcttgagtgtgttgagatagtgaatgaactcctcctgttatagggcagttatgatggttgtagctatgcgaattgtccattttcccccggaaccgtcattgggaatcaatttggagcgtccacgtggagggctgacctgagccgacgtagccagggtttggctgaacctgggctagcccagcaggtctccagcttcggcagggtgggtgacaggtgggtcctattggtggttgtggcagttaatgcggtttccaggatggttacacctgatttgtggaccctccttatccataagcttgcttaggagtgaggtttcttcactttctctttattttatttgctaaattcctgtaacaaataatactataagtacaagtggagatatgttattctaaaacaaatatgcattgtaagcatagctagttctcctttattatagttatattgacggtcgagattggtctataacgtccgtcaacagtgtataaaattaggggatcctaaacatggtatgctccatgagtggcttctcagcagaagggtgtctgtaggaagggaaatatgggtgttgttttttgttgccatacaacttcttcaaataaatgcccatccaaccaaaaagtgtataggccatggtctacttgcagcatgggaggggatgataagatttgtactagccaatatcaaagaatagtacaaagaacatagggcgggcggagccaacgaatttctccaccctagggccatccaggaagccatgaccaatacccccatgacgaaggactggacccaacccaacaacaacgaagcaacaaagccacaaagctataaaggcggctatgtaaatgcgtgaggactcaatgcccgaggaatctggcaacccctccatgcggttgtgaaaatgatcacaccaatcctgaagcgaaacttctccaccaacttcaagactcttcctaatgtccatatgtagcattaagctctttgggtacatcaagagagatggctctaactcactgtgaggtggaacgtactcttcaaaaagatcaccgtcaaggggcagtcctgagagtttgtatatatcgagtaatgtgatggtcctctcgccatgaggaaaaaggaagctgttggtgtgtggatcccatttttccagcagagatctcagcatacttggtgaatggtgatgtacagtacaaaccaagggagcaatagatagacccataaatgtaatctaccccctcttcgctaccacgcaaatgaagggaatgatgacgcaggactgctttaccccattccgcatatcctgaaggagctagaacaaattccaccttatggttttcccaacccaatccctcagatactatcctattccctaaggtggaagccttatcatctcaaggcaaaggggtgagagggtgaaaacagcggcccttgaaagcgtgaccagaagtcctgccacgagtgttacgcgaaaattcaccaccgatcaattctttatccacaatagtagggttccccaagtcacttgtttcaggttcatagggctgaagttgcgccattctaaaaagcggcaagttatgtgttgctcgagaagagccagcatctgtcatctacaaatgaaaaaaatatatcggaatatgtatataggtgcagcctaaatatacaatgaggaagaaaaggtattgttagacaagtttgacatgcaaatctaattaacaacccggattggctgcgtaacatatcacaaaatttccgggaaccccgattatacgagcaactcattctatacaaatgtggttaaagaaagttatatgtatctatcaacctgtaaaaaaaatgaatgactgaaagagggtgaagaaaatctctctgtaccttcctcttgccacacctaaatcaccaatcacccgctgaaattaagacttggtaggtttcgggcatgtgtgcatagggaagaaacccaaatggaattaattaatggaggaatgaaagccaacaataatagtaaaaaggaaacaaaaaaaaagatcgccagttcagtatgcaagatcaaatcaaggtcttacctttgatgctgtcattgatgaagtctctcctcaaatccttgcacagaagaggagaaagagggagaagactggagtagtagatgagttcaacgaacaagtgcctcactgcccctagccatagggaacgtggccaaataatcggagagatgctccttaattttctcaacaatctttcaaacaacgggcacatcgatagttgtgaggataaacttcacatgcatcatgtccctacgaatccaaaattatgtttcgagctccggatgcaaaaccaaaattttggcaagggggcatttgttgacactgattttggctcgtatcttaaataagatgtattaaattataaactaatatataatctcaaacataatgtaaaaaaataaataaacaaaaataggaataaacagtcaaaacagtcaaatgaataaataaaataaaatggcgaccaaaaatatatggccgcaatataaaaataaaatccgctcggtcagagtgaaatgatttccggcgcaaatagaaatgcgtatgcgcgtgccatataaaaataaattagcatcttggaaacacgttcaaaaaattaaaaaacgtgaacaaatattttttacgtgcttttcatcggaccgacgaacgctgatacttagctttctggtcgtgtgcacatatgaaattcgtgctataataaaagagatcgtataaatatattgagactacgattattcgctaagtacacacctggcctaaaacatatggccgtggaataggatttttcccactcacccaaaatagtcatgtcctaaatattttcaggaaaggtgtacgcaccatataaaatagttttagactacggtcatccaataaattaaaaagaaaaccaaaatatatgttcatacaacaaatgagaaaattatactcctaatttttgcgacgtgaaataaaaatgcatgtcacgtgcagaccgctataatgatgcggatatataaacacgcacgcgccaaataagagagggccagatgtcagtgagaggatacacgcgctctctctcactcaataaccaggcaattaaaaggctaactggagtaataaagattagaatgataacaataaatgggaaagcatgtaacgaccaggggcatgaccggtctgctcatgttcaccccactacctgcacgcacgttgccacattcatccagtcaaaatgaagggacccacatgtaagccaaagaaaggtgtatgctgttgagtccatttcccacgatctgcccacggatgcgcgcgggactctgttctaaaccacgaaaagctggttaaccccctagcggcaaaggaagttccaggggagattagcgtagaggctaggtgctgttcgtaggctttgcagaagcgctgcttgttgctaggcaatactgctgccgttccgctttgctcctatgccatctcgtcagcctctgcttcctcgctccactgtgctggaagatcagaggtgtttaaggtgggaatcatgctcctccttcgttattaggctcgttcattgtgtgcgagtcaaagaatctctcggttctcgttcttctgctcacgttgatgtattcttttgctatgttgttcggttcggctaatgagtacgaaccaggaagtcatcttcttgccatattcttaggcttgaccaccatgagtacaagccaaaggaatttttcgtcttttgttatgtccttcgtctcaaccaatgcatatgagacaagaaagttcgttttatttgatggcttttaacataatttcacacttttttctatggttcggccagatgagtatgggtctaggagtggcttctatgcacgttttttttcatgttatcctaccataccctctgatttggtctcgttagtggatacaagcctagacgagattctcgctctcaggttcggtcccctacgaatggatacaaatcacggatacaaacatgaaatttgcatacactactacaaaatcgatttttcatggcgttgactttttgttttctctagcggccataagtggaaaccgttagcgaaattttaacgagggatgaggcgttaaggaccgtcagcgaaaatggatcttcgctggcggctgggttaagagtaccgcttgtaaaaataggggactttttataagcggacctcttaagtgattttcgctggcggttactaaggacctccgacagcaaaaagtacatactcatagagagcagcgcttgcaaaaaaaaatcaaccgcgttattaaaaacccccacagcccacaacccaccacccaccgcatccctctcctctcccagtcgcctccctctcctcttctcccatacacggccgtctccctctcctctccggtattctcagaggtgaagggagcctgcagtggtaacaacgacggcgcgtggaggtggatccggcgatggggaggagcataggcgaagctcgtggtgcggaggcggatccaacgatggggagcagcgacgaagctcgtggtgcgccgacaacgcgagctgcggcgactcaggccacgggcggtggatctggcggcccggggagtcgcaggcggcggtgggtggtgaaggagaggggcggtcgtggtggagaggtggatctggcggcggggagcggcgtggtcggtggagccgtggtggggaggggtgcgggcggcggcgaagagtggcggtctcctctcccagtcgcctccctctcctctcctcccatacacggccgtctccctctcctcctctctagtcttctcagaggcggtgaaagggtgcctgcagtggtaacggcgacggcggcacggaagctgatccggcaacgaggtgcagcgacgaagctcgtggtgcggcgacaacgtgagctgcggcgactcgggccatgggcggcggatctggcggcccggggagtcgcaggaggcggtgggcggtgaaggagaggggcggttgtggtggagaggtggatctggcggcggggagcggcgtggtgggtcccatggcggggaggggtgcgggcggcggcgaagagtggcggtcgcggtggatccagcagcggctgccacacgacgacgacggccgggcctcgaaggttccagcggcttcctctaaccccctcccctctcccagatccaatgggtggcggtggtgctcggccggtgctcgatctggcggcagcgactccggcggcacccatatgtttgataatacaggcagagtaaaaattaaaataattcaaaagtaacatgaattcactgcacccatatgtttaatcgaagcaatatatatccctgcatcatatataaagtgcagtaaaaaatataatattaatgcatgcgtgttgtaggttcataagcctaaaaaaaatgacaaggttaaaacataaatatataaaaatttctgacaatatgttgataaaaagtatcaaatattaaagtgaacaaatactcgcacggttatgccttgtggtttagatcacattggtagtaatacatgtgagtattttaagaaaatcagccaagagtcatatacctgctgcatatattaaagacaaaatttgctacagaaaattaaaaaaacgtataattagctagtggacaaaaaaaactggtaattagttgctggacacctgccagattatgttattatatgtgaaggaattggagagagaaacagctgtgtaagtacgattttaccctttatttttttttccttatccttgttcttttctctctatctcattctttctctcttcttcaagtgagcccgagggcgacggcgcggcgaagtcatgctgggcgcctgggtcactctcacgattgagtttgttttatgttaatttggcgaagctgcgggctactgcagcaccacaggccgcagtggcaagagcaagcagcaagtctgcaaggaagccaaggagcaaggaagcaaaactaaaaggcaaattttgctaaaggacattgttaatgtgtggttttagccctaggacactacctaaactcacttttaggggaaaacactcgatgaatatagtaatttgccagtggacaccgtgacgattaaaataataatttccggttaaaaaggagagaaaaatcacgtgaaatgtcaaaaatgtccttgggaaaaaatgtcagctctatctcctatctctcttctcatctctctctatcttctctcccagaggggaacggggcggcgtcggtcgctggggctcgagcttgttgcggcggaggagatggcgaggacggcggtcggcggagtggagcacagcgtcggctgcggcggagcggagctagaggccgaagcaggcgggcgagcacacggtggctggcggagtggagcggggcggcggcggcggtggacgagcgtgcggccggcggagcggcagcgtcgggcgagcggagtggcggcaacgtcgagcgagcgcgtggcaggcggggtggagcgctggtggcggcgggcgatcgcacgatgaccagcggagcggcggcgggcggggcggggcggagcggagcgggcaggtcgtggctggcggagtagagcggagcggcggcaggagaaagggggaagaaggccgccggatagggggagatgaagcctgccggagaggggggaggatactgctgcaccggcgggagagggggaaaaggcgacngccgctctcgccagctgctggaagaggtgatagagagagaagagagataagagagttaaaatgtgggcccaagggcatttttaacatttcacatgatttctctctcctcttcaaccgaaaattattatttcaatcggcgtggtttccactgacaaattatcatgtttatggagtgttttcccccaaaagtgagtttgtgcagtgtcctagggctaaaaccacacattagtagtgttctgtagcaaaatttgccaaactaaaaaggaataaaaagagggagaggaaggggaaggtcttggcatcacacagtggtacatattgttcaattgtttagaatttcagcacattgcaaattcaaagtgtacagatttgtgattggaaattttgaaataaaatttgtgtaattgatgcgaaccctcgcattgagataatgttatgttgtacactatcatgcattgagattttttccccatattcttgttctatactaactcttgcggataatttacgggccacaccgactgcgagggagctgctccggcctggcgggcacagggcagctgcaacgagcagtccttccccgtcgaggaccctcccccttcgtgcggcgggaggtaagctgtggtgtcaaagccaccggtggtgtgcgcgacggtgggcgtggctgggacggtgtgcacggaggaaatcgcggtagcggacacccgtggtgcgtctcccctgcacgcactggtaccgtggctctggatgtgccgtgccgagctgccggccatcgacaacaccatcgaggaaggcggcggcgccaggagaaagccaagccgagagagccaaagggcaatatggtcttttctttttgtctctttctctgttttgtttgaaaagaataaaataatgtcttcagtgtcctcaagcatatgtttttttagagtgtcatagagccaattcacgtctttgtggtgtcctatagctaattacacgtttttttcgatgttattgttgacggtcattattgaccagtttcgaccgttaatattacccaatatataaagactaactatgcttacaatgcataatttccaaataaaatatctccttccactatatactatgctactaacatgtatccaggagaagcacatataaatggaggagaatcgacagcaaaataaatgatcaatcaattggatgctgtcgagaatcagacttgtggatagatgggctgacaacacggaattaccacgagcaaacaagcccacaattcacaccactggatcaaaggaccaatgttgacggtcgttagcgatcagtttcgaccatcaatactaccaaaataaaggagaactagttatacttgcaatgcatatttgtgttagaataataaatattccactagcactaggattactaacctcttgtagagaatgacataaaatggaggagaatcgatatcaaaacaggtgatcaatcaatcggacgatgttgagaatcagacttatcaacgaatgggccaagaactcagaaataacacgaccaattgggccaaaattcataagtctgcagaagggatcgagagaggaggccacctgccgaatttggaccaggccggcccagcccatggtttggccgaatcattgggttcagccgaacccaccgtggctccgttcgatgcagggtttggatgggcggtcaggattgctcccctatggcggttggagggtattactgacctttccaaccgtcataaccgtcattctcaagctatataaagccctctcatcctccatttcaagacacacctcaagcaagaagttcatttcatctctcaagtttagcatagtttctagagtataatggaatagaaatagaataaaatcttcagtcctcagagtcttcggaagaattcgtgtatggctctagtagcttttccttttttcttttttttatgacttgtactttatttagaatactcttctttatactactttggtattgtattactttccgagtatatgaataccaactttactatatgttcgagttatatttattatgatgctagcttatctgggagatgcaatggtgtgggtataataatcgtatttatgataactctatgtcatgacgatgatattagatagtatttggtaatttaagcgtagtgtttagattactagatatcattatttggggttatatgctgtggaagcgaggtgggccgctgatggtgacagctcagtatgggtattcctccacgaatgtatatagtcctaagatactttcctggggagggtactccaccgtatttagtcccggttgtatagtcatgacggattgtcgtaaggaactcgacaatcaggggtggcttctcgaagcaccagcagggcatcggatggagggtattagctaaggtatactataactaggatgtatatataatatgtatgtaaattagaagtataggaataggatctttctatattctttccacttagcttagataatcacgagtaagaggatgaatgcttctacttagtgatattgtaccctatgaattatattaacccctgcttagactttggttataaattattcgtacagtaatatataaattattagtactgttctctctattataatcttcccacgggattaaacaaatacgatacctttggaatactctcaggtgaaatgctacaatggtatattcatgcgcttgcggatgaactctgtaaccataatataccagaagtatttttgcgccattactgggaattaaatttctagtaatgtcgttaagaaataccaacaagcatttctggcaccattgccagggaagatttataaaagagattaccattactaatactttatatttacctctatataatcattgtactttgcaggctaaccatggttgttttcacttttattgtggaaacagggtagtacatgactggtttcaacttgccggaaaactctaaggaaaatccagaggctttctttcggagcgtaagccacgagtcgtcgctctgcagtaaactcttccgacatagaaaccagccataccagcgctaccaactttcaagactatggctgacaagaccctccgcgaatttgctgctccctctgctaacaacgtggccactgggccgcaaatcaacatgggagacgtggatttcgatctgaagtccagccttatcacaatggcgcaggctagcccgttttgcggcaagcctaatgaggatgccaatgctcatctgcaacagttcctggagatctgcaacacgttcacaatgaagggtgtcagtcctgacgccgtcaggctgcaattgtttccgttttccctccttgggaaagcgaaacaatggttttatgccaaccgtgccacgatcaacacctgggataaatgctctacgtcattcctgtcaaaattcttcccgatgggcaaaaccaacgcccttctggaaggatctcaagtttccagcagacgagggatgagtccattcctgaggcgtgggaacgacttcaggaatatatggccgcttgtcctcatcatgggatggacgactggctgatcttgtagaacttttagtatcatgacgagctgcgtgctcgagacatccgaccatgttttattggtcataattatccaactaaaatgcgacttaatggtgggttgtgggtgcatggttttgctagtcccacccatggcagttaaggaccggttcacaggatgcactggaagacttaccgcgcttaccacaagcgggaatgggtaactgtctgacttgaagtatagctttcctctctgacgcatccaggcaagggtgagcgtgatggagttcggatgggccctgcgacagtctatgcgcctttttgatttgcctaggcacgagaggggactgcccgctgcctgttgaggagtgggggtgaaacctgaggtgtggtgtgcttggtcagagagggttatatgaagggtcttgtcacaatcactcgacatggtgacgtgtccggacaggcgcggtgacatgccggtggattgtgtcttttgggtacagttgtgcacctctggccagagtaaaactattcgaatagccatgcccgcggttatgggcgatcgaccagattcatcgtgattagtcacacacttattaaatcgactcaatgcactgtagttcaggtgggttggttgggcctattcaacgtggtgtagcgttgatcagtggagatttaatattaccttaattaatcaactattttactgttttgctcaataaatgtttagcgattgcctttatgcaaatagcctcaagccatccttgtatccccttgcacgcctgcatcattggtgtggcttgctgagtacggtggttgtactcagccttgctattattccccctttccagaagtgtagtgcttctgagctaaagacggagttagaggaccaaggctcagaccccagttgagttttgcctgtggagtggagctgaagccctgctaggattgcctttttccgctgctgctgctttcgtttcgggtgtgaggactaagtgcctcttctgtaagtattttacgctttatttacgtttgaaaccgtatattacttgtcgttttgtttaccctgggtgattcttggacagagatttaatgcacaaaatagtctggaaatttgggctaaatttttgggcgtgacaaggtacaactacaactggtcttcgaccagtgacgtagcagtccacgtaccacgactttaagtgatcaagaacaactacacacatggtcttcatcttgtgtggtagtcacctcagcatcctatgagcatcaatgtcacaccctaaagttctcctcctaagcctaaaattgaatttataaatcatcctaagaaaatgccggtgcaaatcaagagaaaaccttaataaattaatgcaaataataatcggaattggcatgtggaatttttcttgagttctacatgtcgaaatacgctaacaagatttttagtggaattttcagagctctcgaaataattttaaccaattaaaattgagcacatgcaattttaaatcccagggaaaatcttttcctccttttctttttcttttccctccttttcctcttcttgggccgtcggcccagtccaccccgccgccgcgcgcgccctcctccttgtgggccggcccaagccgcccctccctctctccccgggacgccgacaggtgggccccacctgtcggggtcgtccccttcctccggctgcccgccccacgtcgccaccaccgccgaaaccgccgctgtgccaacgtccccgcctcctccgggtcatgtcggccacgcccgcgcatgcgccgcgcctcccgcacccactccccctctctcccgctcgcgcccgcgcccgagatggccaggattcgaattccgaatcccacctctctctccacctccacctccccgcgttggccggcggaatcccgcccctaccggccatgtccgggattcccctcccctatttaagctccaccgccactccctctctctttttccccatctcgccgaactccctcgtgcttcccatcgctcccgcgccgtgcttccacccgccgccgccgcttccgctactccggctgccgctagccgccgctaggctcgccgccgcaccacgccgtcgccgccgcccgtccgatcggcctcgggggcgatctgggccgtcggtccggtggaccggcagccttgagccgctgacccgggggccccacttgccggcgcccctctctccccttgagccgctgacatgcgggccccgcctgtcggcaccaccccccctttgatgacgtcagccctgggacatattgcgcaataaatgatttaaggactttttattatagtaataaacacagtgaatcttctaaaattcataactaattcatccgtgctccgtttaagcccattcaagtctcagtaaatcaagaaaaatgtgtagaatccattaaaaatggttttgttctctgtttcagtagtcttatagcctgtttgcattgtttgctttgtatg

SEQ ID NO: 2531 - DNA, 5060 bp, Oryza sativa
  unsure (1)..(5060): unsure at all n locations
nnnnnnnnnnnnnnnnnnnnnnnnnnnnnnnnnnnnnnnnnnnnnnnnnnnnnnnnnnnnnnnntgatttaaggactttttattatagtaataaacacagtgaatcttctaaaattcataactaattcatccgtgctccgtttaagcccattcaagtctcagtaaatcaagaaaaatgtgtagaatccattaaaaatggttttgttctctgtttcagtagtcttatagcctgtttgcattgtttgctttgtatgtcgcttagattccggttcttctgatgctccggtgtacttcgagatagtcgccgaggttcctccaactgcagagcaaggcaagttatgcctgtcacttgaacatgttgatcctatattgcaaatggtctattgtttttcttcaaatactgcattgttttataatgttactatgggatgtttacctattgttacagccatgctattttgataccatgctcctttgttagcttgcgttataacatgaatagactttggactaggaattgcttagccatgcttagttcaactagcacacattggggaaaaatcctattaatgtttagactgtaggttctaatggtaatgttggattagtgacaccgcttcagtgttggttaattaaaataaatcacatggtgggctgtgggtgcatggttttgttggtcgcacccatggcagttaaggaccggttcgcgggatgccctggaagaacttatcgtacttaccacaagccagcgtgggcaacggctggacttgtagtgtagcttttctttagccgacgcatccaggcaagggtgggcgtgatggagtttggatgggccctgctacggcctatgcagcttccggattcacctaggcacgagaggggactgcccgctgccttgtgaggagtgggagtgaaacctgaggtgtggtgtgcttggttagagggggttatgcgaagggtcctgttacggtctctttccggtatgtcgtggtggcatgtcggcgcacggaaacgtgtcgtggggctgtgtcttgtgggtacagttgtacacctctgatcagagtaaaactattcgaatagtcgtgcctgcggttatgggcggtcaaccagattcaccgtgattagtctcaccctagtttagtctaatgaaattggatactataggtggatggttgggcctgtcgcaacgtggtatagcgttggacagtggatgaataatatgattaattattacaactgtttaattctttcaacttctgtttataaatgctcgctttatgcaaatgaaccactctagctctcctttgataattccctgcatcatacccctattccggtatgacttgctgagtacagtgggtagtactcagtcttgctctattttccccaaccccagagtacaagtatgtgtcagatggtggtttctccgaggagtaggcttcgtccgtgccgtcgaggatgtctgtggagtggtgttcccgctgcagatcaagtcaaggcttagttcctgttatctttcgtttttccgctgcatttatgtaagacttttatgatgtttgtaagacgtggatctgaatgtcaacattgtcgtttgtgtaccccggccggtcctggacggggattttaatgatgcccaatcatgttgttacaaatgaaagaataatgtctatctatacataataaagtaacttcaaatgcagcacaatatatgcgcctaaactttgcagtactgattttgcagttcagttttctgtgagctttatgagatgttgaaaccgaattttgttttttgcccaaagaaaataatttagagaagttttgtttcaatcattattttggcctgagtttaccctgctaaatgtgtggaaaattatctcattaaaatctcatgtacatgtttatatatccaaatcaaactatttaatgctcagcagaccgtgaaagaggaaaattgggaaacatccattgctgattcactgatctattttaagctgcatttgtacatttactagcttttgataatacatggctgctatctcactttttcttgagttatctatcgtcgtttgttctcataatagtttaactcttacaggcttaaccattatctattgcatgtagtccaaggcataaagtaatgaaaataagattctcactgaaaaacatctgttacgctatataatacaataacaaattagttttattcaatgaattaccaagacaatgtttacaatacttttatttttatcaatgattatgagctttaatttgtgagtatatgtagatgtacattagcaatgaatgcatttttcttcaattgtatatatcaatgtgctttgcacgtgcacgttcactagtttttttaatatatgacgttgttgacttttagatatgatgtttggatattttttttaagaaaaacatataaatataatttattatcattaaagatattttaatcattacttatatttttcctaagacgagtatgaaatgttagataaagaaaaatcaataacaccatctatttattaatacggaaggagtagtatttttatttctttcccttatctgtttattaatttttccttggttttttactttccttcaatctatgatagctccagctcgtgcgatttgtcactatatctgtgaggttgtgagcctgtgatcgtgagaggctatttgggtagccagctagtttgatccagactttcagagggagatgagcggcgcaggaaacactccccaatttaggtgcgtttggttgctcgtatacttctagcctggttcatctcctttatccagactaagattggcctggttaaagatatacatatgcattgtttggttgtttgtattgaataaacctgcatatggttagatattgtttggttagttgtattaaagatactgtatgcgaaagatgtttggttggttggatcaaaaatacattctggattggagggtgagtttacctccatgggtattaaattgagttttaactaagtccaagatgaagttttcggaatattgagtatagtttcttcgtattggagaggataacaacatattacatgcagtgctactgacttcttggagatgcacaaatttcaatgacgaaaaaattcgccaaactaggaagtcccaaaaaattgtgccaaacattaaattacactattataaattaatcgtcgggattatccggtcaaccggatagaaaaagaaaagaaaaaaatgaaaaaaaaaaggaagagagaaatgcatcgccatctcgcaactgccgtcgccgctcgcctacatgacgctcgccactctccctttgagtcccgctgtttgccgccgccagcagagttcatggctgcggatccggtgccgtcgaagctgaagactcccggatctagcgtgtcgaagcttgtggccgtcggatctggtgcgtcacagctcgtgaaggagggaagcggtggccgatgagggagacgatgtcggcaacgactaggagaagaggaggaagaagatggcagcgacgacgatgcccctagccctccctccgtccctcctcctgccctctctctttcttctggatttcgttgagctcaagctccccatggagacggcgccgacaactactaggagaagaggagaggaggtagaagatggcagtgccgctgccgccgacggtgcccctcgagccctcccttctggatgcatcgacccctgcgcgccgctgcacctgtccatcccgagaaaatggacatttagccacttccaaaacacggtttcactctaatgccattccgaaaacgtgtttttgctaaaatgctaatatgaagtgcgtgcttaccgccactttgcaaaattttggcccttttgtacattttcgaaatcaatttcgctcctccaccggatgatgagataaaattgcctttcatgtcctttgccgccatcattgagggagaggagctcgtcctcgtcggccatctccatgtccaccatgagcagctcaccgtcttcctcctcctcctccatggatggcatctgaagcagtgctatatggggagcccagacaacgaggtggccggcgagtcctccgacatattctcttccctcgaccttgccacctccgccgactacctcgccgcggtcgacgacgacatcccggaggtcgcttcgccgtggtcgacgatggcggctagggtttcgaggtggccccatggcctcgtcggcgacggaggcgaagggggggcctcctcgacgacctcacctctgcttccgcctcgtcggtgccgtccggatgcggcaggcaggggcagctgccggtggttttgtcgctccacgcacccagataccctcgttggcagcgggcgtggactcatccgacggcgctgttggccatcccgccgtcgtcggcagcggtggtgggctcatccgatggcgctgccaaggctgccaccatggaaggggaaggatggagggcaatttcgtctcattatccactgaagaagcgaagatgattttgaaaatgcacaaaagggccaaaatggcaaagtggtgatgagcacgcgctttatattggaattttagtgaaacgcgttttcgagatggcattctaggaaaactgtgtttcgaacgtggctaaatgttcattttctcgtccatcccacacttgcatccgctcatccccgcgtcggcgtgagctgggcctggctgaagacctacggccgatttccgcgtttcctcgcagcctggctcagcggccgtttttgcatcagatgatcttggctcgctcacccatgcagacaaccaaacgcgttgctggttgcatgcgggatgcgagccacccccggtgcagccaaccaaacacacccttaattgccgatcaaattctaggggaacggccgggttgaggaggtttcacgggatgggaataagttcactttggctccgttaagtagcgtcctaatctgatccatatccctcaaccacaatatcagatattttgaccctctaactattaaaaccggtgcaatttgacttcctcatcggtttgaaagggcggt

SEQ ID NO: 2532 - DNA, 6478 bp, Oryza sativa
  unsure (1)..(6478): unsure at all n locations
cacatgtcatgcccctctctctcccttatttctctctttctcttcaccttcatccgatgncggcaggcgagggcttgagtgcgcgcaacggcggcggtgggcgatgggcacggtggccggcgggcgggcaaatgctggagtggcgaatgaagcttccgaggaactcttcatcgggaaactgttttaagcattcgggtgaatgtccacctgtttcttgcatgtcatctaaatggttatggaaagttttaaaaaaaattgacatgataggataatatgaatatattacttcacaaacatgcaagttcaaatttaacttctacaagttgtaacaaaaataacaaatttgactgtaaatatacgtatactaaaagtttaatttgttattttcgttacaacttgtaaaatttgaatttgaacttgcatgtttgtgaagtgatatattacatattaatctatcttgtaatttttttgaaattttttcataattatttaattgacatgcaagaaacgggtgggcatccacccgagagattagaattcatcctcactcttcatcctctcctccccctgtctcgtatgccgcactgcattgcttggctcgtcctcgtgtgcatgtgtgtgttcgcgcgtgcgagtgctcattctgccttgcctttcgattggttactattccccttgtaatttgatgctgatttgcggtgaagtagatggattcgcctatgtgtttccacattttttttgggtcttgttgcgagcagcgtctggttgttttgtgctgtgcgtgttcggttgtttccagtttttctcccccaatttcgtgcgttctagaggtaaattagtcttgtctcgtggtcaattttttgcgggatatttcgcctccccatatttgatctctgttttggacttttggtgctatttccccccaacaaagagagctgaaataatcatgcattgcatgtgtagtttgacattcggtagagaagataaataacatgccttagagcagtgctcatgtgaagagaaaggggtgagagggaaaaagagagatcatgacatgtgggtcccacaaatcattttttgtaaatgacaaatgagtctcacatattttttttaattctaatgtcatataaacgtcacgtcaataccgtgtggcataaagactaggtcaacaccgccgcgtagatgacatgtcagcgaagccacccttcaaaaccgctgagggagtcatattgcaccggttttaataaatgaggggggggtcaagatatgcagtatcgtggtgagggatacgaatcaggttaagccactggttaagggatacgattgatttctcgcggcggtttcttaatctgatcgtgggcaaccgcaaccctgatgtcaaatcgctatggtacttcgacatgatgcaccagcagttattctatccggcaacacctccaccgacacagaaggttggcgaattctggcaaaagtttaaacaggcagctggcacgatgatggatagtatggggcttcccttctccagcatcaacttccgagcttcagctctcaacgtcaacaaccaatcgaagatggactgtttcccgcttgctagccgcgaggtgatttgcacggatcagtctggccgcgcattcctcgtcaacgcagatacgtgcgaggtaggaaccatgcccagtcttcacaagcccaagtcgatgcccttgtctgtcttcgtagttcgttcccatgatggctatggcagcagcctctttgtcatggagaggattcccaaaccggagttgggcttcaacagcgatcagtttgaggccttcgtataccgcaagtctacattatcttcctacagaaaggcctggcactgccattaacttccacctccgccttttgtctgtgaacccaagcactgtcacagctgctgcagcagcccagacccagagatcagctcctacgctgtgcttggcggtggctcacacatttgcttatctgtcaatggcatcggcacctactgcctggagacagcaagccactcatggagccaagttggcaaagtggacactgccattccatggcaggattgattatgtgcctgagttcaacctctggtttggcctctctgctgaggcccggcgcttggctgcggctgacctctctgccatggactcccagccacagctagtgggcccttggaaggaactcaacctgccagaggaatggagggagtgcaaggatccacaacttgtcaaccttggctcaggcaggttctgcatcgctaggttcttccgcagtaacagtgactttgggaatgaaccaattgccgtgtttacaggtgtggaggtagtgccacatgtcggtgatgccaatggcaatgcaaataaaggcagcaatgggaaagtgcaactccaaatgatccctcacagatcaaaatgtcacgcatctaatgccccactacaatcgatgttgtgctctgactaatattagtgctggcatccttttttatccattttgttttttatctgaataagagataacttagaatattgttgcaagagatggtctccctattatctctatttgctagtagtgcagtattgtgtcctacaatggcagattctaaaattaactgaatttactcctaccatttatatggcagtcttgttttatatttgtgagaaaattgcacttcttcgtggagctgaacggctatctaactagcaccactttacttgcaagtcgttttatgagccacttaacactttatcacaattgaccaaaatatcttttttaaaaaaagtaaattttacaaaactatatatacgtggatcaaactatcacagaactactacatgaatcacaaagctacagatttagtcattgcatcacaaaactatatatttatcacaaaactatagatttagtgaagttatcaaagaactacaaatttcactaaattacaaaatttgtactacaaattgtagagtttagatccctagcactattatttattataagttataacaattgtggttttgtgataaaattatgctacatctatatttttatatgataccttaaatcggataaatttaacacaaaatctataattttgtgatgcgcattcttttgcgatagttttcatcaaagtacatgtagttttataaattttatttatttttatttatgactttgttaccgtgtaagttggcattggaagagaaacgtagaaagaggccatcgaaacgctttgtgaacgacgacgctcttggcggtgtgtggtgaataagattattctttcgttcatgtaataaccatatatgcaagtttacactttcaactcatttccatattattactaagtgcatgctgaatggttgtttctggatgactgtttattgaaggttactgaaactatactacctgttcttttttttttatgcggggattgattccaagatatgattgatgggcatgtttatcttcagaatctcaatctgagatatatgtatctatgaatgtatgtcagatcacatggtgtcttccgatgaaatcaaccagttagaagatggtctcgccgacgattctgatctcgacactggtgctagctccaacctcggcgacgatggtgccatcaacattgactctgacgccaacctcgacaacgatggtgccgtcgacctcgaccatgacaccgatctcgatgacgataccggcatcgaccttgacgtcgtcggcgccgaactcaacatcgatgatgctgccatcgaccttgacgacgatgccgccatcaacctcgacaactttgatcctatggatatatataacatggatgattttcttgctgagttggtgtttttagatgaatatagtgagcagattattatcaggatgaaggacaagataacagctgagccatctcattgtcaacgtcaaagtggtacaagaccgtatatacaagaaaccaagaagatggctntgaggatcttggggccaactacttgtccgagtcccctatctacaccgatgagaggttccataggaggcttcggatgaggaggcccttagtgaagggcctccttatgtgactaatagagtggatgccactggtagagcaggacattcaccacttcagaagtgtacaggcgccattcatatgctagcatatggaactccggaggaccaacttgacgaggtattaaagattggtcctagtataggtttggagtgttggggccaaattgctaaaggagtcattgaaatatttagtgaagagtacttacgagctccaaggaatgatgaggttgaaagattgctacaggttgctaagtcgcgtggttttcctggcatgttaggaagtatagactgcatgcattgggcatgaaaaaattgcccggtctctcggcgcggccaatttactcgtggtgacaagggagttcctaccatgatcctctaagcggtagcatcgaaagaccttcgcatatagcatgcttttttttggtactacaggatccaataacgacatcaatgtgttaaacaagtcaccgttgttcattgatgcattgataggggaagctcctcgtgtgcagtttactgtaaatgggaaccaatataacacggggtactaccttgctgatggaatttatcctgagtggaaaacattcgtgaagacaatacaactttctcagacagatgaagatatattatatgcagcccgtcaagaggaagagaggaaggatgttgagcgagcctttggtgtgttgcagtctcactttaacatcgtatgtcgtccagcccggatgtgacagaggggtgatgctatcaacataatgtaagcttgtattattcttcacaatatgatagttgaagatgaaaaggaaatgactgaaattcctttggatttgaatgagaacccaggagcatcaatcgttctgccaccggaagtgagcaactcctccaaccccaacccatgctttgctgcagtactacgaaggaattcatctattcgtgatcgtccaactcatatgcaactcaagaaagatttagttgcacatatatggcagcgcttggaaaaaagtagaactactctatataacgaaataatgtaatttagcttactgtttgcttaaaataatagtatgtgtgtgctggtatgctcattgtctttttttatatgatagcttactgtttgcttaaataatagcttgttgtttgcacaatttatggaaggctaaaatttacatttgatctagtatacatgatgaatttattagccatttattagcctgtattaatggagagtcagctaaagagaccatcctttgtatataggagttttttcgctgacatggagtgtagagagcctgcactgggctctagctttgaacatgccctaagattactttctcattatattgttttctttatttccagatatgaacgcaatataacattaattgaaacctaatgaaggtaaatggccaacataagcaaggtgagcaactgaaagccaattatgtggagtgcaataatgaagggtattgttactgataactgagttatcaggttgccgcaagaggtgcctgaataaatttatctacacatctgcattcattcaaatgatgctttgaggacaaaattgctttcctaattagttattggctgaatcatatatttcaatggactattgaacagcacatatgcattctgctataggcaatgtctaaacctaggaggttgggaatgcccatggaccatggtggagcggatgctgcgtaggtgcaggaaggatagccccacagttgcgtcactgcatggggtgcggaggaggaaactgaggcgtctgagagaaggggaggtgtcgttcaggcggcgaagaataacactattatttgaggaactctttgtaaaataaatttctaaaaggactgggaagatatttttgccaattaaaggatccaacggcctgtaatgtctgaattgaaaatcgaatgctttataatcacttaatgatgtggcactgtagttttgcatgcagggtttcacctttcacttatttagatatagttaaacatagtgagatttatgttatgtgatattcaccatgagaaatacttttagataaaaattagttaagtgttatatctaaaagccaaaaacagcgcatatttaaaaatcggtgggagtatgatttaattggcatcactattaaggacaaaacaatcaattaaagtaaccccttgcaacattagccctgaatgaggacagattcatcgcatttatatggtaagaaaagacaattcatttaaattgaagtagaagaaatagccataagtccgaaaacattttcttcctttcatttccaattggtagctgccaaggtttgtacatgtaagctttatgtcgacaggaaacatcaacttgttacattggtcacaataaactggctaatccagaaacaattagagaatacaataacttgttgccatca

SEQ ID NO: 2533 - DNA, 5195 bp, Oryza sativa
  unsure (1)..(5195): unsure at all n locations
nnnnnnnnnnnnnnnnnnnnnnnnnnnnnnnnnnnnnnnnnnnnnngaaatgaatatcaagaaatgcaattctagaagaatgcaaaccaatggtggctctatttcaattctaatggttccctagggaagctgtctaggatgagttatctgaaatttctgatctattcatggcactatgtatctacattattgttcatctcatcctggagagtggcaattgccactccagatgataccactgctatctgatccactagactgctactgaatacttcttttcatcgccattagctctggttcttctgggagcttagctagccttcttcagcaacctgccaagtgtgacctcctcacacaggaattattgaagctacttgattgttctgattccctccggttaatctcaatcccgagcaactttattggggggttagtggagtcattaaccattgctgccatcacagattccgaggggagttcagttccaacagaagaaacccttgacaaccaatagtccaagcattggtgacagggatctagagcctcgatttcctgttgaacaacaaagaatttttgtgtaatattcaactagttacttgaagtgaccaggtttcacaaaaataaatactgtggatatcgtaaaaatctaccttaattataggggaggataagaacccaaacatttcaagtccattcaaagaattgcaggatagaaaatcaggaaggccagattttccaaaacttatttgttttgctatttcttcatttactctgtctcttacactgtcccaacattgcattggtgatgtgtgagtaaacgaaacttctggaagaccttcgacagtcacctgttattaattcagtagcttatgtgagcacaatgaaggaaagcagacaaatcctgaaatttagaaaaacaagaagcgtttataataaaagcgtaccctaaacaatggtccaagaagcccagcatcaagaacttcggagatgtagcagcatgtccttgttggatctagtacactatgaaatgtaactcgactcttaaatcctgcatagatgaatttctattagtgatatttctggaggatgtacatattaccagaagacaaaaataatcattgcattgttcagtgtatatacctttggggaatatagcttgctgattgcaccactttttaccaatcatcattgttccactgtctagcagctcaaccgtatacttagctattgctggcttagagacttcatcagtttggctcgaggaaggcttggccaattgactaacttggccatcagaagactgtgctaaattggatttaatgtcaacaccaaacagtttctctgtggtaatggaagctagcgtagaatttcctgtttgaattcttgaagatggtaactcagatgaatgattcaaggacagtgagccactgcagtcagactttgacctgcttggattactagctgttgctggagactcaagattgacaaccatcttgttcttatcatgtttttctgaagcaatctggattcccttctcttgctggtatcctgctggctttgcggggtcatagtgatattgatcttgacttcctaagctgcagccatgattgacgttggttgctgaatccggaaattccgtgttttcacccaagtccatcttcttgtactgagtagaaccagatgggcagactaaacctaaatcattctgtccccactggtagaccgcagttggatcaccctctagagctgcaacaagagtatggagctcctctatggtataccgcaacaacgcggtttttctgtccatttcacatgaacatagaatgtttgcatggtttaagcaagcaaaacgatttggggagcattggcagctgacagctgacaaatggagatcataaaaacatgaaaagcattcccggtcagctgaatcataatccccatccattttcttatatcgcagtgccatattccctccccgtgctgccttctccattttaacccttgtctgcaatatagtacaaccaaaatatgagtaattagtctttttgatgaaaaagaaagagttaatcctttgagtcacagctgattaataatcagtgataaataacaacggcctaaactagtgagtaccttaattgcacttgtcagcattccgtcctttccgcaagtatcctgccatctgtatactccttgttcacttttgcagtcgctaaggttcatccaaagctgtctgacagcttcatttgcagtttttagtaataatttgtcatgtgatatggatgtcttgcgccgctgctccctgtagagctcaacagcacattgtccgtgaggcagccaatccacaggtgcgacatttactgcctccgcacagttgaagccacagttgaacccagaatggtaagctcgcggtagcgttagaacaaactcgcctggattctgaacaacacgataaacaggaactccttctgatttaagaacagaaggagataattgcgtaacctgcaccatgaaaatttaggatgaaaatgaatgaagatgcagcatatttatttgtacaatacaggaagataattattctcagatgaaccactgtgtagtgtcagcaagaatttgtgactggtagtaggcactaggcaatgataataaatagagtactaaaatggaacagaaaataatgttttcctttgaatttcagtacatggatgctaagttgtttccagttcgcaatatatccaaaaagtttattttgcaatcagtgaattcatgttgttagaatcacagggtcaattctattacataacaaacatgcaatttcaaatggttaccagctcatgtaggagatcaggctgttcttcaaacaatcttggtaagttctttctcatagcttcttccagcttcactgcatcagcaccaggaacaccataccatacttttggttcaccaaaatgcatgtaattcatagaataaaggaaatgatcttccacgtgctacaaagttcaagagagagatatcagccaagaataattatcataatcaattaaaaatcacatattttcctactatgtaaacattcatcttatgttaatccactaagaagattgaatagcactgccaggttagaatatcactaggctagtagcattttccaatcccatagagcaataatatgttcattcttcaacaagcaaggaagttaattagattacttttacctaggcaaacggctattatactattaccaacagaatgataacattgtaaaaatgggtcaatgagaaaataaaagcttacccaacagaatgatgagaagcacatccctacataaagccaagggactacgacgccagatatatcctcagtttcaaatgacagtacagacccaggaatacgtggaagattgttcaaattccaacaagataaaccatatggatctcgtctatttgaatctgaagataatttagagaggccactactgaacatcgaactgcaggcatgcaatcagcaccataatccacctagtcaaagagagtccgatgcttatcagtatgtattaatagttaaataggaagatgatgcacagatagcaaactaaatacctcaacttcgtcagtggggcatacaactatccgccaatattctccctctatttcatcgaccgatggttgccaattttttttcttctttttaatttcagaaagagggatttcgtcacttccctttattccaaaatactgctgcttaaactcatctgcatatttctgaaactcatctagtgtgaaatctgagccagattgaaagccaaacttctcgtctgcatctgcgcagtcttctgatgtatttgcactaggacgcctgtgagtcatcccaaatctcagtctctttctcctcttcctcttcttctaactcgaggttgtgattttttctttgtgggttcccggttttgaagcttgtcaacttgttgaacacgggtattgaactctgtacattcccagaagttcttctccttcagagaacaaggcggtcgccaagaagatggtggaacagtacgacaaattccatacttttctgctgggggacaaatgctcgtaatatatctacatggatctttaaactcccgaagggaaagaacgattagctaactattactatgctatcagcatatctcatggaatagttatgtaagataaatgtacacaaacctcttccgttggagtgaaaacaggggcatcatcaatttcaggtctgtacgattcatgtggatgccactttccatttgtctgttcataaaagtaagataaaatagcatgaaaaattaattagccaataataataaagctgtagaggaatagaaatgacaacattcagctaataaaatcaaaacttttcaaggaattacagttgtagctccagcaacattgtccccgcaagctcctgatgggcagagatcctgaaaaggagtagtcttacaaaattagcttgtaccttgaatatttcattcatcaggaaagtgccacagattggatgttcttataggacagagaaatttctattacaagttaacaatttaacatttaccaatggaaaataaataatattgcacgataccattcatcaaaatttgtttacatatccgcatgtatatgcttgagttcatgattggtcgatcaatggactttagttccaacatcattacttgaggaaagttgatttgatttagtagaattttctcatagattggcatatatttatatcatataatcaattcatggatttgtcaatctactagcacaagggcaaatccaagttttttcgccgggccaaatcccaaattcccccaataggccaagaacatcgaattagttacagccactgaaatcacacacaaatttgcatcaccaatttacagatcgacatgataggttgggggaaattattcctttaatctcaaatcaggaacaacagaacccagagttacctaggggaagatgccaatctgttgcggcatccgaatcgcatatcaattttaaacctacaattctcaggatccataagtttttctctctaggacacattattcatcgatccacccaatgctctcccgacctaatctaagaaccccaaatcaaacgcatcgcatccagaaattcgcatctcattgctactcatccgacctgatagcacccaaacaacacaca

SEQ ID NO: 2534 - DNA, 13094 bp, Oryza sativa
gatatcctactaaagtatataattcaaatttggatgtgaggatgataatatgtggatttaatggtagaaaccaacaccagaccttaggtggtggtacaagtgtcatttgagctaggttgttgttgacgtaaatctgacgtctagtaaataccaaacaaatctggttgcaaaatattataatgttatatttgttttctagatttatttcgagagatattttttatataggaggaagtgcattgattgatgtagatataggtgtgatactcatgtcataactggtggtagctaaatataatgtttatgaaaatgcaattcactagatctgtttatgggcatcccgccttgaccggcctaggttgggcctctattttcatcctaaaaacctattccaaagcctgaacaaaccaaaaaagtaaattaaatattaatactcatacttttttttattttagagtaacaataataataactactccattcaaatatggaaactgataagtattttaggttataggctgggccaaactcgggcttgtagttttctctcagctttttcatgacccagcataacctgctttgacatgtctacccttggcagactatgggcaaagatgacacattgcccaaatctgtggaagggatagagaacttcaagtggggattccattagttttcaaaaaaaaaaaagtggggattacattcatttcatatgtagatcacaatttgagatatttactatgctcaaatgatggtatggaatcatttcagtttttcacaaatgtgtgctatgggttttaggaaatatttcaaacaggatcggaaccaactacaaatcgaacggctgatttaacaccaaagtcgggcaccgggagccacaggcgtggagggacgtgcattaaatatcttgctaaacttaaatcaagacgtatttagatgcgagaatatggtccataaatatgtggatttaatggtggaaacaaacatcgcttatgtggtggtataagtgtcacttgagttgtgtgctagttggtgtaaatttggcatctagtaaatgctgagacatatcttaacacaaaaggattatatattcatttttttcaatatttatttcaagatatatttttacagaaggaagtgcactgattgatgtgatatggatgagctcatgacgtaatgggtggtaactaaatataatgtttacgagaataccattgactaaattgactagatatgtttatgggtagccgacattgataggccagcttgggtctctattttcatccaaaaaaaacctattctagatcttaaacaagccccaaaaataaattaaatatcaatattatacatttttgtttaaataatacataataactatttagatatgaaaactagtgtgggcttgtagttttctctcgggcttttcatgacccggcttaacctactttggcatatctacccttggcagactatgggcaaatatgacacattgcccaaatgtgtggaagggatagagaacttcaagtggggattccattagtttttttaaaaaaaaggtggggattacattaatttcatatatggatcataatttgagatatttactattctcaaatgatgatatggaatcatttctatttttcacaaatgtgtgatatggattttggtaaatcttcctaacaggatcagaaccgactacaaagcgaacacttgatttaacaccaaaagttgggcgcccaccccaacccccctccccaggagccacaagtgcaaagggatgtgatttgacatcctacaaaacttaaatcaagagagatttagatgcgaggatatggtccattaatacatggattcaagggtggaaaacatcatcgcttaggtggtggtacaagtgtcactcgacgtatatggtggttggcataaatctggtgtctagtaaatgttgggacaaatttggatgcaaaagattatatgtcgaattattttctagatttatttcaaaagatatttttacaggaggaagtgtatttattgatgtagatgtagatgagctcgtgacataacgggtggtagctaaatattatatttacgaaaataccattgactagacctatttattggcaacccacattgataggctagcttgggtctctatttttatcaaaaacctattccatagcttaaacaagcccaaaaataaaaattaaatattaatatttatacttttttgtttaaataataataatatctattcagatatgaaaactagctcagttttgtagtttttcctcgcacttttcatggcccaagataacccgcattattcgacatgcctatccttggcatactgtggttgaagatggcatgctgcccaaatgtgcgaaagggatcaatatcttcaactggggatcacatttatttcatatgtagatcataatttgagatatttacgatgttcaaattgtggtggtacgaaaacttttctattattcacaagtacagatgtggatccggttagaggagatgatctggtgacattccataactatgacaagggagattaatacccaaaagagagaaagacatcgactacgctaatatggtggtacaagcgctattggacatgccaaaattccaatgatatatatggactccatgaagattcagaatggcaagcaagagttacaaaccctgtctttatctagggatcagggctcaatataggggaaaataaccgttataagttcactagtctttctgcccttccccctacaactcactttcgtaaaaggacccctacaagttcaatttctcttttacttcccctttcactagtttttaacgatttatcaccgttggttcaattcctcgactcctcatgcctcctgggcttcagcacggcaagacgaagttaccccatgtcgttttagcaagaacatctacctccttgtcaactacggatcacctaagttgtaaacgttcttaatagttgtgctgtgttttgtgttgaggtttgccatcaccacccctgcgctcgtggaaggaaagagaatcctagtaaacttaaatcaaagagggatttagatgggagaatatgatctgttgatatgtggattcaagggtggaatccagcgtcacttaggtagtggtacaagtgtcacttgagttgtgtgttggttggtgtaaatatggcgtttagtaaatgccgggacaaatttagttgtaaaagattatatgctgattttttttctagatttatttcaagagatatttttatagaggaagtgcattgattgatgtagatagagatgagctcatgccgtaaagagcggtagctaaatataatgtttacagaaataccattgcctagacctgtttatgggcagcctgcatttgaggctctgtttggcaaatgggatgaggagtgtgggaaatggatgttatttccatttttcatatttccaccgtttgggtgtggatgggagtgggatatagaatcctgcttgattgagggtggattgactgctaggaaaaattactgaattaccctcaccatttgaacttatagataatagctgtgttgtttgtttactcatttagcatagtttgaaggggcattttggtcattcttctagaaacttccttttccaatccatccaaccaaacatgggataaaatttcccttcatataagagcaagtttaataagagagtcatcagttagctataagccaatgacacgtcatctaaaagcaatcaaatagatagatctttgtatcaaccagctgcataacacatactccaatactaatcattcattttattatatggaggagggcccaccatcatccaatgcatgcatgagagtaaatggctgatgaagataatcggctaagttttctaggcgcctgtgccaaggctggcgattgcataagcgcccgatcccctctctctcatcttgcctctctccaccacgtcagacgaagctgagctgtacaggcttatagctgactgaaattttgttattatacttgctctaaactaccaccacatcctaccaggatattatatccatttcccaatgggtataacctattagccaaacggagcctgataggctagctttggcctatattttcacccaaaaacctattccaaagcctaaacaagtccaaaaaataaattaaataccaatatttatacatttttattttagaataataataataactattcaattatgaaaactagcaaaatactactccctccgtcccaaaatataagcatttttagaccctgacacggtttctgagatgctactttaaccaacaatatctgtaaagtaagatgttttaaaataaaaagtattgcatattatgataatttgtttaatgataaatctagtaacatcaattttacattattgatctttttttttattttttttgttactaatggtcaaagttagaaataattgatttatcactatactaaaaaaatgtttatattttgggacggcgggagtatgtattttaggttttgggatgggccaagatcgggattgcagctttctctcgagggtttttgtggctacactaacaagcttttgacatgtctatcccagggattccaattttggtttgaaaatttgaaacttttgtaattacgctcccctctagcaagcaaatatctcgcccggaatttttgctttttccccaaaattatgtgaatttggtcaaaaatttatccaaattcagtcaaagtttgctaatttttcaaataattttgggcaaaaagttccaaaattaccaaaagtttcagttgcaccaaaattctaaaattttggtaaaaaccaaaagtgaaaaacctggtctatccttggtgtacaagggttaaagatgacacgctgcctaaatgtgtgaaagggatccagatctttatgtggggattacattcatttcatatgtagatcataatttaagatatttatgaagttcaaattgtggtggtacggaatcatttctatttttcacgaattgtatatatggattttaggaaccccctcccctcccctcccctccccttccccaccttgttagaggatatgatacggtgatattccacatactccctccattttttaatagatgacgccgttgacttttgaacatatgtttgaccattcgtattatttaaaaaattttatgtaaatgtatagatataaatcatgcttaaagtactttgagtgataaaacaactcataacaaaataaattataattacgtaaaatttttgaataagacgaatggtcaaacgtgtgataaaaagtcaacggcgtcatctattgaaaaacggaggtagtatatgacaatagaggttgatggcaaaaaagtgtttggaaaagaaataattgtactagttgccttcattgttttcacttgctacgatcggtaggcactgatgagtttggtttgctggtaaagagggccagtgcattctttcgtctgtgacgtgaattggtgaatgtatgatgcacccttgatttttattttatataaaaaatagtagtactactctagtgtcaaatcccaatcagggtatcaaactatttttatcctagttaattctagtataaaagaaagcatacgatcagctaaaatggccatacagaaatatagtggttccccgaaagaagaaaaccaaaaactggactgacaaccttacatatactatatgagcagccaaaaagtgattataaaaagaccttatggtgaccatatacattatggaggtaagccacaatacactaaatggttgtttggatgctatattaacattttcattctttaatatatgagaaacgattttttatcctaagtcccaaaacataaatatctcgactagattaagaactagtaccaaagatgttttagtactagttaaagtcgaagtacctagaaacatctttattctcggttggtgttaccaaccgatactaaagatgcctccagggttagtttaaaaagaaagcagggctgaggtgagagctcttgagttcgaattccacatctcacttttttttgtcttagtatgcatcttgagatcgagatatttagtctcgatttactggatcgggtggtaccaaccgcattaaaggaccgttctcccttgtgttttaaaccgcaccaatttataatacttttgtaccacactttagctaagttatgaccaacaaaatggtaaccacactttacctagcaaaagaaaagtgtgccatacacttttgagttgatgacatatgggaccatgagaaatgaaagagaatcttatacaaggtggtcatgaaccaaacaatgagctaacttgatcaaacttgcctaacatgaggtgtaacaatgtttggcaaagtttaggaggtaaccaaacaacctctaaatgcaaaggataactccaaacttatggctcaaccacaagcaataaagtaatatgtaaaactaagatggttgataaaggtaataaactttacacttgtgaggtccatcttagtatacactcttgttttaagcattgtggcaataaccaagaaatagtgagacctaccttaatgttattaaggccataaatattggagatggagatgcctacttttttttctctctttatggatttggtgattatcgtgtgtatgtttttcaatctcctaaacgatatttttttaaaaaaaatctttttaatatgtaattcatttgtttgggcctcaaataattctaataaactcagttcaatccgatcatgtattggctataaagaagacagcgagaaaggttgaggccccttcagcctgttgggaggcatactcctagtagaaagacagctgagctgttcaattcagataacccaatttttgctaaaatttcgaacactttctttatctgttactgtaaatctgtatccattttcttggccgggctgtttcttcaaatgtcagcacatccattgtcgatgttctttctctatcttgaccaatcgattgagctaactaacgccgacgattcagccatccatgcttcttacctaaccagtttataaaccgattgagaatactaaacattgcaacaaaaggtgcttctttctgaaactgcgaactgcttcgatacctacaggctacaatgcagttctttaatagttctccaattaaagtgatccattcagtcaccaaagacttcgacgtttgactttcattaactgagcttgagatgcgattttgaccacaaattttatattcgaattagtttatatacacacctcttaccaatttctactccatcatttttcacatatacgctatccatattctaaacggtagattttaaaagaattatataaaaaattaattttaaaaaatatattaatttgttttcaagtttatttagctaatacttaattaatcatgcgctaatgaatcactttgttttacgtgcggggagatgaagctccgaatctccacctctgaaagcagcctaagtttataaggtactataagttatacttactgtatttttaaaacaaatatacataaaatatatttttttcaaattaagtatttcataaaccattgacagtcgaagcatcaaaagtttgattaaatcttatccacaacaacagtatttgcgaccaggagtataattcgtgaaatgataatatggagtactccacttcttaatagtttctgaatacaaatataatttatatcagtctcagcgtaggagcagcattaaggatttttgcgtaaactatagcagtatttatgggtcttgtttgtaccccgttgcacatgcacacacgtggagggtcatacaggggttgatccaggaacaaaatattggggattcaattacacagtttttttaacctccagtcatttagggatctttagtttatcagtcatggtgaaaaaattaaaggaggtgttccgaggggtatctatgggtcttgtgggtccccctacacccacgttgaatccgcccctggagtcaaagaaccacagggtgtaaataaacatgaaaccacaaaaagaaactctgaactatgggctactgacagtttgccacaaaacccctgttgctaacattcgatacattaggatacttacagatctcacgcatcaatgttctcaattcaagtacctttattaatttattatttctcttagatcttgtttggtcaattcctttcacaagaaaatcgaaaggaaatttcatatacctggaactaatcccttttaattccctctaatttatttctcatggggattatctgaaaagccttttccttcattgacctggcaatgccatacaagcaatgatgaaagaacattaccaacaatctctgtgcgcgctgtgaaattattgataaatcctcagctaagtcatttaccgactccgacgaccaccttaatataccgcggccgcaacaactcgacgccaccacctcacaatcaaggtcgctaacgcaccggccaccgccgccacagcaccaccacctcatcaccgtagtcggcaccccacgcccgccaccaaagtcacggccacgggccctcgctacctcgcagccgccgccgctaccacacacaaggggaattaaactagggtgttcagctagagaaaacttatctacacgaaaagacaaaaatacctttccaccactctcaatacaggtggtaccatctcataaaaaaatatgtacctggaggtaccgtatgtttccaaccgttcgatcgggcaggatgaagggccgagattcggtaccgggagagctgctggatgggagcaaatattctttctagcaaaggagctagtattcagtagattaaccttactgcatttccaaaatacaacacatcaagttatgatagtcaggtaacacatatagatgcatgggaacacttaaccatcgttctggccttaagggacttcaacttcttcaatacccttcacatcaccacaaacagcgtaatttccctgcaataaaataacacaacatgacaatggtaccaaatagggaaccgaaaacatcaaatgaaacacttgacacagtaagtttgctagctatttgaactctttctttttcatctacttcgtcattgcagcatcgcataattgttgcaccgtttctgaatctagaccaacacactaaccatagcactgctggcagcatctgaagcatcctacacagataatgaaaacttatcgatttcgaaggtaaaaaaaaaaatcaaggtagagatatctcagtgttttttggacagtgaccagcacggattctcctctaagcttgacagcttcaaaccatccctgcatgtttagaactatgattaagtatacaaacttggcacatagcagaatgaaaaagtatgatgcttcaattaggaattccatcttacaggtattaacaaaagatcgatcaaatcaaaccattgtatatatgttcacccccatgataggcaaggaacccacgtgcttattgtttcaaaacaaaatatgcatgattttatgaacatgacaaaggaattacctgaaaacaccagcaaatgcaagtgcagtgtattctcataagctgagactgcatgcgacatctacagagtcaattacattttggtctcaatcacgtgcacgcagtgcttctacagctgcaaggctggtacttcctccatttcgcaatgtaagactttttagcattgcccatgttcatttagatattaatgaatctagacatatgtatgtgtttagattcattaacatctatatgtatgtgggcaatgctagaaaattttacattatgaaacggaggaagtcccatacatagatggctaaaaaaagtattgttctaccataagaattcaacttttttaactgacaataaccggaaccatatctgaaatatgtcatacttggcactcaaacaattgttgataaaatcatagctgggaattctcaaaaaaattgtgggctagacttctagcagaaattgcaagatgaaaatatagaggtgtttaactaggggctgttcagattatagccaaaataaacattatcaaattttggcaatgctagaatgttggtaagttatcaatattgccaagtttttgcaggattccttatgtatttagcaatatttggtacaaaactaaatgtatgcacatctttggtaactttagaaaatttggtatggtttaaaatgtcatcaatctaaacaacccctagattcatcaacaaacctaattgaatcaagcttttcttttggtccattgattcaaagatccaacaaattttggtccattgatttaaaaacattagcatgatcactatttttttcaactttggagtagagcacagaaacttggtaacatggcagaacaagtactctgaaacaggtgaaatcacattgatagaataaaaggttgggggatacccagtacatcattggccttaatcaaatagtttggcagttgctggaacattcagtgcttctgcaaccattccaacaatctgagcaccctgaaaagtgaataaagaaagaataaacacatagaagtaatgcagtagatacactgcaaatgtttatttaccctaaaattgtgcatatggttaaactgggaatgtctctacaccatactatcgcacaggggtttaattcagtttggatcacatggattaaacagcttttggaatccggcaaagtacacatcatgattaatggaacaacactaatcaaataccaacgaagagtcagggtgacccttgttaaaaatatacatattgatttaatttattctataaataaatcataagattgaacatgtaaactagcataatcgtatcatacaatctatacatgtaaactaaaactagacagtacgtaaaacatgaatagattgaatatacgaaacagagtgaatgcgtaccgagggttttggatgttcaactacacagcaggaagaactcacggtaaggtgggagccggtttccaaatggtttacacaagagcccaacctcaccgatcaaaccgtcaaacctccaaatcccctagttaaggaatgggtaaggtggaagccaaacctgaagttgttcatataaggctcgatcactaggacggttattccttcagctgaaggtggttgtgatgcctagggtctaaaggcggatttaggcgcaactcaatttgttggaccatactattgatgctaaaaatacacactgacctgggagatctgcttagctccagtgcaggtccaaatcttgatgatatgcgagcgtgccagtcagtttgatcctgcaaccgacaagatatataaacaatagataaaacagctgatcggttgacaagccgatggagtagttctagccgataccgataccagccgatagcgatagggtttcgagtaatcggctatacgtccaatgtatataatgatataaagacaatcggccgataatcaatataattaaacaatataatccagtagaaaccagtcggctagaaatgatatgatagaataagcactgatccgaagattaaagcatacatcggctagaggtctgatgtcataaaatccacaagattggataaacagtgaaacctttgttgcaattagctaaatccaacttgtatgtaatgcttgtaagccgatgcaacatctagatacctcattggctgaaaccccgatgaaacccttattagcagtcaagaagcaggctagagattatggttctaaacacggtttagtagatcaaacttaactgatgcagcactaagtatgaaaagaaacataatatctagacaatcaagcccttgactaattaatttttaaggtggtagatgccttatctaatctaatctagtaaaacaatttagccgggtaccggcagaaaccctaaagcgagagacaaccgatagagctaaattgatatactaagaatagattaactaagacatatgataaaaaggcagacaaatatatcatccaaacctgagcaatccaagaggtcgaatgtattgatgcagccttgaacgacgccaacgtagacgatataattgtctaggccggcggaacatttgacctaccccttcgccggagatcgaaaagcgatgcagccccgcgttaggtgccaaatcccgtcggacgataaaataaaatagaaaaggtaaaaggtgacgatggcccgaattgtattgatcgtggagatctcttacaatgaccccatgtgtacatatttatacctatggggacatactagtacttgtaggacaataaagaaactttcctaaagataaaaggaaaacatataagtccttataggacattaaatacactttcctaaagatgaaaagaaaactaataaattatttctaattaatagataacttgtcatgccgcatccttcttgaactctgtcacttctggataagctttctttgatagattaattttcttaaccaaatatagcaggaatctgactattggtgatgtgataattcttttaggggcttaccaaatttcactgttaacacacttacaatgtaacactatgtgcttttatcctcgctttaaaaaagtttcaattttgatgttaatatataagtaagctagtattatatctcaagcttcactagagatgtgggaccagctagcttgttgcgctttgctggctgcctgttgctgctagcctgatacgttgatagcaccgctactcctcgcgtgggccggtcaaggcccaaaggccaaccagactagtgctgcacgctagctagctttgctctatgcgtccattatatttgctgcttgctttttttttcttcctctcttttttctttttcctaattattactggggcatcacagacaactaatatcaagcctccttcacaatcttctcgtagaggtcactggacaactcgttccaaccatataggatgcagcaaccttcaaaagtaacaggtggcaaccatgctcgaatgtgattaagtgccacaatagttcaaacaagggacaattttgtttctgcccctattttaatgtctaatattgattttaccc

SEQ ID NO: 2535 - DNA, 731 bp, Oryza sativa
  unsure (1)..(731): unsure at all n locations
atataaaaatattgcaaagagtgtctccttgccgaggaggaaggtgttgagggggttatagcgccatgggcatgcccggaccgaccggcntagggccgggtctattcaccttatccaaaaaggttttctaatctgttggaccaacccaaagcgaccagttctaaaaccccggttcgaccggcctccactatcagggttacgaataaggcatatctcctatccttggggtcgtaagatatacaaatacggtatatcctcaagtatacgggaatgttacctccaaactaaggaaaacagccgatccgcaaggaaaccgtctccccgaataaaagatgttagtgttgtcagggttacggataccacatacctaatagtagttgactaaatcttggtaggacccaccacataccatatcttatacggaaactgacctcggatatggagggagttccggataagaaaagacaaccagagttctacatggaaacgacaaggactactcggattgtatccatattggtttccctagttctacttggacaaggagacacctatgggtataaatacaaggcctcctaggaggagagggacacacccaccacaatcaacatacacggaacaatagatcaagacagaagatcaacatacaagccaacatacgccaagacaannnnnnnnnnnnnnnnnnnnnnnnnnnnnnnnnnnnnnnnnnnnnnnnnnnnnnnnnnnnn

SEQ ID NO: 2536 - DNA, 600 bp, Oryza sativa
agtcgccattacccgttctagagactctctcctccgtcggcgaatcaaatcccccaccgaatccgatcgaagcagcgagatttcttcttccgcaatccaaatcgccaccgatggcggccgccgccatctcccacctccgccgcggcgcgccgcgccacgcccgcgcgctcctctacctctcgacccgccgcttctcctcctcctccgccgcgggggtggctcccctcgccgcggtcgccgcctcagcccgccgccttctctccacgtcggtggactccggcgcgtcctcgacgggggagagctacaagccgccgctcttcgaccccttccgcgccgccagcctcgcctcgtcggccccgccgctggagtcgccccccatcgaggagctccccgatgacgcgactcctcccccggaggaagagcctgggctacccgcgcccgagaaggatccggtggcgacggcgtgccagcacgagttggagggtctgaaggcctgggtggagacggtgaggagcaggaaggagtcgacggaggagaaggaggcgtggagtctgctcggccgctcggtcgtgagctactgcggcaccgccgtggggacgg

SEQ ID NO: 2537 - DNA, 1295 bp, Oryza sativa
acatctgcatgcatatatatctgtaaactcagcacgtttttgcgtattgtgaatcaacacgaaaccctgcgtccaccgtgacgctttcctgcatacacctgagttttatactctctccttctatgaatggtgatccagtagggtagaggagacctagtcctcccagcacctacgctggatccgcccctgagagtgaaagtagccttttaccttgtcaagcatgggcgagttgttattagaactcattgggttactgttgtcacgttcaatggattatattgtgccattgtacccagtctcattagattgtactccctccgtattttaatgtatgacaccgttaacttttcgaccaacgtttgaccattcgttttattcaaaaaattttgtacaaatataaaaatatttatgtcatgcttaaagaatatttgataatgaatcaagtcacaataaaataaataatagttacataattttttgaataagacgaatggtcaaacgttgggtaaaaagtcaacggcgtcatacattaaaatatggtagtaccttgttaaaactaaccagattaacgtcggattgcattgcgtcattgcacgttgtctcatgggattgccgttgcctcttactccctccgtccctaaaaaagacaaatcctggttaccgtgtccaacgtttggccgtgcgtcttatttgaaaaaatgataaaaaaattaaaatgataagtcacgcataaagtattaatcatgttttatcatataacaacaatgaaaatactaattataaaaaaatttatataagacgggcagtcaaacgttggtacgggaactcacagtttgccttttttttggaacggatggagtatgtagtgtgtcattgtacttagtcttatcagattgtatacatcatgagcatcagaatgtccgatgtctcctatgtactgcgtcgtcacatttagtctactccctccgtcctaaaattagtggggagattttagtgcagttttgcactattcacattcaacgtttgaccgttcgtcttatttgaactttttttatgattagtatttctattactattagataataaaacatggatagtactttatatgtgactaaatatttttaattttttcacaactttttcaaataagacggacggtcaaacgttgggcatggatatccacggctatacttattaacacacacacacacacacacacacacacacacatatatatatatatatatatatatatatatatatatatatatatatatatatatatatatatatat

SEQ ID NO: 2538 - DNA, 734 bp, Oryza sativa
cgaattcgagctcggtacccgccctggtaagagttgtctcgatatgcttgggcccatcagcagtagctgtaatgaagggtaaactgaaagaagcataaccaatggttagaatcaaccaagggaatcaaaggattgctacccaaaaggaaacagtccaatagcacaatgctgcagcaaatcaaggcggtcaagcaagctaacctgatatttgtttgggtcaaggatgatagctccatctttgccttctcagctgcttctgtaagacgttgcaaggcctgcttgtcttttagtaggtcaataccttcatcattcttgaagttccccgccagccaatcaacaaccctctgccaatgacaatgatttgtgagcatatacatcttgtagaacagtaagaaatgatgctaaaagatctagcagctacagaaaattataacaaatatacatgacgtaagacccttcaaattaagcaaaagatatgattaccaaatgatgaattagaatattacgattactgagtcggtccatccatttgtttcatcatatcgtacatgtttaatgaagattcaaataattcaggcatccaaaattccaccatagagaaatttattatttattcactgtccccagtttgactagagattaagaacttcaagaaaaaccatagggcatatatatgtagtactgaatttactgccaacttatcatcccctaatcacccagaattaaaggctcat

SEQ ID NO: 2539 - DNA, 7496 bp, Oryza sativa
tgtcaccagatgtagacagcacctcaaaaacaccatcaccaacttcaagaactgaaatcatcacccaaaatatagttaggagctgaattctcatttaagagatgaaaagtgttaatttaattaacatttgacagacgaaccaaaatgaagtacacccagaaggatgaatggataaacaaagttcaatagaacagatttgatcttatcaacacaacacaatgtgaccataacggcataatgttactataataattccttcagtctggaaatgccccttttctgaggaacctaatcattctcctgtcacaaattatcacaacgtatttggaaaattgctactattgccataagatcgtagtatttgaacatacagagtcctcatagcactgagcaaaaagttgtttagaccagcattagcctttgaaaattcattacaactgtcagaactacaactgaatgtaattaaataactgaaaaaataattggccataacagcaagaaaaaatgtttttatttttagttttttgacaaatacttcacttggttatgttatgtcaataaaaaatacactacaacagagtacgtgaaaagatgcaaatagtggttaaaacaacaataactgggtaaaacttgtaggtgcaaatagtgttcagaaaggcaccgtaattgtaggatagatacctgaaacatcaaatgtgcctcctcccaggtcaaaaacaagaatggtctcattgttcttcttttcaaacccatatgccaaagatgctgcagtaggctcgtttatgatgcggagaacttccaacccagcaatccggccagcatcttttgttgctgtcctttgtgagtcattgaaatatgctgggactgtgatcactgcctttgtgactttatcgttcaagaactttgatgcatcatccaccagctttctaagcacctggagaacataaaatgatcaacactcggattaaaaacaatttgaaccataaaacttattttgcaggcatacataaaacatttgcatgcacatgctatttcagtttttgccaacagatccccaaaagaaaatggcacattcgactccaccaaaattacccatctaggcctagtaattgatgaaagaacaccagtaggaaatattgtactgatgaaaacaaagcaaacatgaagggaacccacaggatttgcactataagctgtcaagctcaaagcatataagatgtctaactcagtccatatatatatatagactgcatcaaaaatccacgtgcacatatttagatatatacaaagagcaagggctgttcagtacaaatatcctactacctgcattcccttttgtgaagtgccgttttaaaaaaaaaaaaaagaattctatagttttgtgaagaatatgctaaacaaagcatacaggatgggattctatttgtgagacaccaaaaacactgttatggaagctgtgctattgttggcatcaagagaagtcaaggcgagattaagcaattaaccattaacccattattccatagagcttcatgaacagtcacgatcctataagctagaaatcaaaactggccacatctaagcaacgcaacaggattccatcttgcaaagcattctttctagattctagccgttagaacccctcaattgatgatcaattccaacacatggtaaacaatcacaaagcgtaagccacccctatacctgggcggagatctcctcggcggcgaactgcttgccaatggcgggacagtcgagcttgacgttgccgttgtcgtccctgatgacgcggtaggagacctgcttggactcctcgtcgacttcgttcatcttgcggccgatgaagcgcttgacggagaagaaggtgttctccgggttgacgaccgcctgtcgcttggcgatctgccccaccagccggtcaccggacttggtgtaggcgacgaccgacggcgtggtgcgggcgccctcggcgttggtgacgatcgtcggcttgccgccctccatggccgccaccgcggagttggtggtcccgaggtcgatcccgaccaccttctcgcacgccacccgcagcggccgccacctccggcccccgccgcgcccgtacaccgcggcggcggtgcggacggagacggacggggacggccgccgcctgccatggtgggcgaagaagggggtcgaggtggggaaggtcgtggtcgccatggccaccgagagagaccgctggtgctagctaggtcacgaaaccctaggggagggagggaggaaggagaaggtcgtggtggattcgagtggtgggttttttgagagattgggggagaaatggcgagaggttgggggaaggataaggaaggggagggagggttttatagacttcgcgtgtggccaccacactttggaggccagcctgtggcctcttctttcttcccttggatttttactatggttgtggtggtaaatcacttcagttcatatcactccagtaataatacttagattagagtaatgctacacatgttacaaataatatcaccctagttagtctatgtgaaaatgaaatgaagattcaatcacaacgtaccacatcaatttttatctgatatacttgtacatgagattttttttcttttacaagtatcatttttttttaccaataccatgttgtgacatatatttataatcagataatttaaatttagcttcaatttttatttattatgatataagataagaaaagatatttgctccggtcaataaaagtagtactccctccgtttcaaaatatttgacacagttgattttttagcacatgtttgaccgttcgtcttattaaaaaaatatgtggtcaaacacgtactgaaaagtcaacggtgtcaaacattttgaaacggagggagtatttgatgttaggacgttgtcgattagagttgaagggagtatattagaaaatgtatccacttatttattgtaagtcataaattttaatcatttggtgataaggacttttcaaacactttagtctcaaaatattacatctaagaatcatcctagtagcaacattttgagacaacatagtatctagaacttttgtaaaatttggttagtgataattagtaaatgcataccattattccatatcaatccctgccaactagtgttctcttagaggaagtttaatagtatagccaactactagctccaaatcaactatagccaacgtaatagtcaattcatacaatagttgtttactatactattaatacttggtcccacatctcatacacacatgacgtcttggagtccgtgctgtagctgactataaatctgtagcccgctgcttttctttctctttcttaagcctgctattgtacctgctctgaaccggtaaaaacctcgcagtaggctgatcctatgtttctggcccagaaattctgggtgtggccacacggttgggcagggagctgtggctggagcagtgcatccgggaggtggtggaacgttctggaatcaacgggacggggtagtagctagggagcacacgcagtaagctcgcggaggcgttgagaagaatgtgacacctgctcgcccgcgtccgcaaagcgcacggaccgtatcgccgacaggtggggccgcctctaccggcagggccttggaccaccgttgcgtggggcgggtcgctggaatcctgcggttgatgaatggccacgacgacggggcgacgtggtactatgcaagcggacgaaccagatcgcgtggcttggatgaaggtacccatcggttggcaataagccgtactataaaatcagcgcgccgactgatttatggtctgtcaccatggtgagcttctctgtatgtccataatctttcctgtttattcagaattagttttatgccaatgaaatttgtaacaaaaaaattcacacattgtgatcccttaattagtgatttcaatccttccctcgtcacttacagtcttaatgaacacctaaaataggtaatattgtatagtggcttaaaaatttataactccaactgtgggatctgtctgataactaaaaaaatattgtcctagactccatgatgtaaaatttgctaggttaaattagaccagattttgtttttagaattgcatgtaacattttattttttaaaattattcttaccttaatttttcctatgaatttactttttgccatcttctcgagagtgctcaaatgccactctcccaaaatttcattcccaaatgccacccggacctacacgtcggcctcacacatcacctggtcccatgttacttttgtttgaatgagaaaagaggctgacatgtgggcccggataacattttagcaaaaagtaaattctccctctaatatttagtctgcattaattttgcttgtaaaatttccttgatggctaacattgatctcttttttttccttgttattttcctcctcttacatgcagcagcaggtgttgcccggccagtagggcacccaaggcccagcacgcgcgcctgacgacattcgtccgctcgtcgcgcgtcctttccttccagccggtagcgcacgtcctcgcacatgggccaatcggcccaacctcactgggagcaggcccaactcggacgcgcgtacgcgagaaatcgggaaggcacgagtagaaagaaaataatcagagcagaatcagagatcgcacgggggacacgtggctaattttcaggggagctaatcctcccagggagccacgtggccgaatcatatgcctgatttttatccctaaaatcggtttagataagattagcgaaaagataatttaaaatcagaacttttatatatgtgtccaactgtccataacaacttaaaagtaaatactaaaacgaaactacgttaaaaatactttaaaatctggcaacggcttattatttatagagaaatgatgaggcccgaaaacagtgtcggaaattcctgctaatcgagcatcatttttataaaaagtacctctctcactgtttcaatctaaaaagttcttttacaattgtatacacatacataaagtattaaatataggttaaataaataactaattgcatatattgcgactaatttgcgagacgaattttgtaagcctaattgctcaatgatttaacaatgtggtgctacaataaacatttgctaatgacgaattagttaggcttaataaattcatctcgcggtttactgatggattctgtaattagttttttattagtgcctgaacaccctatgcgacaccctatataatacccgatgtgacacgccgaaactttacgatccttgttgacaccctctaaatgcatcatgtgagtacttcgcttctgatgaaggggtgcaagatgagcaggagaatgattttagtgtagtatctacaacctttgttgttcatccctattcctaggttcatttgtttctttagaggatcattctatttgcaaaagaattgatgatattacataatgaaagtttcttgtaattcttttcatttgcgtatttctatgggtaagatcatgtattatggggcaaccatcacatgaatataaaacaaaggatggtatttcatgaaaaaaaaggtaggatgacgtgatcacggctactatgtataaaaccattgctcacatcatatatcatcaaggaaggtgtcgtttagcgcaacacaggggagtaacgcacgattaggagtcacacattgataagaaaaagcaaatgctgaaaaataaattataataaaaaaaagcaaattagatattaggctttttttttaccaaactttgaaagtggactagggctaacataagatttttgcaatttggcaaagttctacaatctgagcccctccacgcaggcacaccgttgatcttctcctctaagcggttactccctccggttctatattaattgatgttttggataaggttgaggtcaaacttttataacttagactattaataactttaaaaatatttagtttaaaggaactagaacaacatatatagatttgtcttttaaagtactataataaaaataaacatgcatttatttattatatatattataacagaaaaaaaagatcaaagatgtatcttgtagaccgtgtcattgtctaaaacgtcaattaaaatgaaaccggagggagtacacgcaatctggtcactgccaaggcaccactactgtcctcgaaggtatccataccagcccagggacgcatatcataggattatggtccaaactgcattgcatagtgcaatctgcgcttcttcttgttgtttccctcattatctagagcgccgagattagggccagtgttgccaacttgggagcggcatcttctattaattgttgtttctcttatcatccgcgatacccatgaggagaattagaaaattattaacggagtttaggttaactgacgattcacattaagcttgatcaacagcactccacaaaaatgcaaaggccatatgttagaggacaagtcacgtcatggcaataatcaggacaccataggaagagattagctctcaatgtgagccaccggtccaacttaaagacttttatagtacaaaacctgaaaacattgtctacggagtagtgcattgcaatgggaaaactaatgttatgataataatatatgttatgataataatctatctattaacttagtaaagtaatagaaaaatgagcattcttatggtttagaaattattatcatattaattggagtaaaataaaaaaataaggagaattcattgtagacaaggactctttcattttctttttttctaaaaaaaacaaatacgttatatatgtgtagtgtccaatcggacagctgcataaaacaaatcttttgcaaggaaaaaaaacctaagctggatagattaatctctctatacaaattaatacaaagtattgctattttttaatttttgttgaataaaatttagaaaaagaaatgaaatttggaattaagaaaagaaatattgaaatatgagtagttcatatagaaataaaatttataaaataacaaaaattataaaataaattatatttgatgaggattctagaatattctcccaaagaggttagagtgcatataggaatacaatttagaaaaagacttcaaattcaaataaaaaaataatattgaaatgagagtttagagtttgtatagaaatacaattagaagtaatgtaaataaatcgatatcatgaaaaacgtatagccaaatttcttattggttcaatttagctagaattaaattaataagcagtcataaacgattaaaataatactaatgctatttctgaaaatacaaaaatacttaaaatcactgagagagaaaaaatgattttagccttgcccaaatatatgtccctcttctgtgctacgtatgtgcggtccatgaggcggcccaatggcgacttggcctaggaatgacgcccgacccaacacggcagaagccagggtcgt

SEQ ID NO: 2540 - DNA, 2269 bp, Oryza sativa
ccccgccgacgccgacgtcctcctctttctcccacctcctgggcctctctgaccctaagacggtggggcaggggagagggcgagaaccgcggcgacggcctcccgcgcccaccctcacccgccgccacccagctcctctcctggtaaccatgccgcccgcgccaagctccatgtcgccggctgcgcactactctgcccccgatggccgcaccctgctcctcccccgacggtcgcgctcagctcctcccccggcgacggtggcggcgtgggaggacggcagtgagaggccgtgcggcaccggcaatcggtgtccaacggtctcgccgagggcttttgcctcatcgccctcctcgagttcctctactaggaggcccccgacgccatgcgcagcctcacctccgcctacgccgccctcgccgatggcctcggctgcttcttcgccggtggcctacgccgcccttgctggtggcctccgctccttccccctccgtcctgagaagatagagtgagagagatgagaagaggggaaaagagagagtatgctgacgtggcacgatgacatgtggggcccacgtgggtcccacgctgactcagcagctacgtaggacaaaaccgggatcaaaaccgccaagagacctattctgaccggttttgtatagttaagggaccctcggtatctggttttacggttcaggacgttcttgtatcccgatttcaagttgagggaccttcggtgtacgttttcctttaagctacgatgggaggccggaggcccagttaattaagcacaacttggcatgggccagggcccgtttagcccaacacagaacatggataaatacaccacccattcgccaaagagcaaggtaggcaaggcacgcgagccctagccgccagccgactcgaccagcgcccggaggcggagcacccgccgccgccgccctcgccatcgtcggcttcacccctcatcggcaacctagtgcaggtgagctccatctccacccctcctcatctcctctcctccccacaccatctttcctagtctccctctgttgcttcctcggatctgcttcgctctcgtgctctacgcctcacacgacgcgctcttcctcgtcgccaccaactttgttgctgcgcgcgcgtacgtcggtgcgctgtgcgcgttctacttagtttgccttgtgatgctgctcttagtcgggttagtgcttcgtgctgtgctcgctggtttggcgcttcagatctgtgtgctgtttgctctcggagacgctagatccatagtcgtcgacttgcaaatgctgcgagctaatatgattcttgttggatttcttcgctcctagcgtgagaaatccgaagaattgggagaacacggtctttttttttgtcccaataaattggttggattgttctagtatatattttttattatttttttctcccaaattgttggaatggcttctccctctttcccaactggttggattccaaattgttggaatggcttctccctctttcccaactggttggattgaggtgaagcgtgcttactgtattttttccacctggatttggtactatctttactctctgaactagttgggaacggatattccaatctcctgtctcttcgtgtgacttctttctgcttccacgtggggttctggaatcttcaattcactgtagtataagttcatatcttatttattctcatagactatgatttggtcgacttcgctcatatattgccgtgtagtagagggtttttacaattattcacgttcttggattgctgagatatcatggttagttgtgctgtttgaactggttatggccctcccgctgtgaattgccaaggtgtctgaatgttggtgattttgtggatagttcacgtgttggacaaagaatgcattataggagtgacaaatatgactggtttttgcaaaaccggtatatattgtggttatgttccttggagttacaaataacttgcagtaatgtttgaactgtgggatggttatgacatacatcttatattgggtcgtgtgtgaactgtttgttcatctggatgatgcataattcacacgagttggatgaaaggttctacctgaaatggaagaatatgtttggtttctgtaatttcgttgatttgttggttacatctctttgttgtatattttatctttttaggtgatgtagctatatctgtttccttttatatgacaagacgttgtgtgaaagagggttccagatttatttagattttacgttg

SEQ ID NO: 2541 - DNA, 11206 bp, Oryza sativa
  unsure (1)..(11206): unsure at all n locations
gatgttaataaatctagacatagcatctatgtgaatgtgggcaatgctagaataacttacattatgaaacggaggaagtagtaattaactacctttgtacttattttgaatattctacttgttcgttctaactatttgtcagtagagcattctaacgttttacagcttggcaaatttttgcatgtcattatcgtatccagttttccacctaactgaaatccatgtcctgaaattgctttttcataggttgttttctgaagatggctgacgatttgggccctcccactgtgctccagaagatacatgggcagtccatgatgttcagcaagatctcaccttattctttgatgaagaatcccgcactctacaatgccaacacttcttacagtgtgcctctgaagtcatacaatgggatggatgggaacaatgggttctcatctgtcacatctgtatccccagtctttgcttctgccccaaaggagaaaggtctttctgggtttatgattgacttcatgatgggtggagtttcagctgctgtctccaagactgctgctgctcccattgagcgaatcaagcttctcattcaaaaccaggatgaaatgatcaagagtggtaggctctctcacccatacaaaggtattgcggactgctttggccgcacaattaaggatgaaggtgtgattgcactgtggagagggaacactgctaatgtcatccgttactttcctacccaggtactgcatcctactgtctgttttttatttattctccccttggatgttgacttatattgtacatttgcttaggccttgaactttgccttcaaagaccatttcaagcgcatgttcaactttaagaaggacaaggatggttactggaagtggtttgctggaaacctggcttctggaggagctgctggtgcttgctctctcttctttgtgtattctctggattatgctcgtactcgtctggctaatgatgccaaggctgcaaagaagggtggtgggaggcaattcaatggacttgttgatgtttaccgcaagacccttgcgtctgatggtattgctggtctgtaccgtggattcaacatctcctgtgttggtatcattgtctatcgtgggctgtactttggaatgtatgattctctcaagccagtcgttcttgttggcaaccttcaggttagtgaagtgaatgcaatctttgttcatcttctggcaattttttatttattccataaggttgctccactaaaatacctcgcgctcaaatattttgcctttctcattgcttcatttgttttggtttagttgaatctactcaatgtctctatactcctgctggttgttatatttacttctgataatatgtgatatatgttattttcaggataacttccttgccagcttcttacttggttggggcattaccattggtgctggccttgcttcatacccaatcgacactgttcgtcgtcggatgatgatgacatctggtgaggctgtcaagtacaacagctccttggatgcgttcaagcagattgttgcgaaggagggtgcgaagtcactcttcaagggcgctggtgctaacattctgcgtgctgttgctggtgctggtgtgcttgctggatatgacaagctgcaggtggtcgtctttggtaagaagtacggttctggtggtggctaagactagatgatgatgataagcagtggggaactatggacatattaggtgctttcggatgctgttgcgtttaaataaatttaacgtatggacaccgtttacatgttattaggcgtcaggtgaggtttctgagtgtgtaaatcggtggcagatgcttatgccttttttgttgggggatcgagcaagacgagttttcctagttgaaaacatgccaaattattgtctgtgaaagcgtttcttgagattgttattgatgtggttcctagtcgattatatagattatcactccattgtagcatcttcgggattttgtcttatctaaccacatatgcaaaaaaaaaagaaaaaaaacccttgttatcttattatgtgagaggtaggacttagaagctgttcaggatattttttgtggtttgcaagctgactttctgaggacataacattccttgagaaaatttaatttgtgtagataacacaagcacgcaaacatccgcggggctgcgctgacatgccggagtagtaataaatgaaacagaaataaaactcctcaaggacttgtttggttaatccttgtgaggaagggattggaaagccttgtttagttaatccctatgaggtagggattggagcaaatttattccacatctattgtggtgtgaaattattaaatgaaagagaaataaaactcctctaggccttgtttggttaatccctgtgaggaaaggattggaaggccttgtttggttaatccctatgagggagggattggaggaaatttattccacatctattgtggtgtgaaattattctcccttaatcccctcccatcttcttcaatccactctaaaacgaacaaggctctctaaaccgaaccaggctttaagaattcatcctcgtgttgacatggcggagtagtaaatcaaactccttaattcgtctttgcgaagatgggaattttggggatctgtactccttaagaatgtcagagtgaatttgttttgtactcagtaatgtaggaattttaagcctcctttgacctttgggaagaggtcttgtacgatttgaataataatatgggaaaatttcttgttgagcgaacaaagtagaattcttgttgagagcgaacaaaggagtgagactaagagaattctacaaaattcttttagaatgacaaaaacatgggtttttagaaacatgattcctacattttttatacaatttttcatacatagttttttgaaactaaaccgacaggagaactgtcaattatatttcaattaagcaggagtaaaaacacagacagggttacagaaaagaaaaaaaacaaccacttggcgagtaaactcgccaagtacctcaaccgtggccggtacaaatcacacagcacacggagcaccacacaacttctagccaaactaccacggcgaaatccaaagacaaacatcgacgctgagatgctgaagaagtggcacacgactttgacatcacaaggcgcatgtcatcgttgccgagcttgccgcccagcgaccaagcagcttcgacttcacggcgatcgcaacatcatacaaactttttctgtgtaaaactttttctgtgtatcgattttctagtttacgcatgtattcctattaaaatcatatccttcacgcgtttcaaatcaaagtagccctaagaatagtactccttgtgaaggaaattttacaaaatttgttgaactcttgcaagcaaatcactttgtagtttgtacgatccgattccaaccccaaaggcagattggtcagcatcaaatatggcaggctgataatggtaatggcacctacatcaccaacaaagaactgcgaactgcattgacggccacatcaatgggagaacatttctacgcgcatgatccgtcacaatcttacaacaaggcggccgaaaattccataattactactcccttccctctgttccaaaataccaaaatataagtatttttagctataaatttgaataactatatatctagatttatagccaaaagttattatattttaaaacggggataatatagtagtaatgaataatgatggctagtaagtttttgcactccttcactctgacaggctcttttttctctctcataaatatagtagagctaggcttcatttcgttaagaataagcataaaatcccatttccaaaggagggttcacattcatttcattaagaggaaacataaaaacccatttccaaacgagggttcacaacccttacgcgtactcctaccccaaaataaaacaacaaaacatcataagatgacggaggtagtgctcgtaagatgcatcacataaagatgacacacaaccaatttgataagcactaatccacaaaacatcatctttgccacacaaagagtggcagaacattgaagccaaaaacctgtccatgactacagcaaaatgttgcccacaattgctagtagtaagcaagaatagaatacaacaccaagcaggcataaaacagacaaaagtcccagcaacgggcattaacaccgactgtagcagcacatgcagctgtagtaaatatttttcaggtgatcgcagggaggaccggaggaatagtctggtaggtcaacttattctggaccaagatgtctggaatttatacagttgggcatcaatttggaatcttggttcacagggatggtttataccatcttgccacaaccagaacactgaatttgcatgctatccatcatgtacagaaaaactaagcaatcctagtgtttggattgaactgttattaagaaattcgccatctgcttaagcggctgtttgggaaacagggacttatcacatcggatgtttggacattaatttagagtattaaacatagactaattacaaaacccattccataactttggactaattcgcgagacgaatcttttgagcctaattacgccatgatttgacaatgtgatgctacagtaaacttttcataattatggattaatggcttaaaaaattcgtctagtgaattagctctcatttatgaaattagtttttttattagtctatgtttaatactctaaattagcgtttaaacatccgatgtgacagggactaaaaagtgaaaacatcaaatcatgaacaaattgtggcagacaacattaatactgaagggaaccatcactccaaagaaccatctattggtaatcatcaagtgaggtatatgtagcagtacagtattttttttttatctaaatgctaaagggaaccatcactccaaagaactcgccatcaaggagtgattagtgttcttagctgaatgatcaacaagtaaaatcccaatgcatgcgacagaatgcccattggactattccctactaagtactaattaattagacttgagatttctgacctgaatgaaagaattatgtcatatagagaattctccacaaatgccatccaaaatatccatcatcgtcatctgaatcatctgatcatcagtgcaatttcgatagattatgctacagcatggttgcttgatacacctacgtgcttttcttcgtcatgctctgcttccgttctctgaagagctccttccagaggttccaaatccacaggttgctgaccgtgatggcggtgccgacgacgacgatccaagaaatgcgcacccaccacgggatgacgtcgacggcctggccggacaggtagaagaggctcatcttgaggaagaagagcgggccggcgacgcccctgacgacggtgtagatgaagtagaagggcggcgacagcgccctgtacaccctcgccgcggcgggcttctcggcgcgccagatcccggcgagcgtccagacgttctggaggaggctggtgacctcggcgaggacgaggaggacgaggagcgcgtangcgccgtggcggacgaggtagcggcaggtgacgaacacgaagagcgtggcgacgtggtgggcgatgaagagggtgtccccggggaggaaggcgaggtaatggagcaggtccatggtgaagtaggcgacgctgtagtcgagnacgtggtcctgaaggcgggtgttgggcncgncgaaccccctcgcctccggcggcagcgcgaggatggcgccccccgcggcgagcgcggcgggcgtcccgtgcgcgaggnagatgaggcagctggcgccgtcgaggcggagcggccacgcccaccgccggagcagggcgagttggccgacgcagtagatggcggcgtacatggccaggaaccccgggtacagccaccgctcctcgggggccaaagaatccagcacccccaccaccgccatggccggaccaagattcgcgccgacggagcgagggatcccgccgctcctggccggtctgcctccgattcgggcccaaccccccgcgtgcgcgcgaggcggaggcgaggggattcgatcgacgccggtagggtttcggcggcggcggcggcggcggcggcggcggcggcggagggatggatggctgtggagcagtgtgaagggatggacggccgcgtggatggtggggaacgaaaagggggagattttaaagcgattggttttggtttgtttttttttcttttcttttttcgatatttgtttacgtgggttttggtttggtttttccaaattaaattcaaattaattttgggttgagtgattaggtagaggattatagagggtttgcgtgttaaattggggttttggaaggaaggtcagtcttccgggtgttgtttgaattgaagattatattatggttgagacttgggtgccatgaaatttcttctcggttaactatcattacaatattttgctgagttggcacgagttttcatatcaaagttatatttttagcagttttatgaactgaaaataaaaaaaaatgtttggactttgtaatgagaggcacaatgccgacatggaaaaacaagtaaaattttgtcagtgaatcactcgaaacgaacgaacaaggtatataaatttatactcatcgatcagagtatcttatagtatatatactctttccgtgttttaacatatgtgccgttgattttatgagatatgtttaaccatttgttttattaaaaaaatatcatttattttattgtgactttatttattatcaaatgttctttaagtaagacttttcaatgtatacaagaaatttgaaataagataaatgatccaacatttattaaaagttaataatattatatattaaaaaacgaagatagtattgtaaatggctccttttgttttatactaatatggctgaatagctaaataaactatacttgtctaaaaagcgttaaataaactatatccccttcatcctcaaatataattattactaactatgtattttgataaaggtatgtctaaatgtgtagctaaaattgactatattttgagatagagacagtaaaaattattcgagagtagtataaacaaatgaattaaatattcgagggtaatattatttgggatggagtataaaataaaaaataaatctaacatagttttatcaaaaaatcatatataaaagttttccgtaaatcactctgtttataaacttgggaagcatggacatatatcaaatcatttcattaaacataatttctaaatatttagtcatttttcctccttacattaaagaaaggcatatacatccacgacacaagcttaacaaatgtatggatggatcatggaatatttggttacggagtaattaggtccggaagagcacacgctctatttcgaaacggctacttagatcacgtttcatgaaatgctaaatgcttgtttcatgcaaaagattttagttatatagaagttccattaaaaataaataaatctttttttaaaatataatacttaatactcgattaattatgcataaatggttgtctcattcagtgtgcccttaaaatttcaagctaaatagagctccaaatgaagccttaaaacacgagatttttttttctttacagcttgaaagtttgtcctcgcaaaaaggaaatagaaacattcagaataccgtctaaaggagaatcgcatactccatattgggttgattgggttggttccttaaacacggaagcaagctttgggctgtgtttaaatcaaaagtttggatcgaaacttccaattttttccatcacatcaacatgtcatacgcacacaatttttcagtcacatcatctttaatttcaaccaaaatctaaactttaggctaatctaaacataaccttggtcacgtagtatgcgtaaatgtgtcgatatctttttctggatcatgtgacagatcatggtattggcgaatattccacgcaatttggtatcatgataccttgtagtagtagatcgcgtgggggcgtgtgtgttgctaaagaatgtgattcttgtggcacactgctagctctacttgcgatttctatacactaacactaggctgctcctgtctttttcagccttcagaagcgaataaaattatcatcgctaaagtatataaaggtgataataaatgtatatatgttgtcataagagcaagtttaatagtatagccaactactggctccaattcatctatagctaatctaatagctcattcatacaatagttacatactacactattaatacctggtcccacctgtcatacacactgtgtcttggagtccgtgctacagctgtctataaatctgtagcccgctgctttcctctctcctcatttatcttcttaaaatatgtttgcagctggtttatagcctgttattgtacttgctttaatgctctaatgatgggcgatggcggcacggaatgtaagacggattaggacaagtttaacgaaattcgacggagactaatccgtggctaattgtttattgcacagacatgatttttcctcnnnnnnnnnnnnnnnnnnnnnnnnnnctccaaactacacgtttgttccaatcttgtttacgaaactgcacctgtttgttgcaaagtttagttttctaaaacaatctgcaacaagtgtacttttgtgtttatataagggaagtgaaaagtgtacttttatgaaaccttagtacctgctcgctcttcacgatattcccgtacaggtgccgttaaatttacttgcataacgatattcccgtacaggtgccgttaaattcatttgcgtaatactagcaggcaaagtgttaattacaaactagcaatacaatactccctccatactgtaggacgccgttgactttttaacgttgataaaaaatcaacggcgtcatacattaaaatacacagggagcagtagttttcttagaccgatcactaggtgaaggtttcttcatctgaattgattataagtagggaggataatacaaggttcattgatttacaatggagcataaaggggagatgaaatttcttcacagggtgtaactacaatcctgcaatcgtatttcagatgctcagcttagagccgcatagcatcatctacacattttgttataaacctagcgagggaccgcaggtatgattccacaacctccaaaagcaaagaaggtagaaaaactggaagtgcttgaacggcagttggctgggaggctgcaagctggtttgatctctcatggaggagatgttcagttgcaacggtagttgattcagttaatgagaatacttacataatttgaagctatgatctacgaagaaggaatttgattcagtaatttgaagcgtagtagcaattggcagcagagttgaaaaaacatccagtcatcctatagaggttgactgctcctcaatgtcctccctcttattgtcatcgatgacggaaagctaacaagatgaacaaatatgctgaatctgcttcctgacgtgcatgctcggaaggtgtgaaatatgcctactattagtatcaactatcttcaaccacaacggactgaggtgcatgcttagaaatcatctcttattgtttggattgggtacccatgcgttgcaacggaaaaaaaatcaatttaagatcacatgttttaatcactcacgatcccatgtgactaaaatttgagccaatgccataaaagcgatcatctcttactgtttggattgggtgccaatgcgttgcaacgggaaaaaaaaatcaatttaagatcacatgttttaatcactcactatcccatgtgactaaaatttgagccaatgccatgaaagcgaagtaataagtagataatttgcttaataaaaaaaataccccctccgtattttaatgtacgacgctgttgactttttgactaacgtttgactcttcgtcttattaaaaaaattatgtaattatcatttattttattgacttgatttatcatcaaatgttctttaagcatgacataaatatttttatatttgcacaaaaattttaaataaaacgaatgatcaaatgttggtcaaaaatcaacgacggagggagtacttgaaaaaggaagtttaagcatgaaatatatgtatcttgttttatagctgaacaatattactaatgttttattttgaagtacacataacgttaacaatactattttttttttgcgaggaacgttaacaatagtatgaatacatgatcaacgagttcctaaatttttttgaagtacacataacgtaacgttagatcccactccgaacagtcaatgattatatgtatcaaatatacaacgtaacaatcatccggccatcataaaagctcatggtatattaaaaaaataaaaatcatctcaagagactgtatgctacatattaaatctaatgatagaagcttaatttggacaaaaaatcaacaaggcttaaagaacattaaaaaatcatgcttaaagaacatttgataataaataaagatccaaaaaatcaacaaggcttaaaaatttaaaaatacaaccagctactaatttgtacaatttaatattccaagatgacatcttatatgtccaactaatagaaaaaaccatgactacagacatcatgataacagcttacatcttataggtcaacatacaggaatgatggaatttattgacaatgaaatgccattaggaacatgttagttggacagtaacactggatatttcagcaacataaggacagctacacagactgaaatagattctacatgtgtgtacatatatgaccatataatattcatatttggtgaaatcactctgcaaatctaatcatgcacacatagtgtattaatcttatttttctcaactaatactaatcgaattagttataacaataattgaaaaaaaaagaatgtgataaatgcatgccggatctatcatgtttaactgcatgtgataaaccattgtgtacggtaaatgaaatatgaaataagtttgactgatattccagtaggtaatgatttcaacagttaatataaaaattgcaaagataattagttagtacacaatattctttgtgcacactagatatacctcgtctatgctatgaggacatccttgtacacaatattctttgtgcacgttgta

SEQ ID NO: 2542 - DNA, 6882 bp, Oryza sativa
aatcccaaagataggacctgcgtagagtggcatctgttatctgaggcctagtgtccttcctaatgatgcatacacctagtgtccttcctaggtctcaaataacagatgccactctacataggtcctatctttgggattgtatggttcagttgaagcctgttcgcaatatgagagtgtagagcgactcgtggtttgcggactacctccttcgagttgggaatggcattgaagaggtgaatgaggaaggacacatacacctgccttcggatatttgtgtgacatgcaaagggaatgactcggacctcgatgggctgataccgtgttccccaacctaaatgataaccttacggacccaaactacatcacatctagggccataatgtccactcagaatgagttcatggatcgaataaacatgaaaatgatcgagcgatttcgaggagagatgatgacatatcatagttttttaccgagcagaggatgaccctcatagctattacctgcccgaattcttgaactctctaactccaaacgggctacctccgcatgtgctaaagctgaagttaaactacccatcatgctattgaggaacattgacccagccaacgaactttgtaacgggacaaggccactagtggttcatgggttcggaagaaatgctattaacgtggagattgtggtagggaaacatgctggtaagggagttttccttcctcggatacccctatgccttttagatgatgaaatgttcccgtttcactttaagagaaagttgtttccaattagactgagcttcgcattgacgatcaataaggcacaatgacaaacaattccaaatgcaggtgtctacctcccgaagccggtgttctctcatggtcagctctacatcgcgttgtctagagcaacctctagaacaaacatcaagattctctccgtgcaggacaaagagaaggagaaaaaaaatggtcagctctacatcgcgttgtctagagcaaccgtctaaaacaaacatcaagattctcaccgtgcaggacaaagaggaaaaaaaacaaacggtctaaacagactgcaacatgcacaaagaatattatgtacaaggaggtcctcacaacatagacgaggtatatctaatgtgcacaaagaatattgtgtactaactaattatctttgcaatttttatattaactattgaacacatttgatatttcagttgaaatcattacctactggaatatcagtcaaacttatttcatatttcatttgccgtacacaatggtttatcacatgcagttaaacatgatagatctggctatcacactcctttttttttcaattattgttataactaattcgatcagtattaattgagaaaataagattaatatactatttgcctcacttgcatgatcagatttgcagagtgatttcaccaaatatgaatatattgatatgttcatatatgtacacatatgtagaatttatttcagtttgtgtagcttcccttatgttgctaaaatatccagcgtaattgtccaactaacatgttcctgatggtatttcattgtcaataaattaaatccttcctgtatgttgaccaataagatgtaagattgttatcatcatgtctgtagtttttttgttagttggacatataagtcatctcggcatattaaattgtccaaagtagtagctggttgtatttttaaatttgtaagccatgttgatttttttccaaattaatagcaagttgcttctttgatttgtaacccaggttagttctttatttagaaagagttaacatctattacaatagtatgttgacgaatatgctaagagaatacagttttcattctgcaggttttactccttttgataacttaaagcatgtggtgaaggcaaacacgtgaattcgtggcagaaatttttgtatggaaatttaacattgatcagaacaatttgtatgcaaattatgcatcacaaattggcatatatttgatacatatcttcaatgtaccgtattttatcatttaaattaagcttctatcattggatttaaaatgtagcatacagtctatcgagatgattttcattttttttaatatatcgtgagtttttatgatggctagatgattgttacgtcgtatatttgatacaaataatcattgactggtcggattcgaattcacctaacgttatgtgtacttcaaaaaacaattaggaacttgttgttcatgtattcgtactattgtccagctataaaagaagatacatatatttcatgcttaaactttcttttcaagtatttttttattaagcaaattatctacttattacttcccttttatggcattggctcaaattttagtcacatgggatcgtgagtgattaaaacatgtgatcttaaattgatatatatttttttcaagttgcaacgcacgggcacccaactagttcacatcattttatcaattttaggtcatgttctccaagcaattacacaatattttagtgcttctatcccgttagaatggctgactcaattaaaggaacaacaaagaaatgtgtcattagaattttttagaaacaaaaaggtctgcattgttcacatcagtatttttgtttaaaaaaaaaaaaggtctgcatttgtaaactaatgatttttcaaccttcatcttgcatctaaaaatattgatcagccataaaaaaaagacattcgtgaaccagggaatagtgtgaacacatatattatagcaatcaagagttgagaagttaagattctcacctagagatagtagcatgtgagttcacaagatctgaataactggagctgcaatccttaaagcatcaatctgtgaacagaaaaaagcaaaagaagatttcgtgaggtgaaagcatgtgggtttgcaacagttgaaactcgaataaaaagaacaattctcaccggacactatgcacctgggtcagcttcctgtcagccagcttgtaaactctgaaactcgaatcagaagaaatttattgtttgcatatacttgtggtcatcgcaacgcgagatggaggggattatctgaaataccagatgtaggggattaccaaatggttccaaacttaactttgctttttttacatacaggtgatttttacatataggtgattatctgaaataccagttgtcatgggcgttgggccggctaaggcccatcggcagcccatgacaccagttgtgcagacaaatgagtgataacaatctgaatctctccagtagagaacataaagcgaatcaaggttgttcttgttcatgatttttgattatattcaaaaccgtatgatcaacttagtaggaaagaaaatcagcagattttatacgtgttgtgcctatttacaacctgaaacttatactaatgtatgtgatggcatgagctccctaacatggctagtatgtatatatctgctgttattatgaagagaaaacatggcagcatatgcagtcagcagaacttaccaagaagtgtattatactggagaggtagatggcatgatgctgaacttgaacagccttaagagagattgaattgaggaaaattaagagatgatcgaagtgtagcctgaaaaggaaaagcagagtgagaaaggttatccaatttctctgcagatattcattaaaaatatattgcagcgatcctttttaatatatcagactacccaacatacataatcttgattttagctgctataattaaaatcattgaataaacatgagaaattatggttaatagtgaacagtggggatttagtcaacacagtggatttctaaactcgaaagccattatgaatctctatgaatgaatgaaccataccctgcctcgtatgcctcctcctgtacaggaacgggatcgtctgtacactaagtgaacgcaacatttaattcatacatagtaaaacatcaagtacactaagtgaaacatttttcggtggaacaaaaaacaaaatgaattctcttaataggaggtttccaaaatatgtggtttttttgttgcactggaatatttcgttcactgcaatattagatctatatatagtaaaacattgtgagtacactaagtgaaacatttttggcggaacaaaaaataaaccaaatttccttaatagagagtttctaaaatatgtgggttttttgttgcaaaagagtattttaattcactgcaacattagatttataaatagtaaaacattgtaagtacattaggtgaaacatatatttggtgaaaacaaaaggagggagaagtaggtgggcccacgtggggggaggggcgcacggggagtgcctgatccggctctcccgcgccggtcgcgcgacgtagagattttcgaaagaaaggcgatccagacgttggatttcgcaatcgatccaacggttcatactccgcgggtctgcctggcgaaggatttttaatactactagagattatgccaagaccacctatacttgtttgtatatatataaagaaaaaagacgccctgaacatcaagtgcagcccatcaaaaagaaagagttgtacgcatgcctaaaccacctatacttatttgcttggttttctttataaatttgtcatactatcaagagaggtgataatcttggcaaacatataagagcagctctagcctgcacctaaaatcgatttcaacgtaaaaagaaccgaactatgcacactgtgggaagcgaactgcatgtgtcagatgaaaaagcaactccaaaacaaaagtcgaacactgatgataaaaaattgcttgttgctataggtgggattaagattttttttatgggtcccacccaaaatcgattttaacgttgtaggggtcgaatcgaatgtttatttgacttttgtggactagacttttgtgttcgcaagtgcaggatgggaacacatccctcctgcacgtaaaacggagcgtccttttaacatatgattaattaagtattggctatttgtttttcaaaaatggattaatttgattttttaagcaactttcgtatagaaaatttttacaaaaaaacgtaccgtctagtagtttgaaaagcgtgcggacaaaaaacgagggagaggggttgggaacaggcgttgcaaatacagccttaccgaaccaacactacaaatgccctaagcaaacacacgccacattagtacacgagcgcgttttttttatttgtagctttgattttgttttctgtgtacgagaatctatacgataggacatcaagcacacatgagacaaagattatactggttcaggtcccttgcgaggaagccctaatccagtttatatgggattatggagaaacccatatagattataatagagaacaatggaaccctgagattgccgacgagatccctatcaagaacggctcgacgagatccaccggtgagttggcttcgcgttctcttgattgtttctgctatggtgtgtgtcttgcgctaagattcgatgccatgtgcccctccagggtcctgtatttatatcgtaggttatcttgacctccagtagaactcggagatacctttctacgtatgggatcacaaatcccctatttcttccgaatatgactcttgtcgacgtttgatgtcgcgattccggtatttgtatggtatggggatcgtcggtgctaggatatatgcgagactgaggtaaaagagatatgtacaaggatttttatacaggttcgggcccctgaattgccaggtaatagccctacatcccgttggccgaagccggtcgttgctcttattcatcataatcacaccagtacaatatttggggtagcctatctaattgttgtcgacatggtggtctgaagttctgactcgtagtcgacaacagggtagtcttcctcttcgaatccgtgcccggcgagatcagagatagagctttcgtttctcctgacagtatccggagacaccgtagggaactagctatgcttatccctgaagtcgatatccgacgtcttgtcttggcgtatgttggcttgtatgttgatcttctgtcttgatctattgttccgtgtatgttgattgtggtgggtgtgtccctctcctcctaggaggccttgtatttatacccataggtgtctccttgtccaagtagaactagggaaaccaatatggatacaatccgagtagtccttgtcgtttccatgtagaactctggttgtcttttcttatccggaactccctccatatccgaggtcagtttccgtataagatatggtatgtggtgggtcctaccaagatttagtcaactactattaggtatgtggtatccgtaaccctgacaacactaacatcttttattcggggagacggtttccttgcggatcggctgttttccttagtttggaggtaacattcccgtatacttgaggatataccgtatttgtatatcttacgaccccaaggataggagatatgccttattcgtaaccctgatagtggaggccggtcgaaccggggttttagaactggtcgctttgggttggtccaacagattagaaaacctttttggataaggtgaatagaccgggccctaggccggtcggtccgggcatgcccatggcgctataaccccctcaacaccttcctcctcggcaaggagacactcttggcaatatttttatatttcacttgatctattgtatttactctcatactacttgagcacttctccattcactgttggtttttgagggagagtaagccaagataagtgtattgcaatttcatttctacccctactttgatgtctaatattgattttacccttattttttagggttttcgtttttaccctcaatttttcgaagtgaatgcttgttttgcccctactttg

SEQ ID NO: 2543 - DNA, 1302 bp, Oryza sativa
tcaaattcccttatattatgggacggagggagtaacaattaatactcgattaattatatgctaatcacacatctaatttcacgtgacagcaaaactaacatctaaaagcgacgatcgaacgcagccgaagtcctgtactaagctagctccattgcatctgtatgacatgcatcctagttggtgggttagggcgcataccaactaccgacgagactagtgactctcgcactgaacataaaaatcctatttcctgttcccctgggcaaacatgttcccacttcccaggtgaaaaaaagccgattaatggcgttttgtatactccacgtagacgcatattacaagccaactatgagaaaaaaagaggccattgttatcagcttatcgctttgattcagatcgcataaaccgctcaacacacgtcaattacaactatgggcttttgatcgagaaaatcaccatctgttgccgtagttgacttccagttgggcatctgcgctgctaaccatctcaaattccgaatttgattcttaattaaggcgagctattcactacagacaggatgctctgacgaattgatgtgcatcgaaatccaagaaacggagcagtactaccgattaaagttagtgcctttctttgcggggagattaagttagtgataatcatcgaaaaacgcaaacacaagtactaaacgcgaaggaattaagaagactagcagagtgagtgaggggtgcaagtgcaacaagatctcgccgaccgacaggggcaatcctgtaatctacaaagctgcaattttcgtgtaaagagagaaataataaaaacggaaatatttctttcttcttcttctcacctaaatcgaccaaactaagcatccgtttagttacaccgtcactcgcaaatccgatggcgtgtggggcccacaagctctgaaatgcctcactgcccccactgtcagtgaccgtggaatctcttgctcggtcccacatggcagcgtcggcaagctcgcgctccctcgtacgacgcgcacattcacccgccgctttaaaccgcgcttctctttttttttttcttcgcacctaattttcttcgtcctctccctctcttcttctcttctcttctctgctcggctcctgtacgcggctggatccgagcggcgcaggaaggaggcggggcggatgctgtaaagagaatggcggaggcgatcgcgtccgcgggtgggatcgccatggacgcctcgacctccctcacgccgggccaggtgagccctaaatcgcaccgtcgatccggggaggggggggctgctgc

SEQ ID NO: 2544 - DNA, 262 bp, Oryza sativa
  unsure (1)..(262): unsure at all n locations
nnnnnnnnnnnnnnnnnnnnnnnnnnnnnnnnnnnnnnnnnnnnnnnnnnnnnnnnnnnnnnnnagggctgaaacgcacaggcaagagctgccggctccggtggctgaactacctccgccccgacctccggcgaggcaacatcacgccgcaggagcagctgctcatcctggagctgcactcgcggtggggaaaccgctggtccaagatcgcgcagcaccttccgggacgcaccgacaacgagatcaagaactactggcgcac

SEQ ID NO: 2545 - DNA, 629 bp, Oryza sativa
ggtgagttaatcatagcccaagttaactgctgcctaaatgagtctaccatactacttagatacttgtgatatcatatcaccaaaagctttgcaatggattttaaaataaatgtgctattttgttctatccttacatgtggaaaacttgcaacattgttcacactagtaatatgaaatctgcggagaatgtgacgatatacaaatgatccttaaaaaaatggtttgaaatggatgcgatgggtaaaggccttgtcatcacaaccaactccttttgtcaggggtctctggaagattattggtttgtgcgaaaaaaaaaaaattaaatttgggttggtccattaaaaaaaaaaaaaaaaaccccccttttgggagttcaatatgttgctctagataaataatgtcaggcaagactcgatggaatttagtacatcatatgcatggtatctaaattttagctatagggagcaatcagtgtgtgtctcactggtgttctaggattgattatcttctagagtcagaaagcaaatgtactctactgaactacagaatatctgactggcaaaattttgacaacaggcaggagtgttgtctggtgatgtgagcgacattgttcttcttgatgtaacacc

SEQ ID NO: 2546 - DNA, 2601 bp, Oryza sativa
cagagaagtttgccaaggaggacaaagagaagagggacgcaatcgacaccaagaaccaggcagagtctgtcatctaccagactgagaaacaattgaaggagctcggtgacaaggtcccaggcgatgtgaagggtaaggttgaggcgaagctgacggagctcaaggacgctgttgcaggtggctcgacacagacgatgaaggatgctctcgctgctctgaaccaggaagtgatgcagctggggcaggccctctacagccagcagggtgccccaggagcaggacctaccccaggagctgatgctgccgctggctctgctggcccatccgagaagccaggaggcgaggaaggtgatgtcatcgatgctgattttacagacagccaatgagcaggagagtagttaggtccgaaattttaaggaacgtttcgcgacgagtttgaaatttgttccacaagattgtaggatctggggtgtatctttttgttagatgggcacctttgcttcctatttgtggagttttgggcggcggagttttgagttctgggaatttcacttccaaatagatgatgctttcgttgctcatacatacatattcttatgccctgtagattcgagttggcaactgcatggttctcaaaaaagaaaaaaaaggagttggcaactgcaccagcacaagaaggaattaccaaacttctggcaaattggtagcattgtcaaattttggtaggatagacttaatatttgccatattctctaggcatgatcaatttagtaacaaactaaatattatcatatatttatcaataccaaagtcatatatttatcaataccaaacaatacaacgatatagtttaaaatgacattaatgttcaattgtgattatcaaatcaataacaaactcctttacgattgtgccgcccagtccacacctgtttatgatatgctgccgtttactgagtttactgtagtaccttaatgcttgtcgataacgtccgatttgactcgcgggttttacagcgcttctccaaagtaacatgaccctataacggtacctgtctgttctaaaaatttatatctttcttatcttcgatatgtaaatcgttgagctttgttctatcaataccccttaccaacctcaattatccattcactaatactacttttcggtatatgtgattcttttgttacctcgttttgtatatctaagattaaaaataaagttattttgggacgaagaaagtaaaacttttacttattgtgattgttattgtgattgccaggacttgcgttacttttaatatagaaaatcatgaccaatgtgttcattatagatggtgtgataatatgtgcttcatgattgacaacttgaagcactattagagcgagtacgatagagagggattagctagcaacaaggtaagacacgtaggttcgaaagctagactggagcatagaggcgaggagagagatggcgagccggcgactaaattgtcactcgctgcacgcgtgctccaagagcgttgaagctttcctgtcgccggcccgcagccgatgccagcagcaccccaggcggtttgtgggcccgttcaactgtcgatgcggcgcgacccctagagaagtggcggcgtgaccatctcaaaacgggaacatcgagccagaatcagaacgtcgagtttaataagtatagccaattactcgctccaaatcatctgtagtcgatctggtagctaattcatacaatagataactacaaatataaatatatgctatatcattaataattggtcccacctgtcatacacacacaacgttttgaagtccgtgtgatacagccgttacatatctggagtctgtttctcttctctttcctttcctatctcctttatataagcttatagctgacttatagtctattattgtacctgctctaaagataaaaataaaccaggaggaaataggaaccgatgctctttagcttggacagtggcgatggtgcgtcggccgcgcaacgacgcaaggtcgcctcgtctcctcacaacggtgcagcgcttcgccacagctacggcccagaacaagcttcgccgtaagggtggccgctgtccacaactttcgcagccactacaagcaaatcaatggtcgattggagatttggagtactagtgtgttcactgttcaagcgatctcctgagagaaacggattgatggtttcgtctttagaaaaataggaaaactgcatagccatgtaaggttgaaagttgtaaataattgttgtatgaataggctattttgtgctggctgtaatagctgacgtatgcaattttagcgccagtagcaagctatattattgaccttactctcagttatatcttcaatattttaattcatcatactgttaatataacataatgacatcgatgatctcctcgataagactacatacttgctgacttcacaatcgaacaccatacccaatggtgtacctatggtttttaccctggttgtgcccatgcaaatctaaagaggaaaactaaattcttcatgtagggatatatgatgtttttatctataaatggagtacaaaacaacaccaattacgactaat

SEQ ID NO: 2547 - DNA, 1706 bp, Oryza sativa
  unsure (1)..(1706): unsure at all n locations
gatgtttttatctataaatggagtacaaaacaacaccaattacgactaatttctactccctttagtactcttgtttgataatgttcctttttatttttctaaaaccagttttgttctggaatgtatcttcttttttaagataatggaagctttattaatctcagtaaattttatcaagtgatacaattattccgagagcatctctggcttctgaaacgtatctagcaccatacagaatgtgaatcccataattgtttggtgccatgcatttttattttattttattttattttttggtgccatgcatgttaaagacaaaaataagatccatgttcatcctaatactaatagttgattgattcaatttaatatcattcagagaaaagagatcgcatatttgaaggaagtagaattgtaaagaggtgaaaactagtcttttagcaaactccaaaatctctcgttgctagtcctggctggtcgttgctgctgccaatgactcaatggccggcatgcctccgttctggctaggggcaggcaggctgcaggggctcagcttctctgggctagtgggcaatgacagacttgccggccgccgtcgcacttgctgctttgcccacgccgcacggccaacatgaaaagacactggtggataaggagtttttactcccggttcgtaacccccttagtcccagttgaaaaaccggaactacgaatacgggactaaagatcattatctttagtcccggataaaaaaaccgggagtaaaaacccatttttaatcaagatagagtaccaactgggactaaagaagctagctccgattgctactttattatattcttttcttcattgtttttaatatattgattcactctatctcatcccaaaatcccaaatcaatcgtcccagaatagtctccaaattctcaaatcaatatctctaaatacatcacaaaatcttaaaaaaattacatcataacttctacaaaattcatcacaaatacatcacatattcacatcatacacaaatcaaatacatcacatattcacatcacacacaaatcgtctcagatctgaatcatagattctcaaaaaaaaaagaagatcaaaaaattcctctgagctttcaaaccgggactaaagatatttttagtcccgatttttaatacaaccgagactattgtgaaatctagcggaccgatcaaagatggtttctccaccagtgagaaggaggcaagtaatactgtatcgacgcacacgcacacgagctgggtggtgacttgctgtttgctggggccttgctagccacctaggcctctcgagctttgatgtaagcacttatccatcatttagataagtttttgcaaactacatgttaaacttttttcagaatttctgggtatgccggtgcatacccagcacaccccctggggatgcactcctaagtcctaagacaactaggttagtgaacctgacccatgcaccggcccaatttttctatttaagtttagcgacaaaggggatgctcacgagaagataatttccctatcgatcatcttcaatcgtaccatagttttgcagttttttttccctatatgaagcaactatgtcttcctctaggtcaaagaacatgattgtgtactctgaccgaagnnnnnnnnnnnnnnnnnnnnnnnnnnnnnnnnnnnnnnnnnnnnnnnnnnnnnn

SEQ ID NO: 2548 - DNA, 2655 bp, Oryza sativa
cttgctagccacctatgcctctcgagctttgatgtaagcacttatccatcatttagataagtttttgcaaactacatgttaaacttttttcagaatttctgggtatgccggtgcatacccagcacaccccctggggatgcactcctaagtcctaagacaactaggttagtgaacctgacccatgcaccggcccaatttttctatttaagtttagcgacaaaggggatgctcaacgagaagataatttccctatcgatcatcttcaatcgtaccatagttttgcagttttttttccctatatgaagcaactatgtcttcctctaggtcaaagaacatgattgtgtactctgaccgaagggggtgaaaatccacatgtgttatgttgtgatctttgtaggttagtcaagcctgcagattaacctacaggaggacgtagctcctctataataactatgttatgaaaatagatgcacaacggagacacaaattttacgtggaaaacccttgcgggaaaaaaccatgggcgccgaccggcaataatcactataatcactatagaggagtttattacaaacgtaggagaataacaatgggaatgtcaccccttcccgtacggcttacaagagtatatatattggataaaagaaagacacctaatagaaactcctactatgaaactaatccgaatatattgtgggcccaaaattcggatcacatatttaacaaactatgggcacgtttggatgcccaaccttccaatgggcggcagacaaccatccatgcatttacctaacgagattgctaaggggcgatcgatcgcccctagcgccctccctctcttccacgtggtttccttttttggcaccgtattactttcctattttagtaaatttatgcacctaaagtttgtacaccttaagtttacacatctaaaatttagagacccaaagtttataaatcaaaagtttatatatccgattcaaatttgaatttgaattcaaatattttttatttatagtatttctatacatctaaagtttatagacccaaagcttataagtcaaaagtttacatactcgattcaaatttgattttgaatttaaatattactttatagacccaaagtttataagtcaaaagtttacatacccgttttaaatttgaatttgaattcaatttttttatatagtatttctatacataaattttttcaactttgtgttttttattttttaaaaatttatggtgtagtagggtgagaagaagaggaggaaggaagagagtagtgtatactgtataggggggatggggggtgatcgggcgatcacccgcccattagccggcccctttaccttgctcaatagagattgtaagtggaagagacggcactactgcaaaacatcaaataggagtcgccactataggtgccggtagtaaaccggcacctataggctttttcccacctccgcgggctgaaatcataaaaaaatggcatctttaaataattataggtattggttctaaataaaaactggcatctattatattttgtatctttttttaaaaaaaaccggaacctataatatattataggtgtcaaattaaccgacacctataatatattaaaggtgtcggttttcttagaaaaccgacaacgagccgagccgagagacggccttatccactcgcgtgggaggtgaggggaaacattatcctctctctcagccatgacttctctctctctctcggcaccccaaggaggtggcgggagggacgcggcggcagcaacaggcggcggcgggagaagaggcggcggcggcgggcgacaccctcctccgccagatctggcgggaggggaggtggcttcggcggcccgacggcggcggatcggtggcaggaggggaggcggcggtggtccgacggcccggcggctgcgccctcccctccgccagatctggcggaaggggaagtggcggtggcgggtcggcggcgggaggtggcaacgacagcttccttggcagcggcaacggtggtggcggcgccctcgtcctctccatccggcggtggcggggtggtgatgaaggcaagcctcctcctcgatccgatttagtcttgatgaatgtctgtttttgatgaatgtgtttgattcttgataatgtgtgttcttgatgaatgtgatgttgatatgttgttttttaaaggattatagactatgtttgtgttcatgaatttgaggaaattttgggatttgggtactatattggatcggctttgaccgctcaatgcatcggctccatgcatcgagccgattttttttagctcatgggcacctcaaaggtgccggttttggaaccagctcctttgacattgggtgatcagtgccgcctcctggttgccagttggaaaaaccggcaccgaagggggtttcccaaccggcaccctttagagtttttgtaatagtgcagggtgatggtgagagccagtagaatagaggggtctgacacatagagcgagcacgactagcgaagagagggaggatgaccaacggaagatggaggagaggaggaatgacgagaagaggaggggggagggtgttgacccgtcatccccgcttttgcactcgggggtgtggtgtttgcacacccggatgcatcg

SEQ ID NO: 2549 - DNA, 11914 bp, Oryza sativa
tgacccgtcatccccgcttttgcactcgggggtgtggtgtttgcacacccggatgcatcgtcgtggcgtgcatcgagccaggacaagcatcaaagctcgattcgtcttgtttccgtgggctgttttgcattccatgggcctggctcggagacacgtccaggcgaccaaaagggttgttggtagcatccaagatgcgaggaccgtgcgtagcgcgggtggcaggagccagtggctcgctccgtgccgaccagcgttcgagtcccaaacttgacgctcgtccctcgtccggggggatttttcccctctttacccgggactgacttcggttggtcccgtctaggtaatagggtacacatacgcgtgcgcgttcagtgggactgcacgtttcccgtgcactgaggcctagtgcctccaatctcatttctagcgtgtgttagggacgcgcacgcgtgtgtgtgcgtgtgttgtggtgtgaatgtggtgtgtgttagtgtgcgtcctatgttgtacccttctccaaaaaaaaaaaaagggtagcatccaagatgcgggccaagtgcgttctaggaagtcaaacactcacaatttaatttgctacaacacgtcagtatagtagcttaagatcttatttgtgctcacataggttttaaactatcatagccttaaaattactggaacagtctcccacattcgtgtgatcgatttcttctcgtgattgagcaatcaaacgagggccaataatacattataaacgaggtgggtatgaacaactacgaggaagagcaggaggagaaatgtttctagaggaacaacaatccagatgaaagaggacaaggaatgtcaggccacggggattcatgacgctgataaagacaggaagcgtgaccgtgggggcagacatgccgtacgtgctaagcatgttggacacttggaccataagctatttgcaaggggaattatacatgttgtactcaggtaggatctaataatgcacaacctggtgaactgcctaagacatgttaggcttcgctctgaagcacaccaaccttgcgaatgtcaaaccattgtagcatgtgtttttttagtttatatggctcacattgtaggtgtctaaacccatgttatctatcctctaccgtagtagtagtcaaacaataatactatgttttcccttaacatatttgttgtatccacctcttcatttagttcgcagtatttcatatgtgttaatgtaatgccaggggtttctattagtgatttatcttttgacaatactataatttcacacggacaagaaaattgcagactatatattcttttaataatggatgaaaattcgaccactatatccacatgtggatatacacagctaaaaggttacatgagttcgtagactgtaaatccttaaaactgaggaacacaaagaaaacaagaaagggaacaagaaaatccaagtctagatgatataatgtactatatacaatcagcattttttttgatacttatgtagatagacttaacatgttccataaaatatcgaagaactagcgacgctaataagggaagcaaccggcatcgtcatgagccagagaaaggtgggagcaaggtccatgttggcaactaactgaggagaggtgacgtgacttcatggcaatgacgtgtctaagaatagtagagaagtgttttagttgggatcaaaaccctttgctatatggtccttgggcaggccaccaggttttatctcctgacatgtgatagcgcattggtttatttcctagaccatggtctaaacaacaattttatgatctactcgtctttgtgttgtctaattgcctggtctagacggtctagaccaatctttgaccgagtagacgatcaaacagtctaattcacggtttaggccctaactagatggtaacccatggtctaatgtctagatgtggtctagaccatctataccatgttctaggcgaacactaatataatacacgatactaatatccaaaatgacccatttccgtgactagacgtgatgctagctagattagacgtgtttcatgaaagcgaaaagtccatttaatttacattcttaacctatcacaaaataaaatgtaaaattcatctataaatttcaaaaccaggtattattttttttgagggaaagcactgtaggggaagcccccacagttatatagttttattaaaaataaataaatagattacaactggttcaaccaggagagtaaagttgatctctcatctaatttaagcgaaaaactagaagggatagatcgttcctaaagaatgtcatccaagaaggaacaaagggcgaaacattataacaaataaatccatttcgttgcttccaaatgttctaggccgcatataaaaccttctccagaaaatgtgaagatcgataagatgtatttgcatggttcaacatatttttaaaggacaaagagagatcccatacaataccaaactgcacccaacactctgtactgaaagagcacttgaaaaaagatgataaggggtttccctttctccagatgaacataacacacaatttaaattacttccaacaagggcacaaaactttttgtcaagcatatcccaagtgtttaacctatcaatcataaaaagccaaccaaaaacctaaactttcatagtatagttactcttccagctccactttaagtaggcaggtgcctgcacatgcatgaaatttgtagcacaaactttctgggatgaatacttatcattaccccaaacataagaccatttatcaaattcatccgacagctgatctaaggtatctgtagaaagcattgaaagatactcttgaaaagcctgtttagacaaagggagggtaaaagtctaagacaagtccattaaggaagtcagatgaactgagtcttttgagtaaattccctatgtaccccctgaaaactcactctatccctttcatgcccctgaaatttacccgatcccttatatacccctgaaatttcaacttgatcccttttatgcccctaccgctacattttcattcatttcactattacgtttgattgcaaatgtcttttttgcccttgatgctttaggtttgaatataagcttgaaaaaaattgaaatttttgtttgagtgcacaatatgtgcattttatgaaactaatgagactaaattttgaaaataaaaacaaatgtaataaattaaaatttctatttgaaattttaataggataatggatttttttatcgggagcattcataaaaaaattattgtgagcattggtagtcctatgtttgtaggaatgctcctctttttgatgactttgtttcaaaaataaatacatattttttatttcatatctaaaaataaattttgtgataaataatgcatcacacaacaaactcataactataatagtctcatgcgacaaacttttacatttttagtaatataattaataaatttctatgttcatccagagggtaaaataatcatttttagaaattagacggtcaactgatggcaggggtatgaaagggatcaaaattaaattttggaggtatacaaggaagtaagcaaaattcagaggcatagaagggattagcttaaaattcaggggtatacaagggattttctcgagtctttttggttccttgcaaaagagaaagctctaggataactcctttgcctaatcttatcattccatagatcagaccaaaacaaacaggttctgccatcaccaattgtgcactttaaaagacctctaaagatatcaacaaactgtagagcatctttccaccaaaaagaaccttttagagataaagcatgtgggactttatcactataataagaggaccatgtcaatttaacccaaggaacaagatgcctattataaaatttatgaagatttttcattagcaaggcattgttttgaagtctaagatcaattactcctaaaccccctttagacttgggttggcaaactctatcccaaaggatcaaggatttcctactggaatttatgtctgaacctctccataaacaatgcctccttgctctattaatagaaaggatgacagattttggcaaggaaagagtgcacgtgtaaaatatcggcaaagaagaaagcactgaattaaccatagtcaatctgtcaccataagagagtagggaagaagtagcaggcaatcttgtttcaattctatccacaagagggctgaaatcaattaccttaggtctacttatacccattggcagccccaataagtgaaaggtaggtctcctaccaaacagccaaacatcttggataaatgctcaactttgtctggctgcacattcagaggaatcatacaagacttactaaaatttatttttaaacctgttgaagaggaagaagtatttagaatagcctttagacaaaagagttcctttgaagatgctgtcaggaaaagcagtgtgtcattagcgtactgtacaattgggaattcattctctagtgttaggataggcatggatataaggttgttctgattggccttgttaatgaaattgcaacaagtcttctcccaaaacaaaaggaagaggagataaagggtccccttgtcttactcctcttttgcaataaaatgactttcttggagataaaaccaggtattattcgtccctaaacttttcgtagcatttactttttattgtgggttttgcatttgtgcccacattcgagcgcaaggttttggtggccccttatttaaagctaagtcaagggggatcaagttttttttatagtttccacttgtatttttgtgtgcaccgagaatgatttttcctagcctgcttgggtcagacctgcaataataatttcaccgtacatagtgatcatacaaatgagtgaccggagtgcacgtgtatgctgtgttgcggacatcactccttcggatacacacaacaatcctccaacggtcattcaaggaccgataacacgagctcgcgcgcgacaattgaattcagaggtgagctcgttcctatgttcttctttgtatgaatttgagaatagattgctacctaattattatattgtgattaggaacaatggaggggacaaggagacacttggagaaggacttagagtcatggaatatcatcgaatacgtccaagtcaaggtggaggcctaaaccaagtcgacctcgagtgcaactcggagtccaggactagtctgcactaaaacgggcgcccaggtcgcatacgtgcttgtattggggtgttctttatatggatggaaagctaagaagatttccattggttttggtcccacgtccaaattctttccgagtcaatgggaatcgaccgaacaagttgacgtccataatctgttccggcgctgtgtcatcgtatttgggcctttgggccgtgtatcgtgttggaacctattagggttgcgtcaagggttggttgcacgaccctaaactctatatatcagtagtcgccgtcatctttagggtttgggttttgcttagattattctgtcgagaacagtttcgccgctagatcggtttgtaagaccccaacttgtgagcttaatcattcatatgcaattttggttgtattctatctcgttcttgttagtgttcttcgattggcaaacagggattagccttctcggcgaggtcatccgcgtttcgacacaggtgataaccagaggagacgtggtgctgtgattgcggagctcaagagcgtgcgcgttcaagaagccggatcgatttgtgtcgcgactccgcccaaatcgttgtttatcagaacttctcggaagatcgggaacgtgcacatcatgctggggtgggggcacagtaggtgcttatgcatggtacaattggtgtgattaatccgctatcaacaatgtggatagcaccctcgcaaagtgagtgagccctggcatccatgccaacatgagagaaggggagtatgcatacgttaatggcttgttgagtaaacttgttcggttcttggcaactgttgttgagtacttccttttgtttcacattataagatgtttgagtatgaatagattaatacatgatatcatatatgtgtctaaattcatatggatgttagtgaatctagacgagggatggagaggccaaaccgccaaaacattttttaatgtggaatggagggagtgcaaaatattgttttttttgactcgggggagtaaaaaatattatgcaaacagtcaaccacactattgccaaatgtatataatgttcaaaagagaagtgcatggaagatttgctagacaatatctagtcttgtttgtctttggtcgagcagatttgttggagcttaggattcaggattgagtgtttgaagtagatgaacattattccctcaaaaaaaatatttcgccggaggaatgagaatgggaacaaaacatatgcaagaggtaaatttttcttattggataaggtgtgattgtttgacatatttttcttaaatgatgggtataatatggtgttgtggaaaagatataactagaagcatggatttacattgatgcaaacatctctagatttttatatgtttggagggtattaattaggtggcattcaatgcaataaaactaaacaaatgagtttatgtactattgagaccactagtaactatgcacatattgagatacttatctattgttatgtatccaaatataaactcaatgtaattaaaattggaatatgaaaaatgcataccatatagttcccatcgtcaagataagatgtgataaaaaaaggtcatggtaagggtaagcaagaaaacccatataagtgtatcatctcgagtaaaatcttccccatattgtttgtgtcactacatcaatctaaaccatagtatttttcttgttcatgttactaacgtaaatgacttatactttagtttcatacactccaactggatttaatattatcgcttaagtgactaaatagagagctgtggtagaatagttttctggggaagctctcatgcacccaccctgctagctttcaactccagatgtgctgtcccatttttcttaattaatcgacacttaaatcctctttggttctccaacatttcaattgactaaataattactctattgagcatgcatagggaaatttaaggacctcaacgaatggaacctagcaagattgagacacttttgcaaaacctggaaaatttagcacgctgcaagcatttattgggatatattttttgttcattcttttatttcctttccatattctttgagctgaaatttagttgagaaacacttctctgccaacagaatgaagctgtaaagataagtgaaaggaaaaagaatggaaaaaatcatggcaagaatggccttgtccattccatagccttctaccccataatagcagcactattcaattgtttggcaatcacctataactagccaattaagtcatgcaattgcaaggctatgacttgcatatttatgtgcaaagtgtaatttataataattatatatgttaaaatttagttgggtataatgacagctataattggtattccttcaggcttcaggttaaaaataattgtcatttaggacaatactgatgtcaaaattttaaaacttgaactatatataacttctaaaatatttaccttagaaacatagagaccatatgtatggattaatctttaagagctcttcaataaaataatacatttgttgatatttctatatatattgtaatagaaaatagtggttaaaattattttttagagaccatgtccttgtctaaaacgataattatttctaatctggagtgagtataatttatgtttttcaaaagagtgaggtttgcatggtattttgtactaaacgaccaacaagagctatgataatgttgggaactaagatgttatcacagtatgtgaaagatatttaagagctttaggtgatcaaagaatacgattatgcattttgagttattatagttgctccttttactgtcatttagaaacttttattttgattgcattgtttgttcctttccctacccaaagttactaccgacgactaggatatttataaccaccatgtcactcattgatccttcccatggaagttttctgactcttcccctaatctccatcaatccaaccatcctgaccaaattcaatgtctcaagctatataagtatacgtggctcaatgaggaagcgaaaaaacattttctgttcattaaatgagattttcttctttcggctgtgcaccaaagtagaaacatcagtgttgtatctttgttctctatttcaattctagttttatttgagacttctctagtatgtccctgctagtatgccatacacaacatatactagtaatggttggtcatattccatacacaacacactagttctatactataggtccaacaaaaacatcttgatcaactgacatggtggtagatcctggcctctggcaacctagtcatgcacaagtcatattcaatgggcctgttcggctgcaaggtgaagccactgtgttgcgacgtcattgtcgctactgatgacacaaaacactgtttaggctggctgcaccacggctaaatgagtgcagccgaacaggcccaataaatatgacataccatcagagacataccatcagaagttgactcataataatctagaactaaaagttacttaggtcgatctcattcttctgtaagtaaccacagggagaatacacttactcaagaacatggagaatacacttaacaacatttggtattatccctgttcttgcataagtgcctttcttgatgacgttgcgctaagtatatgctcgctattgtttgttgtaggtctagattttacatttggttctttttaaaatttattttacaaatagatccttggacaaacttattctcggaatggaccctcggcgccaatgatccttgtatcgagggcctatgttttaacataaatttatgaaaagggtcaaaatataaatatttttcttacaaatagatccatagtgccaaagagcaccgaataggtccttagtgctaaagaggttggtgctgacccttcaacgtcagcgacttgcctaccaccggggaggagggggggggggggtggggtggcggcaaggagtatcatattgagccttagcgccaataaccctagagttgagaaaaaaatctattcctagctagaataagtttttccagatttctatttgtaaaagaagcttccaaaagggctaaaatataaaaaaattagcgtcgtatgtagtcaagttaactaattcatgcacaatagagggaaactataaagacaaatgtctccaggtgagaactaattattatgctcacattaggtgcttgcggggtaacacatgtttcaaatatagtttaattttgagacccttatcacttgtaattagatttaattaatatgcttatcagctatattgtattataattacggcatgtacaacgacagttcattctgctatgaactcttacgtacatatgttaccattaattaatatgtgctaattaaagggttgtttcttaatcccaatcatcattaatacatatactaattaaatatgtgtgtgtatataatgaactattaggatcaattgtgaattcactagtaggaaatcgcccatctatgacgttttcctcaatattgatggttatttccgttacataagtgttgtaatttcttgttagtttacttgttttaagttaggaaattaatgtgcttttatgcattaagtccattttgcatccttaacatatcacggaaatctaacattcatctataagattcaaaaccagatattattcatcccaaatatttcaaactatataccttttatcatgggtgttgcatttgagccctcaccctctttcttaaaagccaagtcaagggggactcgagtttttcttttctagtttccacttgtattttgtgtgcaccaagaactactagcttttgctagcgtccactgacaaatacatattgatcatacaaatggcattgaccagtgtgtgtgcacattgttgggccccatgtggttgtgccaggaaaaatggaatataaaaaaaccagtggcgttgcttgataaaaaaatattcggttcttggcaattacaatgttgtattcatattggtgatgcatacaatgttgtgccaaacacaatcctagttgctacctacttgaatcatctttattcttagaatgcgaacataatgttcaagagtgaagtgcatggcaaatgggactgacggataatatctagtcttgtttgtctttagtttctcgtagatttcttggactttaggattcaggattgagtgttcaaagtggatgaacaatatctctcccaagggatgagaatggtaacaacacatatgcaagaggcaaataggctactccatgccaatatgaaactgttagattagaaatagctcggcttaatatgtagtggttaacagcttcaaaattaaatcaacttaaagttttcaccgaacaatcaatagttcagttactatgtattatccaaaggctggtgatttctttgtttgtagtccataattaggagggaacgattcgtaagttggatatggggatattacaactttgtcgtagttaattagttgatgaaacctaatatatgccgcgttgtaaatgtttcgtatatagactaccggatttgatagcaaatacataaatgtgctacacatgtttttaatgagggcttttatggtgctttgtacttcttaagttacaaagcatccaaaattgatctcataaagggcgctttagagatagaaataacttaactgtcgtttttgagtaataacaatctctaacttatttcctattttttcgttgctagttgagtaaattccatcaagtgctgctccttgcatcatatagctatgtttcatctaatggttatcattaactgttgataattattctcttataatcaatatgcacaaatagaatagatcttaaattcttaatcctgctttatttcacaattataagaaatatatacatacatatatatatatatatatatatatatatatatatatatatatatacatatatatatatatatacatacatacatacatatatatacatacatacatacatacatatatatatatatacatacatacatatatatatatatatatatatatatatatatatatatatatatatatatatatatatatatatatatatacatacatatatacatatatacacatatatatacatatatacacatatatatacatatatatatatatgtatacatatatacacatatatatacatatatatatatatatacatacacacacacacacatatcatgatagtaagttacttggctagagaatttgttttgaatacatcattcgcattgaggtacgactaattgattgtattagtactttcaaaaactaaaattctatcttttcagttttatatgtaataacaagttgtgcattctacagttttatcatgagttcgtatgcaaaattgattaatcacttcgatttatcatcacacatggtatttagaaaatctcacttgacgatggccatccgatctaaagatacttcgactatagatttaatgtaatacctcatcaaaagtgctatttgctgcagagtttacgataacatccactatcaagatccgaccgccatcttcaaaaggaactccgaataatactaagtggatctgaataatatgaaatgcatcgatcgattaaaaccttgcttttttaaagtaatcaacatatacaaaattactagcacacgttattctgaaactaatacctagcacacgttt

SEQ ID NO: 2550 - DNA, 1502 bp, Oryza sativa
  unsure (1)..(1502): unsure at all n locations
ggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgatgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacataactccttgagctgttaaaggatctgttgccagaggggaacaatttacctcagacgacatatgaagcgaagcaagtattatgtccgtgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2551 - DNA, 711 bp, Oryza sativa
ttgggagaactaaacacgacccaagttatatgaggtctatgatctcaattccatatgtggcacttcaattttcatgtcatatatgtgccactttcagcgacaaacatgagattaggcaaaattttaatggtagacagggattttatccgaataaaaaaaatactccaggaacaatgctcctcagtccaccacttttcaagtttaagcgtcatcaatatcacaaaaggtaaaaacactacattcttttgtacaaatttttaagatgcaagaaaccacaagcaatggcattcctgactgagctttttatccaccggatgcacattgttatagtttgaaagaacaagtttcaaaagtcccaactataggaaaataacagagaacacggagcaaggtaaaacatttagtaaattgaatcaactaatcaaggtcccctgttagatgcctctacagttctttttaatttcatatttttttttactttagagatgaaagattggttgagaacaagtttaatagtaaagccaactatgatcttatagcttatattagagttaatatgtatagtaaatgagctataagggtatctgtattttttttctcctcactctagctctcacatatgcatttaatatattcatcttaaagtatgtgaatagttagttaactcttgcatgagccaaaccttttcattttcaaattctttcttctcta

SEQ ID NO: 2552 - DNA, 574 bp, Oryza sativa
  unsure (1)..(574): unsure at all n locations
nnnnnnnnnnnnnnnnnnnnnnnnnnnnnnnnnnnnnnnnnnttgttgtgctttggtagaggggtactatatatgcgccgttgctgtgctctctggatagatggatggatggatggatgtgtgctgcgatgaaactggcgggagacggggagggaggtgtcggggtttatatagacgggaggagcgcgaggaggaagaagaagaaagaagaaagaggcgggtaggctgggctggacgacttggaaagaaaggaccatgtgggggagaacgccgcaaccggggagattagtttacgccttttttgaagtttttttttcccttcttcttctttaaaagccaaaagtttaggcgattaacccccatcgtggttaattagggataatcatgcgattaggattaattaaccacgccgctaatttaatcgcccgcgtacgtacgtacacgggttggagagactcgggggacttttgcggtgggtttgacccgttgactcgtccagctgtacagnnnnnnnnnnnnnnnnnnnnnnnnnnnnnnnnnnnnnnnnnnnnnnnnnnnnnnnnnnnnnnnnnnn

SEQ ID NO: 2553 - DNA, 611 bp, Oryza sativa
aagaaaaattatcaatttaatacactttacttctttcccaactactgttgagtgaccacgtctttcgacgtatgcggtagtcgtttcgacaacagctggcgccgaccatggggatttccgagcgaaaccactgagagcaaatgccaccgaaaagggtcgtgaaggagaaggttacaaggcgaaaggaaagcgaagccgaggtggagatggtcgccgaagagggagcagagccttcggcgccagttgccgaagatggaggagcattgtctgcctccgcacctgcaccatcactactgccttcggctcctgccacctctgcgcaggtgctgaatgcggctgacatggcgaaggcagtcgcggcggtaagggcactccagaccaggcggagatcctttcgacaagccaactgctggtgctccaagccgctccgtcgcagctggcagcagcctcgattgcgctcgccgctgtacaagcccaagtcaacccagaccccgaaacacaaatcgaagccgacatggaagccatgcgacagaacatgacacgacttccagacatgctttggcaaatgcaagaacagcatcaggcgtatcaggcggcgaggcggtccaagg

SEQ ID NO: 2554 - DNA, 358 bp, Oryza sativa
ccaagcaaatgctgaaaacgtcttcagataataaatatcgtacgttaaacaaacaacaacgcttctaaacaagaaacgtagtaatgcaatggcgagagaattaacagtgccttttggggatgcaaatctggccggtcatgtgccaactctcgcctccgtccggatgcgcgtacgggcacgacgggacgtgctcgtcctccacgacgaggaggttccactgcgcgtgcgggtcgtgcgtggagaacacggtccacgccggcgtggagttcttgtaccggctgtgcgtgacgcggacgaacccctccacgtcctcgttcctcggcatgtcgtccgggtcgatgtccacggtgaagatgtc

SEQ ID NO: 2555 - DNA, 418 bp, Oryza sativa
  unsure (1)..(418): unsure at all n locations
gttattgcttcctagaatgggttgccaattttctatagttccaactttctcaaatgagaaagtctagtgggtttaggtcagtaaatgactcatacccagaaacaaaaatgagcagacatcccctatgtaacgcattgtcctgcaaaaactgcagcatgtttacagatattctaagagcaatgctacgctgtatggagcattttcactatgtcaaatgcgggtaaatatgcgggtgcaaacccaatttaggtgaaaactagtgtaaactagtgtaaaccctgagtttggaaaagatcttttacatggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2556 - DNA, 707 bp, Oryza sativa
aatcaaacgcagcgcatccagaaattcgcatctcattgctactcatccgacctgatagcacccaaacaacacacaaatagaaactccccccacatgctccataccagagaactaaattcacgatccatacagacagaattctatcctctccaatcaaaacgaacgaaccccaaacccacggcaacgattccttacgtgcaacagtcgcctaccaaatgaacagttcctcgaaacgtgaagggcgagacggaacaaaaattatatatataacaaacaaaaaggaatccaccaccacgtacgacgacgaagaaggcggcgtgttcccccctgatctaccctactaacaccacatgcaaatccggcctcgtaagcacgtacctgcggcgcggaggccggctccggcgacggggtgcggccgcgcattcgccgcttctcgccgcggcgcgggggcgggggcggcggcgcgctggcctcctcgccggggtcgcgggaggaaaccatgggcgagatttggtgggcggccgcggaagctatctccatagagaaaagaaaagaaaaaagagaagtccgcggcttggttttacgggggagggagtcggagaggggtaacgacctcgcacgtgcgctgcaccacgggggacccccactaggagttgtggtcgggccgggccggtgggccccaccggtcagcgtcagccccctctttg

SEQ ID NO: 2557 - DNA, 709 bp, Oryza sativa
aaggagaaagaagaacagcgggctaaagatttatagccagctgtagcacagactcctagacgcaatgtgtgtatgattggtggggccagatattaataatgtagtatgtaactattgtataaatgagctattagattagttatagatgaattggagatagtagttggctatactattaaacttgctctaagcagattaattctcatactgcgttcgacatgtgcaatcaagatctcccgtcctctgagttcgacatgtgcaatcaaggattaccttccgtcttctgaaaatttattcttgtacagcgttcgacaattagggtgagtttgaggagaaagggattgagaatattgggaagatatgtaaaacgaggtgagctattagcgtatgattaattacgtattaactatttaaaattttaaaaatggattaatataatttttaaagcaactttcctatagaaatttttaacaaaaaaacacaccgtttagtagtttgggaagcgtgcgtgcggaatacgatgtcctttctcaccctataccaccagaacgaacactccatctcctcctttgcatgtagccatacatgatggtccttatggaatttctttttctttcttttaatctatggtgatgaattcaatctatgatggggactaatacttctgcattattgggggcatggagcacatgagagtgagggtgatctg

SEQ ID NO: 2558 - DNA, 449 bp, Oryza sativa
cgagaagacggcgagcgacaagacgacggagaagatcgtcaaccccgcctaccaggagtggtttgcctcggaccaacaggtcctaggcttccttctctccacgctgtcaagagacattctcacccaagtggcgacggcatccacggcggcgcaggcatggcagcaggtgtgcgccatgttcactgcacaaaccaaagcccggtcgctcaacgtccggcttactctcaccaatacccagaaaggtaacatgagtatatctgagtattgtggcaagatgaaagcactagcaaatgaaatcgctagttcagggaaaccccttgatgaggaagatttagtcgcttatgttctgaatgggctagatgatgattttgaacctgttgtatctgctattgtggcacgcaatgagtcgaccacaatggcggaagtgtactctcagcttcttaactttg

SEQ ID NO: 2559 - DNA, 695 bp, Oryza sativa
  unsure (1)..(695): unsure at all n locations
nnnnnnnnnnnnnnnnnnnnnnnnnnnnnnnnnnnnnnnnnnnnnnnnnnnnnnnnnagcttgaaaaattacagctagaaaaataacacttcgtgggacaggttaggtttttttcaaaatagagttcaacatcataattatgaacaaaaatagtgattatgtagtgaattccaaacaataactgacaacaaatgagaggctgaataattgtaaattaacagagaaaacactcaaacaacaatgggacaacacaacttgaagctgagcacctccaagttcaaccagtattgcaattacagagttacaacagtgtcaaatttgatgtcaatatcatgtgtctgtaaaatatgtatccctgtgacacaagtgattcaatccacatgcaagagcatctttattgtttgtaaaggaattaagggcgatacacatagcaagtagcaactgcaaatgcctaaggtataactgacagagaatgagatttacctgaacaccggcaggtggatcacggtaaccagtaagaagagcaaacacatagttctggccattgtgccttgcctgaacatacggagtcaaacagtaaattacaacttgaaggtggaagattaaacaatgcaacgccaatggcataaaatatcattaccttcgtgataagactgagatctggtgggtatgccccaccatttgcaaaacgggct

SEQ ID NO: 2560 - DNA, 776 bp, Oryza sativa
acgtcgaataatacttgctcttcacgtctgttttcccctgtgccgaaagctaccagcaactgtgcttggccaagaacttgaactgcttctccgccgaaaccacggagcgaggctggtgctggggtaagggctagggtgggcaaccccatcttggcatatgcttcggcgaagatgacatcggccgaactccctccgtcgaccaggattcgccggacctcgaagccagctatctcagctgagatcaccagaggatcttgatgcgggaacattactccttcggcatctcccggcccaaaagagatttgctggttcagatacttcggggccccttcgcccgccgaaatcatattgtggaccattcggagctgcatcttcttttatcacttcgatagctagatcggcgggtcggcccttgtaatcacttggattactctgcgctgcgcatcttggcgctattcggccgggggtgcttgttcttcagctgcttcacgaggtgcttcgacagctgctccctgctgcggccttagatcttgcacgttgccacgttgccgaatgtttcggcattgttccgtggtatgcgaagagcgtccgtggaaggcgcagtagaggtcttttcggaccttcttacggataggctgctgatggttgcttgcttgctgggtgtcgaactccttgcagagggcttgcacttcttcgacagccatcacagccttgcccgcacggtcggttctgaacttcctccaggtcagggtaccgagctcgaattcgccctatag

SEQ ID NO: 2561 - DNA, 1407 bp, Oryza sativa
  unsure (1)..(1407): unsure at all n locations
nnnnnnnnnnnnnnnnnnnnnnnnnnnnnnnnnnnnnnnnnnnnnnnnnnnnnnnnnnnnnnnntccacgatggaaagctcttcttgcgttcagcagccagtagcccaacaaggcccattgttcgggttaaacgaacccaaaaccgtacgaaagcccgagaaaattgccttcgtctgcgccccgcgggctctcgtcccaaccgctcaccggcttcccgcggcggcggcggcggggctccatgctcacggtgaccctcctggacgcgcacctcgcgcggtgcagctcggcgcgccacctcctccagatccacgcccagttcgtcgcgtcggtctcctcgccgacgccttcgccgccagccgcctcatcctcttcaccacctccacccgcctcctcccgctcccgttccaccactcgctccgcctcctccacgtcgtccaccgccccaacgccttctcctgcaacatggtcctcaaggcggcccgcgagcatgggctgccgcacctgtgcctcccgctctacgcgtccatgtccgcggcccccgactgctacacccataccatcctcgccgccggctgcgccaccaggagggccatcgaagaaggccgccaggtgcactgccacgccgtcaggcacgggttcgggcgcaacctgtacctcgcgaacgcgctgatgagtatgtactccgcgtgtgggtgcctcggcgacgcgcgcaaggtgttcgacgcgggtcctgtttgggacgccgtttcttggaacacgatcctggccgcgtacgtgcaggctgaggatgtggaccaggcggttggggtgtttgcacggatgcctgaacggggtgctgcggcggtgagttcgatggtgtcgctgtttgggaggagaggaatggtggacgaggcgaggaaggtgtttgatgtggtggagcgcaaggatgttttcacgtggactgcgatgatttcttgctttcagcggaatggcaagtttgcagaggcgttggctttgttctcagatatgcgtggggaggggtggcctgtggatgaggcagtcatggtctgtgttgtcgctgcctgtgcacggttggaggtaactcggaatggggagatgtgtcatgggctggctttcagagctggccttggctcgaggttgaacgtccagaacgcattgatccacatgtactcaagttttctgaatgttgttgcggcacgaagattgtttgacagtggccagtgtttggaccagttctcttggaactcgatgatagctggctatcttaagaatggctctgtcaaggatgcaaaggaattgttcactgtaatgcctgacaaagataatgtttcttggactacaatgatatctggttgtgtgcaaaatgannnnnnnnnnnnnnnnnnnnnnnnnnnnnnnnnnnnnnn

SEQ ID NO: 2562 - DNA, 672 bp, Oryza sativa
  unsure (1)..(672): unsure at all n locations
nnnnnnnnnnnnnnnnnnnnnnnnnnnnnnnnnnnnnnnntttttaagcggttttaaatagtttctgttcctgtgccatgaaaaggaagggtttatccaatgtcaacctgcgaagttacaaaagcgatcgagtttggttctctctttgctttaatttatggtcctctctttggtgaaacagcattgcccttttgtggacacctgggatgacaacgtgctgctgggattgtagccaactaaaacaagtctcctatccctttttcacctgtagggattaacaccagaccgtcttctacaaccaggcgtagcaggcaaacttggcttgtgttgatggcttccgtgaactacttgctgtttgaactttacacaggttacctacccgaaaactggtctacgttgcaaatctctccactgtttgctctccattttgagcagaaatagacgcctaatccagaaaaggctatagtgcaggaaatagagatgctgaactgaaagtccaactacaattgggcctttgggaggcctttctgcaagtgttggacaactttacaacagggaagcaacatccatttctttcagtaactttactttcatacacattgattgatacaagcacagatcgaagatgggaaatggttggaatacaataggtcttcttcatgccttttagat

SEQ ID NO: 2563 - DNA, 712 bp, Oryza sativa
  unsure (1)..(712): unsure at all n locations
nnnnnnnnnnnnnnnnnnnnnnnnnnnnnnnnnnnnnnnnnnnnnnnnnnnnnnnnnnnagagggaaaggccccggcggttgaagcgagcgtttcggacgtgacgcttaccgccccacattttgtccccgctgacttcgccacgcggccagagatcactccgttcgtggacggtgtgtgccaggtcatagccccaaccgaaggccttgggctcttcaccaaactgaacgagttcagcgaaagctgcgcggctgtggaaagcctatttgtgcgggtatgatttttattgttaagcgtcgaattttgctctttcgccagttccctgacgtaattttttttaccagggccttgccgcgcacctaagtgccaagaagtccgccttagagcgactggatgggtaccgccttcgccttcgcaaatccgaagaagatcttcgccacaaggaagacgaaagacgcgttgtggcggagactttgaagaaggcgaatgctgaaaataggtctctccgctctgaccttgaagcagcacgcaagcaggacgccgaacaggaccgacaacttgcttcggctaaggagaatattaaatgcctcgaagcccgtcttgtgtccgccaaagatgccgccgcgaccctggtaccagccacggagtctgtcaaggaggcctgttacactcttcagctggcccttaacgaccttggggctcgggcaaaaggt

SEQ ID NO: 2564 - DNA, 9234 bp, Oryza sativa
gtgacactatagaatactcaagcttgcaaataacgagatattcaacgcgtctcaccaaccagattcacctggtgtagtccaatcaataagtcaagaaaacatgacctttcaaactgcaaggttttccttgacgccactatacctccacacccccagatccaacaacgacaagttcaatctcaacatgttgcagaggaacaaagcgtggaaggatctccagatcgcttcgtgggatccgtcggcattgacccccacaaacccttagttctacatagcatggaggatcaagaatcttcagcatctaatactacacgtgatgtgaacgttatcgaaggagacgctccaagcaatgcaaacccatgtgatccacctcatcgcgaggctacagatcctgtccgtactcatgcataacatctcaccgcaatcgacttgctattgagagagtcctttcgatccggttctgtaccctgaagcagatcactggttggaagaatacgatctacaatatccaacctcaacagtgcctttacagcaacagctggaccagcaactcagggaccctcttgtcttccggcacaaggagaagaggtgcatgccgatgggaacgtcgatgctaccgaaatcctttgcgagcacccgagtcgagattaggccggaacctttggaacgcctcaccaagacgacaaagtcagcagaccctatcgccccgagatgatcgcgaccttcgcgaccacttgaacgggtgtaggcgggaacgataggagcaggatgacgtctgccatcaccagcgacgttctccacatcgacaacgcaataacaacggtaaccgaggaggctgtgacaataacgccaaagccaccatgatgaaaacagcttgtcaaagagaagaaaaagcaacgccatgattttttgcttctgcaacgagcgcctgatgcagagcattgacattgtttggaggttctcagagctggctatcccatttattggaaatgcagacatgctaataacaagctgcaaagctggacaacagcaagcacactatggtatgttcccacttccgaagccgaaatccggtggcatgccggccatcaccttctgcaccgtcggcctggccagcagcgcctcccaccacgccttcacgtgcgggtacgcgtcgaccacgccggcgtactccgtcgccatgaagtagcgcatgttggagaagtggctgaggtccgcgaggctgatgcggtcgccggcgaggtacctggagcccgacagcctcgcctcgtacaccccgagcaccttctccagcttccggacgctctcgtccacgacgccctggtcgcggtcgcggccctcgaacttgttgatgatgcagtgccacaggatgggcctcacggcggcctcgtgctggtgggcttccacgtccagccacacgtccaccattgccgactcctccaggcttccaccttctccgagtcccaggaactctggtttgtacttgcgaaagatgtacctagcgattgctcgcgattctgacaagaaaaatacaaacgattttagtttcttcttttgggcatagtgtgttatatagtatgtgtatccgtgatcttgaataaagaattactgaatctctactattaattgaacagttattcagagaacaacaagtattagttttgattggaataattcagagaagcaaatagaattcaatcgacgaaaacaagaatacaagtcaagcttgcttacgatagagcgtcaggtcgccatcctccagtactggaatctcaccgaacggctgcataattgatatacagaaaacaactttaataagcaggaattgaaatgttcttagcaggagaaattaagtttggaaacaacaactcgtgggcaaaaagcgcatccaaataaccgagtattcatgacaattcggatcctaacgtctattgccaacatatagtctactattgggcaatcgaagtgcaggtattccatgaatcagcctgcactgtaggtcgctctgaccctttggactaatttgcgtaacatgcgaagaagatatagtgcgagaattatgagaggctcacgtacgtttctggcgaggtgctccggccggcggtggtcgccgccggacctgctcatcggaacgacctcgtactcggcgccggcctcctccagggccaccagcacccgcgccatccatggcgataccacccacccgtacactttcatcggcgccattggtccttcttgcagctgaatttgccctgcactttgttggtacatatatagttgctgctcatcggcccattttgttgctaccctgggcgtctattattgtacaatgttgaccgtagtgtgggggatttggtgatataagcgttgtttcttttgtgatttatatattggctgcggaactgtgggtctgtggctgctattgccttgcgtcattgcttacgcgagggccatttgtttgttctttccacgcaggcacgtgcacctctggttctatggaagtgtgaattcaccattcttgagagctacaggggagctacttttttccaaagaaaaaaaatggtatatctcggcatctttttaaggcctataaattttctctcatcagtggtagttgcaaagtttgaatgttatatttacgtgtttctccttacatttttatacattttaactgaagttgacagaagcctagctaacggtaataacataaaggaagaaaaatagttgtgtgatgcaactcacgtaatctatggcaattcttaggatcaatcgttggtcattggcaaaagatagaatatctgtgagaatgttattgtttcattacatatttgaccgttttgactgatttaattgagtaccaaaatatgaaacaaaattatgaaaaaatatttcatagaaggctatttcatagaatgtgagaaactttgtagaaatttatttgagcataagtgatttgtcatttttaattatatgcatgcaaatacaatgcataaaaaaaaaccaagaataagccacaaataatctgtcagggttatggataccatatacctaatagtagttgactaaatcttggcagaacccaccacataccatgtcttatacggatactgacctctgatatggagggagttccggatagagaaagacaaccataattctgcatggaaacgacaatgactactcggattgtatccatattggtttccctagttctacttagacaagggaacacctatgggtataaatacaagaccccataggaggagaggggacacggagcaatagatcaagatacaacatacaagccaacatacgccaagacaagacaagatgccggatattgacttcagagataagcatggctagtccctacggtgtctacggatactgtcaggagagacatagcgctgtctttgatctcgccggatgtggattcgaggaggaaggctaccctgttgtcgactacgagtcagcacttcagaccgccaagtcgacaacagttagataggctaccttaaatattgtactggtgtgatcatggtgaataagagcaatgaccggcttcggccaacaggagtagggttattacctgacgattcaggggctcgaacctgtataaaattcctcgtccccatctcttttattaaaatctcgcatatatcctagtaccaacgatccccatactatgcaaataccggaatcgcgacatcaaacgtcgacacaatcaaattagcaaaacaagatctgtttgttgatgagtgtgagtggtttccacaacttggctcctacaatgtcacattagttaccaagcaatttggccaaattagcttattcagatgaattacggagttgggaattttttttaggatatacaaagtccatccactaatcttgaagtttttattcgatcctggagcgattttatgagctatgtgttctgtaaatttgtcacatttttatcattttgaaggctaggaagatcattagtttagtttttattataattcaaagtgttgacctagttggctcaactaaagttaattagtggatgtaagtttttgtaatctatactaccaatagtggcggtggcagttagtctgtgtccaccactaccaagtgatttgtgggaaccaacgatggtaagagaagtttcctagttcaaagggtgtatgagttgtgtgcatgcagtaagcacacgggctgaagtggcccatctgaatgtaactttcttttttccgtgtggtttcaggatggatctgctatacgtcataagattttttaggtctaaaattatattttaatacaatatatgttgtataacaaatctatctatctatgatatactaaaaatccattaaatttcctacaaacgctctcaagctgccatgtggcatcctataaacgctctcgagtcaccatgtggtactctaataaaatagataaatttgacaatcgattttcatttaaattggtagactcattattttagatcgttagatttatctttacaggaaaataaaaataaaatccccctccgtgcgcgcctcagggctttcacggacgtacataggaatgatccatcccatctcagtgcctttccttttttttaaccccgtgataattaaaattaaaaactcttttacgtgccttaaaaggccatagataaacaccaaccaactctcatctattctctactaataaatagtccattaaacatcatataaatatttctaaacatttgtatagtaatcttaaattagaaaaaaaatacattcggccatcaatttacattattttaggtcatcatatctatctttttctttaaaaaacatccaaaacctccctccacactcccatgcagtgttaaagcccattaatcatcttttaaatgttttcaaaccaatccgtgacacttctaaattagataaaatcataaaaaaaattagaacaaagcatccaaccattgggttgtgttaacagtgaaatttagtaagcccgaagtagtcatcggcttagagtcagcatcggctttgaaatcctgagattagcctatgagagttgccaagtcgtcagttgttggattcttgctatattcggttaaggaaattgatctactaaaggaagcttatccagaagagaccgagttcaaagagaatgcggcatggcaagttatctattaattagtaatagtttgttagtttccttttatctttaggaaagtgtatttagtgtcctataaggactttatcttttccttttatctttaggaaagtttctttcttgttcgacaaggacttgtatccacccatgggtataaatatgtacacccggggtctatgtaatgtaacacacacgttcaatacaattcggcgcatcaccaccctttttgctttagttttgtttcgacgagttcttgctttcgggttgagctgcatcggtttcgatcttcaacaagaggtaaaacttgttatgacggcttgtgttttcgggattagtgcttccatctttatgatactctaatcttatttatgtaattcgtcgagttatcatatattttatataatctctggcaatattgctatctaacctacaatcggctaacatctatcagtagagggcagtcgattaggttaaatatcaacgctggcttagattatatacgatatccaccactctatgaaacttccaatggcttgattgtctagatattgtccttcttttcacacttatagctgcatcagttgtttgatcttatgagtcgtgattagaatatcaatctctagcctgcttattggttgctgattagggtagtatcagggtttcaaccgatcttacctgatttaactatacttgctttatatgctttattgacatgttaaatctgccctttatgttaagatcttattgcatttaagtatattaggctttcgtttgatatattctgcttactttaatatcttaatatagagttgtatctgagtactagccgatacatgctagatctatctgatcagctatgctataaacatatatagtcttgttgttggtatatatttcaatttaagtgatttatactgtcttggcatggcgactgatctatcccaatcacttgatttaagtatatatcgacataaggattatatattgttaatatctacagccgatcgagtagatttagtcctttattatctaattataactgccgatcgatgtatatatgacatcggctcaaagataaatgatatgtcatcggcacttagccgatcggctatcgtttatggatttaaccacggtttctttgtttctatttcttgttgattgcaggatcaaatcaactggtacgctagcatacccgaaggtgagttttggacctgcactggagttaagcagatctctcaggcctcgtgtttttcatcaacacgcaattggcacgcccggtgggatcacgaattttatatccacaagtctgaagaagaagtcaatgccaagatcatggtcacggtggagaatttaacggaggaacaacaatattggctcggggggcaagcgcatcagtttcaacatggtggagcacatcagtatcggctcatgaaagccgattacaagaagcaaaggaagattggttttggagttatcaagacaagaaattttgaagcatgaattctcgtactccaaaactagggggggatgtgttaatggtgaaatttggtaagctcggagtagtcatcggcttagagtcagcatcggctttgaagtcctgagattagccgatgagagttgccaagtcgtcagttgttggattcttgctatattcggttaaggaaattgatctactaaaggaagcttatccaaaagagaccgagttcaaagagaatgcggcatggcaagttatctattaattaggaatagtttgttagtttccttttatctttaggaaagtttttttcttgtccgacaaggacttgtatcaactcatgggtataaatatgtacacccggggtctatgtaatctatcttcatgatcaatacaattcggcgcattgccaccttttaccttttctactttgttttatcgtccggcgggacttggcacctgacgtggagctgcatcggtgttcgatctccggcgaagggataagtccaatgttccgccggtccaggcaattgtatcgtctacgtcggcgtcgttcaaggctgcatcaggacattcgacctcttggattactctggtttggatgatatatttgcctacctatttatcatatgtctatgttaatctagtcttagcatatcaatttagctctatcggctgcttctcattttagggtttctgccggtatcggctaaatcgcgttgctagattagactaacttagacatctaccaccctgaaaactcagtcaacggcttgattgtctagatattatgtttcttttcatacttagtgctgcatcagttaagtttgatctactaagttgtgcttagaaccataatctttagcctacttcttgattgccaataagggtttcatcggggtttcagccggtgagttatttggacgttgcatcggctcataaggattgcatatacatataagttggatttagccgatgacaacaaaggtttcactgtttaatctaatcttgtggatttcatgacatcggacctccagccgatgtgtgctttaaccttcggatcgatgcttatttatcatatcattatttgccgattggtttatactggattatattgttattttattacatcatcatcagccgattgcctttatatcatcatctacattggacatatagccgattgcttaaaccctatcgctatcggctggtattggcattggctattatcggctatcggctgaagctactccatcggcttgtcagctgattggctgttttgatctactatttgcatatcttgtcagttgcaggatcaaactgactggctcgcccgcatctcaacaacctttggacctgcattggagccaagcagatctcccaggccggtgtgttcgattttttcgtcaacaggttgttattatatttttttaaaaaaatccctattttttaataaagctggtagacctatacttatatatcctgatagacatataacgacttcctgtcaagttaattaatttctctcaacatgtatatgggggctatttacctatacaatttgatcttcatgcatttatcaataaatgatctttttaggagataaataaataatcttaaaatgatcatagcatctaaattatatatatgatctatgaagacactaataaattaaagaaaaaatctttaaatgatatcatttttttacgtcataatgtgtaccccatcttgcctaaatttcatatagacaacatgttgaatatataaacatgatcagttgaacaccatactaattgtatcagcatagaacaatatagaaacatgaatttattgtatgagctctactttactgacatttattgtattgcaataaccactgcataataattactttagataattggaacaactctaataggtttgaaaaattatctaagcctgacaattattgtattgcaataaccattgcataataattaccttagataattggaacaactctaataggtttgaaaaattatctaagcaatgccaaaaagaaaatttatgaaacaaatagttcttttgaagcatggcatgcaaatgttactcagttaatattccgcttcaataagtttctcaaatacaacttacgatacatgcccactcattcgcgtgggctacctttcttgttagaataaaaacatccttcttaaattccattgcaacgcatgggtatttagttagtgttataaatggtcttatcaaatttcaagttccaatatttcaaatagcaaaaagaattcggataaactattttatcaaattttctatttatttcttggagagtgattgtgcgatgttatgtctgtgataaccctagttagattagttatacagaagggaacaaaagtgaaatttcatttgggcactcaaattgaaaatcatgaactgtggctgtttagagcttaaccgttgattatatatgttgctttgtatcaagtcgcctaaatcggagctcaggccaacaagatgatctctgcacctgtagattttctaatgtacaaaatatgcttaacctaaagatcacaataatgcggaatttaaattatggatcgtta

SEQ ID NO: 2565 - DNA, 4077 bp, Oryza sativa
ctgcacccctaggttgcccatgaacatatatgccatatcaatatttatgagatatttcaattgattgttttcataggtattagtggtttatatactacgttttgggttatgtacttctgtcaagtcatcatttcaggtcacacaacttaattgcaagcagtggtgtttcccctttataattcattgcttctggctttgtccaccagttataagttttgaatgatgtcatattttaatctactaatttcatgtcacgatgtgatctggtttagttttgacatgcttaattagcaaaatacatatttgttctctacttcaattagtttcttccaactgttacctatttattgcgttttatttattcatacatatggcatagaaatatatagctaactattcacactttttacaatatattacaacctatgggaaaactaataaaacattattaagaacctgccagtgtcaaagcaccaaaatatttattagagtgagctttgcaaatcagaaactcaacggctgtgtctatgctagaaaaaaaaactcttttacagtgcttggtaggtacctgaggtacctccttaacgaattgttatccaccgttaatcttcaaaggataatttaggaacaaaaatttttacactgcacaaatccattcaccaggaaggcaaagggtactgggtactcgagcaggtcgatcatgtacattgacgagacaatcaaaatcgatcgaacatcttgaatgatcgcactaacagcaaggcggtcaatctcatctcaggttcggatcatcaaattgatcagaagtttcagaagcacaagggcctcaggctgtcaggcagccgagatcacagctacaggatacgaaagaaaaacgacaccaaccgaccaactagtgatgaagcgatcaagcaaacaattcaatcctgcagatagattgactagattgatcaccggagatctcaactcaattgatgccgccctaatcagaacacctccttccgcaccatggcgatcatggcaacgaggtccaccgctcttgccctttaccgaaaaataattttatgaaagtcaattactattttacccttccaccttctatacctggctcaccattttaataccttttttctagtttcttctctctatccgttagattattactgatcaagcgttctaattaatttcaagcattgaagatctcttaaaatatgtgcaccacatggatgttctagtttggctgggtcgagttaagatttgggtgaacggatacaaagcaacatagctctacacatccactgttcatgattttcaatatgagttttcacatgcaatttcacttttgccccgttctttataaattatggaacgtgggtttactaaaatgcacctattctcatcaggtgcatgatattcgtgttccgattctttttgttgagtatgtatggataacctgtggcaggaacaataggtaattccccgcgttttgctatgtaagttcctaagtaacttttatttttttaataatcaagctaaaaataaaaaatatattagttattaacaacaaattaaattaaataaaattggtttgtcaaactatgttaaaagagacatatagttagtagactatgtatgagattgtagatgaaatattaatatatcccgcacatagataagtatatgttaaatattataaaaatgatggatatatatgtgtgttaaaaattaaacagcagtgaggtggaatttagttaggttgttactttgtgttcaaaacattacatttgcagaaataatgaaccaggttgcattcatttggacctttctgagattggtctgtcgattggaagatgctagcattaagcactagcacagagtgcttggcgttactagcttacaaactgatatgggacaatggactaccaaacaattgcgatgaaagagtcagtagtcatccataaattactgattgatgtgaaaattaaaaaaataaatccacatacatcattatcatccataaattacttgattgatgtgaaaaaaaaacccacatacatcattatcgatcctttctctggcagataatactacctccgtcccaaaataagcgtaaccataagtttccgtgcccaactttaattgcctgtcttatttgattttttttatgattattattattattattattattatattataaaatatgaatggtaatttatgcgtgacttatttttcttagtttttttaaaaaaatttaaataaaacgaacaattaaatgttttttttataatgaacgattaaagttggatacgaaaacttatggctgtatttattttggaaggaagggagtatatctgaaagtgctagctgttgcactcctatggtgttaggattaatatattatagtggcggcactggggcatgcttcacctgggtaacttagtagcgttgactgtttttcttttctcattacagaataaacaaatcatggttaagtgaatagaaccaggaggggatggcgattcattaaggccttgtttagttttaaacttttttcttcaaacttccaacttttctatcacataaaacttttctacacatataaacttccaattttttcatcacatcgtttcaatttcaaccaaacttccaattttagcgtgaactaaatacacccttagtttttaaacttaccagatgattggggcgaactaaagaaattattgttggactaatgtattggtgttgttctcgtcgagaatctgattcttcgtcgccaaccttgatggggaagcgcagtggaggaggcggtggtggttgggacggggatgtggaaggatggacgcaacaattgataggggcggatggcggcagaactagctgtggtggaggtcgtaatgggtgcgggggtgtggcggcggcagaagtggtgggtggtggtgatggggaggtgtagtggaagatgtaacggtgaaaacaacgggaattggggcggcaacgaaaaggttgggaggcatttgagatttgtttttcgctcttggcctcatgagcgttttacattcgcgaggcttctcctgttctccaacagtgccgcacacacacggtgtaggcgcagccgccaccacagctagcttggcaaacatgcccagtgaatttgtagctgcattcgactgtcacttttaatccgatgatgtggcacattctaatggtcaaaaagtttagtattttcactacttagatattagaccctgtcggagaatgaacacctccaccagggaaccgtgaggcccccttttgtgagttcggccgggggcagcgggtgagattcgaggattcggtgagcgaagatgtgtgatcttgagggggttcaatcccctaaagacgatgagacaaatggggtttatacagtttcgggccgctaagaagcgtaataccctactcctgtgtttgggattatggtcgagtgtagaacacaagtgcctggggttgctagactcaagcgccagttcgctcggaagtccccccctccaccactaggcctggacttccttttatacctcaaggggttaccacatgggcccaacaacctaacctagctccggtggagaagtattataatctttgcattaaatgcatgtcttgtctcttgatttgggaagccaagcgcacgtcgtcttgatgatggggcctgtcaaaccttgccgcctgacacggggggtgcccctgtcagtcaccatttaatgggtgaagacttctgggctcctattacaccgggaaacgagagccttgctttgaccagagcgggaggaccgactccggctgggataagaggatgagaacctctcaccatcattatttgatgggatatgtcgggctgcacgtcgcctgacacacgcgatggtgcgcctgacatcctgggtcccatcagtcattcgaccggtcacagaccggttgagtgcactgcacaccgcattaaatgcggcgtggcgcgaccgctcgggttgccattaatgtgggtaggtgggcacctggaggcggacacctaacccaccgtacgtggtgacctagagagggggt

SEQ ID NO: 2566 - DNA, 12723 bp, Oryza sativa
tcgggggagggccacgtggcattggggagcagcctcctccaaagagtctatgtaggagtggccgccaccccacttcgggcctgactcccctcgggggagggccacgtggcattggggggcagcctcctctgactagtctatgtaggagtggccgccaacctcacctcgggcctgactccgtctttgggaaggagtggccgccaccccaccttgggcctcactcccctcgggggagggccacgtggccttggggggcagcctcctccctctaaacatgatacccccgggcccatatcaccgacatacccctagtaaattttattctagattaggccagcagtgggtggagttggcgatgggtggcaacgagatatgaggttagcaggtggtggtcggacggcgacaaagactagaaaaaaggtggtgcaggggaatggtgttgccgttggcttagtgagaagtgagggagggaggtggggagggggagaagggataagcccattccccccccaagacactagacatagtttctataaactccacatcgtcaagaaactagtactagacactactcttccaatgcaaacaccactattccatacttaaatttaatgctacttatctcacatgatgtcttcgatattgtgtagaaaccatgtctcatgcaatactctctccgtcccacaatataaggaattttgagtttttgcttgtaatatttgaccattcattttattcaaattttttttacaaatataaaaaacgaaaagttgtgcttaaagtacggtagataataaagtaagtcacaaataaaataaataataattttaaaaaatttgaataagacgagtggtcaaacgttgcaagcaaaaactcaaaatcccttatattatgggatggagggagtatatagattccttttatttcctcatttattcacttgccacatcatttttcattctaggtggcaacttatttaatactatgaacactatcctagtcattgggttggaaatggcctaatgcttactattgcgcatgaatcccgatgcatgtcttagacgtaaaaaatttggctcaaatttatgatatttttggacacctgaaaactaaaaaaattcataataaaatcaagtacttattttgagtaagtcgtttttatactagtatagtacacacggtacaagctgaggttcacaccacaaatgtccaagctagatgcatgcaagtgcccagcatggtagcacgagcatctggtcggtctttgggacggaagaactcaacgagttgctagttctgaattctgatcatccagaaacgggtagtccgtgtagcccaccacaggatcagaggtatagaacgtgctcctgtcatacttgttcagacctgccttcctcctgaacctctccggcaggtcagggttggccaggaacagccgcccgtacgccaccaggtcggcgtagccgtcggcgaccgccttgtcgccttcgtcccggtcgtacccaccgttcaccatgaacgtgccccggaacgccttcctgaacggaagcaggcggccgtgcgcgatcaccggcttgctgccgtcctcgccggcgccgacgcacattctcggctcgatcatgtggcagtagaggacgccgaggttgttcatgaggccgatcacgcgcagcgcgaggacctccggtcggagtcgtggcagtccatgtagtcggcgaacggggagaggcgcacccccaggcggtgcgcgccgatctcgccggccaccgccgtgatcacctccgcggcgaagcggcaccggttctctatgccgccgccgtacgcgtcggtccggtcgttgacgctgtccttcatgaactggtcgatcaggtaaccattggcgccgtggatctcaaccccgtcgaaacctttgttagaaaatgagtagcattgttaagctgtggttactgataccgaagactcttaacacttgaggacgtagtatctggttaatatcgactaagtgtaaaaaaaaaacaatgtttcgtccattgacttttaatgttgttgcaatgattaaaaaaagaaaaaaagaaaaagaaaatatgtgtgggtcgatcaaaccatttccaaacactttactcgttgcaacagaccgaatcagcaattgcaacaaaatttcaacattatcgatacataacatgtttacggcggatatgtccgagttgtgtttattaccggcctcgatggcatttctggcagcaatacgaaagtcgtcgacgatgtttgggatctcctctgttttcagtcttcgaggaggagcgaattccagaacttggccatcatggctgacctgtggggtcacttgcttgtccgtgcttgagatgggtgcttgcccattaggctggaactctgaaaaaaaagaggatatatgattgtccatccttaaaatcaccagcggactgattgcatccatcttgcggccaactggacttaacaaagtgtcgagcgagcaaattcccaggagatacgaaaagatactcagctgatttggacttgacttcatgactaatttaaggaggagggggttgtcactttcattttagtggtctatttcaggaccataagaagataaggatatataaatatctgtctaaaattattattaaaaatatatcacaacaaatcaaaatcgttttggatgacaatacaaagtagagccaagcatgaatgagagagaaaaaaaggtagccaacaaatcacaaaacagcaccagttcattatcttaaaaaaaaagcacgagtttcaccagcgtcgatcagtgacaaatcatcagcagtgttgggttgcaaaaatttctgaaatgaaactgccgaggtgttgcttagatcaaactataaactaagaactacgaaacgcaaacaatatactttagataattagataaacttttagcgcatggtactatggcaaactgcagaaagatgaatcaaaccaaaaaacttaaaaaaaaacataaaaggacgacttggagaagaactaatcaagtatagatggccatgtgggccgcccggcacggcacggcctaggcccggccgtgcctgggccgaggcttgtcgggccggcacggcccgaccgacgcaccgggccgtgccgtgccagctcacgtgctgcactcacagcccaggcacggtccaacacgcctcgggccgtgccgggccggcccgaaggcacgatgggccatcgtgcttttcctcagaataagtctaaattttctccctcctattgggctgcaacattgtatagctaaaaaaagtctattttacctccctcttctttgagctgtggtatataaatagctaaaataagtctatttaaggtccctattctttaaacattgacatttatatgcctatttttagtcctatactttgtgtaccgggcctagccagccagcccatcgtgccgggccggcccgaccgtgccgggccagcccagcgtgctggtggggaggcccaggcacggcccgacagtcgggccgggccggcacgggcccgacccaagtcgggccgtgccgtgcttgggccgggcaaaaaggcgtgccgtgggccgggccttcgggcctcgggccttatggccaactatataatcaagcgagcgagcgtcaccctgcctgtcggggagacgcggcccgtgtgccatatctggcagaagaagacggcgcccttggcgtgcacgccacgcccccacctgctccgcgctccaaatcccgggcacgtcggggtaccctctcgccgtctccgacaccgcgcaggcttccgccaccagcagcgcgccccgcgccgcccgctgcgcgtagtacgcggcgttgtgcggcccgggcacgttcccgtaggaccggcaccgcgtcaacggcgcaagaacgaccctgcatcagtacgcgcgcgcgcgcacacacaaggcagaagcaaattgaagggatttgcatgaaacgtgcacaggagaacccgatcgatcgacgagaacaatagcatggacacgaacctgtgagcgagatcaaactggcccatcttgtaaggggtcagaagaggggtcgacgcctccattattgtgacagcttcgaccgatggttggattgttttgtttgtgcaagaaatgatgaaaaagaaggctgcgaggcgctgagctgagcttgttctgccgctgaaccttttataggcagagggaagttgcgtcactgtagtagtgtgttctgctttcgcgcgcgcggcaaagtagtggtgtcctagttgactttgcccggccgaaatggttcgctagctgggatattatagttttttttggcaatggcgtgtgcttgtctgcccggctaacggaaggggacgggcaggtcctgtcattgtggcattgtgccaatcagcggtcgatctaatcttgtatgaattaattactagtaatagactagctggtagtaccaagcaatgaacacaaggagatagacgtacataagtttctttttttttttctattgtaggtcacgcaggttccatagtcatagtgtagattattgcatctatgtgggccacaacacataaatcgatgaattgggacgaaagcgacttcacttttccttatattatatcacatcaaactgaacgaaagtgacagtttctgagaaaaaaactcccttcatccctcccaacataaattcatttttttatccatattacacatattaatataaaactaaaaatactataatattcctactttatcaaatcttaatgcaactagttctcactttatctatttccaacatagttacttcataatttcacaaaccctgatggaatgattattaaaaatgaaattatttcgagagagaagtcaaaatcttgtataaattaattactagtaatagattcgccggtagtaccatacaatgaacatatggaggtagacctgagtttctagtgtaggtcacgcgagttacatactttaagttgtcgcatctctgtgggccacaacattataaattgatgaattgggacgaaagcaacttctcttcttttattatatcacatcaactggaacaatagcaatggtttgtggggcgaaaaaaaaagtaatgagattgttcaggccttgagggtcacgtcttagtactactcacagattgtgacggagcgcacactatagttttgtttttttcagctcattgttttcttcatttcagacaataagttatcgtgaggcgcaaataaaaaaaaaagctatataggcatgtgtaaaaaaaaccatagacttggcagatttttttttcccacaaaactgtatatatctagttgtttggatggcacaatctacatttgccacaagacacgaaactattggagaaatgagcatgacatattttatggtgaacgagacttgtgcccatgaaggtggcaaaatacggcaagaaattaaaataatatgaaccaagcgtttgccttggttggtcaaatttggcttccacaagtgtggtaaatttgggtagccaaccaactaaataatccagctagaatccaaataacataaaattgtaaatttagctctcttttttttttttgaaatagcatgggcacatgaatatatatgaggtggtgaaggaaatgggatgtgtattccatcctacccacccaacctgaagctcgcgaggaggaaatgggcaagaaacatggagacccggtactatccgagttcaaattagcctgaatccgcacaaactatgagttagggataaaggaagagttctatctaaccgtatgtcctatattataaaaaatttatataaatctattaggaatccaagtagctacaaacatgataaaatattggttaatcactattttacaagttcataactaatatagcataaattcttacttatgtatctttttaacactctaattgcctccctagatttaatatctatgaattagtgatacaaataaatatccattcccaaatctaattccgagaaaaaaaaatgagataggatacatgatatctatgtcaaccagaagaacaggtggactaggggttcatgatatagaaaaccagaatcaatatttactaattaaatggttgtttaaactgattgatgaagaaggactttgacaagatcttttgaggagaaaatacttgaaaattgctcaattattcaagctggatggaaacaagtagattcccattttttattaggtcttatggttaaagatagattcttaaatttgggtccttgaatggttaataatggcactaaactaagattctaggaagacaaatgggtaggaaattattcctttcagaatagatacccatccctttataatatcgttcaaaggaggattgtttcaatcgcaatagttatgagttatgttccacttaatgtttcttttagaaggacgttggttgatcagaacttagataattggcacaatttagttgtgttgattttacatactaatatgaatgatagcaaagatagctttacagggaatctcatcaaaatggttagttttctattagatcaatgtacttatctttgattaacaatggtcattgttggtgaaatgggaactagggtatccctttccccagtgacccgagcttacattcttattccgtagaagaaaaaccttatttagtcgcaactaaagacgaccgcatgtcagggtaggggacccaggacccgccctacttcgggtcccaagggctcctatgttattctatgttatacatctctatctctctctccataggagtgtagatacatataaaatctatatctaagatttggatctataaattagcaaggcggagagcccggggccgcctttgaccgggtcctagtgctctacttgcccttctaggtcacacattcctccttgagaggagtgtggagacctataagatttacatcctaagataataagccaggggaagcctaggacctaacctagactaggtcaaatggcattccttacctttctagaccacacattcctcttttagaggagtgtcgagacttataagatttatatctgtggatttggaagccatgaggagcctgggactcaccctattccaggaacaaggacccctcaggctcttcttagttcgtactctcctttacgtggagagagcatggagacatgtaagatctacatcccgtggatgtggacttagtgtcctaaactcattcataatgtcttcgagaagctcgtcttaaataacaagactacctactaaggagcatcggggtgtgcccgagaacgagagggtccatgggtccagcccccaactagctatttgctagtatgtgaaagtccatgaaacgggttcacagctggatttccaagttttctagaggtgaaaagacatggaaaatatggcactgctgagtcacctgggacaataggagtgaagccgcgcgtcaaacatgcccaacgacacccagtagcgccagtcggcagaaaagtggagatgtgacattatctcggcaaggcttgggccctctgggcccaccacttggcgcgtggcgagctaaacaatggcccagttggcctcggtcatcaccgggggagcctagggtaatccaaagacaagatcttcaccagctggcctcggtcatcaccgggggagcctgggcaatccaatgacaagatcttcagtaggtcttgcattaagaggccaaagaaccaccaagcagcgacaagacaactcaaagccaaagtccctagcctacagcagaattgcaagcccctctttgaactataaaaggagagggagatgccacttagaggaggatgcacattatctagttcaagaatagttaaatcttgtattttctccatatcaagatagcaaaaaaaaaaaaaaacaaacacaggagtaggggattacaccttcgggtggcctgaacctatataatccgcgtgttcatttggattttcacagttcttaacaatttcagtcaatgcaacttcatctgtagttaaccccctggccgaatcttcactcggggagaggtctgcacctcccccactgttggttgatcgctcctccgacagtcatattgagataaataagtttatatagaaactaaaaatgtcaattaaaatcaagatttttatgtgtgatttctgttcaaaggactaattctaacctataataatttagcaaaaagaaattagaatggtagtaaaagatgctattttttatgagatatgagactatatattcaacatttttttattgtcatattagaaatttcgttggagagtagtttatattttctttgaactaaaacctcttaatagtatttctaatatacctaggaattggctttgtggtatcgattcaagaacaaagaaacttattttttttaggagcgtccacattatgtgggttcaatggttgtgtagaaatgatgtggtttttaataaatcttaaaaaaacttatggtgcaggtacttttaaaggcaacacactgattctagtttagggcattgtttcaaaagtgtgaacagaacaaggagctaatacatgttgcatgccaaaacttggaggttacagttatgcagattttcatcattttccgttggagatttacaaataaacttcaataattgtattatccttaagtgttagtgtatgttagtcaaactttttttggttgcctggattattgctctctttgagagaattatgtaacaagtgggtgtagcttctctgaagcaaatgccatattttattctattattaaagaaaaagaggtgcattacgtatgataaataaacaggagatcaaattaaaaacagaaaaaagagtttctttataccaccctcagcctctctgtgactttgcccctgatataggcttcttgcaaaatgctacatatacaaagtagcgtaacatgcatgtccaccactccattttattcgtaaggtcgaccacaaactagctttaatttattgctgacttgcaccaactttgaccatagtatcaacagatgggtcagtcgaatcaatcaaacagctagaggctgctcaagaaacgggtagtccgtgtagcccaccacaggatcaggcgtgtagaaggtgctcctgtcatacgcgttcagagccgccttctgcctgaacctctccggcaggtcggggttggccaggaacaatctcccgtacgacaccaggtcggcgtagccgtcgccgaccgccttgtccccttcctcccggtcgtaccctccgttcacaatgaacgtgccgtggaacgcccttctgaacgggagcaggcggtgcgggacgttgcggcgcgcgcggtgctcctcgatgctgctcacgcatgcacctcggctcgatcacgtggcagtagaggacgccgaggccgttcatgacgccgatcaggtgcagcgcgacctcctccgggtcggtgccttcctcgcggcagtggtccgcgaacggggagaggcgcacgccgacgcggtcggcgccgatctcctctgcgacggcggacatggcatccacggtgatgcggcagcggttctccacgctgccgccgtactcgtcggtgcggtcgtttacgctagccttcatgaactggtgaagcaggtgcccgttggccgcatggatctccacgccgtcgaaaccttcgtcaaagcgtaagactaacggtatcaataacttggtaagatctctagtagttagatggtgaaatattaccagctttgatggcatttctagcggccacacggaagtcctcgacgatctggactatctcccctgtttccagcctttgaggtgccgccggtgccaggtcatcggtatttccaaaatagctgacttgaggtgttactggattatctgtgtttgaattcggggcatgaagggaagtttatgtgaaacaataagagcatatataccgtaaaatgttctctttccaatactcccttcctagagaaaaaaaagagttgtaataaagaattaaacatgttaagtatacccgttgaaaacacgcgaccgttgtgccagatttggcagaagaagagtgcgcccttggcgtgcacggcatcaacgatcggccgccaggcctcgatttgctcctggttccaaagtccaggcgcgtctagggacgacggaagcgtgtagtggctttcttcagcaccaccagcattcccgctctcgtttaggcgtgacatgaaccaccattttgacaggttattccggtcatttacccctgattcagttgctttgacaccatctgtagctgaattatagtctgttaagttcgtgccgaaaagaaagccagggggacctggacgctggcggtggattggaccgttcgcagcgtcgtccttggatcgtcccaacgcagcgtaggagactgcgctggcctctgcaatgaggagggcgcccggcgtcgccctctgcgcgtagtagaggagattgtgtggctggggcatgctcccatatgatctgaaccttgataccggtgcatgtacaatcctgtaaccaccgccgtaagtttccgtaatgaattttagtaattttttcacggatttgctagaaaacttcccccaacagcctgtttggcaagagaagggaagatgaatgggagtttcaaggagggagttggtggtatgattggttatgggagttacatttttagttcccatcccttgtttgcgctgtgtttagttcagcgcaaagtttgggttttgattgaaattgaagatgatgtgactgaaaaattgtgtgtgtatgacaggttgatgtgatgaaaaaagactgaaatttagatctaaactttgaatctaaacacagccttagtcgaatcccaccaagtttcacgaattaataggcctcccccaggtaagagatttgtaggaattggacctcttaattccccatctcaaacactctcaaatcccaagtcttccaaccaaactacaaccaaactacagacttaaacttccagatatcataaactcccattccccatcaccatctccctccaaccaaacaggctgcaagttcttttcccccaaaaacactcagatttgtgaccatcgtatcacctcgagatttgtgcacgaatgaaaaaaattgctagaaagaaaatttcacacatatcacatgtcccagtgctagctaatcaaaccatagttgaatggaagttttatataagttatattatggttgcaacgcagttacattgcagtcataatgtaattataatgtaattgcactttaattatactgtagttacatataaaagtttctgcctcaaaaaatttgctgcatttatttttacatactcccaatttcagagcttgtaaaagtacatttcttaaaagaaaaattgtgcaaaagtacaatcacgtgtcccgtatatatgaaagtaacacattgtttgtaccaaagaaaagacatctcaactttcaggaaattttataggtggggtggaccgtggacgaactaatcaagttctttacttgagagtaactagttcataactgacctgtgtgccaggttgagctggcccatcttgtagggtgtcaggagatgagtgtcctccatgtgtgtttgtatgcttttgacagcccgatctatataacgcacctctgttcctttcgaggctatttcggctcgcttctacatcttctagcttggcatcttgagtacttatagtggaagaagaggtgtagttaattagtcatatcaaattacgaatcgtatatatgcatgttaatggctatgtgcttttctggtagcactcaacacgtactgcttaacaaccggagcgcgcgagccgcgaggattcgtattgatccggcagagttgacttgggaatgagaggattcgtgttgatctggctgttgacttcggagttgggaggggtttgcacgctatatacatcggtagtagctagacgctagatgcatggagtacgctagctagctagccccgacgccgcaccggcgattacacgaacccttttgtttctgtgtttgttttagtcccagaccatgaaatctatctattatattaatggaattaaaaaataagaaatattagaagagaagactaaagtccatatagaaatacaattagaaaataactgaaatttagaattaaaaataaggaacattagaagtttagaagtagagtatagagttcatatagaaatacaattaggaaataatagaaatttgaaattaaaaataaggaatattagaagtagactatagagtccatatacaaatacaattaagaaaaaaatagaaattcggaagtaaaaaataaggaatattagaagtagagtatagagtccatataggaatttaaaactaactaaaattcagattaaacataataaaatgaaaagtagtgtttagagtccgtataaaaatacaatttacaaataactaaaattcgaaatttagaaaaacatgggaataagagtttaaaatcaatataggaatacaatttagaagtaactgaaatttaaaatttaaaattaaagaatattttttttatcaagaggcgtgaaagcctctcatttccattactagaaatgatagagtttacaggaattttttttatttttaattttttttattaaaagttttacaaaaataattttccattttgaaaattgacataagtggtcgcctaccgccctctgggagggcgatttttaaaa

SEQ ID NO: 2567 - DNA, 3501 bp, Oryza sativa
tgcaaatgggcggcggggggcctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgtattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacatgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcataactgatcaaagttcgcgcattggaagaatctccggccccgagtttgtatcatgagggaagacttgagtatgcatccatccccacaatcgcacaaaggacggtcacaccatggtagaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgttgttatggactgtgcgcgctactggatctgacactaccgtgaagcgccgaaagtgtgttgttgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggacagaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacacgcccgaagaggtggcgaacgcccctgcggagctcgcgggagcgccggtcgtgcctgcgaacgcgctcgaaggcagacgaggtcctgcgatgaagaaacgtgccgttaaaacatggtgacatattcgtgcaaagctgaaacaaaaatgaactaatctctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtaccgtatgtcgaggtgctgctccgacggtaggcgcgcgaggccgtggttgtaccggaccagctggaggtacgacgtccacagtgctgcgacaggagaaaacgcgcatgaccgcacgcatcttctcctgcatccagtcaaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtcacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtcccc

SEQ ID NO: 2568 - DNA, 2490 bp, Oryza sativa
ccagtaagtccccatcgtgggaccgtcctctggccactgcgcgctgcgaccaaccccgtagggtgcgctgtccaccactggtcgacgtatggcaaacctcttggctgcccaaagctgaagcaacatagggcagccagcgatgatcgctcccgcgtcagtcttcgtgcacggcagaaccccagctccactgcggcacgtcctgtggctgagcatccacgatggaccgtgcgtagtggaccagccggaagtccacagcgtgcccgtgggtgctagtgaacatcacccacccgaacaaccacaacaggtacgcctcaagggagcgtcggaccgagttatcatcagcgtcagggtgcagaaggtccgcctacaattaagaatgaaatgttagtacaaaacactatgttgatcgcaaataagcatgtatgataataccaacttatttacttacagtgaactggagcaaccaagccttgctaggcccgactgtagagtacggaggaagggtgttgcccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctgaggtctccagcggtctaccagagcggcaaggagtgaccggtctgcatcccaccgcttcgctgggtcacggtcgtccgccgccgcctaacaagcttacaaagtggtagaaggcctgccgcacgcaacctgtatagaacaaacttcaaacataagtacaacataaagcaaagttgagttgaaatgtgaacatacgcgtaccaaggaacgtgacgggggtcgacacgcaaccacgcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattagttcaacataagtaataaatgttcataagcgaattactaacacatattaaacaagagtacaaacaaacaaaagtgtcaccatacggaatatttctgattacaacaataactgcagttacacgatatgagtacttagtccgaacactcatcacgataacattatgatacaacaccgaatagttcgcaatactactagtacaacaatagtcagaggtactcattacaacaacattcaattgaaattacacgatagaagtatttagtccgaacactcatcacatcacaacagcattttatttcctaaatcgatagcattgttacaccatggaatcgcgtgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcaacgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaatttttttgtatcgatccctaaagtacgcttgcgtgccgtgaaggatgaattcaacaatagcaaccaatggaagtacccgaactcctcgcattacccagttgtacacctctgccaaattggttgtcattatgccataccgggatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacaga

SEQ ID NO: 2569 - DNA, 1230 bp, Oryza sativa
taatttgttgacttgaccaccctaaactctctctgcaaggaaactgcccaatgcttcactgcctccttcatctcatccttatgagcataccttgcaccgtcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggtattagttcccaaaaataaccttctgttgcacgactcactacaactgatactgtcattgtgtagacttcttggtctattctaaatcctctcaacaaccaactataaattgactgaaatgttctctccgcaggcctatcgatgcccttagatgtcattacaaaatctgacagataacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaattacatcttacaattaacactactgtctatgtctcaattcatactattatattctatactctggatctacacatatgtgctgtgtgctacagatatgctaaaatatatggaactaaaactaaaacgcaacatatatactcaaacataacatattagtacaaatgtaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttatagggggaggcaaaaatcgccctcccccagggcg

SEQ ID NO: 2570 - DNA, 15822 bp, Oryza sativa
ggcggtaggcgactacttccgtcaattttcaaaatgaaaaattatttttgtaaaacttttaataaaaaaaattaaaaataaaaaaaattcgagtttacagagagttcagaagttaagtagcagacacaaagcccacattttgtcgggctgaaaacaggacaacactcagcatggtttctaagagaacctgcaaacatcctcccaaaacaacattcacccaggtgaaactaagctaactatcagactaaagaagagcctaaaggagctccaagccccagattcttttttcgttttcctgcatatccaagtgttgtcaacagtagccaattcttcttgccccaggcctccatccaaactttgagcagaagatatcatttgccacctgtcttaagagcttggcacccaagagcagccttcttcgatcggcctccgctttctgcaaaatagcccaggagtccatccaatgacagacaaaaaaaataacatcagtaggatcatttggcaattttttgtcaaaacaggctttgtttcttgttttccaaatggcccaaattatagctgccacaccaacaacaatcaggttcttcattttttttcccaaatgcagagatccaagagccaaagagatggttgctgtctgacacaggatttagatcaaaagcacagtagacagtgttccagattaatttggcaatgggacattcaaaaaagaggtgctggatagtctcacttttgtcacaaaactgacagtttaaactacccttcctccaccctctcttgaacatattgtctttagttaagattcttcccctgagcaagagccagagaaaaactttaattttcagggggattttgtaattccaaacctttttcagaggtgagctggcctgttgaacacacagagccctgtaaaaagatttcacagaaaaggtcccatgttttgtcagagtccaactaagtttatctttagccccttcctgaaagtccaactccccaaatttcgatttgatcttgttacagtcatgtagcttatccccatataaggatcttctgaatttgatcacctcccagcctttctcttttatcttggctaaggtaatgtgtttagaaaaagtgatattatacaaggcagggtactggatgttcaggggtctgccccctaaccaactgtcttcccaaaacaaaatagatttcccatctccaagtttcttagtacacaaagagtagaacttatcttttatttccatcagcccctgccaaaaatgtgagtcaccaggtttgttttttttaattgacattggtttctttcttaagtatttgttttttaaaatatcttgccaccaaccctcctcattttcgagtttccagatccatttcccaagtagggctttgttcataaggtctaaatctaggactttggagtccacatagaaatacaattagaaataataaaaaatcagaattaaaaaaaagaaatattaaaatacaattctagagtccatataggaatatatataatttacaaataactaaaattggatattaaaaaaattaataactaacacgtatataaaatacaatatgaatattacacattagtagtttcgtaatttaaaattatgttgttattgtaatatattttaataatataatgtgaaaacatatatgctattatatgagagaaaatataatgatgctagccgcgcaatctgcgcaggccaacatgctagttatattattaaaggaatagaaaaaggagcatccacgttcgctctcatggcttagaaattctcacattaatcgaagaaaaagaaaaaacagagtctatataaaaatacaatttaaaaatagctgaaattcggaattaaaaaataaggaatattagaagaagagactagaatccatatagaaatacaatttagaaatagttgaaattcggaattaaaaacataagaaatattagaagaggagactagagtccatatagaaatacaattaggaaataactgaaattcggaattaaaaataaggaatattagaagtagagtacagagtccatatagaaatacaattaggaaataactgaaattcggaattaaaaataaggaatattagaagtagagtacagagtccatatagaaatacaattaggaaataatagaaattgggaattaaaaataaggaatattagaagtagagtatagagtccatataggaatttaaaactaaacgttcgctctcattgtcaaggttacggataaggtataccctctacccttggatatacgatgtataccagtatggtataccagcgtgtatacggatgttccctgtacacgttaacgaattccatacctgcgtgtatacggatgttccctgtacacattaaggaattcatcgtgtaacagaaacggagtccacggatggaaggagtcctgctcggacagaaccgggtcgttactatatcgtgtggggtccgatgtctccgagtcctacttagagaccaactgacccgcggtataaaagggacctccccgggagaacttaagccatcgaatctcaccaccaacacatcgaccacagcctacgaagccgaagcctcaggagcaaagtcgccggttgatctagtcgaatcaactcgactatgatctcatcggtatcatcgagttccattattccctttgtaatctgtgacttccatcatataatcccacaccaactggattagggctattacctgtcaaggggcctgaactagtataatccttgtcttctatttgcttgatgtcgtattatgtagatcatcgtaccagcgtaccccaataccttctatatctggtctacgggtatcccccatcgacactcatggcctagaaattctcacattaatccgagaaaaagaaaaaccagagtccatatagaaaaacaatttagaaatagatgaaattcggaattaaaaactaaggaaaattagaagaggagactagagtacatatagaaatacaatttagaaatagttgaaattcggaattaaaaactaaggaatattagaagaggagactagagtccatatagaaatacaatttacaaatagttgaaaaattcggaattaaaaaataaggaatattagaagaggagactagagttcatatataaatacaattaggaaataactgaaattcggaattaaaaataaggaatattagaagtagagtatagagtccatatagaaatacaattaggaaatagctgaaattcgagattaagaataaggaatattagaagtagagtatagagtccatatagaaatacaattaggaaataatagaaattgggaattaaaaataaggaatattagaagtagagtatagagtccatctaggaatttaaaactaactaaaatttggaataaacataataaaattaaaagtagagtttagagtccgtataaaaatacaacttataaataactaaaatttgaaattaagaaaaacatgggaagaagagtttaaaatcaatataggaatacaatttagaagtaactaaaattcgaaattaaaaattaaagaatattgaaagatgagtttagagtccacatagaaatacaataagaaataataaaaattcagaaacaaaaataaatagtattggaagaagatcatagagtctatatagaaatacaatttatagaaaattcagaataaaaaaatattaaaagatgagtctagagtccatataggaatatatataatttacaaataactaaaatttgatattaaaaataattaataactaacacgtatataaaatacaatatgaatattacacatgagtagttttgtaaagttattgcaaaatttaaaattatgctgtcattttaatatatttaaataatataatgagaaaacatatatgctattatatgagagaaaatataatgatgctagccgcgtaatctgcgcgggccaccatgctagtttaaataatatttataacactggtaaatgaataactagcgttataagctggtagtaattcttttataatcatttaggaatggtgcacgtattatatgggggtattcgtgcaagtaaatttgttactttagaagagggtattcattcgagtaaatttgttactctaggaataaatggaaaactcaacacaataaattcgttatttttgaaacgtggggatacactagaaaaactgaaaatgaaaaactaaatggtaaatattttactaaaacgtgaaaacaaaaaacctagagagaaggaaaaaaaatctggatggttaatattttattgggtcctatgatgaagcatggataagagatgttaaagagaaaaaaaacacgaaaggcggggtggtaaaaaaatgaaaaaacgcgcgaactgagaaaaggtgggatgcggagtaaaggtggggtggtaaaaaagaggaaaatcggaaggagagtgcgttgtgcggcgctcgaactaatattccgcgcgcaacacgtgaattaacgctaccgcttaatgtatttttttcagagttcacgcgctgtttgaaatttgttgtacaacgagtactagttgcttgggttcaaatttagatttaaattgcaacacttatgaattgctcaaaaggcaaatatatgtacatcaggattgagatcctctgacttaagccacatgactttgagtcactggtatgtgggtcctctttgctatggacccacatgtcagtgacggtaaagtcacctgacttagggcagaggatctcaatcctatacgacattggtagaaaacacataatacatttatctttacatcatcatatatagatgcattgtgttctatgtatattttgcacaaggaaaaaatgttcttaataataacttaatatttgaatgcacagtaatgtacgtgcattctgtcgacgggtgatacccgtagaccgatatagagggtattggggtacgttggtacaaggatctacgtaatacgacatcaagcagacaaaagacgaggattatactggttcaagccccttggtaggtaatagccctaatccagttgatgtgggattatacggtggaaaacacaagttacaaagggaacaatggaacttgagggatccggcgagatcatggtcaagttggttcgactagatcctcgcgatttggctccttgcaggctccgacttcgtaggttgtgagggttgtgttggctccgagattcgatgccccaggtcctccccggggggtcccttttatatcgctggtcaggcggtttccaagtagaactcggagataatagaccctatacaatacattgacgacccagtcttgtccgagtaggactctttccattcgtagactccgtgaaggatttccttagtgtacgcaggaagtatccgtatgcgcgtgggtataccctaccaatatgtaacgtatatcgaagggtaaagggtatgcctaacccggaaccctgacacattcaaaatgtaatgcattatttctcaccataaaaaaatgctactaccaaaattcatttgaactgcaccatagtatacacctgcattaaaacttaatacattattttcttatagaagaaaaaaatactcccagaatacatttgaattgcacagcatttatagacagatgcattcgaattgtgttattaaaaaatggattttctcaatttttatagacatacggaggcaagggcggagccagccaagcggctgcgcatgctcaccgacaaaaactccattaaatttatatgttattgaatgaattgatgatgaaatttatataacaattactagaagtgaagcttgctcaggctcaaaaatctttctagctctgccactgtgaggagagataaaatgggaataagtagtttcatcactttggttcattggaatttggaatttgtgcgcatatattcgacttccaacttatgtcgatgaattcaatgtcttgctgctttaaattaatatatgaataacagggtaaaatttcataatttcaggtattaaatagataaagaaattaggtgtacttatgagactccctacattccatattcattattatataactttttcaccaagaccaacaaaaagtattaactttcctatatttcatttaatgtgagtatgtgtgtcacgccccgaactagtcccgaccggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaagcggaagccaagacttggaccaaacatcacagacacgacttgggaactaggccgaaaccctaaaactcatcgtagccggcttgctcctggaagaactcctcgtcagcaggatccgcttcatcttcttcagcaactgggggaggggattatttatatagagcaagggtgagtacaggagtactcagcaagccatgggaaataagtgtttaatgcaggcttcaaagaaaggctgttgtttttgcgattgattttatttaaactcttttctgaaacaactaagggagtgcttctcaaatgacatggatgagacagtgcgtctcgtccggtcggagtatgtgcaatgattcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgttgagggggtacactttacccacacgacattactaacccggatcatccagcccgtgcagaacggccacgactagagaccttaaggctttcatgacaaggcatttcgaaagccgacatgggttcaccatatgccaacgagaggggtcctagaccaacaccaggttaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacaccaggtacgttccccggtccgcggttttgaaaattcatttagttcgcaagcaccgacccaggtgtagggttttccaagtcttttgtaaaacccaagttttacccaagatgtttctcagattttaagtttgaaggcgaccgtcgatacctatgcagagtgcacgattaccaaggcgcaactaggtgagtacaagggaacatggtataacaattacaatagaagggtcaaatgcaacaaattaggtaggtccgccaatctgccttgcaaacgggacaagcagattaagtgtgatcctatcaatgcataatatttttcaagcaacataattaagttcaaatataggcttaagatgttcaaaggtggcttgcctcgctcgatatcttgaacttgatcctcgaaatcctcacactgcgggtcttcgggctccgaaactacacgcgaaacgggacaactaataaagccctattattgacctctaagcgtgccattagatagatcttgagatttgaggaattttggaacttgaacggagtcaaacggacttacggttgggaagatattgaatttctaagattattggatttctggtctaaaggaaaaggatttatttaaatcctttttgaaaaagaaaagaaaagaaaagaaggagggagggaaattagacttccctcgggcggctagggcgcggcccgagagaatggggcggctcggccgagcttaatgggccggccggcccaagaaggcggccaaaaggcgcgcgcgcgggcggggaggggagagagagagctggtgggccaggtccataccgcgtggtccctggtgggacccgcttgtcggcgactcggctcaccgtgagcgaggtgcacgcagggtgtgctagggtttggggagggaggcgtggcgcatgcgcgcggttcgcggaggacacggtgcggcgggcccacgcgcagcctcacggctcgcggtggaccgcgcgcgcgagggggcggagggaagcggcggaccggggtctgcttgacccggtcgcggccgaggtggcaccgacgtggcgcctacgtggctgccacgtgggccggcgggaggtagacgacgacgccggccggaacggacggtggacgacagcggcgagcggcggagcgaaccatggcgatacaggcgaaggcgagcacaccgggatgttgcacaggacgaggggagacgagccaatggctcggattcgccggagggagtccgtcggcggcggattacggcggcggcaaccggcggagagaaaagggggaaacggcgacgaggtcacgaggggccgattcccggcggtgagagcatctacgcggctacgggaatccacctcttgcgccggattaggaggaaacgcatcgaggaaggtcggcgacgagagacgcttccgagctcgggcggcgacggcggcgagcacacggcgagcgacggcagcagtcggggcggcgccagctagctgtggggaggctactcgtgctactacccgagtctaaggggaggagatggaacgaggagggagaacggagggaggcactaccgagacgaggcggggcgttgtgacgagaggccgacggcatgggagtgtcggagtgatctctccggcctcgggccggggaagaggaaggagagggtgcgacaatgtcgggttgggaaccgacctagggcggtcaagggagagggctagcgctcggcggtcgcggcccaaacggcgacagggggggaggatgacgccggcgagagggaaaagggaaaaagggggagagaaagggggcttgcccccttgccacattggggaaaagaggagagagggcgatgcgccagaggcgggggggagctctgcctctgtcccttggaagcacgcgcgaggagaggcggggccaagtcgatgacgacggcgatgacggccgggcggtttggagcggagcgacgacacgggcggtaggcgcgggcaggcgctgacggcggcagtgaccaggcggtcggccaccacggcgcgcgtgcgcgcgggaagcaacaggcggcgcggtgatttcagcggcgtcggcgggaagcggcagcgagggcagagggcgctcggctcagcgcggctcatgcgcacgcgtgagcagcgcacgggcagagtgggggagagggagagagagagagagagagagagagagatggagggggagatgggccgataggagttcggcccatcgaacccgagggaggcaaaatagacttttgcggagggatttgatttgggaaggatttggattcgggattgaactcggcaatagatcggggatttgagatctgagatggcacggacactagacaacaagcaaagtaacagattttgcaattagggtttttaagagatagttttcccgctaggcgccacgacggaacgggcgctacaatgtggtagggaaaaatcaagaaacatgcacactttagctccttctgggccccatacataagaaacgatagctttattacctcaaattcgtacaacatgcatgcaaactcaattttcatgcttaaatgcaataatattacaagtaaacgaagggtctatgattacgtgatgatcaatttgaaaattttaatttgtgttaaacgatgatccatataaaacgaatggagtattttatactagttggtccattatgcggcaaagccgcgtctattttctagtgttgacctatcttcaggggagtcctagagaagcgtcagaattgtcggtgctctctcctcgcttgtactccgcggatgcttcttttaataaagtaagtgttcgggattttcttttttatttaatttactacttaagtgagatatatattcctatcgttgcgtgtttgtcgcttagtatttatgttgagtgctttagtactaggactttgtaggaaaaaggaagttcctatacgaggctagagtaatcaataacttaggtgtgttgtctaggttagcgattacctttgtttgttgtgtgctctctgaaaagtgaggtaggtagtaggtgatgatagcgttgttcatcctttgtatccctccatatttggacacatcatagagctacatgccggactcagcttggtagactggggggagtcggtgcccgaagtaatcgatagagttttacattcaacttaagcctacttaattaaaaaccacaggaatcctccctagcctaagcctgccttctataccctcatgttttgctcagtcccttatgtacgcccgaattttagtttgaatctcttccatacacttttcattagttgaccattaaattcatataaaaaagatccaggggtatataagggaatgagtaaaattcaggggcatagaaaagattgggcaaaatttcatgggtatacaagaaattttctgtcttgaatgtagatattgtgttattctgggtatagcattataattcacgggcatgtattttaaggtatatcaggcatacgaggatatattcatctactatgttcaatgtttccatagatactttttcatttccatttctattaatggaaatggagggctctcgccctttgcaaaaaaaaaaaagatcaatgtttttatcttatgtaatttatttagttgatagatgtagtacctcccatttgattagctatctgtcatgtccgttacctacatgaaggggttgtttagttggatgccacaattttaaaggaacttgtggctacgcactttgatcaaattagataactgtttagttcattatcacgcttttgtagctcgtgtacccgcaagtcatacgcacaaaattttgccataacattgctatccttatggtcaatgaatttggtgccataaaaattattacgtgtgataaaatgtttggtaaaatggagcatcctaccaaacagctccattatattttggcaaattttgttacagcacataggaaaatgtggttttgctcgacactccctcttttgttacgaggcacaagaatgattttattattttcatccgttttggagagaatctttctgcaagagcaaaaatgtccctgctaattctcatgtagccacatttcgcaaaaaaaaaaaaacaaatctaaaacttggtaggcatatttgcgctaatcttcttgatagatggcctcgacatcaggccctcccaccaagccttcacatgagggtacgcatcaaacagcgacgcgcacggggtcgccatgaagtagaacgtgaaggggaagtggttcaggtccgcgaagctgaggaaatccccggcgaggtacctgctccccgacagccgcgcctcgtacgtctcgagcaccttcttcagcttctccaggctctcgtgaaccacctgctggttggtcgggaccccgcgcatgatggggaagatgatgcactcgaacacgatgggcgacagtgcagggtagtactggtgcgcctcgacctccgtccatacgtccaccaacgcggcctccctgatgtcgctctcccggaggagatcgactttgctcgacttgtacttgcgaagaatgtactttgcgattgcgcgcgactctgaaaaaagaggactagtaagtttgtatttgctgcaggagaagctgataagattgccgcaagtatttaacaattaacatggtcgttaattatttgggttttggtagagagctgcaggttggccatggtggccactcaccgaacaagacgaggtccccgtcctgcagagcagggatcttcccaaatggctgcagaaaaggagaggtggcatccactgtgtatcacggtggaagctgatacatacatatgaaaaattactgaaaaaaacagctggagaaattcagttacgtttcgctcgacgtgctctgggctgttctgctcgccggcgaggaagtcgacggtcactagctcgtagtcggcgccgacctcctccaggcagaccagcacccgcgacacgttcgtcgagatggcccggccaaacaccttcaccggcgacatgccttctttcttttttttcctttgtcctcactgcagcttgaagatgacactgcaagtgcagtgaagacgatgacccactgtagcgcggatgcaaggccttggcagagtgcccttcacttatataaagcgtagcgtcagaagaagcccaactgcccaagtagtcatcttcaagtcttcgttgaaattgtaaaaatcactcgacaattttcgtgcaaagagggaaaaaatgtcagtggcgtgcatggaggagggaaaaaaagagggaaaattttggaacaaatttatatgcaatttatataagatcaatgtgtgttttgattcttattctgtgatgaacaattggcatttgtgattattggttttgatatttgaagattatcgtcgaagtggttttgtagataatcaattttcaggtgatgatcggattcactgttattttatgtgaccggtccgaccgggcggaggttgccggtcagaccggtgctatgtgtgcggtcagaccggccaggcccgcggtctgaccggccgacgctgtgtcggtttcggtttcgggttgtttctttggatatccgtgattatttcatggttatggcttctagatggatactatacgtatgtaatactgatgtttgctaacaatgagtcaagttggggatagcttggtctcggaatatggtttctctgtttgtttcatatgtaggtgactcgatgtctcgggagagtattgcggtgatggaccgggagtcagcttggtggtaagacgatgtccgtggtggtcagatatcatgcgggatactaaggctagagttgatgcacgtggttgatggagattccatatggcatacgatggaggtattgtgtgcgtatgggatgcagagtcgaatttggaaggacaccaaatttgatatgattggttatgtaaagtttgtgtcttgtactagagggtttcctaaggtattttggactcttagtatgagtttggttcgtgctttaggctgcctacctcatgtataaatagagggggagcatgaggcctcccggtatcgctttttgtatcggtttttgagagcaatagagttgctagtttagttagggtttcgagtttagtcgagatttttgtaaggagtgctgttggtgcactttgtaaacacagagagaagcaataaagttttcatctactttgagagttcttcgatttgtgtttcactgggtttcggcggtctaactggcaacactccggcggtcagaccggcggcaaggcagcggtcagaccggcgggtgacctgcggtcagaccggcggcggcaactggagctggcgattgatctcggtggttcgaccactgttacaaccttagtcagaccgacgatatccaggtggtcagatcgatgcatctacttcggtcagaccgcgatccgtcgatttcgagggtaacttttatttccgctaaaagttttcggtttttggttataccaaccattcaccccctctggttggctttgttcttgtgattcgatcctacaagtggtatcagagccacgtttgctcttttcgatctttactgatcttgagtttttgtcatggctacttctaataagtttacaactaagcctcatgttttcgatggaacggatttttctcattggtgtagtaggatgcaatcttacattatggctgagaattatgatatttggagaaaagtttctcatccttatgtgattcctgaagttattaatactgctactgcaaaaactgagtttgaactaaattgcaaagctcgcaatattcttttgagtgggatttctcgttcggattatgatcgtgttgctcatcttcaaactgcttatgagatttagactgctttgagtaatttttatcaaggaacaaataatattaaagaacttcgtcgtgatcttttcaaaaaggagtatattaaatttgagatgaaacctggagaagctttggatgactatctttcttggtttaataaaattttgagtgatcttagatctgttgattcttcttatgatgccaattatccacaatctgagatttctcgccactttttgaatggtcttgacatgtctatttgggagatgaaagttacatctattcaagagtcagttgatatgtctactttgactttggattcgctttacacaaaactgaaaactcatgagatgaatattcttgctcgtaaagttgattctaagtctagtgctttggtttcttcctcgacttctttggatgttggtgcttcttcatcgaagtcttctgatcttgctttatttaatgccgtgtccgatgatcaactcgaacagttcgaggaggaggacttggttttgttatctaccaaaatttctcgagctatgaaaaatgttaggaacaggaaaagaggtgaaccaaatcgttgttttgagtgtggtgcacttgatcatattcgctcgcattgtcctaagcttgggagaggcaagaaggaagatgattgtaaagtcaaagatgatgacgtgaagaagaagaagagcatgaaggagaaggagaagaagaagcattgcatgcagtggttaatccaagaactcataaaagttttttatgaattggaagatgaagatgagggcaaaggtaagcaagttgttgatctagcttttattgcttgtaatgcaagttctgatgttgatgaatctgatgatgataatgaagaaaatcttagttatgatcaattcttgctgcttacaaatttgctaagaaacttcaaacatgttctattgtgcttgatgagaaggatcgcactattgagattctaaatgctgaaatttctagattaaaatctttgattcctaatgatgataattgtcaatcttgtgatgttttattttctgaaattaatgctttgcgagatgtcaattcggttaattgcaaaaaattaaaatttgagattgaaaaatataaaaagttggagtcttcttttgctcttggatttgctttacatgctcgtgttgttgatgagttgattttgacaaagatcgttttgaaaaaataaaaagttgctttctgtgcaagttctttggtcaatgcttcatgtgcaaataaggcaaaacaaaacaatggtattttgatttctcaagattgttcaaagtgtgttttgaatgagatgaagttgaaaagatgctttagggcgtgttaaacacatataagatcaatgtgtgttttgattcttattatgtgatgaacaattggcatccgtgattattggttttgatatttggagattatcgtcgaagtggttttgtagataatcaattttcaggtgatgatcggattcactgttattttatgtgaccggtccaaccgggcggaggttgccggtcagaccggtgctatgtgtgcggtcagaccggccaggcccgcggtctgaccggccgacgccgtgtcggtttcggtttcgggttgtttctttggatatcccggattggttcatgggtatggcttctagatggatactatacgtatgtaatactggtgattgcgtaacaatga

SEQ ID NO: 2571 - DNA, 806 bp, Oryza sativa
ctgctcttgaggtccctaaaagaattgtgatttaaagggccgctgcttttgggggtgttggaagatcttggactgtttcggtctttctgtgtcatggggagatgcctgatatcatgcctggggatgaagatcttcctcctgtgaatcatattcctatccctgatcctgtcctacagccggcatctcatgtggaagtctttggggataatatgcaagaggatgcccctgctaatcagcaaatttctcaaaatagtgctctgtcagtggtggctggttctcataacatggtgctgcagaattaggggattatctcttttgaacatcttgtgcagcctcagtttcttattaatccattctttttgaggattctgtctgcttttaacatagctctctctacttgggaaggctctttgtctgttcagaatcagagtcccttcaggttgctgtagctctcacctcagtggtctctggcattgggcccccctcaggaccttcagattgtgcccttctctttgcctgttattcatattgttcagtttgctcttctagcagcagtcctgctggtggttggggttgaagacagtgagactcaacagaccatgttgggccaggaagatttggaggcccaacattttgaaaatgctgaaataattgagcccattagctgtgtcccccctgtgtaacatgtctcagatctgcccctggacccttttcagcagaattggtcctcttgtcggccttccttgaagaaaagcaaaaagaaaaaaggtaaaactatggttattgtggacactgatcgtaggagg

SEQ ID NO: 2572 - DNA, 1012 bp, Oryza sativa
acatgtaagtttcccgatggagggtggcactagtgcctacctgatcgtgggattcccgacatcacggcgaagttggaggcggcagcggacttggtgacgacggcagtcggcggtggtattgggtagagacttcggctagtcctccatccctccctctatcatcgaaaaatgagggttgatagcggtgggggctagccctcccccatgatggtgggccagttcatatgcatggtgactgtggtgaatgattggttcggtgatggcagataaagtcggcgatggtggaggctcttcccggcggtgtcctagggacggcgacactaggcgagctccagcacccgaatctgactatggccaagccaggattgcagaaaggtggttgtaggtgacatggatgattgacaatgtgatgatcatcgactcgcctaatgcagatgaagacaagaacaacagaggctctcagcagtagctgccaagcgagcgttggcgccaatatatgagtgcgggtaggtgtggatggtggtggagcatctctggcaagctcatggcagtaaaggcaggtgcatgtcgtgctgaacggctctgtgtgatgctctaggaacggccgggagtttgaaagtttgcgggaaatgatggtggtgcgacatagcggattcgcggcgcactaggtagtttcaattctccccatcctccctctcatgctgtgacaaaaggagtaagtcatctttgatggttgaagctaagtcttcaagtagctttttttttcttgttttcttctttgtttcttctatgcggggtttagagtctaaataactcgtataagatttgaatgtgtatatggttcatggatatagagaccaaatttaagaaaatccatgatcttaaaaaatgttgcattaaaaatatgaaggtttgaattggaaatacatacttccttcattttaggttataagttgttttgactttggtcaaagtcaaactgtttcaagtttgactaaatttatagacaaat

SEQ ID NO: 2573 - DNA, 597 bp, Oryza sativa
tgggagatgtcttggctgtaaagacagcggccaaatcatcaggaagtctcatcaggattgagggataggaccgtcgtcttgatctggtcgcggaggagtagattggatctcgtccgagtggtttgaagccgacccgagagagatgatcttggagtaggcctcggccgagttcggaataccgaacggcgcggggacatggtctctccccgactggttcgaatccgagtcaaggagagagatcttgctgaggttgttggtgatgaagttgaggctatcgaaccggaacgcctgcccgggagggaaggcgaagtcgtcgatgccggagacggaacccatcgtacttagtcagcaaaaacttgatgctgcccctacctggcgcgccaactgtcgaaacaagatttcggcaataataaaaagggggtggctatcaagctaggaaagtggatgggtttgaagacaaggaattttatacaggttcaggccttcttattcaaaaagtaataccctactcctgtccggggatgattccgccgagtatgttattgattgtataaactggaaaaaagatcacgcccccgcacacagacccctccttat

SEQ ID NO: 2574 - DNA, 1104 bp, Oryza sativa
cttgtttatgtgctgttttggtgattttgcttctttctgtttagattccgacgtttccggagagtccgtttttgcaggagaagaatttgaagagttccaaggccagcaaggcaagtcacacagatcccaaacaaccctttgagcatgttgatcccgtttaaagctactgtttctattcaactattgcatttattttcgaatgtcattgggtgaaattaacctattgtttgttatagcccttttgttcttgattactttattccgtgataccttgggttattataacttgactagttgggctatatatattggttcagctagatattagatatgattgcttagccatgcttagaaacattagcacactattgggataacttttgactcactattgtttaatgatggcttaatgatagttcacgatggtcaatcgtgattggttaattaattacatgccaactaaaacctgataatggtgggttgtgagcacatggttttaagagtcgtgctcatgacaattaaggaccggttcacgagtttcggttgtgaaacttcacgagtttcggttgtgaaacattaaccgtgccaaccacaagccagcgtgggcaacggctttaccttttgtatagcatggttcattgcggagcaccagactgagaagtggcggagataagcccacaggggtcgctccagtcatcgtcgtcgctcaggaaggtcgccatcatggtcgccgtcatgtcgccgtcctcgtccgctcctccgccgttgctgtagaccgccggagcaccgtcgccgccgtcgacccgatcttctccgccgcttcgatctcgccgccggtgccgtccgttgatcttccgccgcttctttggtcaccggtgagttcgccgcgtcacgctctacgtcctggtgccctccgttctcgtcgtcgcgccgtcgttcgccggcgagcttgcgccgcccgagccgccgccggtggtgacgtcaccgctgacgtcatcgtggccgtttgccgtgagccggtcgtggaccgttcgatctcggccgtccgttttggatggatcgatctcggctgtacagttccatgaaccagcggcgtgcacccgg

SEQ ID NO: 2575 - DNA, 6611 bp, Oryza sativa
atttgaagagttccaaggccagcaaggcaagtcacacagatcccaaacaaccttttgagcatgttgatcccatttaaagctactgtttctattcaactattgcatttattttcgaatgtcattgggtggaattaacctattgtttgttatagcccttttgttcttgattactttattccttgataccttgggttattataacttgactagttgggctatatatattggttcagctagatattagatatgattgcttagccatgcttagaaacattagcacactattgggataacttttgactcactattgtttaatgatggcttaatgatagttcacgatggtcaatcgtgattggttaattaatcatatgccaactaaaacctgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacaggggtcgctggggagtccatgccttgtttataagggggtgattatgatccaggaaaggtgcgctgtagtggattgtgttgtacgagaggtaatgtctgtcacgcccggaaattcactagtaatttccgaacttatttgtgcatgaaatcctcgtccaggaatcagccgaggtacacaaattgacaatttaatatacagattcatcaaatacttacttaagaggcacttagtcctcaccaagaagaaaattgcagtggaaaataaaatctagcgaagctccggctccactcccacaggcagctcaactgcggtataagccaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcgtttagcaaaatatttaagagaaataaaacagtagagtagttaatcagaaattttaatcaacactgaacagcacacccatgctgcacaggcccgaccatcctaaacaaccatacccggctgtacagatctaatctccaaaccaggagctaagcaaattattaccagttataacatcaataattattgtgagaggtgtgagactaatcacgaaaaacattgctcaacccgcccataaccgcgggcacggctattcgaatagttttactctggccagaagtgtaccactgtacccacaagacacagccccacatcatgtcaccatgtgcctcagtaccaccacggtacctcggaaaggagctgtgacattacccctcgcataacacaacccaccacagtgcacctttcctggatcataatcaccccctcaaaaaccagaggcatggactccccagcgacccccgtgggcctatctccgccacttctcagtctggtgctctgcaatgaacaatgctatacgaaaggtaaagccgttgcccacgctggcttgtggttggcacgattaatgtttcccaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagttatcccaataatgtgctaatgtttctaagcatggctaagcaatcatatataatatctagctgaaccaatatataaagctcaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtgttcaattaatcttcttgaatacttccggcgcactcgcgaaccttcgcaacgacggaaacgacaaactaacacgcaaaacgaagaaaaagactaataaaaaccaaataaacagtacatataaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagctaagatgaattagttatgaatttttaaagattaaatcggattaaaacacttatattgattttaattgaattaagacgcaataatgaattatttttgaaaaggaaaagaaggattattgcgtcagcggctagggtttgcggtggaccgggtgcacggcagcggttcacgggaacggacggccgagatcgaacggtccacgaccggctcacagagaacgacgacgatgacgtcagcgacgacgtcagcaccggcggcgactcgggcggctcggacggcgcaagctcgccggcgaacgacggcgcgaggacgcgaacagaggacaccaacggatagagggcgacgcggcgaactcaccggtgaccaaagaagcggcggaggaacaacggacagcgccggcgacgaggaagaagcggcggcggagatcgggtcgacggcggcgacggtgctccggcggtcttcggcggcggcgaaggggcggacgaggacggcgacgacttggcgatcccgatggtggcgacggcgaccgacgacggcggctgcaacggcggcgcggcgcggctgaaccgacggcaacgacggtggcgactagggctacgcggaggcggcgctagacacgacggcgggctaaggcaaaggtggcggcgggtagaggagatatcgggggtccttatataggtgcaaggaggcggcggcgaaggcccacggcggccggcgacgagaaggaaagattggggaaaaacgaatccgaatcaaactcgaatccgcctatttccaaaggaaattgaccggagtttctataagagaaaaggaagaggagatcgagaagatcatttcccctctattgatttcaccggatcgggaaagacgcggccgaatttggaaggagacggcggcggcttgcgctagggtttcgggcggcggcggcgcgaggaggacgacgaccccgacaagtgggacccacctgttagcggctgagagagagaggagagcggcggctcggcggactgggccgacttggctgactgggccgggaagggagagagaaagagaggttttgggccgactttcggcccaaagccaaaaggaggattttaaaacctttttctatttaaattattcatgaaatgcaattccatttattaaaaatacttccttagctcaaataaatcccagaaaaatctaggaattatagaattaagcaaagtatttaatgaaattttatctggccccattttatattgagatttaacaaattaaaattagatcttctcttctaggcttttaaaatcatttctaataattccttttaaacaacaatttataatttaaggattttaaacaagaaaagcacttaacaattataattagatcattattgatcaaataattactgaactgttctttgtatcatttaggaattgagctctgaaaaatccgagaaaatttcagagagtatacttaatcatggagaatttaataaaaattaaatccatccatgccttagatttaggaaattttatttcccacatttaacttcacttgtaaattaaagaacatttaatataaattctattaataatttattaaataatttataaatcctgaaacaaaaatcaggatgtgacaatgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacccttctcatcataataaaatgtgctttaattggtaataatttgattagctcctggtttggaatggtatattcctggtttggagatagaactgtgcagccgggatggttgttcagaatggttgggcctatacaacagggtatgttgtatagcgttggattaatattgcctatcccttaactgttttattaaattctgaaataattatttactcctctttaagccaatgaaaccctactatgccatcctttgttatcctgtgaccttgcatatttgctgcgtggcttgctgagtatgtcatatactcacgttgcaatcattcatcaaaggaagagttctccaatgatgttgatggtgtggaggattaggtgtagccctggtcaagctgcctgtggagtggagtcgtctgcgccgtttatcttatttttctgctgcttagatctctattgattgagaggaactatctacctctgtaatgacattttattcgcttatttaattagagtaataatggtactctattatcaatttgttattgtgtgcctcggctgattcctggacgagggttcacgcacatgtaagcgtttggaattttggatagaaattccgggcgtgacagttcgtccgaacactggtgatcgccgttgatcccaggttttggcatggacgctccagatcactccctgatgacggttgcggggtagttcggacatttccccttctcacaaccgtcataactgccctataaatggacctcactccctcactacacacacttccaagcttgagctgaattataagaggctctattatactatattgtgtaatagaataggaagagagtagagtagaagaagtcggaagaattccggagttgtcggtaatcttctctcagttcttttattctgtttatactctgatttcagtataatattcttcctgagtaattcagatttatcttgtgagaattatctcttggttagttcctaaatagtatacgggattattgttcactataatcaactaaaatatagtgattgctttggtgagttataaacagctaaaatatagtgattgaaagtttgaaacagctaaagttcaccctttttgttgcagatatgcaatattccttgggtgagcaccaaatcaatttgaaaatttctaagaaatttatgtatttctgttgactaagtagatgacgactacggtatttgcagagtatgaggattgttggtaccggggtatgcgcgagattgaggtagaaaagatgggagatagggatttttatataggttcgggccccttatttgtaaggtaatggctctactcctgttggccgaagccggtgttcctcttattcatcaggatcacacaagtacaatttaggataacctatctagtcatcgtcgacttggcggtatggaacaccacgcgtagtcgatgatggggtagtcttcctcctggaatatgaacttggcgagattagagataacgctagatccctcttgtcggcctctgtagtatcagattgggtatgtctaggcttatcttctgatgtcgatgtttggcagtgtgtattggtgtctattatgactgactgtgtcccctctcctcctagggggtcttgtatttatatccacagatatctctttgtctaagtagaacgagagagacaagtatggatatgatatgagtagtccttgtagttttcatatagaactctgcctctccttccttatccggaataccttctgtatatgagacatgactccgcataaaacttagtatatggtgccgcccccccacccccggagcctaaccaaagactattgggtatgccttatctataacactaacaatttcttaatttaatccgtctatgagtaaattattttcatgcactctacggtaagtgcaacaaaatttaagaaataggatagatgctaaaatataatgtaactgctgacctatttctattcccttcattttatattataaaacgctttgactttatttctatcaaacttctataaatttagacaagtttatagagaaatagtgtactatctccatttcaatataaagtattttgcctatgtatcaccctttttgtattttgagcggaggtataacatcaaattagttccattaaatataacattaaatataattaaatggtgtgtttgtttggtgttaacataacattaaatataatttgtaccagcggcatccggccgagggtcattgtttttttcgtgtttggttattgatgtgctattgggattggttatataacacttgctttcacaaaacttatgccaagctaaaacatattccctctgtttcacaatgtaagactttctagcattgcccatattcatttagatgttaatgaatctagatat

SEQ ID NO: 2576 - DNA, 5658 bp, Oryza sativa
atatgtttagattcattacatctatatttatgtgggcaatgctagaaagtcttacattgtgaaacggatgaagtattttaatattgatgagaaatatatattgtaattcctacactttggtgttgcttaggttcacaagaaagaggaaattgtcctttatttttcagttaggatttggacaagctatatgttctgaagaaatttgtattacgagcaaacggatacaccaaacatgctgaaccgccaagcaaattattccagtcaggcaattggacttctatgaatcttattgtatcaaatgcacatgctcagaaatattggcaaagctaacgaattctccggcgaggtatgtgttctccgatagatgtgcctcgtacacctccagcaccttcttcaacttctccacagtctcatccacgatcttctggttggttgggatgccatgcaaggccgggttgatgatgcactggaacatgattggcgatagtgctggattaaattggtgcgtctccacctcggtccagagatccaccatggctgcctccttgaggttaccttcacggagtagatcgacctcgctcgtcttgtaattgcggaggatgtactttccgattgcgcgggactctgaaacagatgatgcaatgagatttctttgtttttaaccatgttttaaatgtgatagtttattttatagtaaaaatagttacgaaaatagtttgcacgcctcgtggtggaatctctcctttcttgaaatgcatataagtagtaataaaattttttgattgagccgaagaaatctcttttggctgttggatatgccagtcatttgtttggctctgtgttagcaatcatgatgacagaaacatttccggtcccttcgaattacaggattgagaaaacgtaggaatataaaaaacgtaggattttgataggaataatgcaagtgtaaaacagaggattgcaaaacgcaggaatgaacgtttgattgaaccgcaggaaaaatgcaggaattggatgagagagatagactcaaaggaaagttaccaagaggttgaagctcttgctaaatttcctccaaaatctctatagaattgtccattccataggaatttcaaaggattggattggattcaataacaaagggcttcataggaaatttttatacagaattgaaatcctccaaaattcctattattttcctccaaatcaaagggacccgaagaccatgaattaatcatgaacaatagtagccaccgacagctcccgactcattaaatttagaggtaaaaaacagagtaaccagaaagtattaaaatggtacaggtgcatttctcgggtagataacatatataatcgtcgatagtgagacatctattatctattatgatttctttaatcttaagatataccgactcaatcttcaaaggagctaataaagatagggatgtacgtgtgtgcatttattgggtaagtgtgcatgggtttatatgagcgtatgcttgtgtattgtgttcataaaaaagttgatataattttttctgagttatatttaattttaatcctagtgtccataatattttacacatggatgtatattatttagtgagattaaacatcagaggttgccattaacctctgaatttttaagaaatcgtaagcctccgtctctttaacaaatgaaacaatatatgaaatgtaatgtttatcccttgttcgtatgcctattcaatgtaatcagaaaaaaggctgataagttttcatttgagagttgagagcaagaattaatcgaagccaaaatcaagcatatatactaacaaaagagatacagatccccgtcctggaaagctgggatttgcccaaacggctgcaagaagagaaagaaagcaccattcatggcgtcgccaaattcaggaattcaggagcagagcagaggcggcgcgctggtacacgtacgtacgttgcgctggaggtgttcgtggctcttgtgttccttggccttgaagtcgacgttgtgcggccgtctgaggtcccaaaatctaggggccgtatacacatacggtatatatactacgtacggtataaatttagtccacgtgccatagatctatattaagttatatagctgaatagcccaatacagaaaataaattttagttcatcgttaggcctgttttagcgaagccgaagcgatcttcatttgactcccatcgctttgccttgatcacatcacgccactcgcgtcgtgccgcctcgatcacgtcatgccgctcgctgcttctgcgctctcggtgacttctcggcgtctcgcaaacgaaaacaacaagttggcaaatcgcgactcgccaatagccacgctcgtgtcgatcgtccgccggtcgacttctctgctcattactgctatttatttttctttgaagttttaaaatgttatatatagataattttgtcacatcgaatattaaatggtatgtgtttataagactatataaatatataaattagtttatctatacatgtaggggactccatgtaagtttttgccctcggccctaaaaccccaggaccggtcctgttcaccggcgccatattctccgcgcgcgatccgagttcatggcggcctcggcgtgtgcaaacagaggatcctttggagctagctggtgcctggtggtagctttagcgtgcgatttctggagagaaatagatggattggttggactagttggtgtggtgtgtggacagtgtggtgtactgttcttgtgggacaaaagaagcagaaagaagagcaaaaatgttatcgcttgatactttgatgactcgtctagggtgaggtgagtgtcggtaatgtacagtgccttctacaaacaatattatccttttggatttggaggattctgaaggtcaaggtgctggtgcttgagacgtcagctccatccgaactgggataaaggcccttcaaactttcaacttttccattacatcgaacttctacacacgtaaacttctaacttttccatcacatcattccaatttcttcaaacttccaattttagcgtggaactaaacacattctcaagggtatatccccttgtttttgcatgtcacttaaaaaatcatcaaaaaatttaaaaaagatttatatgatagatcaatatgtgatatgtcactttatagatatgcatattcaaattcaacttatacaagtagaaacgaaaataataaatctgactatgaaaagaacgagtaattcacaatcaattttttaattgtataagtcaaattttaacttgcatgtttacgaaaagatatttcatatatatattgatctatcttgataaattttttaaaatttttttgataaaattttaaataccatgtataaaacgataggatatccttcgagggaaaaatacacttccatcatcattcgcattcgcgctggggagccggttgcgcatgttacatgttgtaagaaaggacattcaaccaaccacacaacataatggtgggatgctgtggaacaggatcatctgacacacagtgatattatgtgtgaggatgtggttgcttttctctattgcgattagcctgttaggtgtaagatttgtagggactcgaatagatgggatgcctcatgggcccaacgagctgctaggcgtgagggtgaaactataaagcgaactaggtgaaaccccgcgcgttgcgatggacacattagaaaagattaaatatggatgtaagtataaaatgtctagcagatgatgtgggaatgtatgctatactataactatttttatttccagatgattgttcagcagtagctgctggttcagaggaaatggatggttcagcagattgccgctctgaaactgatggatgtgcatagtttcgaaaacagtataagctggacgttccattttttttaagagactaaaacagtactcagtgcataggtcccctttatgcccgaaaaccacaatgtatgctcaaatataattctgacaaaactcatgtgaaattcacatatactgaactgactcattaaagcatccaatagttctcatttctttttttttttaccagagaacagtgggggggggggaagcccccacggttgaatttcatttataaaagagaaaactggaccaaattgacattacagatcatcaatccatgattgcaaaataggtctatcagctaacttaagcctagataaatgtaggcttaactcttctcttaaattcagcttccaacacgggacagatgttcgaaagctattaaagatgatatcatttctttgcttccaaagcaaccatgcggccaccaaaaaaatttccatgaaacaggcattactgaatccatttatctgagaatgaatcatctgatgaaattccaaagaggtatcccaccaaagtccaatagagttccaacatgcagtagcaaaagggcattggaagaacatatgctctcttgtctcaggagttcccaaggaacagagatcacaggaaagagggacattggggggcttactgtgctttctctctagaagatccctggtatttaatctgtccaagaaaaggagccatgcaaacacctttatcttcatatagactttactggtctatatccaagacaaacacaaaggcggttggattgaccagaaagaaattttataaaacttatgagaagagtaaacattagagtcccagatgtatgtccaaatgtcggccgaagagtttaaacttatctaagcaatgtcctccagatatagtttgtattcatcataggcttgaactgaaagaggtaaatagaattgatcatccactgccctctgtaaatgttgttggacaaagtcattcttgtgcctgacaaaagagaagagagtaggatacacctgagcaaagacctttccattacacaagtcataccagaagctcactgaagatccactgttaattgttggccttgcaaaacctctgaatagaacttcaaactgaacaatgtccttccaccaaaatgagccacaaacactggcattttgaggcaatatcctagagtaataggaattccaaatcagtttaacccaaggtatctgcatatgctggttgaaaaactttcctaactgcttgaggagaagggccctattttgcactcacaaatctattacacccaaaccacctttcttcttgggcctacaaaccttcccccaggcagccaatgattttttggtggaagttaaatcctttcccctccaccgaaaatgccttcttactctatcaatattctctatcactgccaccggaagctgaagggagcacatatagtaagtgggcattgctaacagaactgaatttacaagagttagcttatctccataagagaggaaggaagaagtggccacaagtcttctttcaatccgatcagtgagaggagaaaaatccactaccttgtgcttagaacaactgagagggagccctagataggtgaaaggcagagaacccaggacacaaccaaaagtctttgccagacaatcagccttctcttcatccaaatttaggggtatcagacatgactttgcataattcactttcaatcctgtggaaagagtcactgtattcaataaagcttttagagctagaagtcgtttcccgggctgcagga

SEQ ID NO: 2577 - DNA, 1022 bp, Oryza sativa
agttttgatgaaaccatattggttttggtggaccaactgaaccattttcccttgtagtctatttgtcatggcctttgagatgatttttactgaactattcatcaaggaaattggtctatagtcacttgcaaactagggagaagatttctttggcactagagttatgaacgagtagttcagaggctttagatcacaaaatcctccatggaagtcagcaaacaacctgtagaaatcctgagagataactggccaacatttttttaaaaaacacccattgaaaccatccggtccaggagctttatcagctggcaaaagagatataatgctatcaatctcttgagaggaaaaaggcagaactaagtcatccaaatcacccctcttatcaaacaactcagataagttaaaaagcatagagggatcttctgaaactcccagccttgatctgtaggcctcaagcaaaagggcagctttgccatcatgatctgagacttcaattccttctgaagaagtaagctgagtaattgaattttttctgaacctttctgtggccatagcatggaaaaaattagtattttcacccccaaactaagcccagttctgtctgcatctttttttccaataaacttgcttgtaatggagaagggtgataacttgctttttgacaatatttctaaaaataagttcaggcactgagagcaagcgacattcttccaggatgtccaagaagtgaatgactttatgacaattatcaataagcaaagagagtttcgacagcttcttactcaacattttaagtttcttctgagctgtttgaacttggctgaaatagcaagggcatttgaactcgcattttggattcaaagccaagcattttcaacctgttgtaggaaaccatcatgctgaacccagaaattcacaaatctgaacacattagctttagggatggacatcttcacctggatcataaggggcacatgatctaaaatgtgcttagaaagagctagaaccatagtgatcggata

SEQ ID NO: 2578 - DNA, 24035 bp, Oryza sativa
cttatggaagatgtgagatttaatacctatcactatgggggatgttttattatctagactttatgcagatgttggcggtatagagtcggcatttaataaccgccaacacccttccaaggaagcacttagatagtcagatatattgcatcatatatttgttgtttaatatgtgtttattttaagaacttattcatggtaaggggtaaagaatattctcggtaggtacaaagttgtccaaattttatatttgtcattagttagaccatatcctactttggtaagtctgtcgactatcacccaaatagagtcatggcctgatgatgttctaggtaaaccagtgataaaatccataccgatttcttcccatttccattcaggaatcttcaaaggctgcagcaaaccggcgggtttctgatgttctgccttgactcgctgacaaacatcacatactgctacgtattctgcgatttcacgcttcatacttgcccaccaaaatctttccttgagatcctggtacatcttggtactaccagggtgaatggagtataatgtatcatgagcttctttcagaattgcttcttttaaatctttgttgtcggggacgcagattctctcacccaaccatacagttccttgctcatcttccaagaaaccgatagcttttcctcttctcatattcttcttgatttcttgaatatcaagatcattaatttgggcttctctaacttgatcaattagagtgggcttcgcttctaaggctgcaacgaaacctctactgacaattcccaaatttaatctttaaaattccttgcataattccaatggcaactgtcgtccttccgtagcattgcaatagctttcctgctaagagcatctgctacaacattagcctttcctgggtggtaatgaattcccatgtcataatccttaattaattccaaccatctccgttgtctcatgttcagatccggctgagtaaagatatactttaaactcttgtgatcggtgtacacctctgtacgagtaccgaaaagataatgacgccaaattttcaacgcatgaactactgcagctaactcaagatcatgagtagggtagttcttctcatgcggacgtaactgacaagatgcataggcaaccaccttcccatcttgcatcagaacacaacctaacccaagtttggatgcatcgcaatacacttggaaacccttctttggatcaggcaaaatcaaaataggagctgatatcaagcgattcttcaactcttgaaaactctgctcacattcttccgaccacttgtacttcacatctttctgaagcaatcgtgtcatgggcttagcaatcttggaaaaattctctataaacctccgataataacctgcgaggcctaagaaactgcgaatctctgaaactgtctttggttgtttccagttggttacggattccacattactaggatcaacggcaactcctcctgctgagatgacgtgaccaaggaacttcacttcagacaaccaaaattcacacttgctaaacttagcatacagttgatgttctcgtagcttctctagtgcaaagcgaaggtgttcttcatgctcttctttggttcgggagtagataagaatatcatcaataaagaccaccatgaactggtctaggtattccataaacaccttattcatcaagttcatgaagaaagcaggggcattggtgagtccaaaagacataacagtacattcgaacaacccatacctagtggtaaaagctgtcttaggtatatcttcctctttgattctcaactggtgatatcctgatcgaagatctatcttggagaaaacggtggcacctttaagctgatcaaacaaatcatcaattctgggcaggggatacttattcttgatagtcacatcatttagggcacgatagtccacacacatcctctgggtatgatctttcttttccacaaaaataaccggagctccccatggagatgaactcggtctgatgtatcccttctgaagcaaatcgtctacttgccttttgacttctgccaactcattggctgccattctataaggtctcttatggatcggagttgttcctggtaccaaatctattctgaactctatatcccttttaggcggcataccaggtaaatcatctgggaacacatcgggatactcccggactataggaatctcttccaaagttatttggttcagtcttgaccttaatgactcagaagacaatgcatgaacagtcacaactcgaccatcattgctggtgagaattacttttctgttagcacagtctatcacacctttatgtctggctaaccagtccatccctaggatgacatcaaggtctttggattctaacaagataagattggccagaaatggtactcctttaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagcactgttgcaggaactaagttaacaagaaatgtacccaaaatcacatctggagcatcttgagcttctgcagcagcgacatgattgacacgagcctttgatgctggtacggtagagttgctctgggcagggacaaccttcacgcgtcgaggcttcgggcacttgtccgcgtaatgtcctgggtctccacagttgaaacacaccacgggcttgctgccttgctccctcttggcaggttgttgctgtgtcgaagctgcaacaggacgtggagcttgattgcggatgttgttgccagcattgttgttgaagaactgacgctgcggacgaacaacagacgaagaacctccctgtggcatagactgcggtcctaaagtaagacgcggcttctgattatttccctgttgtgttttgaattgagcaatccggcgtttcttttgctccatgctgttgtacttgtcttcctgacgaatagccttaatcaccaacttctggaaatcaggataatccccagtcatgagtgggtaagaaagctcatcattaagtccttccaagaacttctcctggcgctcttcatcattgcgcacatcttccggagcataacgagccagacgattgaactcgtgcagatactcagtgacagagcgagacccctgagtgagcgacctgaattccttcttcttgagagacaccactcccgatggtatatgcgtcttccggaaagcagcggtgaattcaagccaagtgataggttcagcagtagtcctattcaggcggaagtgatcccaccattcagaggcagggccatgcaactgatgtgatgcaaatgagaccttctcctgatcagtgcactgaagcaaatccaacttcttctctatggcatgcaaccaatcaccagcttcaacaggattagtggtactagagaaaataggcggcctcacacgaagaaattctgctaacttattctggggaggtgcatggttatttccctggttctgctggttctggagttgctgcatcatcatgttcattaactgagtctgttgagcaagaacttgggcaagtgtgggattctctccattgttgttgtttccacttccactggcgcgagtgttcaccatctggtatgggcaaggcacaagaagagaaaccggggaaaactacttaggacaaagaattaatttaacttttattgatcttaaatgagttttgttattacaaaactgaagactctcacaccactaaactcaccaacttcctaacactcaaaagcaaacaaacgcatgcacttacatcccaccactgatgtaaataacatgcaagacccacacaaccaaacttaaacaaacaagctaacacaacgatctaagacaacggcttgacatggcactccagttcttccgggcatcggagttgattgaaggctcgttcggctcgtcttcatcatcttgagttgctccctactcaatcttggaatgagtgtgcttggattcttcttcttcatcatcacttatgttgatgaccggaggatccgctagggctggggtaacttctttctccaccacacggacctttggcgccaattggtaacgagggacaaatagagctctcttccttgcggtaagacgaatcctggccttctgcggtggtgcttctccctttaacgcggctagttccttctccaaacgatccactttgtcttttagcttgcaaatcttaccacgattccggtcttcatgatcttgagccgctaacacagtttccgcacgggtttcatccatagcccacagcatctcaaccaaatgctttgtggtaacatcattctcgattccttcagtctcaaggtagctgccgcggtcacttccctgtggttggcgaggatggtagcgatactcagtgtcggccaactgatcactgtagcgatcgcgaagctctcctatggcgatccttgccacctcctgacatgcatggatgtagtttcttcctccagcttcgaacatcactgaggggatatcttcactattactgttcaaggtgactttgactcggcacttctcttcatgacgatcatgaggaatctgggcataaaaaggggtagtcccaaatcctatcacaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaattcaaagtaaaaaggtaagtaaataaagtaaaccaagcttgcaagataagttgaaacagttggaaacaaggtcaccaattttgtacttttgaacatcaggttccaaaagaaataaaagaaagttataaaatcaacatgctaaatttattttattgaagcaagattaaataaaacaatattgtaaaacttttgttggtaaatgagccattagtacagtaatagatgtacagtactaataacactggaataaattttgattgagaaccattaaaagagattatgaagtgcatgtgccattagtttggtttaattaaaagagaaagggaggagaacagttctacttttccaatatttttagagggcttctatgggttaccatttggcataacctagggttaaggaggctctgataccaacttgtcacgcccggaatttctatccaaaattccaaacgcttacatgtgcgtgaaccctcgtccaggaatcagccgaggcacacaataacaaattgataatagagtaccattattactctaattaaataagcgaataaaatgtcattacagaggtagatagttcctctcaatcaatagagatctaagcagcggaaaaataagataaacggcgcagacgactccactccacaggcagcttgaccagggctacacctaatcctccacaccatcagcatcattgtagaactctttctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaagtaatagacaatattaatccaacgctatacaacataccctgttgtataggcccaaccattctgaacaaccatcccggctgcacagttctatctccaaaccaggaatataccattccaaaccaggagctaatcaaattattaccaattaaagcaccttttattatgatgagaagggtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagttgtgacattacctctcgtacaacacaatccactacagcgcacctttcctggatcataatcacccccttataaacaaggcatggactccccagcgacccctgtgggcttatctccgccacttctcagtctggtgctccgcaatgaaccatgctatacaaaaggtaaagccgttgcccacgctggttgtggttggcacggttaatgtttcacaaccgaaactcgtgaaccggtccttaattgtcatgagcacgactctcaaaaccatgtgctcacaacccaccattatcaggttttagttggcatgtaattaattaaccaatcacgattgaccatcgtgaactatcattaagccatcattaaacaatagtgagtcaaaagttatcccaatagtgtgctaatgtttctaagcatggctaagcaatcatatctaatatctagctgaaccaatatatatagcccaactagtagagttataataacccaaggtatcaaggaataaagtaatcaagaacaaaagggctataacaaacaataggttaattccacccaatgacattcaaaaataaatgcaatagttgaatagaaacagtagctttaaatgggatcaacatgctcaaagggttgtttgggatctgtgtgacttgccttgctggccttggaactcttcaaattcttctcctgcaaaaacggactctccggaaacgtcggaatctaaacagaaagaagcaaaatcaccaaaacagcacataaacaagcatgaacagtacatgtggatatttttagcatgtagatctcaattttagaaaaatttagagacttgaaccaactaaatccgagctaagatgaattagttatgaatttttgaagatttaatcggattaaaacacttatatcgattttaattgaattatgacgcaataatgaattatttttgaaaaggaaaaagggatttattgcgtcagcggctagggtttgcggtggaccgggtgcacggcggcggttcatggaaacggacagccgagatcgatccatccaaaacggacggccgagatcgaacggtccacgaccggctcacggcaaacggccacgatgacgtcagcggtgacgtcaccaccggcggcggctcgggcggcgcaagctcgccggcgaacgacggcgcgacgacgagaacggagggcaccaggacgtagagcgtgacgcggcgaactcaccggtgaccaaagaagcggcggaagatcaacggacggcaccggcggcgagatcgaagcggcggagaagatcgggtcgacggcggcgacggtgctccggcggtctacagcaacggcgaaggagcggacgaggacggcgacgtgacggcgaccacgatggcgaccttcccgagcgacgacgatgactggagcgacggcggcgcacggctgaagtggcggcgacgacggcggcgcgaagcggcacggcgctagagcgctcccggcgacgagaagcgaaggcgagagtggcgacgggtagcggcgacaccggggatccttttaaaggggttggagagcggcggcgaaggcccacgacgaccggcgacgcgaaggaaacctcggggttcggaggaaagagaccgatccgattcgacctcgaatccacgaacttccaaaacgattttgccgatgattccaaaagagaaaaggtagaggagatcccgaagattgttttccctcaattgatttcaccggaaacggaaagacgcggccgaatttggaaggagacggcggtgcggctcggctagggtttcgggcggcggcggcgcgacgaagacgacgactccgacaggcgggccccacctggcagcgagcgagggcacgcgtgcggctgcggcggactgggccgacttgggccgaggagagagagaagggttttgggccgactttcggcccaaagccaaaagagacttttaaaaacctttttcaatttaaattattcatgaaatgcaattccatttattaaaaatacttccttagctcaaataaatcccagaataatctaggaattatagaattaagcaaagtatttaatgaaattttatctggccccattttatattggaatttattaattaaaattagatcttctcttctaggcttttaaaattatttctaaaaattccaattaaacaacaatttatatatttaggattttcagggtgtgacacgaaccctgggctgggccctcctggcctggccttcggcggatctcctcccttggtcctactctatctatttctcggagttttgggctaagtctttgatatttcgatgaagtttacaacccatccttatatggatacatgtttctccttactttagtctagatttcctcccatcttcggggtttaacacctgcatacaaatatacaccaacacttgtggaagatgtgagatttaatacctatcactatgttggatgttttattatctagactttatgcagatgttggcggtatagagtcggcatttaataaccgccaacacccttccaaggaagcacttagatagtcagatatattgcatgatatatttgttgtttaatatgtgtttattttaagaacttattcatggtaaggggtaaagaatattctcggtaggtacaaagttgtccaaattttatatttgtcattagttagaccatatcctactcaccccttacatattaatttaacttcaattcataattataagttcacccaacttggctataaagaggacttccttgggccctaatgttcacacaagaaaatctaaatttagccaaatgcttttcttcaatgtaattatgttttccgctgccatgcctctaatggaaatcactgtccatccaatgaccaatgaagccatccatattctggtggtccacatataagaggtgctcttctaggttgctgaaaaaggtgcgagagctgtctatgctcttcaatgtcccagcccatgtcatcttgtacaacatagatgatgaggtggagaccaacttgttgtagcctacaattgacactccggagtgctacaaggacaaaagaatgttggactctgagagactcctccggctgaataccaaaactatcagctttagatcaatgtgataatgaatgatgcaccaaaagaacttggatgatcttgctcccaagataattgacaatctagaatgggtgttgtgtatgtgccatcgtggaattcacaaccgcgccaatgtgcttctctcaggggcttctccgtagaagaagttattgcatttaggaagcttatatattgtttgatcatttcctgtttctcctaaataataccattttaatgtttgtaagtgcagatgatatgcagccttgatggtaaggattgtggtgtttttaagtacagtacatgttgtcagtaaacactattcaaaagattgttgttgtcattatgatttgactcgaattttgtaccattagatcacttcttctacttttctagtgagccagcggtagtgctacataagggtcggagatcatgggcttagtaggaagcagagggtgtgagtgaccctatcatgggaggtggaggtggcagcatggctaggaaacaatagtgccataggaatcgtggggtcaaagctaggaggttagtaggagatgtaggtgactgcggtgaagagattcaacatgttatgacctaaagaaaggatagtggattctagtagcggttgcatatggtgacggagaagcacacatggggttcttctggccaagatgaagtgatggagaggaaaaagatgtgacaatcgaagatcaagatattggcatagggtggtgtgacagacttaaaaatggccaaaatttttatacatttttgctatgtggatatcaaaaattattctcgtatttgattcatgaaggaaaattaaaagaatcagcattgataatgctttcatggagccaaaaaggatagtcaacaaccaacctatctcctgctccctccaacctggagccgacttcctcgacagctccttgggcccccaaatgctcctcgaggtgctgaagcgccaaccactctcgccatcatgtcatgttttgttgtcatcgcccatgatcgttgatcctgcatatcgccattatctgtgccagttgttagagcgtcaaaatgtggtgacctaaagctcgcttggccagatccaacaaccttttgatcgagatagcctgtcatcgttcatcacagttgccattcttgggaagggagagggagtgacgtcatagtggatccggtagccccaacctctcattagtggatccagtagtcatggagacaccagcatcatcacagtcgaatgtccactctagttctcaggctcatctaccactctgggcacggccgtaccaccatcacttgtgccaatttaccatgctcggggaggcagaggaagtgattgtggatctagcagccttggtagttggtactaccaccaccatcagagttccgtgtattcctgctcctcagcaagctaccacaccactactgttttgccatagcatcactcctcgacagtcccccgctccatcagatcaattgagccattaagggagagtggtgggggaaggaggtaggcttcgcagagtgagagggagagggagggcgagataggaaattgtgaggttcaggtgacaacaagaaggggtaagagtttagtggagttcttacaccatgatttgcaaatattggctcaatctatttgtttagccggttccggtggcatatcactgtcagtttttattataaattgacaacgatatttcaacttcattgtccgttaacgatgaatcatagcattgttctaaatatcacttgcaattcataataaattcaatacgggtgctaacacggatggtttttgttgtgaacccgcagcagtaatgataccttacccaaggaaccacacaaattttcggggaagctaggggagcaaagtcactagagcaagccggacccacggcagccatcattagggatgcacaatggttgtaaataatggtctcttaatattgctaattaggaatatttgctgatcatatggaagagagaaagaggagagataaaacatcattgttatgggtaacaacggctcgacaatgattcttagcctccataatatggaaacatagttgcatgagaaagaaacatagaaagaatagtaacaaaaagaatatttttttagttactggttagaacttttatcgtctcaactgttataaagactcggtttatattgtctaagtgaccataattgtctttactattgaatgtgccctaaaccaaggagcagacactgcatggctggacatgagtaaccttcacaagattataacaggagagacagttttcattgtaagaattgttctcaaatttttggaagacgcaatcttatcaagtattgatccaatactttgagttcttatgatgacacagatacactaaacatggtcaaccgtcaagcaaattgcacagccaagcaattcagcgctaccttatctatctattatctatctatctatcttctatctattatatactaaaagtccattaaacttcctacaaacactcttaagctaccatgtggcatcctataatcactctcgagccgccatatgccactctaataaaatagaaaaaaatttgaccgtcaattttctttaaattggtgcacccactatcgttagatttatctttgcatgaaaacataatctccgtccgtccaacgtaccaacgtgcgtacgatccctctgcagcttacttactgaccccgtttcctttttttttctcttttttacatccccataaaaattgaaataaaaaaaattaagggcctaaaaagctcatcaatctactagatctagctagctcttcctctatcctctcctaataaatattccattaaacatcatatagaaattcctaaccatccataaagcactcttaaattagagaaaatctaaaaagaaataaaacattcgaccatcgatttactttattttaggttattagatatatctttttcttaagaaaagcatcccaaaagtccctccgtgctcccatgcatcgttaaagcctgttaaccatcctcataaatgtttctaaaccactctgtgacacttctaaattagaaaaagatcataaaagtttaagaacaaaccatccaatcattggtttcgccttaaatcgacgaacatatcatataggttgttattagacttatattttaagaaaaactaccaaacctcctttcctccctccacgcccatacaatgttaaagacataaagtatattaaacatcctataaatatttctaagccactacgggtctttcttaagttaaaaaaatcatacaaaattataagaaaaaaaaacatccgattgttggtttcgacttaaacatccaatacattattttagatcattaaataaataattgttttaaacaaaaaagcattccaccctccctgtcctcatgcggtgtgtgtcgttcgttttctcttatttttctatttatgacaagagaaaagataattgaaattaaaattatctttatgggaaaaaccacaaatggacctccacatatcaggtctagctagctgtcccactgccccttttcttctctttctcctcttgctagcacttataggaacaatataaataaaataataataactttttaagtcatacaacttatgatatgcttaaactattatattttttagtgaagtcaatacttcaatatctatattgactatatttaaatgctaacagaaaaaataatattccgaacccacatccattctgaggcctccactaaataaaaaaaaactaaaattcgttactaaaaatcaaaatatcccatcttaattttcaataaagccggtagacccattacttatatcccattagacaactaacaactttctatcaacttaattaatttctcgggctatttaccaatacaatttcattttgatgcttttatcaataaatgattgttttaggagaccaaattatatatatgatttatgaagtcactaataaattagagaaaaatcattgaatgatatcaatttttaggtcataatgcgtaccccatctagtgttaatttgttatagacaacattttaaaaattaaaacgtgctcagttgaacatcataatattcgtaccaagcttgtgggttgcaccaaggaatcttagcagtgaaacaataataaggtgtccttaccaatatagggagtcaattccatatggaaattaaagaccatgttcatttatttctttttggtaaaacttgctatgctacatcgtaaattcttaacttttagcgtagaatagtctagaaatgtgtatttattattgttaacagtggaatttgaattatatgacctctattttaatatttcttactcatttgaagagagataatttagaacatatgacttttaccaatgttaggttgtaggctgaacccacatatatttttaacccaaattgaagagatcaaatcatttcaaagatatttcatagagtggaattctccaaaattttaaaaaatggctggaaaaaagaattcaaaatttatgtagtttttaaaaaataattgttgggtttaaaacccattctaaatataaatattcaaatattttagtaggactaatagaatgaccatatctaaaatttcaaatagaatctaatacaaaaattggactttttggtagggataagatatccctgtggggagtcgaaatactcaaatttttctcatagaaactacatctattgtttcgacataatattttcttataaattgaaaactgttcaatttacagtttcaagtaattttactttagaatttatgtgctgcaagggtaattagaagaaaaccataaccaatgtttctagcacattaaataagttcaattataatttagatatggtaaaagaatattttaatataaagtcacccatacacggacattcgtaattatattaaataaggtgcccgtgcatgtgtgcacatcttcctaaacagtaagcaccccacagcaagatggatcatgctcgacaagaacaatcccatcgctgaacaattaattgaagttcctacttatgccttcaggggaagaaccatggcagcggtgaccttctttatggagggcctcgccgcgagcccatcccaccatgccttcacatgagggtacttgtcgagtagtgaagcgtatggcgtcgccatgaagtagaaggtgaaggggaagtggctgaggtccacaaagctgaggaaattgccagccaaatacgtattctgcgatagacgggcctcatacacctccagcactttcttcagcttctccaggctattatcgaccaccttttggttggtcgggacaccgtacatggccgggttgaagaggcattcatacacgatcgacgagatcaccggatagtactggtgtatctccacctcgatcccgatgtccaccatggccgcctcagtcaggttgccttcccgcagtaggttggcctcgctggtcttgtacttgcgaaggatgtaccttcctaccgcgcgggactctgaaaaggaaatgcatttagccagttttatttgcttaaatctgaatattttagatggtaaatctgtgaaaaaaatttatttgtaatgtaaacatatgaaaatctattgtgccgcaaatgagcgatgtgatgctatgtatttgtagtattatattatcggtggaaataatctgaattatttattattaaaggtaaattaataatttactcatacagtgactagggtaatttatgtttttctctatataggttggtcggtgatcatccatctcactatcgcggatatcgctcatattctatcaagaaaaacaaaaggaaaaagggctctggatccccagtcctccggctggcatttttttaaataatttcccttcacgtttctactactgatagctttgatgctagtaaaacttagatttaagcacttcgatcaaatgaaatcaacgattcagattactttatactaccgatagagagcatcgcagtggaactccctgcaaaaagctctgtttagttgtaaaatctcaattagctgccgaatatgcatgccagtcgattggtttagttctgtgttctcatgatgtctcccaaactattcacgactcctgtccaagagtacagaagaactacagaccgaagagaagcagatccccgtcctggaaagctggcatttgaccaaacggctgcgagaggaaagcacagagatcaagctgggagcacaggaaaacaaaagcagagtaagcacaagcgttagcgtgtgcttacgttgcgcttgaggtgttcggggctcttatgctccatggccttgaagtcgatgttgacgagctcgtactcgacaccgacctcctccaggcacaccagcacccgcgccacgttcgtcgacatggccggaccaaacaccttcaccggtgccatcttcgtggagcctagctgcccgcgagcaatcagaggaatcttgtggagtagacgagtgcggctgcgtgtggtgcaatgagcactacacgacttcgtttttatttataacgcggaaatcccttgcgaaatactagcagccgggttagcacgtgcttgacatcgtgctcggaaatttcctatcaggtgttgtactggtactactggtatccgttcttggcacggtagaggaggacgagttctcatcgaaatctaacgctagcttaacgctcaaggatcggagagcatagatacaagaaacgggagactgagctctatacgtctagttcctatgtttcatattataaatcgtttagattattttctatataaatttattttagtttgatcaggtttataggaattaggaagttagtccacgcgaatgcgcaggcatcttatttattatgtttatataaataatgttacgagaattaagtcatatctcaccatacgcgtataagaaattgtatattttacctcataataacaaaaatctatgttgtgaaatatattgtagactttaatactttaatataaacgaaaagaatgtttcttatattaaaaaaatcacttttgtccaaattatgtaaactcacctattgtcactattacttattatcattgtcgctagatgccattttaataaatgaaactgcatctgtaccaccaaaataagcctaatacattattaatacataaaacatttgtctccactacatacctaaatgtttatgtcaacacttatttctaaatctataaataatattcttaaaatgatgcttctattggttaatgggatatcaccgttaacaattagacatgaatgtcctctctaaaaggtggagctaccaactctttatttttttgttgcctttaaacatgggttccgaatcgacatactcgtgcctctcaaggccagcgtataatgtacttttaatgcttaattcactatcaacaccctcaaagacgattgcatcagtaagtagaaagttgagcactattgtcaatggtggtctccactggggctacctcaactgaaccaaatgtatgcccctactatacttcctcagtgccctttagagaaagcaagaaaagatagatgtaatgaaaataattcttcacataaaaaatagttgtttttacgttttgtgtagttataatttgtttatagtattaaatcagtactacccaaatttttatggtatatatacaatattctcttttgaaatgagtgaggttgatcattaaaaaatgtatcgctaaatagatatatgaccgtaacaatcttcagagtatcatatcattatatcattgttcatattttgacaaagatctctattttagcgtctagtttgttttcgtcacttgttcataattgcatcagacacctttactaattttaaaatctatttatttatcaaaattatctacaataactaatttgttggagtgcacttacggtcacgtcagtggggagtatatggcatacatctatcaactatcacttatgcccgacatattagagttacttgacaaaaaaatatcatgagtagtttaatgcatatgttatatgattgttctattttttaccaaaccaatttggcaaagggaaaaacgtatggattaaggggtcgtattatagcgaaatcattgcctagaaataccattgaaatagttttgaaaaatctgaaacaaaacatttgagaatcttagtctccataaattaaaattaaatcatatataactgacaaaacataatgttgtttcgctttcacagatttcagttagtgttatatatttgccaagtgatatttgacaccacaaaatatgatgtgaaattattcaaagattatgatgaaattaattattatatgtcacctaaattatttgaaaattattataatattaattattatatattatctccatttgttataatgtatttagcatcataatataactatgataagtcatcaacatttgaatacaatggattataatttaaaattaatttaaaaatgggtgtttaaatacctttgatttgatatttatatggatctagtttaacttgcatatttctagagtaataaatttggttttattgtatataaaatcttatcttgaggattgtctatattttttgtcgatggttgtacgaacatacatatgtatttttttttgggttttatagcttgtttaatggtatatacgtatgttactttggtttttttttaatcgaacatccggtaaacagtttctctcgtataaaaaaggaaaataaaaggaagcgagctcatgtaatggtataaaataatgggtccattaatttaaatgaccatgttgtagagtaataaattttatttttatagtatataagattctattttaaaaaggcctcaatggttatatattgttgtacatatattttcctttagagttttaatcgtgtgcacatgatacatatcctttgttttttcataggtgaacagtatattaatgtttttttatgtttttatagtttttttatcgtattactacgttctttgttattattgtttttatatttttttaatcatatgtactatgttctttattttttctcttcgaataaacagtacctaaatgcatatcttttttttgtcttaaaacatggtggtttaagagtgcttgtacaagcaccaaatgaccatgtttgtagagtaataaattttatttttatagtatataagattctattttaaaaaggcctcaatggttatatattgttgtacatatattttcctttagagttttcctttagagttctatagtatataagattctattttaaaaaggcctcaatggttatatattgttgtacatatctttttttcattcaatgtacgtacataaatatttttggtaaacggattatctcggatatagaaagcataattttttaaaatagatctaatcggacggtgtaaaataatgtgtccaccgatttaaataaaaatcgatggtgggattgaagaatgccacataacggcctaggagcacaaagatattggcgggtaaaaaaatagttgtatgatttagatatcgttgttacttaattttgttaatataaaattttactttaaaaaggaattggtggaatacaggagggaatcgaaggaagagaaggtacgtaacttatgcatatataatatcttagtacgtaactatacatatttaacgtacgtatgacctaatgctcggtggggctggatccatttaggaggtggattttttgttaaacataaatctaatgattgtaaataatggacccatcaaatttaatgaaaatcaacggctatttgttagatatatataaccagtaacctcactctcagatccggttgttactagtacaaccaatcagatccggttgttactagtacacccaacaacagtgtatgtctttttttgtcatcttatagaatttccttttaaaatacttagctgatttacgatctgattatattgttctattcattgcaataaagtctgtataacaagatgtcacacgattatatttttatgaaaaattacaaattaattacttttatataatatctaaattatttatagatttcttgttaggcatataaaagtaaattcaacaaagccttaaagtaatttacatatattatagaagtaacttagaaaataaagcaacttgtcatgacattaaaagtaaatctattgttggggtaaaaacataagtctatctagaaattaaatttaatcaacatattatagaactaacatttttaaagtaaatagttcattgaatgtctaaaaagtaatttaatcaaatataaaagtaatttatatatatgataaaagtaacttacatatataataaaagtaatttagaacataaatattttttcgtcgtaatataatcatgtaagatcttgttataaagatttaattgcaataagcacacagtggtgtaatcggattgtagatcggataaataatttaagaaaaaatttaataaggaaaaaaatacatgcactgttggatgtgctagtaattctctcacgtataacatataagtaacatttcaaaacaaaacaaatatattattaaaatacattcagttctagatttaatgaatctctaaatgttgctaaatttttatataaatttggttaaacttgaagttttgaaaataaaacagttaaaacgatttataatatgaaactgaggggtcaaagtttgatacttatgccatcctcaatgtttaatgtaactagagcaattagacgggactcacaatttgatgttcttttgtatatagcatatgctacatgtatatagtattttcttgatcttaagttaggacccattcatgaaaataaaactctattcaatatgaatgaaaaacaccatgcatgttgcaaaaggtatgaactatttttttatttcttctggtctagtcttgagcttaaggttaaggttggacatagcaatatatttcttactaaggttatggttggacatagcagtatatttcttaccttctcttctcccaacgcataaagttaaaaccaaatgactaatttatttctcaaggttacgttgcatgcaactttatttcttagccggagatttcgttagcttgtcagataccatccattcttcgatggtatattacctatttatattagccaaagattccaaaagagaaaaggaagaggagatcgaggagattatttcccctcaattgatttggccggagaaggaaagtggcggccggattttggaaggaggcggcggcttgcggcgcggctaggagcggccggaggttgaagacgaatgacaggtgggccccacctgtcagctgcactgagagagagaggagggagggacggcggactgggccaaacgggccggacgcaagcaggccgaggagagggagagagagacctgggccgactttcggcccaaagccaaaagggagattttaaaacctttttctatttaaattattcatgaaatgatattccattgattaaaaatacttccctggctcaaataaatcccagaaaaatctaggaactatagaaacaagagaagtatttaacaaaattttatctagcccacttttatattgagatttaacaaattaaaattagatcttctcttttaggcttttaagatcatttctaataattccttttaaacaacaatttataacttaaggatttttaaacaagaaaagcacttaacataattgtaattagatcattaattgattaactaattactgaactattctttgtatcacttaggaattgagctctaaaaaaccgagaaaatttcagagagtataattaatcatggagaatttaataaaaattaaatccagccatgctttatacttaggaaattttattgaccacatttaacttcacttgtaaattaatgaatatttaatataaattctattaataatttattaaataatttataaatcctgaaacggaaaatcaggctgtgacattatggcatcctcaatgtttaatgtaactagagcaattagacgggactcacaatttgatgttcttttgtatatagcatatgctacatgtatatggtattttcttgatcttaagttgggacccattcatgaaaataaaactctattcaatatgaatgaaaagcaccatgcatgttgcaaaaggtatgaactatttttttatttcttctggtctagtcttgagcttaaggttaaggttggacatagcaatatatttcttactaaggttatggttggacatagcagtatatttcttaccttctcttctcccaacgcataaagttaaaacaaaatgactactttatttcttaaggttacgttgcatgcaactttatttcttagccggagatttcgttagcttgtcagataccatccatttagcttgtcagataccatccattcttcgatggtatattacctatttacttgtgcccatgcttctgtgcttgatgactgtcctcatgttaagggattattgattagttcaaaaaagaaaatttttaggtgtcacattggatatatatttgaccggatgtcagaaggggttttcggacacgaatgaaaatactaatttcataactcacctagagaccacgagacgaatcttttgatgagcctaattaagccgtcattagtacatgtgggttaccgtagcacttatggctaatcatggactaattaggctcaaaagatttgtctcacgatttccatgcaaactgtgcaattaatttttatttttatctatatttaatgttccatgcatgtgtctaaaaattcaatgtgatgtttttaaaaaaaaaattgggaaccataccagacctaaagcttggatcactgccatcacgaacatatgatacgagttcgtgcactcaccacgtgaactcacgtgacaacggtgtatatatttctgccaatttattataaacatgtatatttttgtaaaaccggtgaaaaacaagtatattctcgaaaaaaacattgaggccaagcgtgaagaaagtgacagagcttatgaagatgccgtttgttgcttgattaaaccagaaactatacattggggcattcaaaaactcaaattcagcatgatgtgaaatcggtgtagtactaagttgcagcatctatattcatctctaaaagcttgttatccctccatctcaaaatataacaacttttagctctcaggatttgtcctaaaatataacaacttctccaccaacattttctttctaaccaatcacaacactccactgttcacttttcccacctatctctactactcatccgatcacaaccctccaccactcacttctacctacttacttaataatcatgttcaaccctaaaactttttatattctggaaggaagggcgtacattgtttactggagaggcggagtgctaatagtagaacaatgatttcatgtaggcccttggccaatcttgaatattatgtcatatttcttgatataaaatttcaaaaataattaattaatcgcatgttggatagccatagttatgacaaatcacaagctgtagtgtttcatgaaacctcaagttgtagtccacacgagttatgtattttaaattattaaaatcaatataatattcattaattgatgaaaaaaatattaaatgatcatagaattattaaatgatgaggtatattaaatttattcaaaactgagcacaatttggtattgttaattttaaatctcaaaatactaattcttcaaaaaattgattgagactacattccaatgcatttattaattagttattattttttgttattttcaactttaagatttatcacatcatcaaataaacaataatccaatatctaaactatgtaaattttatattaattaatttcgtattttaaattattgaataattccaacttttagaattatcacataatccgaaagctataattgagaatcgagcacaactctatatttcttaattctgaattatttaaattattaaacaacaaaaactgtaattgagagtccaaactgaatacaacgatgtatttattaattctgaatttgaaaacgtaacaatggatttgagagaggactttatatgagtttaccttttttatactagcaatttcatgctatttttatctcacctggttaacattgacgctcctatgagagccactaaatgggtgacctatggagtgacatcatcgaaatcttattatctaaagctggcggttatcgccgcaagctgattggttcgttttacccctatttagttttacgccacgtgtccatgaagcattcggcaaacgatcgagtgtctcgcgcatgtattgttgtcttcatgcggcagaaaacaaaaataacagcagcttctggatgtcgtctcacctcatgtccatgctatgtgggccaaacactcattaatctctcatcccagttctataaaaaaaaatcaatcatcccagctggcctcgccacattggcccgtgcgcctttgctggctgagtcagctatatggctaacctgtgagccgaacccatgcatgtgagtattgtagcataataccaggcttggaataaaaaataaataaataaatcaaaccatattggtctaatatacaattatatgtggcattcaattagtattagttttatagttaataattatataatttgcatgaatattgatgatcaaattttggtgtcaatgctattttaaaagctaacacatcatatatttctcaaaaagacaaagtatggtatagtctgcaacagaataaagaaaaaaatgcacacactttgattgggttataatattcatatattacttaaaaataaaacaacaaataataaaatttgtgtataaaaa

SEQ ID NO: 2579 - DNA, 10522 bp, Oryza sativa
  unsure (1)..(10522): unsure at all n locations
accgggactaaagatgctcccatcttaagtcccggttgggaacaccaaccgggactaaagattgatttttagtcccggttatttgaaccgggactaaagatagcgatctttagtcccggattcgtagtcccggttggaaaacgggactacaagggggttacgaaccgggactaaaaagcatttctccaccagtgtggaaaatagttcagagagtggttgccctataatagtcacacatcatatttacacgatatacaaaagaattcatataacatattacctacattatacttagtaatttggctctatattttgtatatggagtgcatatatagtattaagctatctatctaaaatactgtgtctagcatatatgtctaccaattaatagacgcacgtatcctctctcctctcactcacctccacatcaaaaaatatactatgtggcattctctcctacacggtgatcgtaccattattcatgcccttagtgctaagtgtgattggttaaaactggaaacatgtaacttaaccatgttaatatcctatattatagaaaaggttaaacaatttattaacaaaaggtaaaacaatcgatagcaagaaataaaaaatatgttattttaattttactaattctaacagcttatatacaaaattttaaaattacaaacgtgagactaaattcaccgtttgtttgtgtatactgtcatgctataattctccgtaggaattatacaaacataaaaccaaaaccaagtacatattgaatgatattttttaatatatgatatttacatagattttattagtattaaagtaattactctaaaaagtatacatgtgcccgaggggaaaaaatcacatgataaattatccagcgcgccaataggcacgccaataggcgcgccgattttctaatgaatactactactgtccttcagttgggcacaagaaaaagtttacttctcgttttcgctatcaacggtgtgtttcatatttcttctcattttcgctatcaacggtgtgtttcataaattgtgtactgtttgcaggccaggaaggacctcgtaccacgtgcagtacagtcatactcctaaggccttgtttagttcctaaaaactttttccaaaaacataatatcgaatctttgggcatatatatgaagcattaaatatatatattagattatgctagaaacttgaaaaaaatactttgcatttttgaacaactttcaggactgaaaatcaattttaataaaagtgaggttatttgtttgggagaagcaaaaaaacaaagaggagtacagtaagatcttcacttccaatataggtaatttgcctataaagtatttgggtataccgattaataaaaaatgaatcatgaataaagactggaaacagactgaggagaaaatggaaaaaagggtaggatgttggcaggggaatttgcaatatataggaggaagagtaactttgataaactcttgtttgagcagtacacctctatacatgttgtctttttacagaatttccaaaggagtgaaagaaaaaattgattttataagaagaaggtttctttggcaagaagaccaaaggattaggaaataccatttggtacaatggccagtagtttgctctccaaaagagcaagggggtttgagaattagagacttagacattatgaacaaagctttgttgggtaaatggctttggaacctggagaaaattgattgaatgtggcaaaagcttttaaaaagaaaatacctatcaaagaaaatcttggcagcccagaaaatcaaaaagggggcttcacatttctagcaagggattatggaaattaaagatgttttctttagttattgctggaaaaaaccaggaaatgggacaaatactctgttttgggaggataactggatggggggagcctctggcacaaaaattcccttacctatacagagtcacacatacacattatataactctggcagaggttaaacaaaaaggttggggtagcataattttagaaggaacctattgggagacaatttgagggattggaattacattaaaagttgctgtgatcaagtaagactccaaagatgaaactgtttggggactaaccaaaaatgggatcttcagtgtaaaatccttttatactgctatgaaaatgcaagaggctgcttctatgatgggggtgatacacaagaagatttggcagataaaagttcctatgaagatcaggatcttcctttggcttttgttgaaagatagtgttctaaccaaagacaatttaaagaaaaggggttggaaaaaaggaaatgaaacatgtcagttctgtgataaaaaatagtcaattcaacacttatttttttattgccccatgacaaggcttacttggaatgtggtggcatgtacttttggtttgcaacctgtgaaaaacattcaatatgctttgggttgggggtttggatccagaaatgggataaagtaacaaaatacttaatgttggtggggatagcagctgtgcggtggtctgtttggaagacaagaaataaagcttgttttgagcggttgttgccataggaccccactgaaattttatatcaagcgtgctcatggatgcatgattgggttattctgcagagacaggtgggaaatcaagaaaagctgcgatggggaatccaattgctaaagcaggtcacaaatgaggtgttcaattcaagacatggatggcgcgcccttcagaaggattacaagcagctgagcggattagaagagaggagagaaatatccaagttttgaacaaggacacatttgttagcctgtttaggagagtcatctgttaaatatctgttgtcgcttttataaactctaaacgcaattgtgttttctttttttctcttatactgtaaactgtgatatttctcttaatggataaaaagaaaactaattgcacagtttgcatgtgaaccgtgagacgaatcttttgagcctaattaggccatgattagccataagtgctacagtaactcacatgtgctaatgacggattaattaggctcaaaagatttgtctcgcggtttctaggcgagttatgaaatctgcaggacaatattttttatcacaaatgtgagcatctacaaacaattgagttttttatgagaaagttaaagaggattttagttctaaaactttagtgacatatttcttgatatttgattctgagtaaaatntagctaaacacatattttttggtcatggttattggacatcacaagtcatagtgtttcacgaaacctcatcgagtctaaatttcaattcaccaggaatcaactggcacatccaaacgagctacgtatttgaaatgattatcaatttggtattattaattctgttgtggaattatttttttacgataaactacaggagaggctcctacgactgtgattgtagaattattgaatgatgaaaatattatatttgagaattcaaatttctattatttatttgagaattcaaatttctatcattacagaccacaacttgctattattaatccaaatttcgaagaaactaggtattcataagaatacaattgattgactatttatttgttatatttgttgttattaatttcaaattttggatttaccaaataatgaaataaattagattattttgtgagggaaataaactataattcaatcccgaaacaaagtgcaatttgatatttatttttttgaaatttgaaataattaaatcaccaagaaaactaattaatattttattagaacaagtatgagttggaatttaataactccagattctagaattattacattatgtacaaactttaattgagactctagatcaagtacaactctatattataattatatattattaaatcataaacaaacttatatcttagagtgacaaccaaatagaacgaggccatttattaatttagaatttaaaaattaattttcacattaatttagaaactaaaaattaatatttatttaaggctcctagaacagcaacttaaataaatagctctcccatgaaagtgacatcatgggaatgttttctgtcattcagcttatttcttgtttaggcctgtttagttcccaaaataaaaactttcacgctgtcacatcgaatgtttgtacacatgtatgaagtattaaatgtagggaaaaaaccaattatacagattgcgtgtaaattgtgagatgaatcttttaagcataattgcgttatcatttgacaatgtggtgctacagtaaatatttgctaataacggattaattagtcttaataaattcgtctcgtaatttttctgacgaaatctgtaatttgttttgttattagactacgtttaatactttaaatgtctgtccgtatatccgatatgacaaccaaccctaaaaattttccacaactaaacaaggccttaggccgtatttagatgctgtaaaaatttggccaaaatttttttttgacgtatacggatacatttgaagtattaaacatagactaattacaaaacaaattacagattccgactgtaatctgcgtgacgaatcttttgagccaaattaattcgttattagcacatgtgggttactatagaacttatggctaatcatgatgtaattatgctcaaaagatttgtctcacgatttacagtcagactgtgcaattagtttttctttttgtccacatttgatgctccatacatgtgtgcaaacatttgatgtgatgaaaaaataggaagtttgaagaaaaaaagttagaatcaaacacagccttagtttggcacgtttagctatgagtaaattgcgccagcggtaaaaaacttggcaggtgggtacgatttagtgtaaaaacttgtaaaataagcaaactggtacataaacttaacaatcatgtgcattttgataaaaacacggttacatacctatggttcatcgtattttattggttgtatttgtaaacatgactgctagattaattgttggcaatgagtatgttttacagtgctcatcaccgaatttgtatgatcagatggatcgctcggaaattttgttagttggcatgcacttagttttgataatcattatttttctaattttaaataataggttattttagtattataaccaagcaaatgcaatacatctaaaaccttattcggaactcaagatgacctaactggctgctttttctttacatagctgaaaaagtatggtgtggaagagagatattttaaccaaaatgcacgtactaaccaagttgttacatctatataatcattttttaaattcttgcactagatcgcacccacttaccaagtttgtgtactgtagacgtaatttactctttactatcaacagtgcgtttcatagatgtgtgtcctgctcgcggcccgctgggacgtttgtaccacgtccactgctagctgtcattgatcctaataaaatttctcccacttgtcagcaacaagtgcatccaaacatacagtttattctagaaatcacaaattaataagagcatctacaaacaattgtatactgataaacttattggaattttaattctaaaattctaaaatcggggcgttacaaataaattcacggcataaatttttaggacaaacagactataattttaaaaataaatgctctataaacatattttcaaatatgaacctatttgccagggtaagattgccatgctggtaaccaataatgccgtatatcgtttgttaaaagaaaaaaataatggcatgaaaggatttcaccatagtggacaatgcaaacacttttactccatgtaccatggtgctacagtcattttggtgggaaaatagggtagataagaaccggtctaaaattttcacaagaccaagttcaccaagttctggtatttttctaaaggcaaattttgctacaggacatcctgacttcgcggttttagctgtgggacaccgcgccgaagtgacttttgggggaagaaactctcaaaagttggatatttgctggtggacaccgcacccattaaaataataatttccaggtagggaggagagagaaatcacgtgaaatatcaaaaatacccttgggcccacatgtcagctctcctatctctcctctctctcccctcttcccacgctaagatggcgacatgctgaggtgcgagctcgccctggacgccgggctcttggccacctccgtgccagagccggtggcgtcgccgacctgtggctgcgccatgtcactctcattctcctccaacaaccgcatcatcatctccatcgtgaatgcgccctgtcactctcattctcctccaaagatttctaatgcttgcaggcttgcagctcaaaattttctcatatgaagatgttggaaattcgtgcattccattaacacatactgtgtcagcaaccataaaaatcactcattgtctcctttattcaatcacaacttggcagagttcatcaaatcaaagtaggaaaatttttcgcacacccaacagcaaacaatggcgcgtggccacgaactcggagatcacgcgccggcggcgttaacgaaggcgaccatcctgttgagcaactccttggccttgccgccgtcggggtcgaacaggtggaagacgtggccctccccggccgtctccagcacctccaccgacgcgtcgccctttgccgcggccactgcggcggcgtacgcgtgggcgcgccacctgaggaagtcccccaccgcggcgcacaccatgaccctgtcgcacgccatctgccccagcgccggcgcgccgggcaccatggggttcatccgcgggtcgtccatgccggtggtgcaggggcacgcgtacatccacagcccggtgcccatggcgcacccctcggggtcggggtactcctcgccgatggcctccgagccccagatctgggactggaacaacgtcatgtcccggcctagccagaaggaggggatagagaagagagatgggagagctgacatgtgggtccaggggtatttttgacgtttcacgcaatttctctctcatctccaatcaaaaattattattttaatcggtacggtgtccaccagcaaatatcaaactttttagagtgtcttccaccaaaactcactttgcgcggtgtcctacagctaaaaccgtgaagtcacaatgtcctgtagcaaaatttcccttttctaaagcacttggaatggtgtggtgtgatgaaggtagggtgctacagtaatttaattagattaatgggagagatagttttgattggaatcatgctatacgtacgacccatccatccaaccggcgtaccactgaaacggcagagcaacacattgcgagacggcgtgatgattcgtactgcatgctgctgacgccgcgtacatcgacattgtagtcatctgagagtcggatgttgggtcgtgtgtgtagcattttccttttgattgtaagcactggtatcaaataaatgtcactccaagaaagattggaaaataaattttggtaggttctatttatgtagatggaaaaaaaatctaaattactcctaaactatcgcgatggtctgaattgcacaactaaacaacaaaacaggatatttgatatcccaaactctctaaaccgaacgagtaaacccctaactcaatctgaagcggttgtgtggcgcatacgtgctaacctagtcaacactaaaaagttaaaaataataaaggacccacatataatataggcattcttccctgctctctccaccctaccctagctaaatcacccatccaccgctgccgtgtcctaaatccgcatagcaagcatgccgactgtcgccaccatcggccacctcccagcagcgcctcctcccaaattgtgacattctagcccaattaggatgaggcctatgtagcctacgagagctgtgtgtatatgtttagtaccaccttgctagtttagcaaaagtggaatcaatttataaaggtttgtccctccaaccatactactcccgggttaaccctcttacacgaagcaaggatgaaagtgtaagtggaatggtatttgtaagtgggaatgcccgtcgaatgggttggctacgcggttctagacgaagggccattacaaatggtaagtgaggcacatgacatggcatatgggggccggtactagacatacggacatgcgctaagaggggtgtgttcctgtacatttgcctatatgcctgtgtggctatgtgggtgagttggactgacggggacgtcgggtcctttgaggggggtgtgtgtgacatcctgactcaattaggatgagccatgtgtggcccatgactgctacgtgtacacgtttagtaccaccttactagtttagcaagagtggaccatttgcctatatgcctatgtgggtgagttggactgacggggacgccggatccttgggggggagggggtatgtgacatcctggcccaattaggacgagagctgtgtgtacatgtttagtaccaccttgctagtttagcaagagtggaaccaacttacaagggcttgtctctccaaccataccactttcacttacaagggcttgtccctccaaccataccactcccgggttaaccctcttacattaagcggggacgaaagtgtaagtggagtggtatgtggaagtgagcctgcccatcggatgggctagtgtaagtggagtggtatgtggaagtgggcctgcccatcggatgggctagctacacagttctggaggaagggttgttacacagacgtgttccctagttctggctccggctgcgacctcctccttgtcaatcccattgcctcctcaccccttccccttcctcctctcccccttcggcagtcatgtctcgagtgacgacctcctcatagatgagcccgctcactgttgtcctccatgaactaacacgaggagcgtgccgcacgctgatttggtcctagggccatggcgcgccgcgccggcaaatgaaaaactctaacgaatgttcgggagttagggaataatttagaccccttccccttcctcctcctccttgtcaatcccattacctcctcaccccttccccttcctcctctcccccttcggcagtcatgtcccgagtgacgacctcctcgcagatgagcccgctcactgttgtcctccatgagctaacacgaggagcgtgccgcacactgatttggtcctagggtcatggcgcgccgcgccggcaatggaaaactctaacgaatgttcgggagttagggaataatttgggaaaaatcgggaactgcaacctataggtcgacagggaagacatggctgtacgagtgcatgtcgcgggagactgatgacatggtggcgtggtttttgtgtgttaacgtcaaaatttggtaagccccgaagtcatcatcggcctaaagtcagtatcggcttcgagttctggaattggctaatggaaattatcaacttctagtagttggattcttgatggattcgtttaagaaaattaatcaattaaagaaagtttatctagaagagagttgaaggaggatgcggcatgacaatttatctattaattagtcagagttaaatagtttcttttatttttaagaaagtgtgtttaatgcccgatctggacttgtgtttctccttttatctttaggaaagtttgagttttatccaataaggactagtatctacacataggtataaatatgtatactcgagcccttgtaatttatctcacggatcaatacaactaatctcgacgcattgccaccctctttttcagtatttttcttattatcggcggaacttggcacctgacacggggctgcatcggctttgatctccggcgaaggggtaaaccctacgttctattggccttagtgaatgtatcggctacatcggtgttgttcaagactgcatcggttcgacctcttggattgctctggttcggttaagatatttgcctacctgatagttcaattttatctttaatagcattgtgtttagagacgtatcggtttagttgagactgtctcggttaggtctaatcttctgacttagccaatatatctcaacaatcacaatgatactttagatagattagttatatccatcatattagacagatttattggctcattgagtgcttcattattatatacaatctcatgttctattggttaggtctgacatactatatagttgttgataatccctaagtcttgctaagcccataggttcatgctaatgttttatcggagggttagccgatcttatttgatgtgttaaatttccctttgattgttttactctcttagttaaatttaatacatgacgagcaccctggaaaacaatcaaaggctcgattgtttacaccttatacttccttcatactaagtgttcatcaattgggtttgacctactaagtcatacttggaattgtaagaactaacttgctgtttggttgctgataagggtagcatcgggg

SEQ ID NO: 2580 - DNA, 3824 bp, Oryza sativa
gatgggttatttatcgtcaatatatctatctcgtcagttacatgatcaaattgattgacacgcccacatctcatcaaatattaggaactacacagcagcagcagaagatctcccaaaccttcgtagtgtttttttttttgcgtcaacactgtgccaaggaggaggataaggccttgccggtgagctcaacaggctggccgtcaacgcgtacttaaggtaggggagggaagagaaaagaataaaaggaattgagtaacaatgactctttaacatgtgggtcctccgaattttttctttttttatgctggctgaactaccacgctggaacaaaaccaatccagatcgagatatggaggttatttgtctaatttaaaaagtttgaggttttacatatccggttttgtagtttatggggtgtaattcgaacggccgcgagtctaggggcaatccagattttttttctttttaaaatatcaaattttaaaaaggtttaagtaaaacagaactccatgactccatgtgtttgatggtctactgcaacaagtggtaccgcacttattaccaattaatgtagctcggtttcttgctactccgaggttcacgacttgttcaagttttcgttgaaacttgcttttgtaaaaagaaaaaaacatttttatactttattcacttcatcaaaacaaacctctttagtttgccgattgggatttagacaagaaaccgaacatgctgaaccgccaagaaaattgcacagtcatgcaattcggctgctgtcttatttaatcaaattgcacatgcgcgaaaacattaagaaagccacagcaagattcaggataatcatcaagaagagaactatccgattggccatccaccgaattcaggatttcaggtcgtcctcacgcctacgccccctgaggagccatgaccgcggcgagcttcttgacggacggcctcgccatgagcctctcccaccatgccttcacatgagggtacgagtcgaacagcgacgcgtacggtgtccccatgaagtagaaggtgtaggggaagtggttcaggtcggcgaagctgacgaagtcacctgcgaggtacgtgctctgtgacagtcgtgcctcgtacacctccagcaccttcttcagcttctccgcgctctcgtccacgaccttttggttagttgggatcccacgcatggctgggttgatgatgcactcgtacacaatcggtgaaatcgccgagttgtactggtgtgtctccacctcggtccagacatccaccatggctgcctccctcaagttgccttcccggagtaggtcagcttccctcgtcttgtacttgcgtaggatgtactttccaatagcgcgggactctgaaacggatatgacgtaagtcagatttctgagccctcgctactacggtgctctataattatcgttgatctgatttgatcaaaatatttaaatctatttataataccaccttgttagttagtggtagtagaaaagtaaagaggcattatgttaaaaaaagatatgaaagggtataatcatcacttagcagtgactaaattatatatatttttgttttttatgaatatgagcgataccaatgtaatcgatgaccacatattgatctagccggaaaaaaacataaatgataaatttaccctaatcactttattagtaaattactagtttactattaatacggttcagattatttctaccagtagtatatcactataaatagagagcatcggagtatcgcttaacggtgtattattgtgcagtaaaacatgtttagtttggttagttctgtgttaacatcatgatgacaaaaacatttcagcgggaagtagctagtcatgaccaagagtagccaccgacactccgacaactccagatccatctcattagatttattagagttacaaaacacgctttttagttattttcaatcttactaatttttgataggataatgttatttatattggtccaacataggcaatatgcagagtgatgtctttagatgatatgaacaagatagggctgttctgagggccatatttgtagacgtgtgtcgtatgcttcgtcgatgtaaccggaaaaaaaattgttccaagtaaaacctggtacggctcttaagagttgagagcgagaattaaccgaagctaagctaagatcaggcttacttaccaaagaggtacagatccccgtcctggaaagctgggatttgcccgaacggctacatcaaatcaggcgtcgtcaccaccaaatcaggattcaggagcagataaaatcatgtcgtagagggcagaagagcagaggcatcacgtgtgtacacgtacgttgcgtttgaggtgttcggggctcttgtgctccatgaccgtgaagtcgacgttgacgacctcgtactcggcgccgacctcctccaggcacaacagcaccctcgccacgttcgtcgattgcgccggcccaaacaccttcaccggcgtcatcttctcagctatccgagctcacggccactggtcggctgcgcgagtgagcgtgcgcaaacaaggaggagtctttaattggagcttagctggtgtgtgttgtacgtgcctggtggtagctttagcatgcggtgcgcgaggccggcttttataagctagcggtgatttcttgagagaaaaaattgcagtggttggtgtggtgcgtgggcgttcgaccctgttgggcgcaaagatagatttgcgaccaattcttgtggcgcaaagaagagcataaagcctaacgaaagagcactagtgttaccactggactggagcactagtgtgtggtgtttaccatgttgggcacaacacacacgtgctgttcgtgtggtgcacagagaagagctggagagatcgagttctggatggctcgtctggctagctagctaggtgaaagagccggtacgtaaaaggcggtgataatgagtagtgccttctacgaacaacattaaccttctggaggattctgaaggtgaaaagaaaaggtgctcgtggttggctgcagtcttgcagacgtcagttcaggattcggaaggtgaaggtgttggtggttgccggttggttgcacagacgtcggctccacccgaatacagtaccgaatgtgatccattccattactgcgaatccgtgactggaacggcgaataaaggtgatcttcattcgctggggaagggaagaagaatccagtccagtccaggatggagctgcttgcgtacgcacggtacatttcgctgtaaaacgcccttcaaccacagaaggaatagttcacctgtgctcccttaacttaacttatcgatgaacccgattttcgtccttcaaccgaaaaccagatacaacggtacctttattgctaaaaccggtgcaatataagtcccataacggtttggacgacggttttagctgacgtgacgcctacatggctaaattgactcggtcttcatctgacgtggcaatttgatatggaaaataataaaaattgtgaccccacatgtctgttataccaaaagaatgaattagaaaatggtgggacccaaatggccccacgtatcattctcacccctcctctttttcctcctctctccctatctcccctctctccatctctctccctttcctctttctaggcgccacagcatctcggggaggtccagtggaggcggcgggcgatggcaacgacgacgacatggagggtagggcgtcggcggttggagcgcttgggacgggctccacacgggcatcacccacccagagaagctgctctttgtctttgcccgcggcgttggcgcagaccctg

SEQ ID NO: 2581 - DNA, 1672 bp, Oryza sativa
gcccacgagaactccagctcgtcggagacgggcggtgccgcggccttgaactcctccacgagcccatgcgcagggtctgcgtcagtgcccggatgaagacaaggagcagcttctcggggcaggcggcaccctacgcacagagcccctccaccaacgctcccgccgcggacaccctgcccttgtcctgcgtcaccgctgccgtcgcgtcgttggccgttgccgttggacctttctgtgatgtcgtggctcctggagtgaggagaggggagagaggggagatgggaagagaggaggaagaattaagaggaggggtgagtatgacatgctctccccacatgggccccaccatttttaattcattctttgggtgcaactgacatatggggtcacgatttttattattttataaatcaaattgccacgtcaattccacgttagatgaagaccgagtcaatatagctacgtaggcgccacgtcagctaaaacggtcatccaaactaccatgggacctatatttcatcggttttgatagttgagggatccgttgtatctggttttctggttgaaggactaaaatcggattcgttgacaagttaagggacctgagataaacttattccaccacagaaaagatgacgagagattagctgggcctaggatggtgcctgccatgcgctgttgctcctgcggtgtgtgttagatgggctctctcatgggcctaatacagcagtagctcatcgatgagccttatgctctctctatttacttcttccccgacaaaaatcggtttggaaatttccgaacgtaccactccataaaactaatataataataatattcttaccgatattacggtatccaaaatttaatttttctaatttctatgtattgaagttgacactaaataatatccataaatataaaaatttctcaactgttttcaaccgtttatgtaaagtcatagaaaaatatcgtttccggttatttctggccgttttcactcctgtccataggggccacagcactttctgctgatcagggaagcaattttggagcttgttcattagctttgtttgtttgcttcgttgcatgagaaatttgtaatgtcagacaagttacgttttccgtaagatgatttatccccatttcaccctttctttctttctttctttctttctttctttttaaaacacaatacaaacataggagcccacaatacgcgtacactcacctatacgaacacacacgtacatcctatctctatgagcacccccaaaagactgggtacgtcacctaccactgaaagaataattaaccgtaaatagaaacaccccatgtcaaatctaggatttgaacctggataagttgattccaccacaagaaacattaatcggttgaaccacgctcacatccgccatttcgtcctttctgaaagacgtgtcgtcagagcaagcagattatatttcagaaaaaagatcgtcggaaagtgttttatttactcaatatctcaagagtgtcaacccaacaatcataaaaagttttaaatgaaatcaacatcatagttgtttcatgttgcattaaaaatgaactcctatccttccccatccttgcttcagatgctgccggagcgagccgtcggcaagccacgtggcgagctaggagggaggtggcg

SEQ ID NO: 2582 - DNA, 1999 bp, Oryza sativa
tagtgtcatcaaattaatattgaatatattttgataatgggttgaaaatgttactacttttttctataaattttcaaacttaaaacagtttgactttgaccaaaatcaaaacgtcttataacttgaaacggagggagtaggtaaaatacttctcatactatttagagtttgatttgttccttttttccgtcaatatatagatcaactttaaaatatgcagtcccatcgtttcatctaaaactggttaaaatccgtaacgtttgttaatgataaaaaaaacaatttatatggaaaaaatttatatactccacccatccctaaatatttgacgccgttgacttttttaaacatgtttgaccgttcgtcttattaaaaacttttgtgaaatatgtaaaactatatgtatacatataagtatatttaacaattaataaaataataggaaaagaattaataattacttattttttttaataagatgaacggtcaaacatttttaagaaagtgaacagcgttaaatatttagggacggagggagtgtgttttcagcaacttaaaaactatgtaaaaaaataaaataagatgaaagttataaaaatcaactttgagattatgatttaaattttaaattttggatgtgactgataagctaatagggaaatctgagctaaatatccctgtaatttcagggtaaacgaggaggaatgtcctagaggtgtacatatctagctcaactaaacttttttttaaaagaaaatcaagttaagaaaggcacttgaagttgcccgaaaattaccgttttccttttgtactgaagaatgtagaactcaatgaacattggtcaacaacgaatgtacggtctgcctagtggcggaagctagtatccttgaagtgtcccagactttccaggaaataactcggtagaaataaattcagactactaaggccgtatttagatttagattttttcttcaaactttcaacttttccatcacatcaaatatttggacacatgcatgaagcattaaatatggatgaaaaaaaccaattacacagtttgcatgtaaatcgcgagacgaatcttttgagcctaattacaccatgatttgacaatatggtgctacagtaaacatttgttaatgacagattaattaggtttaatatattcgtctcgcagtttacaggcggaatctgtaatttgttttgttattagtctacaggcctgttcactttgatgaaaaaaatcttacccaattttagcaataccaaaattttggcatagttgccaaaattttagcaacttaccaaattttggtaggatttcttatatagttaacaaaatttgacagcaaactaaatgtaaccatttttttggcaactttaccaaaatttggtaaggttgaaaatggcatcaaagttaacaggtcatatatttaatacttcaaatatgtgtccgtatacttaaaaaaaaattggcaaaaaattggcaagagagtcttgtattcttgtcgcctgcttctgattgttgattttcaggcagctcacctggtcgacttccacaccgcatcatattctctagctccatgccttcatcttgttcaggttcctactgataataattaacaaggatataccgatcatatcgatggcgcctgtgaaggtgtttgggccggcgaagtcgaccgccgtggctcgggtgctggtgtgcctggaggaggtcggcgctgagtacgagctggtcggcatacacatccccgccggcgagcagaagagcccggcgcatctcgcccgcaacgtacgtaacgcgatcttccctcttcactctcgtgcaaattcaaaacttctatgtagctgagaaagagtcagaaccaatctcagaagtagtactacttcatgtagcaagattaggatatgtaaaatggttgttaacagtggtctcttagcgttgctaattaggaatacttgttgacatggaggaaagagaaagaggagagacaaa

SEQ ID NO: 2583 - DNA, 3816 bp, Oryza sativa
tttttcttacttttaattcccttcctttcaccaccatgcaacaaaatttgctctagtaaatgctaagagtcgattttgagccgttgtcatgcataacaaccatactcctttctctttcctctatgtcaccaaatttacttgcatggcaatagagagagaacactaataaacaccgttgtacatgcccttatacatgacaacggcttaacaacgactcttacactataatatagaaatatggttgcatgaggataaaaatatggaaagaatattaacaaaaggaatattttttgagttaatgattagagtctttgtcgtctcaactattataaagacatggtctctaaatatcttgtattgtttaagagaccatacctgtctctaccattgaacatgcccttagagctaagctagatttgccctcgtatgagtcgatctttatttgttttctttctatctgctttcagccattcggtcaagttccagctttccaagatggcgatcttatccttttcggtaagatatctctaggggaaaacttgtacatactctagaactgaatagaacactacttaatataaagaatctaaacatgctgttttgtcatgattcgttgtaatatatggtgttctatctaatcctactgttagagatatttgtgtgcatgcatatcttattctgtttttgccgtttatctctcacaatctattccgattttgtttctataagtcggttgagatattgtggagaggtagaggctatatgtacacatgttgcgcgatgaatctttttatcgtgttgagctatccctgctttcacctacattgatatattataggacggagagagtaaatgttataactttgatgaaataatcaaaagttcaaaacataagcatacttgtagggtattttggtaagttttagtctagactttggtactttccaatacctaagtcaatgagaaatatcaaaatttgtattaaaaaatatgataaccttttaagagatagggagaatacgaaaaatgagatacttagggtatctacttatataatccactcgtatatttttacgcctcgtaacaatacaaatgaatgtgaatacgtaaatttaactaagctgttgtcttctctgccatcgttaccaagttgtcactttcttttgtcgattgacagagtctcgtgcaattgcaaaatatatactccacttcgcaaaagcgcatcagacttgctgaaggaaagcaacctctcgcagtctgcaataatggtcgatgtgtggctcgaagttgagtcccaaactttcgacactgccatgtcagcaatcactttccaatgcttaacaatacccactttcatgggcggaattgctgacgacaaaatcgtggaggagaatttggggaaactgaagaaagcccttgaggtttacgaggcacgctcgtgcaggttcaggtacttggccggtgatttcatcagcctggcagatctcagccattttcctatgacgcactacttgttagctactcctcatgcatcagtgctcgatgcatacccacatgtgaagtcttggatcaatgatttgatgaagaggccggctgtgaagagggtgagagagcttatggaggcatgatgagaaaaaggagatatccatcaattaatcatcagtctgtaggtatgaaatgtttgtcatttctggtggggctgttagttaattataatggcttaatccagagaaaggaaggaacgacattcattatcttaattaaaacaaaaaaatgtcacgcctccatgtgtccacgtagcttattatgcagctttgagttgagagacttaattccaagttgtttcatgatttgatcagattatttaaaaaaaaaaatctctgctgttgagatatgcatctccggatctccccatgagttgaccactacagtgctctgatcaactcgctataaaagcgaccaaccccttcgccttcgcctcaagtcacacgacgccatcaatcaccatctacacctctagagagctaattaagctaaggaaagagaaaaatggcgccggcgaaggtgtacgggccggcgatgtcgacgaacgtgatgcgcatcctggtgtgcctggaggaggtcggcgccgagtacgaggtcgtgcccgtcgacatgtccaccggcgagcacaagcgcccgcctcatatctcccgtaacgtaagtacaaacgtcgcgcgcgtgcgtcttctcttgctcttgtgtaatcgatcgcttattaccggagttgcaattgcacacgatggtagcttagtactaggtactagctaagatagtattcaaagagagtaggaatagctaggcagctagtgacgtttcttagccaagtttgtatgatagcgtaaaaaaaatcattaacattaaattaggtttattaaattaactattatatatactttttactatatgagcatcttatattaaaaatgttgctatatttttttttataaaactggtcaataaatttgacttaaataaaaccagaacatataacagacgctcgcattgaagttttggcatgctcatcattagttacgaagagtagctatatttttagcatcatattaaaaaaatattcaaaacgtttttatatgataaataattacctactcttacattgtaattacgatgtaaattttcaatcttaaactgcaattatattatacgatttaatatttacatttggatttttcctaatacacaacatataagataattaggattaaaactaatttattatctacttacaaaataagaggacataggacagatagaagcatatgcttacatatagaagagagcgggaaaaaataaatcaaatcaagttaaaaaaacgtggcaccatatttttaataaaaccgttaattattactagtttcgacgccatcggtgttatctttaggttctgttaatgttaatcacgtcttttgtatctctctctatgtgttgcagccctttgggcaggttccagcgttcgaggatggcgacctgactctgttcggtgagatagcatcgtatactgcccacttgctttgtgatgtgacattggatcgatcaacacaaactattattgtgtgtgtataataaactataaataattttaacttttttctagtcaaacttatcgaagattgaccaaatttattaaaaaagattaataatattttcagcacaaaataaatatattttatattatatttaatgaaataccgtacctgttatcaaatttttctataaactaaaacaaacgtaaaataaaattaactagaaaaatgttaaatcgacttataaaataaaacggagggtactattttacttgcatctttgctattttcttggaagatattttagataactgttccagtgttccattatagactttagtaatttaaaaacgagaatacaatagcaagaaagtcaaacactctgattcctttcggagtagtaatatattgttctcgctaagcacatgttccgaattcactaggtgatgcttgaccttcaaccactgcaatactcttgcttcctactactatcaccaagagtagaataaattaaagtatatttttgacactaatttttattattacattcgtttttaaacaactgacagtgaacactgtttattttaaacttgaccattcatttgtttttgaaatatttataaacactaaacggaatgccatgtaattaaagtctacagtgtcgtaaggataaaaacgaatttttggttcatttaatctgaccatttaaagttccaatagtatatttgataca

SEQ ID NO: 2584 - DNA, 10188 bp, Oryza sativa
aatatgataataactgagctcaaacttaatcactatagttcaatctggtgtaaacctcatatgccattggtgtcaacggtcgccacaattatttgacttgtcattttcatcttatatccattgttcttccaccaatatgacaagctgcattttaacacagagtcccgcgcaatttcaaagtacatacttcgcaaacatggatctgacctactaagggagagcaacctctctgagtctgcaatggtggatgtttggctggaagtcgagtcgagccatttcgacggcgcgatgtcgccgatcatcttccagtgcttcatcgtccccatgttcatgggtggagcaactgacattggagtggtcaatgagagcttagagaagctgaagaaagcccttgaagtctacgaggcgcagctgtccaaatccaagtacttagccggggatttcattagcttggcagatatcagccatttcccgacggtttattacctgctggcatctgcccatgcttctgtgctcgaagcctatccgcgtgtgaaggcttggatcgatgatgtgatgcagaggccgagcgtgaagaaggtgacagaggctctgaagatgccgtctgcttaataaaaactgaagctatacagtttgtagtaatgaactcaatttcagcgttgcgtgacatgatgcagcagtttgcatcatctgtatgactatattcgtctagaaaaaacgtgttgtttgttcattaataagcagtgtagcgcctatatttatgagatgcatgcacattatcttcaataaatttatatggtattgaacttttcactacagcttatgatgagataaatatctgtcaaactgacaaatataaacatgcatctatattgataggattatttttctatgcctcctttgtggagctacaggtaatgaaaagttatagtacctatacaaaagagtaatcgagtaaaaagaaacctttcattgaaaatattagatcatttttgccatgcaagcaagtcctcttggaccactccaacactatacatgattaatatgagtcgataattgttcaatccaggttttatcacttaattagctgacctacttcctcctttcacaaggtaagactttctagcattgcccacattcatttagatgttaatgaatctagacatatgtatgtgtttatatttattaacatctatatgtatgtgggcaatgctagaaagccttacattgtgaaacggagggagtatgaagtaacatcatggaaaaacaacttcttgtatcaagccaacagctatggacggtgaagcaattcgatcgccatggcgctggtgagggtgtttggctccgcgacaccaagcaacacatggcgggaattcgccacaaagcacctaacagctgcctagaactgatttttggagcacactctaatggacagtttttaacaccagaaaaactgttagcggagaacacattttaactacatatatagtatcgcacaaatattcaatcaagacaaatataatacccattttcttcacatttaaatgtccgcataatacagcacacaaatgcaatacgcatttttttcgcacaagaaaaacgatgctatccacaacagcagcgctcaagtactcaggaatcaggactgagcatgggagtaccatttcttttcggctgagcgaaggtcttcacttagagtttacaagtcagaatcatacatccaagagagatggacccaagaaataactctttgtttctatggttatggttgggatgcaccctcagctatgctcgaagactcgaagttgcataacaagttatcgtgtattttcggcaccatatgtcgggaatatccaggctttttcatctctttctagcatgaacagataatgccacatttagttactatctaggtttagagggacgcccaggggaccttaacacaccactccttcatctttcagggtttgtccagtcattagataggtacctcgctttgacattaagttaacttgatagacttcaaactagagttgccacactcgataggcgggtagaaccattatgtcattaagggtattatgataatgcctttatttatgggagcaccattatgcaaccactcaccgaaacactggcacctcctatgggtaaatcgtagggcacacatgggagtgggatatcatcataacaaccgcactatggctgacccgacatttgttggtaatccagcattacatggactgtcatattttatgaaaggaatggtcgacactaccgtctaaccatggcgacccctaccactgtggtacccaatcctccagctgggttttctgaaggcacttagatcttgtaatagggatccttgaataaatgtaaccctcctatagtgctatgtaatattatctaaatctgaaccttctagtagtcaaattttgtaacaccatgtcctgtacgtggttctatgtgactaccatccatctttatgtatgcaaacctatgataaatcaatgtgaagttatgtaaacttttgtgattgctcttccattttgaattgatatgcttgttgtgcagaacttattattctgtaaagttgaaattttactcctttaaaacctgcacaatagaaacataaatctagtactctattcggctatctcaagttttgtcatatcttgcttagcttgctcatgtactcatttgtactttgagtgcaggatgactaatactcgatccatgtccgggaaaccggaggtcggtgctccgaaacaatcccttctaatctaacctgagctggcactcagccatcaggtcatgctagaggaagttgtcgaatcgcagaaggtgatcaatgtgatgataagctttctttaccacatatcttagccacccagaaccggctatttgaaaggatgaaagcaaatgccgagaatgtgggtgctgctatggtcaatcatgcaaaacaaggacaatccaagctcgccaacgttcaatgcactcaccctccacatctcttctctgctactgatccactggctctgtggcagtgaatccaagcttgacctctgccgatgcaaaaatgtggagaaagcctcctatgcttcctattaccttcagggtgcagcctcagcttggtgggagtcatacaagactcttattcctcccgatgagcttatcggctgggttgttttcaaaggagggatttagatttgctcatatacatgccagtctcatggaaatgtagaagaaagagtttctcaacttgaagcatgggaatatgtcctttatggaaatttctagattgcttgaactatctagggcactatgcaactttagagatgcccactaaagctaggaaatttgagctattgcgcgaccgacttaatctggaactcaagcatgctctctttgctcataaaatttctagcatgaagactctggctgacaaggctcttcgtgtggagccagtgaaaaggaagttcttgaggatcgcaaatggaagtgggtagccagaaaagatgcaagtagcagcagctctacccgatgcgcctttctcagcccacgatggtccgctatgtggcttcgcagccaccgacgccacagtttgctgtttcccatcattcagctccgacaacagttcaattatattcctgtggtgcctcatcgcaaggaaatcagaatcgtgtagctaacataaatgctacaacgtactgcgggaaacttggtcattattccaataactatccatttccgaagaccgaacgattagtgccacgtcttcagggaacaaaaccgcagccacatggtcccgcacagggtcatggtgggcagcaaggtggacatattgcagccaagccatctcaacctattggatggggccgactcaatcatgtggccgttgaggagactacggacacatctgacatcgtgctgcgtacttttcatgtgcactctgctcctactcttgttcttttcaactctgggtcatcacattctttcatatctaccagattagtgaaccaacaaaatctgaaagtcaacctattaaagaatgccatgttagtacaatctcccgttgcaaccattaaaaccaatctagtatgtaatgatgttgaaattctaatagaggggtgaagttcaaagccaacctcattcagttaaactatcctagcttagatgtcatcttgggtatgaattggttgtccaaacaaggaaccatagattgtactaaaaatattatgtcattagtaaaaactgatggtcgacatatcacattcacatctgatcgtgctactacttctcagcagccatcacttcattctctatcaacatcgagctcaaatcagtacccatagtaaaagagtatccatgtgtgttccctgatgaactaccaggaatgccacttgaccgtgacatcgagtttgtgattgatttaattcctgggacagcacctatagctaaaagaccatactgtatatcctctaaagatttggtggaacttaaaaggcaaattaatgaacaattagcttaaggatttattcgtcctagctcctctctgtagggatgaacgttgttgttcgctccaaagaaagacggtaccatgcgaatgtgtgtggattattgtcctctaaatgaaatcactataaaaaaatcctcttccaagaatcgatgatcttttcgaccaattgaccggtgctcgtatcttctccgaaattgatctgtgattaggattttcaactgaaaatcgaaccggaggacattccaaaaactttgtttacctctcgctacggtttatttgagtataccgtaatttcctttggattgaccaatactcgtgctactttcatgaatatgatgaatacaattttcatggagcatcttgtcaaatttgggttggtattcatcgatgacatccttatttactctaaaaatgagtaagagcatgcccatcatctgcgtttggtgttagacaaactccgtgaacatcaactctatgcaaaatactccaaatgtgaattttcgttgaaagaagtttctttccttggccatgttctttccaaaggagggatcgcactcaaccgaggtaatgtactgttgtcgaaacgacaaccgcatacgtcgaaagacgtggttactcaacagtggttggaaagcagtaaagtgtattaaattgagaatttttcttgggatcccccttttacatggccctaggggtctatttatagccctattacaggttcccctattagggtttaggtttaataggggaatttacatggttgcccttatgaaagggacatttacatgggtatatagtgtaattgaggtacatgggcctctaatgggccgactggcgaacgctggcccagtggcccccgggcttgatcggctgagacggcctcttgggcctccttgaagtttggcttgctatggcgaagtcatccgccttcgccataccttcttcgccatatagacttcgcccaaaatgccttcaaccttgtgggataccagtgcgattcttcgcccttcgccatctttgcttcatagtcttcgccatgggggcttcgccccgatagactcgacgtcttgggcttgaaccctccattagttgcatggtttcggcaggaccggtcgaagagtctcatgacataccgccaacaagcctctcacaggaaagggtgagataggagcttcggctgagaccgtgcaaaccatgtggtatggtatgaggcaccccttttcgaccgacgctcctgccgaaacctattatggattcctgcagagaaaacgtgcattgtgtgtacgtgtatttttatggttagtaacgttttgtaggtttcgcctcttgtgagcggcgaaaccgtttttattattttttcctgggccgaaatgaacagtgatgggctttccctttgtgggcttatcactgtgcggctcgatcgatgggaatttcccgtttcgcctacccttgtgacatgtggcggcttatgattgggcggggaggcgaaccgtcgcttgggtgggctatatattccccccttccctttttcaccgccgcactctcattattttcactgcgagcgctctctccttctccattttttcctttcacggcgccccttgatttcctagatctttcggttgttctcccttttcgccaccgcgcacacctttcaccatggcacctcgcaagccgaaccccgcttccgcgacaggccctgatcccggccggatcgacgacgactccaccgcctttctaggggcttcacttgtggacgacgatgagctggcgaagcttgtcagcgccggccctctggtggaggggcaggccttcctcccgggaaaggccgtggtgccgaaacccggcgacaactggacggtggtttttgccgtattttttggggcgggccttcggttttcatgcaacgttttgttgctggagatccttcgcctcttccaggtggagcttccctagctgagcctgtcggcacttgtccgagtcgccatcttcgactgggcgtgccggaccgccgggttcgaaccgagcactgagcttttcgacgtcgtgttctatgccaccgtgaactcgaagacggttgtcaccccggccaggacgaagaaaacggcgttcggaagcgtgaactttaatgttcgctctgagcgctccgatctacggccggtgaacgccgccatgtcgaagtgggatcgccattggatggcgaagtggttctaccactccatccccttcgagactggctccgacgcggcgaaggccctccgttagcggcgcagggcgatttcgccaaacatgaagcccaatgtcacgtcctgataaattcatcccgaaataaaaatcattctctaaaaggaataatagaattaatgaaaattcaaaaagaaattggcaaacactaaaatacgtacaagaaaaattcaaatgtggcccggagaatttttgttaaattctccttggtcttaaaggagccctcaagtttcacttgaattttcagagcaccggaagtaattattaagcaacaacaactattaagaaagtttattaaaaagaaaacctaaaaataatcccctcctcctttgggccgagcccagcccaaagtctccctctcatccctctctttccctcctcccccgggcctctcctcctcctcccggcccacctcttccctcccctcccacctgggccgcctcctggcccaatgccgagccgcgccgcccatatatccaagactattgcaaatcaactaaaggtagtgctgccggatatcatctctatagagcaatctgcttttgtacctggcccgtctaatctctgataatattttggtggcttatgaatgcttgcattacatgaaaaccaataggacaaagaaaaattctttttgcgctttgaagcttgacatgacaaaggcctatgatcgcgtcgaatggaattttttggaagcaatgatgaggaagttgggctttcatgattagtgggtaagaactataatgaaatgtgttacttcagtttcctattcaattattttaacggggagcatttggatttttttcgaaccctctcacggtattagacaaggtgatcccatatcaccttatctcttcttgttatgtgctgaagctttaacttgttgtctgaagaaagtgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcgcttgaagcatgtgtggtggagagaagaggggaaacacacgcgcgcgctcgctcgcctcgcctcgccgggcagggcagggcagggcagggcagggcaagcggcgcgcgtgcacgcgtacgcgtcgaatggtccgaaaaattggctcctcacccttgcgcagatgcagcctccttttgcagttttgttttgttgcaaattcggattcgtttttgttttggaaacgttccgaaagatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatacacaaaatcaatctagggtttgcctcctactctgtactgcgccgtcgctcgtagactactccatcccgctcgtcggcgtgcaccggcgatcgggagagcaggtctccggaacctctgccttcgacgttctgcaccgggagaaggcggcaataaggtttttgggaagcgcttcgcgcgactgctccctgttcgttcgcgacggcttgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttatcataggcactgtgattttactatggctggttttgccgatgcactgaggccggataaattcaccggtgtgcattttaagagatggcagatcagggtcactctgtggctgacagctatgaaatgcttctaggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactaccttcatcttggagaagtttcggtactgcactcaaacacaagagacaggaatacttcgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaacaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgtttttttagttaatcaatctactaattggtgggttgatactggggccaatgtacatgtttgtgctgacatctcattgttttcttcttatcaggtcgcacggggttccaccgacctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttctgtttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccaaggagagaaacttggcaccactagaactcctacattcagatctttgtgaaatgaatggggtgt

SEQ ID NO: 2585 - DNA, 3085 bp, Oryza sativa
tgtgaggaacatggcatcatacatgagaggacgcctccctattctcccgagtataatgggatgctgaaaaggaagaatcgcacgctgactgacttggtgaatgccatgttggacaccgcgggactgcctaaggcatggtggggggaggcattgatgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccagacatgcatgttggtacaattatggagtctcgtgattctatcttctttgagagctttttcccaatgaaggatacacatagtggttcgaaccaaccctttgaaataattcccagttcaatcacaccaccaaaacaaactgaacatacacatgaacttgtctctgaggaggatgtcagtgaagctcctcgaaggagtaagagacaaaggacggctaagtcttttggtgatgatttcactgtgttcctcgtggatgacactcctaagtcaatttcagaagcatatgcatctcctgatgcagactactggaaggaggctgtccgtagtgaaatggattccattatcgctaacggaacttgggaggtgatagagctaccctatgggtgtaaacctatggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaatcgtctagacatgtgaaaagacgattgaagtctgtcaggaaattaagaaactccggagttataacgttggattacatccaaacagcgagaaacctggcagatccttcacgaagggactatcacgaaatgtgatagacaatgtatcgaaggagatgggtttgagacccatgtgagttatactatggtggtaacccagtctatgtgatcggagatcccgtgaattagatcttaggaagaccaaaccattaataaactagaggagagtcccaatatatataccctctccaagtgaagatgcatatactctcgtgagctgcaaggcaggttggctatgccttaatgagttctgttggcttaaattagcaaagatgttgtcctgcagagcatttttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagtctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcgcttgaagcatgtgtggtggagagaagaggggaaacacacgcgcgcgctcgctcgcctcgcctcgcctggcagggcagggcagggcagggcagggcaagcggcgcgcgtgcactacgtacccctcgaatggtccgaaaaattggctcctcacccttgcgcagatgcagccttcttttgca

SEQ ID NO: 2586 - DNA, 6211 bp, Oryza sativa
cgcatatttgatctattcatgttatactgtgtagtttacatgtgtagatctaatgatgcgttcatgctagttttcatctgtaatgtcatgatttatttatggaatagattaaatcattatatgtctataatctcaacagaaagaggaagcaaacaagagattgcaaggggttcaaataactaccacagctccaattataagccaccttttgtttgctgatgatagcttgttactattcaaagctactagtgtttgtgcagatgcagtgagtagagttttaactaactattgtgcagcttccggacaactggtcaacttttctaagtcctgcattttcttcagcaagaagtgtgatatggccatccgtgaggacatcaaacgaaaggttggaatgactaatgaatctataacagatcgctatttgggtttgccaacggatgtgggtagagccaaggaaggaaaatttaaatacttgaaggacagagtgtggaaaagagtgcagggatggatggagaaaacactttcagttggaggtaaagaagtccttattaaatcaatagttcaagccatcccaacttattcaatgagttgtttccgtttacccatgggcctttgcaaccatataaattctttaatccggaaattttggtgggcaagtaaacaaggttcaaggaaaaccaattgggtagcatgggacaagatgactgtgcctaagtttcttggtggaatgggatttacggacataaatatttacaatctaatattgcttgccaagcaagggtggacaatcttgcattatcctaattaactaacacctagagtttttaaagctttctatttttcaaatggagacttcctgaatgctggtttgcgaagtaggccatcacatacttggcgtgctattattgaaggtcgtgaaattcttaaactaggaattattcgaaggattggaagtggaaaagatactttttatctgggatgataattggattccaagagattggatgcttcgaccaatcagggcctaagaatctcacccaccggtgaaggtcagtgaacttattgatgcttcctccggaaaatggagacatgacttactggacaagttctttctagacatggacaaggaagttatcttaaatattccactaggctcaacaagacaacctgattcttgggcgtggcattatgagaggtctggaatcttctctgtgaaatctgcttatcgaatgctggttcaaacaaaattgcaaagagagaattggttagacaacaaagctagtgtctccgatttcagtgccattgctaagtcttggaaatctttatggggaatcaacgttccttccaaactgaagatttttgcctggagactgtcacaaaattccattccaacagaaaacttgcgaaaacagcgaaacatgagtacagcagatatatgtaaaatatgtggtgcagcacaggatacttgggatcatgcaattctccaatgcaccatggccaagtgggtgtgggctctagtggataatgatataacagaccttattgcaatcacaaatattaaagaccccagagaatggttgtttcatatgcaagaaaatctaacacctgagcttatggtaaaattgattgttatatgctgggcaatttggcattctcgatgcaaagctttgtatgatgatttttatcaaagccctttaacaatctggggctttattgaatcatatctggctgatttggaaatcattaataatccaatgcatgtacaggttgagacctctagtttgtactaaaacaaccagttggataccacctcctgaaagttgcatgaagattaatgatgatggagctgtttctcgatcaagcaacaaaggagctcttggagctatttgtcgtgacacatctggtaaatttctggcagctagtgctatggtttgggaagggatgtctgatccaactacactagaagctcttgcttgtaatgaaggacttgctatcgccatggactgcaacatcctaaaggtctgtattgcttcagactgtcaagaagttatcaggggtattgcgacaataccaaaatgcagatatttggcagtccttaatgacatcaacataagaagccatcactttgttagagtagaatttcatcatgaaagtcgggatctaaatgtagatgctcataacttggctaagtttgcatgtacattgagtgaggggcgtcatgtgtggcttctaaaccctccaggttttattgcgatgcatgtaaatctgacttctcatgaatgaaattaccgactttcttctcaaaaaaaaaaagccacccgagccgcgtgcgcacgcgcattgcacgcgcgctgaccgcgcgcccgcgtggggcccacgtgccggtcgtcgtctccttcctccagccgcccggcctcctcactctctctcgtgaaccctagctcgttccctcctccaaatccaccccattcaagccggctctttccaaattaattggggggttttaatccccattgattcctctttgatttcccccgttttcccccttgattcgtgcccccaatcgcccggaacggccgcgccattcccggccaccttccatggccgccggccgccatttccgcctccattccaccttctcccgtggtcggctcgctcccccatcctataaaatggaacaccctcgctccgttctatcgttttagccccttcccgagctcccccgtggccgcaccacctctccccgcctcctccttctctttcctcggtgccggccactctccagccgcccctaccacctcgcccgtgcgccggccggccgcgccgtctcctccctcggcgtcgcagctgcttcccctccaccggcgtcgcctccgtttcgcgtgcagaccaccggaggcgcgtccccgccaacaaccggtggcattgccgccacccactacctctagccgccccggttgccgcgacagagcatcgtctccttccccggccactcctaggtttcgccggaacaccgccgtgtcgccgccaacccctccacccgcctcgccagagtccttcggccgcccgttcctcgtcgtggcgtttgtccctccatcaagccgttctcgttcgtcgtcctcactccgtcaagtgccgcagccccgtcgtcgtcttcgtcctcgcctccgcgtcgtcaagcgttgcaccggccgcgtctcgcctttgtccaaggatcgccgccaaagtcgttccctcgccgttcgcctccgtcgtccccgagctgtctccgccgcgcccgttcaccgtcgtcgttcccacgcctcgttgcgtggtggtaaggatccgtcctctcgctcctcgtcctttcggtgtcacccgtgcccgttgtgcggttgtcgaccccggtacccgtgtaccggtgtcgatagtcgttcgcttgtgcgtgtggtgaccgtgtttgtgtgccaaaaagaaagggctcgtcgatatcgctcgtgttttcagcgacgacgagtctttggacaaaaccctgacttcgcccgctggtcgaagtttaagtctttcgaccgcccccgttgtcatagttgacactggcggagcggggtgtagtgctgccgctgggaccttggcttccgctgaccgggtcgtcaaggccgcggctagggtttttggaagccctatgcgtcagccggttgcttcgccgcttgtcataccaaaggggaagggggctgccgtcgaaacatctgcctcgaagtattctcttgcggcgccccacttcgcccctggtgattttgaaactcaggcagagcttatccccttcgtcgagggggtaagtaatcttgtctcgccggctggcaacccgagcttgttcaccaaactgaacgagttcgacgaaggttgttctgccatcaaaagtttggcagttcgggtatgttgttcatttttctttcctttctcttgtttttctttttttttaaaacaatctcataactgacgttcgtcctcttcgccccctctatttttgtacccagattcttgtggctcattgttcgacagagcgaaccatgcgggcccgtcttgatggattcaagaaccgtcttcgggccaaggatgacgaactgggatgcaagagcttggagatggagggcctcgctaacaccctcaaagagacgaaggccgaaaacaaacgactccaagccgagctggagaaggagagggaggcgaatgctgagattgagcgcctcaaggctgaacttaaaaaggagcacattctcctgctctgactgattattacaatctcaccaagccgaagatggaggctctttgcctagaggtcagcaaagctgaggcgagcgccgagaaggagtcgcagcggttcgtgcgggagatggcgaaagccaccgagtccgcgaagatggcgtgccaaacacttcgccttgccctttccgacatggaggcgagggtgcgaggagtccctggcgaagatgcctccaccttcgacttctcggagtgaacctagcaggccggtggtgcggtctcggactgcgccactgcgtacggcgattgctgtgcacgcgtgtcggcggccttcaccatgggctttctgcaaccgttcggctacagcacgtcgccgagttccctaactatgcgaagggggactgggaggtcagtgcacaggacatttcgcccgcgcttcacgcctggcgaaaacagttatggcagaaggacggccgatccaccgccaaggcgcgtcttcttgagcaactagcgaaggctgaggcggcggaccagggcgaaggggaggatgcagcggtcggagggggtggaggcgatgcccaagatcacccagaggtatgaggccctccgtcctctctttagattttgtagttttctttggcgtttgccgcggagggcgaacaatgtaaatttggccgatggccctctccccttcttattgtagccgaaaacggccttttggatatgtggaatggatgacccaagtttagccagttattatggtcgatgcctttggcatatatgcttgcgtcattttcgcattatttttgcatactagagagtgtttactcttttcgccgacttttacgtttcttgcaaagccttaactttgcacttcgccttttgccctttctgcactgttttagcagggtgttcaccgaaaattgtgcgtttggcccccctttgggaattggcgaagcaagaacaagaagttcgtggcagtgaagggtttgccgaaggtgcgatgtccgtttcggcttgtttatcatgagatgataataaacagcaacagttacaaggttttgaaggttgtcggctggatgcgggcgcaccccgggcgaaccctggaagactacgaccatgttcatacagaaggtctggagaacatggttcgcttttggcgaaaccatcagatgaccaatcgtcaggaggcgatctcctagcgtcgttatagtctagtctgtgtttcgcccccttcccctcttagggtcatgtataatattagtagtgatgacgaacccaatttgccaaaccattccttagggagtgaggattgatgtgggggcaaaggtgtaatttatctgtaagctaggttgtaaagccattgctttctttgcttgtaccatgttgtaagacttgtattcttcgattatttattcgaagttaatatagatgtgctttatttccttttcgctatttttcgcattgtcacttttcgtgctttcgttaggtcggaatgtgtcggcccctttgcgtatattagcgaaataggtctgctgactttttagctttcgactttcgttttcgatctgtagtattctgcgctgaaaggtgcgcttgtgttttcatattgatcgagtgtaacggtgttcggttagttgttttccgaaacaagctgttgcggtttctgtcacgtcccaaaacgactctaaaatacatcctctaaattatgcctacaataattaaaatccgtgtgaaagcctccaacaattaaaatgtgcaaagttaaaagtcaaataaggcttagaggatttttgtatatttcctagaagcctaaaatgcgtaaataaattttagtggaattttcagagcacaaataataattattaaaaaataaacaaagttaaaatgattttataaaaagaaaaactctaaaaagtcccctttccctccctctccctcctgggccggctcggcccatctccctccccct

SEQ ID NO: 2587 - DNA, 25932 bp, Oryza sativa
tggtagtcgccgtcgacatagggtgagcagtgcaccgccgcttcttttcccccttcccttcccctctttcggccgccgctccgccacgccggtggtcgccggcggcgaccatcggggcgcgggcgcgccgcctcccgccggctgcgccggcttggccgccctcgggcgcgccgagtggctgccgcgtggggcccggccgtcaccgcccgcgcctttaggtgcgactgacgcgtgggacccacggcgccggccagtgtgagcccgggtgcacccggtccaccgtggaccgtgaggctgctgcgtgggccccactcccgtggacccagtccgcgcgccccttcccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttagaagtcaagaacccatttttgtgctttgttcctgcttgttatatggagtttattagagtaaaagctttttcctttccgttggtcgtgtagacgctgcagcttcggaagatccgctcttcgtggaggttgaagccgacgtttgggaaagcgagcaaggcaagtcacattatccttgagcatattgaatcccagtttataaaattattttgatttaaattattgcattatcgcttttcttaaattcccgcgttatcactgtttttatctagccatgcctagttacctttgttatgaccttattattgttattgttattattaccttgttcaccctagattaaacaaaaccccaactagtggacactccactcatggtaccactagtatgattttaggtagctgcttcgctggttaattaggcaacattaggtggttttacaactctagaccttgggaatactcttatcacctggacactatggaattgttggattattgtggaattggattcacacctccccctctattcaaaatccccaaaatggttttaggctgggctcggggtgcatggttttgatagtagcacctcggccatataagggccggtcttcgggcctctgttgcaaagcactaccgtacttccacatgtctagtgggtaaggtttagtttgtggctcagtctggttataaacaaaagtacacgaatggagatggacgaagtcgggggtcgatggacatctctaggacaaatgaaggctacacgagctgcggcccggtagtcgagatgtcatggcacagggccggtgtcctgctgctcggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagctgcgccctcggttatgggcaagccgagcaatgtacccaagttagtgttttaattcttaaaacctacttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctagaatcgtgtttacaaaatagctttgagcaactaagtgtcttttaatgctgtttactgcaaaccctaaccctttatattataacccccttgtactcccttgcatttatcctgcacttgtggttgtgtcttgttgagtacggtggttgtactcagtcttgcacaatttttcccaaacccagaagaggagcccctggaagatgaaggctttggtgtctagctcgtgcctgccgtcaagcgcctgtggtcgtcgccctagtcttccgctgtttcccgtttgtctttgtgtgtgctgggccttcgccgcccatgtaataaattaactatttacgcttccgcttgttaaactctgaactgtatcaacttttggtgtaccttgcctcctgggacaaggaataatgcacgcacgtaaggaacgcccgttgggttatttccggtcgtgacagtttcaacgttcagcgagcgatgcttcggccgattcgtttcgccccccctggcattttcgctgatcaggcgtttgccttggggtttttccacaaattatcattcacacaaaaaaggcaaaaaacacaaatattttatactggttcaggcctccagagtggataatagccctacatccagtttttttttcttttttcattttcctctttttttgcatttttgtgccgaaaggcttacatagtgccgaaaggcttacataacagtatgtacatttttacaagttagcgatttgggtgccacccgcgctacacatagaaacgcttaagggaagccgcgttccaggaatggtcgaactcttcgccttccagcatcgctaggcgaaaggagcatgtcctggacatgtgcttgatgaggtacggcccttcccgcttcgattcaagcttcccgaccaccaccgggttctccttccttaggacgagatggccaggcaatagctctgtcggtcgaacttttttgtcgtaatttgccgaagtgtttgtggcgtatttgcgcatgtgttctagtgcttcgactctcaccccctctaggagttcgagcgacacctcgcgcccctcttcgcctcttcgcctctagagaacatcacccttggtgaattagcccctaactctgttgaggtcattgcttggtcgccatagagaagcatgaatgggctgaacttggttggccttgtgggggtcgtccgaagggcctatagaacaactagcatttcgttcggccacttacccttcgctgccccctcaagccttttcttaagcgcctcaaggattttaccatttgtgcgttcggccaccccatttaactgtgggtgcgcgaccgaagcgaacctgatttccaggtttagcccctcgcacatctctctgaacttgtcagaatcgaattgcttgtcgttgtcagtgatgatctcctttggcactccgaaacggcaaataatgtttttccatacgaacttttgtactgctaccgaagtgatcgcgccgagtggttcggcctcgatccattgggagaagtattcgatggctacaatcgcgaacttgtacccgtttcgtgccatagggaatgggccaatgatgtctagcccccatctggagaaaggccagattggtgcgataggctgcagctcatattggggtgcagtttggcttcggctatgccgctgacagcttttgcacttcttagcttgctcaacacaaactttcagcacgatgggccgatacacaccctgtcgaaacactttggaggcaactgtccttgcggcctggtgtgcgccgcagagcccctggtgtattttattcgccatttcttctccttcggcaaaggagatgcagcgaagcaagggttggagcaccctggagcgatatagctagcctgagaccagcttgtattttgcggctctgagctgtaggcgcttcgcttctgcttcatcctccgggagccagccgttcttgaggtactttacgaacgaggttcgccagtcttctgggtcttcacccagctctgtctggtcgattgccatgatgtccaggctctctatgggcacacttggtgcgtacaggacctcaaaaaagatgcctggcgaatgcgggcctccacaagcagcagatttcactagggcgtctgcttcctcgttctggcctctaggtaagtgttcgaccgttatgccggcgaaacacttttccatagatcgaacagcctccagatacctctttatcccttcttcttttgcctcaaaggatttgtcaacatgacttgccaccaatttggagtcagttcggatgagcaagcgccgaacccccaaagctttcgtcttttttaggcccaacaatatagcttcatattctgccgtgttgttggttgtgtcgaactgcagccttgcagcataccggatcggcatgccccctggcgaagtgagcactgccgcagcacccgcccctttgtgcgaccacgagctgtcggagtacatcacccaaggttgttcgacaggctcgggttcaagggcgaatgccagtgtccattcggccacgaagttagctaggacttgagacttgatggcagtgcgagcgacgaaatgcaggtcgaaggaagataactccgccgcccacttgttgagcctgccagtaatttcctggccccggagcacttcgcccaaaggatactgcgatggcaccgtgactttgtgggcctgaaagtagtgtttaagcttgcgcgaagccatcactagggcgtaagcaagcttttccatttcaatacactggtttctggcctgactctgtttcttggacgagggctgcactgaccgccaccggcaaagccgctaggtagagtagcagttcgcttcctagtgctgggctgaccaaagtgggtgggctctgcagatatcgcttcagctcgtcgaacgctgcttggcattcgggtgtccaggtaaactttcccgcgccccgaagggtcttgaagaagggcaagcctctttcgtctgcttttgagaggaatcgactgagtgccgcaattcggcctgcgagcttttgtacttcgcgtacgctcgacgggggcttcatttgctgaatggaatcgattttctcgtggttcgcctcgataccctattcagaaacaagaaaacccaacaactggcccgcgcgaacaccaaaaacacacttctcacgatataatttcatacccgccgcgcgtaagttgtcgaaggtttcctgcaggtcagacgcatggtcgaaatccttgcggctttttatgacgatatcgtcgacataagcctgcacatttcaccccagctgcttgtaaaggaccttgtacactagcttggtgaaggttgcccctgccgaatggtgtgacgaatgctgtcttggggatgtcggccggactcatgtggatctggtggtagccttagtacgcatccaaaaaactcatgagttcgcagccagctgtcgaatccacgagctagtcgatccgcggcaaggggaaatcgtcttttgggcatgccttgttgaggtctgtgaagtcgacacacatgcgccatttgctgttcgatttccgcaccagtaccggattcgccagccactcggggtggtcgatctcctggatcaccccagccttgagcagcttttgcacttcggctttcgctgcttcttggcgatcaacggacatcttgcgcagcttctgtttccttggcttggcatccggcttgaccgccagatgatgcatgatgatgtctgtcgaaacacctcccacctcgtcggggccctaggcgaagatatcaatgtttttcttgagcacctccaggatgttctcaacttctctttcgcacatgtcgccccctagagatacaagtcttgtgggatcggcatcgtcgacctgcaccttgatcaccctgccatgagggggtcatgcagttcggcctcaacattgtgcactgctctgttgattatggctaaatcgccctttgatgtagctgaaggttgccacgatcactcctgcaaggccaggcatcttgagcttgaggtaattatggtgggagatggcttcgaacttgttcaaggttgcgcggccttagatggcattatagttgtatgggatgtcgacgacgtcgaacagtatttgctcttcgcgcctgttttcacctgtgccgaaggctaccaccaattgtgcttggcctaggacttgaactgcctctccgccaaaaccatgaagcgaggccggtgcttgggtgagggctagggtaggcaaccccatctcggcatatgcttcggcaaagatgacgtcggccgaattttctccgtcgactatgattcgccgaacttcgaagccagctacctcggccgagatcaccagggggtcttgatgtgggaacaacactccttcggcatcttctggcccaaaagagatctgctggttcaaatatcgcggggccccttcacttgccaaagtgatgttgtgcaccattggcagctgcatcttcttttgcccttttgacagttgattcggcgggtcagtccttgtaatcacttggattactctgcactgcacaccttggtgctgttcggccgggggtgcttgttcttgaatagcttcgcgagatgcttcggcagctgctccatgctgcggccttggatcttgcgcgttgccacgatgccgaatgtttcggcattgctcggtggtgtgcacagagcgtccatggaaggcgcagtaaagatcttttctgaccttcttgcgaacgggctgttgatggctgcttgcctgttgggcatcgaactccttgcggaggtcttaaacttgttcgacagccatcatggccttgcctgcccggtcggttctgaatttcctccaagtcatgggagcttgacttggccttggcggttgtccttgggtcgccgactgagactggcgaatggcgaaaggagccggttcggcgacctgtgcttgtacttgggcttaagcagcggcgacagaggctttatcatactcggcctggattgcttgctgtcacttggaatcgtcttcgccccttgagtacccgttaatgatgcgaagtaggtgctcaagcgtctgcggctccttgttggcgatttttcttgtgagttcgccctcgagcagcccggccgaagcggcgttgatgacggacgccttagttatatcctgaacttgacatcgggcttgcgagaagcgatgcatgtactcccttatcgactcccccggcctctagtgaatgccgagtagatgttgctgcgtcttcggctcctcgtaggtgcctcgaaagttaaggacgaagacatcgcgcaattgctcccatgagtaaatgctgttagctggtaaattgaagtaccaagaacgggcgatgccgtctagagcgagatgtattaccttcgtcttggtattttcatcaccatgagaggcttcaatcgtggactcgtatatggacaggaactcttttgggtctgtttcgcccgaatagcgtgggacgggtgggaacttgaactgggatgggattggacggatcttgattctcccgctcaatggtagcctcttttcaccacccgccttgttcgcggcaccttgctgcggctatggcgtggcgaagggcgaagtcatggcttgcgcgtgaggttgggccacagtgttcggcggcccgtctccgaacggggacgcttggtgcgccgccatggatgggtcgaacgacggctgggtccatgccatggcgacctggtttggcgcttggtttgctccgaagcctgatgtcggttcctgtggtcgaatggttggtgcttgagcagtgttgatgaagtcgaactgcggtccttgactccaaggcgaaaccctcgaaccaggctggctcgacggcaaccaactgggtgcactttggccggccaggtggtggcgggtgtacttggatagtgaccggctgagcctgcggctgcacataaggggtcgggtgtattgttgcggccgaaggctgcccggcgaagtacactggcgcttgcatggcttgtggcggaaggggctggattgatgcttgtgggtggacttggggtggaatgtagcccgccgaatactagaggattgggaccgaagcgaccttggcttgccgcgctgcctcgtatgcctactgctgttcttgcatttgtcaaagcatgtcttggagttgcgtcatgttttgtcgcatggcctccatgtcggcttcgccttgtgcttcgaggttggggttgacttgtgcagcggcgagcgcggtcgaagccgttgccggctgtgatgaagcggcttggggcaccagcagctggcttgtcgaaaggatctccgccctggtctggagcgcccttgccgccgcggctgccttcgccgtgtcgaccgtgtttggcctctgcccggacgaagcggcaggagccgaaggtggcagttgcggcgccggtgccgaagccgatggtgctcccctagcttcgcccatggacgtcggaggctctgctccttcttcggcggccatctcctctcctgcttcggtctcctttcgctttgcgaccttcttcttcacgaccctcttcggtggcattcgctctcaatgatttcgctcggaggtccccacggtcggcgccagctgttgtcgaaacgacagcggcatacgtcgaaagtactcaacagtggttggaaagcagtaaagtgtattaaattgagaatttttcttgggatcccccttttacatggcctaggggtctatttatagccctattacaggttcccctattagggtttaggtttaacaggggaatttacatggttgcccttatgaaagggacatttacatgggtatatagtgtaattgaggtacatgggcctctaatgggccgactggcgaacgctggcccagtggcccccgggcttgattggctgagacggcctcttgggcctccttgaagttcggcttgctatggcgaagtcatccgccttcgccataccttcttcgccatatagtcttcgcccaaaatgtcttccaccttgtgggataccagcgtgattcttcgcccttcgccatctttgcttcatagtcttcgccatgtgggcttcgcccccacagactcgatgtcttgagcttcaaccctccattggttgcacggtttcagcaggaccggtcgaagggtctcatgacataccgccaacatgtacaaaatgtgtttaattggaaacaacactagaacgttcccgaagtcacaagttttctcggcctagctgattattatcatcgattcatcaaaaacttctctaaaatcacaaggcccttgactcaactctttaaaagagaacacaaatttgagtggtctgagatatgcgaattaagccttcatgaattgagaaaaaggctcaaagcagccctagtgctagtgatgccagatattcatgaaagctttcatatttactgtgatgcatctcgacacggacttgattttatattaatgcaagagggcaaagtggtggcttatgcttcacgtcaattatccaacccatgatttggaattagcggccgtagttcatgctctaaagatttggcatcattatctaataggcaactgatgcgaaatcttcatcgatcataagagcttgaaatatttcttcacccaattagatctgaatctgaggcaaagaagatagttagaactcatcaaggattacaatcttggcattcattaccatcccgaaaaagctaatgtggtagcagatgctctcagctgaaagctacatcacattaccacctctgtccaagttgatcaaccgaagttactctctgatttttagaaactcaatttggagattgtagatgaaggttatgttgctgctttagcatttgttaacagcaaaatttggcaagatagtctcggatttggagttggatatcgaattgggtttgaaggagattgaatcttgccaaaacagactgcgccgattgagcggatatggcaagcagccgatacgactcaacttgggctcggtttgggcctcgattgagataactgatttttccatatagagatagagctcgtttaagacaattatatctattaattaagatattaatgtcaatttgaattagagatatagtaagagtctgccatgtggacttgtttgtttgttttatctttaggaaagtttgagtcgtgtccataataggtacgttttgtttccggggtataagtataaaccctagatcattgtaataagggatgacaatccaataaatacaactttcagtgcgttgccaccttttctctttttactttcgatgagttcttgcttcaagttggggcatcggctgcgatctctcgacaagaggcaacttgtctcaatggcttgcactattggagctcttacatcgctttagatgtattagtattttattgtgatcatcgctatcatatatattagttaatctagtttagtatctcgatttagtcgtatcggccgattctcgctttagggtttatgctgctatcggctaaattatcttactagattagattagctaagatatctaccatcccgaaaagtggataattccttgattgatttttatcatactttaagttgcatcaaccctagtcttgtctagaaccttaaaaactaacctggaattaatcataactaaggatagtatcggagtttcagccgatcttacctaatatacatgatagtgcatgtttcgtgatatgttttatgtatatttgccacttatatacatatatattactctatataaatacatcaagttagattggtctcgattaaacctcatattttgtgatcgattgttatttgatatatttatatagattgacttgtttatataaatttgtattggagtaacagctaatacattatctatctttgctctaaatattggtctatcagctatttctataatactgtcttaaagtgattgataaaaacaaaagagacagtattacagccgatacggcatatttagggtttcgttctatttattcattccaaagccgcagtcgatttggttcaacctatcagctgggtccaccaaaccatcgcagccgctgtatttagctggccaacatccactctcctcttctcaccctctgctcatttcgtgaagaaactagggaagatcatctagggttcgtcgtgcacaaaaccatcttctctggcaccagcaaggttgagtccgccgctcatagtcatcaggtgagaattctgttcttgcttaagccgtgttccgcaatctcctctccatgctgtctctaacccaatgcagccaatcctcaggaaagcgcgccatgtcaactcggtccaacggtgaactccgagcgctaccatggagttgcagacgtcgcccggtcaccacagtctgaatccggccaaaccgtctcgccattgtcttcactaccccacggtgaccaagaacccgcacggaatcggaacaaagtggtctaggttggaagattcctttcttcttcctcatctccgattgccaacgccatctatctccctctcgctctctggtgagcttcggcacgattccttttgcttagaaacatgccatgccacctttaaccaatgcgtgcactacccttggccatatcaagactagaaacgcatcatcgacaacgactgtggagccccgccgccgatgagctcggttctttttcattgagacttcgccagactttgctggccttcgggttagcttcctaggtgccccaagttccatatacgagcctggtaccgcatagatcaagcctctaactcaatatgcacacatgcatgctgagccaagccgcttccaatgccaacgccatccatgtagaccaccatagcttgcaagaaagctgtcgatagcttcgcctagaaccccttctcactctacattttggttgcacaatctgaaacctcatctttcgccggaggcgacgccgcatatctcactgctaccctgttctgttagcgcaagggcgtggatttgcaaacttttaaaacatccaggggtgttttatcagtttaatctgtcactcacatgtggggttagtacctatttgtaaataaactaaaacacgaggatatttaggctttgaaaaattagaggaaaaattaattaaacactctcttttgagctgaaaattgacataactttggaaattcattatagttctaaaaatttcaaactaaattttgttaggttcatatttttataatctgtaatctaaaaatgttcagcttgacagaactttgaagttttatgtcttaacaactcgaaatgcatataggccataatttagtagtttgcaactttgaatatttatatcttgcagatgggatatgataaaataaaaattccttcactaaaaatcaagtcatcacagtacttattaaccataaaaacagcagtcattgtagaccatgctgaatctttgtgtatatttgtaatttggttttcacctgtatgtttagacgacaatcaggcgatagttgaagaaatccacgagactgaacaggtggtagaaccagagcaaggcaagccacctcccctccctcgttgatcatattgctcccatgttctggaggttaaatgttttgattgaaaaattgcatacttagtttcaaacataaatggttgaaaatttaatatgtgatagctaaaaccaaattcttgcattcccctctttgaaacttgattaacctactgattgtcacctttttgacatgacagtgtactgtccttttgctaaaaagttattaagatcctgttcaattgtcatactatacttagccatgcctagactagtgtagttatcattataggcactctttaattttgaaagtttgatttctaaatacttctggacagaaaattaatatgtgattatttgtgaaccaaaatgaatcaatcaatgattttagtcttgggcagcaagtggtatacatgtgatgtttagttgtgtaccgatagggggagtgtttgcccgacacactctaaggacttaactcaatgttagtcacttgtgattacagtacgaccacatgtgttattatggggtagccagagctcactaagttaatttctcattatttagccttgcattctggtaggccgaagtagtatgaattagttttagtggtagttcatatgaactacctatttacatatatggtaatttaggcatctaagtctatccaatacaacgatatagtgcctcgtggggaaaactcttgtgtttgttgccacggtgttaggttaaggcgtgggcactccacctaatgactctaggtcatatgcctagggtggaatcatacttatcatgctagtgtaaagctaaatcatgagtaatgtaacggctatgttgtgagtagtaaatcgggtatttcagtacggtgtagcatgtttttacatgattactatagcgcatcatgtgggtatagtgtacaaactccgcagagtaaaaactaatcatttagtcgtcctcatgattatgagcggcataaggatatgtattgagtatagaataatgttttaaatcctcttgttctctctttaattatgaactaaaccttttgtgaattgatgatgaaatgagattcgaaatggttcattatacttgttgctttggagagcaccaagttgtttatatacatgtatgatttttactatgtataagatgccataatgatatatgtatgcttgctgaaattttctttttttttctaaaacatgattttaaaaatatttgtgaaaaacaaaacttgcttaatgctgaaattgaactacttttgaccttccattattttagccatgcatgtacatatgttttgaatctcattttgacccttgctattgttattgtatttttgtcttgttattctagacttggatgcaggcgaggtcttcatcgatgaggattgctttgttgaggataacttcaagttttaggatggttctaactagggtctactctagtcggttgcataaaaggtattttgggtagaataatgcttccgctaaaccactaactatttggccggtcggccatatgtataatagatctgaactttatattatatatgtgttagaactcccttttatagatatcaattgctagatgaaagtgtcttgacaagttctatgtgttaacgaccaaatttgtaatctgagtatcaaagatagagttaagatttaagcggaatctaaatccaagattgtttcggagacagagcatgaatcggctgtgatcagggtcggcagaatccgagttggacagggttagccgattgagccgaatctgacaatatggcatggcatacgttgtcaggttaggttgatgtgcttcatgatgattgccacgtatggatagagtcctgagaaggtaattgtatctattaattaggatattttatgtaatttccttaaagatatgcttaggcaaaagtgccgcaaagacttatggtatcttaaaatttgttagagataagaatcgtgtccgatatagacatattgtcgtaggctctccggacctcccattatatttgagagatgaagtgaataattcaagtcatcaaacaaacataatgaaacatccaacgcctcgagagaagaatattggagacattgccagtcaacttcagtctgagatatgcccatcaaaccactcaaaggcggcgaccagatgtgttacacattcagcagacttgacaaaaatggtaaagatctacaacatctcaaatattcttaactcatactcatgtaaatctagttcccaagatgtgcactagattcacactttcatcttaagcatgaaaatacatagcaaaaatacacttaagacgaaaataatctaaatcacaactacttcatagttacataggccgaccggccaaataaatataaagaacagcggaagcttgactacccaatcctcaaacacaccgactaggggtttaccccattaagtttaagtcctagaagaagcagtcaatcacctgcatcactcaaagactaaatctaaaacctgcaagcaaaagttaattcaacagcaagagtcagtacattaattaagacatataatcaagaaaggcatagtatggttctttttagcataaagcaagttttatttgtataaaacatttccaaatcagatttgctttcaaataaatttcagcaagctagtactaataaatttcagcaagctagtacttaagtacttagcatatgggcatcaaagtaggcattaatcatgtataaatatgcacctcattggcttccatggcagccaggagatcattctcaaatctcatcataatttgaaggtaaattttagcatttagaagaataaacacaagcctatactcaatacatatccacacgccgctcatgaccgtgagcacggctaattgattagtttttactctgcagagtttgtacactttacccacatgatgcaaaataataatcatacaagagcatggcacgcgatacataagtacccaatttattacccacaacaaagcttttccaaaatttatgatttagccttacaccagcacgatacgtgttactccatcctaagccatacacgttatatgacctagaaccgttaagtttaagtggtgggcccacgccttaaacttaacgccatggtggcgaacacaacgggaccccacccacgtggcacaataccattgtattagatagagttagtcacctaaactaccacgtcgaggtaaataggaagttcctctgagttatccgaactcatacacaccggcctaccagaatgtaaggctgaaccataaataatttactaagcttgggctatcccatactagcacatgtggttgtactgtatacgaaatgaactgactcaacgaaatgaactgacattgagtgaagtccttaggtcggtttgggcgcactctccccctatcggtacataactaatcaccatatgtgcaccacttgaggcccaaacctaaaatccatgttttccaccattttatttatcaaaaacacaagtattaaagttctgtccagattatttcaaaatcaattttcatatttgtaatgagcccataatgacaaggaagaccattctaagcatggctaagcattatagtaacctagtgactccaaaatttatatataaagtggtatagtcatattgttcctaaggttaggaatgatggatatggatatatgtggggttaaggtgataatgcaaataataggagtttgtctaacaattttaacacaattttaatttgttagtgtacaatcgacatgcaagatttggaaacgttttcaataacctccaaaacataggttcaaagtgatcaaagagagggaggtggaacttgccttgaatcaggaaaatgtcagcacctaaatcacttcttcaccatttaagcaatcatctatacaaagtacacgttatacaattaaacatcgaaatatgcgaaaaatccgaaatgctctaaaatgcattatttgtgcacagtggataagtgcttgtctaaaatgaatttaggtgaaagaatttctattttatctcatttcatttgagagttatgaatttagaagttttgtcggtatagtgtaggatttacttaggtactattgtgaaatgcttgtgaaatgctgttgtaagatgattcttattaagtttatgtttgctgaggtgaagatatgtgttttctaagacttaacacatttggtttcataatttttagagttaatatgaattctttatgtattttacaagttatagcgtgtcataggtgtatagtgttctataggttcatggcttcagaggtttaggttcagaacttgcctcatctagctagtgatgtataaaataagtattttatttaactaatgtaatcttagtttataaattttagagttcaaattactttacttcacattttataagctaggggatgttctatgctagaagcttaatatatcaatctagagattattatatgagtaaagggtactaagttttggaggaaggggatggatcttatgccttcactggttcaacaagttttagttgggtttcattatagttagtgtattcctatatacatttatatatacgtattgcttaatccttactatgtgattagcacctatcctatagatttaaagtttagagcaataacctatacagaaggtgccatattttattttactatgttgaagctcaccatttgctggttctataaaaacttggttcactccatttggactaaagatgaattttctacaaattttacaaattaaaggctgctctatgttggttattaattacataaatattagaggcttttgttgtacaataagcatatatttttattttataacttggaagtatatgttttggtgattctacagaacttgggtatactcaaaaaggatctaagatgaattttatataaacttctaaacttcagcttatgtaaaactagttattttaaagataatagttttagaggcatttgatgtaaagtgtgtatatgttttattttactttgtttttagagaacatgttggtggatctgtagaaactaagtttgctctaaaatgagttgttttcaatttgttatagattttacaagtttacatgtttttctgttgaaaatataaagctttaggcatttcatttagatttttccagaatttaaatagattggatccacaggtcagtctcagaccaatatgcaaaaaggcccctatggttttaggaaatcaactcgcagtcctgtgactgttctgtgtgtgaggtaggttttacaaactagtacctagagttttgactcttctcagcagaggtccttggtttgagcagacacagagctagccatggccgagctcgttctcgagctcgccggtggcaaacggcggcagatctcggtgtgcaacataaggataaaatgtaaaggggttcaaggcgaggctataggtggtatttttgcaagcattggtcatcggaattaatggcgacggcggcgcgagcggcggtggttctcgggtgacggtgcatgtggagctagagcattgatgcatgtgcctctatgggatcctaggatgcttaccgagcgtccaatgaaacttggcgaggtccagatagcgatgaccacgagcagaacgactcggcgacggcagggagcctcgctcgatgacgacgccggcttgatatggctgatgatctaccatgcatgcatacacacggtgttgaataggtctcaggaaagctttatgcccgaggaattgaactgtgactcaccggagagggagaaatcgaaggtggagcttgacggccggaattggggaagacgatgccgatctccaagctcgctgcaccactggcaggggttcatgagggatttaagagaggacaccgaggagatgttgatggtgcggtggctcggctcggcttgctccggttcgacggcaacgaagacgatgtcccgatggcggcgcccagtgcgcgctccagagcatcgtcggcgaggtttgcgttcccaccaaaccactgcatgaaatgggatgaaacttaagagggatggaatcggcgtagagaggcgataatggaacgcaagagaagaggaaacgaccgcggcacaatggtgatggcgacggccatcgtcttcacggccggcgacaaggtcgagatgaaaaagaaaagctggagctctccccctcggtttgctcggctcaggagtggtaatggggaggaggcgatgcagctgggtggaggtgaagcctcggttcggcgctgccacgtcgaggccacgcgtcgacgccgtccagtgccggtcggcgccctcggtctctctctctctctcagctgtcactgtgttggatggaggagatgcacagggtgtggttcaaaccaaagaggctgccatgtgggcccaggtcaatgtaagctaggtgggagtctgagggatgggtaagaaactgggtgttgattgatttttggacgattttcagattaattctctccctccaactttatatctcaatattttaacgtgtgaagcatacaaattagtgcgggtttttctgaaggtagatgaatgtagctagtttctattttctttggttgcacttaaaaattataaatagattgctcacagaaaataggagaagatgggctcgatagaacattgtttgaatttagaagacctaaactgagaggataaattctggaaaaattatatttattcatgattttcccctatacacttccatgcagttaaatgcacattttagttatgtatggttttagctgattaagaattatatttagtctattatttgacaagtttgacttgtttatttaaggtatcaaatttagttattaaattgtaccaaaattacagtgagttgtatatattaagtagagcttacataaattttcccatcattttatcttgcacgaattattttagataattagcgatgcttatctcttttatgtgtttcccttttcctaaatgcatgtaaatgcttataaaagttttatttggactcttcttaacctgaggtgatgttgatatggtagaattacagtttaccttacataggtcgtaagctccttacctatttatgcataagtttactttaatattaaattaagaggatgcttatagagatgattaagatagaatataccctatatgagttaatttatttgttcactttcatgttcatgacatgtcttcagatggatgaccaaattagttttgtgaggcttgacattaaccatgttgatatattttaaggtgtacggttcctattttaacttcctctagctagcactaagccctaatggtttagttgtttatcgttaatattcatgagacctattatgaaatgcaaatcgaaaatccaaatgcatatgaaggactcaagtcaaacatgtctatgagagtatgcatatgagagtatgcatgcttacacagaagtttacattttgtcctaggttataaatgaaaaagttttaatttgttctcaaattttattcatgcaagagttagatcaacttcacctaggtttaaaatggaaatttttggctctcaaaaatagaaaagttagcttccaactattttgacaggaaacttttaaagtctagaactttgggtatgttacacatattttgtaattctcgggtataaataggcctcgagccccatgtaatcaaactaacacacgttcaatacaatctcggcgcatcgccaccctttttactttcgttttgtttcgacgagtttttgctttcgggttgagctgcatcggtttcgatcttcgacaagaggtaaaacttgttatgacggcttgcattctcaggattagtgcttccatcttcatgacactctaatcttgtttatgtaattcgtcgagttatcatatatcttacataatctctggcaatatcgctatctaacctataatcagctaacatctgtcagtagaaggcagccgattaggttaaataccgatgttgacttagattatataggatatccaccactctatgacacatccaacggcttgattgtctagatattgttcttcttttcatacttatagctgtatcagttgagtttgatcttatgagtcgtgattagaatctcaatctctagcctgcctttggttgctgattagggtagcatcggggtttcagccgatcttacctgatttgactatatttgtcttatgtgcttagttgacatgttaaatctgccctttatattaagatcttgttgcatttaagtagattaggcttctgtttggtatattctatttgctttaacatcttaatatagagtggtatcggagtattagccgatacaagctagatctatctgatcggctatgctatgaacatatatactctcaatgttaatatttatttcgatctaagtgatttatactgtctcggcatggcgaccgatctatcccaatcacttgatttaagtatatatcaacgtaaggattatatattgttaatatctacagccgatcgagtagatttagttctttcttacttgttaataattgcagatcgatgcaaatatgatatcggctcaaagataaatgatatgtcatcggcacctagctgatcggctatcgtttatggatttaaccacggtttctttgtcttcgtttcttgttgattgcaggatcaaatcaactggcacgctcatacacccaaaggcaagttttggacctgcattggagttaagcagatctcccaggcctcgtgtttttacatcaacactatgactatagaacttgctagacatgagtatggtattgaattgaggtgttgtagagctcatgccttttgagtcaagtttactgaatgtataatacatctggtcgccaccttcgagtgatttgaagggcacatgccatgcagaagttgattggcacgcgtgagtcccagcaatatcctttgtgcttaatattcgataccatgtaaattatattgaacggtgtttgattatgatcatggggcgcattgagacttgagtggctattatgcgcgtatggattgcactcacccgaaaccatgtgaaggtcacaataaatactggacggtataattcttggcatgctgggcaacccagcccagtgaaaacgcaagtatttatttgcttttgtttgtgaaggggggacctcattaatttaagcatgattgatcaattgccatgcatgcatatcatgcggcaaccgaaaggggcatgtcatagtagcaagtacatgttagtgataaaagtatatggttgttaaagatgtattaggaatgattgatttgtatgtattcttttcttatctgtaatccttccttatatccttcccatgtactcttatatataccggctcctaagacttaatacagcgtgtctaatattcgtagtatcttcccctctccctatactatacagtcaggttgctcatcggagatgatagttctgacatgtcattttgccagtagttcgctctagtccaaccatatctcgaactaacttcgtattctcaaattcaaaaacacgaaattcagaacgcacaactccaatttcactggtgtgcacgtacgtaccctagcgtcgtcactggagaaaatataggagaagatagagcagcgcatgcagcaaactgctccacgcgcgcttggcggtagcccgcatatgcgtgcacgttccgccatgcatgcgcgcacaaatctatagaaacaaattataccacaaattataccgtaccggatggtgattctacataatcctcaaggttttctcaaaactcaaccaatccaggcaaatactccatctcgatcggcttctgtgttctagatcagccatgtcgaagagatctcgatcagccatgtcttcggccggagaggaggtcgaggcaagcacgctcatcaccctaagggtcaaggacaacgaaggtgtcaggatcacctgcacgatgcgcaggacggacaagctgcgcgtcctcatcggtttctacctcgacatggtgacgccgaccgacaagggcaagggcgccgccgtcgccgccgccgccggtggtggcgtcttcatgcactacggccgttgtgtgaccggcaaccggacgccggcggactacgacatggaggacggcgacgaggttagcttcttccccgacggaactaggaccatgcccgtcaccctcaccgtgaaggacaacaaaggccgccgggtcacacacacctgcgtaggttggacgtcatctgcaccctgttccgtctctactttgacatgttgccctcgacagcgcccagggaaggtgttttcatgtacaacggcagggagatcagtttctatcagacgccggagaaatgtgacatgaacgacggcgatgagatcaccttccatctgttcagcaagccgagcaccttcgtcaccctcacgatcaagggcagcaccgacgatgccggccgcagcggcgtcgtcgtcacccgccccatgcgcaggaccgacgagttgcagcgcctgatcgattactacttcgccatggtgccaactgatgatcagaacggcgagtgggcggtcacgtacggtggcaggcaggtcggcggcgaggagacgcccgcggattacgagatggaggacggcgatcagctccgcctcgttccggcgagcaaaccgagcaggttcgtgaccatcgatttgttaaccatggtgaaggccaagcgcacatacaccctgcgaaggactgacaagctgcagggtttgatggacctgtgcttaagcagggagcctgcaagtatgtacaggcatgggtgtgttttaatttacgagggccgtcgtgttcaggactcgcaaactccggatgatctcaaactggaggatggtgatacaatccacgctatagcccgtcaggtcggataatcaaagcaggaggatggggaattgaggataccatccaatttttatggtcggtttggttcattggatgtacgtcagtacgtggatcagattagtctaaaactctaaatgaaggttacatctcataaaattaggttctagattctggtttacaaaaatgttgcttcattttccagtatttgttattttattattgacatttttttgcgaggaattttattattgacattgttctgtaatgcatctcaaccaaatggttttacctatcaagtgttctagaaaaatgaaaatggatggagcggggggctactccactgctctatttcagactctgttcatagttatatatagtagttatctatactaatataaaaaacacaagttcatcaaacacctatctttcctgacttttagatctattcatccaacggcttatatcaaaagttggatcaacctctgcaattagccatccccaagttcgattagcagcggttatagcgatacagcgatcgaaaaaaaaaacttctctcccgtgcgctagcccgtcgccgcctcccggagccgctcgccgcctcctcgcacgtgcccgccggaccgccaggcgccgccgccaactccgagcgcgcacccgccgcagccgcgccccctaccccgccgcctcctcgcgcgtgcccgacgctcgccctaccccgccgttgccgcctcctcgcggccgccagtgagccaggttcgccgtcggctggcgccttctccaccaccgccgccgcctcctcgcgcgtggcctctggagttctgggctcgccgtcggccggctcctcctcgcgtgcgcccgccggggagctgtggtgggttacggcactacgcagtacagactccaggttaaggtgatatcctctcttcctaaatcctcaaacaataaagattttgtgcttttattattttggggtcataaaattgtttacctagggtttgggcagggttgcttatgatacggggccccaaatgtttagtcaattggttctatcgtctcgctatgttatttgctcttgtttaggagataattttacttgctatgaattctgcttgctaagcatctcacaagtatcatatcagtcatgcttcctcaggaaatgtctaaaaacatggtggactactgatcacacaaatttattctacaaagcaattattagttaattacctaaggacttggctgactgccgattaccgattatagtgtaaacgataagcatcagttgtggcagtgcacataattgaataaacaaaatgcccaatgcccctaattaatctgaaagcaattcatcagtttaataaattaagttgtgggatgcagattgcaattagtgtttggccgtcaggcatctggcattaattagcattcggccatcaggcgtcttgcattctggttgcttgctttgcctatttgattgggttggatcaggggtccaatgtgatttggtccgggggtcccacactaaaattatacatagcctataggttccacaatgtcattaaccaaagcactcgcctttcccatattcaagtggatccccattgatctagcttggcaaatcttactacactatttcgttacctcgtaagtattaagttcttttatggaacatatttttagatttaattccaatgataggcttgaagatattttgcacttttttacttattggagttgatgtgatggagctaacatcagctggaagtcaccttgaaaatggcacattttgtgtcttgcccattaactgtcaagtatggcacaattattagtgtgttttcccctttctgcggtgcagggagacgcatattacatatgtatccctctattctctggatcaaagagtgcagaggtccttcaattgcattctaaggggatagggttcataattgaattgtttagtgatgtttgcaatctcacaaactcaaatgtcgttagcctctcttgaagacaagaaccattagtctcataaattatcaggtttggattttagcagttttaggttagattataattccagattaaagtgaaaatgatgaaagttatacattaaagattttgagtgaaaacattaccagattttttttctccaatggaatgttaattgttaagtgcaatatatattcttaattaaagttgtgtgcatagatgacctgccaacaatactatcccgtattgttcaatccattgatgattgaactggatgtcaactccatgtcctcattgtcttgccaggcacagggaggcaacaatccaatacaggagagataggatgggatcccagctcaagggagccctggcggcagctacggtcgggaggacctaagccctacaggcaagctctataatcaacccccttttgcttaccggcgataagtcaaccaacttccagtgatgcaggtactgatcctctcctccctccctctccctccctctttatcacgacattagctgattgatcaccagctttttattccgattgctccagtgaactttgttcacaaaatagtgtttttttcattttctgatgcttgtgcctatcgtgtgactcctccaccgacttgtacattgatatctgcccaactgattgatgaaatgatcgtttacatttttttttgttcagtcaatagtttctgatcagcttggagtggtccgtgccatgttgctgtgataatgctacaggttaatcctcctggctctctgtactgaaacaatttctctggatctct

SEQ ID NO: 2588 - DNA, 3244 bp, Oryza sativa
tattggatatccttcagcgatatgccctgcccggccttgtaactaatatgcaatatcagttttatgcccttgacatggcatacattcctccaggctgcactcacttacacttttactgtagattgataggttaatgttccattgtcaaggtgaaccaatcagctaatgatggttcatatagttataatttgagtgcaactatgtatccactatgatgtagaattgtgggtatttgcaatttaaaaggtatgccacttaggaatcgacactcaggcacatgcacctaggcttgatgggtaagtctggccaatttacatatggggaacacaaattaatttaatcagttattccaatttattcttctttgtttctatgcactgcaatgccaatttgagtgcctatcttgtcatgctattcagcataatgtcttggcaggctatgcatatgttcatgcttatatatgcagcattcatataagtacggattaattggattgcttgctttgtctaatgcagcctcaccatttaatttgtggcgagcaccttaattccatcttgccattatcgagggagtatatcatatgcacctaattctgtatatagagtatttattgactagggtcttggaaatttttgaattgctgtcagatgtaagttcctcagattgatgatttgattactttcacagctaataccattgatcatagctaaacaccacttatagaagtttaatggatttttatctaaaaagggaaaaaaggaaattaataactgaaactgcatagtagtactatgatctctgaacaaagaaatttgctgagtttcctagcagctgctgggtgcattttcctcttgttatgtgtgcctaaccttgcatccattaaatttcaaaagtgcaaatagagaattattgcatgcattccttttatatcaaagattgggatgaaatttccagcttaatcctgacagccgcaatgtgtcttgagcaaaaggaagcaaggctgcaactgaaacacggtgaatagtaaataaaaatctcgcttttaggaaaaaaaaggtgagtcgtgcacaagtgctgtaatctggttttggcaaatttttatcgagatatactactccgtcgctttgtttacacaataaacctgaactctaggtgtagcagcttgaagcattaaaaaataagatggcagcaaacagatgtttgctttattggatttaatacttggatattccactgtgcttcccaaattgagctgaataaatagcttgacgaattgttctcttaacatgtctcagttgtcctttgtatcaaatgagcagcataatccattcatggattgttcttttccactggtgatacagatagttacttctaatgtttcatggaaaagttcgagctacagaaatttcttaagcaagcttacggattgtttctgatgagtttagcaactctatggaaacaagcataagtgcttctcatctgaccagttccaagagagaagtagccaagtaggtagaacaatcccaaaactgcaaacttattttactgtatatatatactttcctttttagcattttctgtaaagtcccagttctgtattgcagttggcatggttgtgttcatcggaatattgaatgtcaaatcgaaaggaggcgccaacctatagctatcaacaacatggacaccatggttcagattcataaatttggggatcatggatgtctaggttcagaaatttttggattttaggcaacaaattttgtagaatttccaatttagaaaaacacattttgcatttcgttataatgtaataaaataccaatttacgtttatttgatgaattatcaaagcaacgcttacaatacttttatttttatcggtgcatgtgagctacaatgtattaatatatatagttgtgcatcaacaatggatgtgttgttctccaatatacttcgcttagtatatatatcgacatgccttgtatgtgcacgctcactagtagccctaaaaaggccacatgtttgtgcttcatcatatatcatcacataattattcctgaacattgcgccactgtctccacaactttgagaggcacatcaaatttatctgcaactttcctagactactatgcaacaccggtggattggtcttcgccaacaactctaaattaattgtgatatttaagtcatctggttactttctcccgtttgaacctgaattagacaaatcataaattttacatgcaaagttcagtacatattcactataaagtcagtactagagtaaaatcaaaacttgagcaaaaacaggattttaggtccaggtactgaattggacttaaattccatgtctcaaaactaattaaatcagaaaaaaaaattcataacttgacaacttgaacttgagtattcctgaaaattactactactcatgaactagagttttagttttgctctatgaactgtagcaatcagacaaatagagggcttaccaccggtatcaatcccacctctatgtaccatagctccagccccatcctgatctgacgcttctatataacaaaaagaaagttaattcattcatgtacttgtaaaaatatccagttattttgggggaaacattttcagaacaaacaagtacaacttctgatttaatgattctgaacaagaactactgcattttcagatttcagaactgaagttaaaattcaggacaaatacaagtacaacttaagattttagatttcagaacaagcacaactatattttcagatttcagaacaagcactagtacaaattcagatttgatctcttcagttcattttcatgtttcagaactaacgctcgaaaattggttttgttaatatactaggactgatttcagaacttaaatcacaactcagtttcagtacttgaatttcagaaatcatttgcacttgaattttaaaaataaattcagaacttcagtttttagaaggtatttaggatttcaggacattgctagaattgagatggacagcaacatcagatcttgggaagaggatcctctgatgttactgttcactatgattgacatgtgagctccaccactctcgggccacatgtcaaccaccaaatcagtaggaagttatgtcaggggatctcaatcccaaatctttaactagaatactcctacagtccctacaacttcagtcgctgcagtttcactactagagcaaaatttaaaacatgacaacttaaattca

SEQ ID NO: 2589 - DNA, 2121 bp, Oryza sativa
gtactcaacagcaatgaaaccagtatgattaacagctcctccctctccagtccttgttcgccacgacacgcttacttgactgtaaagtctaccacccgaagacagtgtactagtctatgtacgtgttggactcgttcttctccaggcttccctccgtctctttaatctgccaccatcaacaaattaactctgcactgtgcacacatatgtaagaatcctactattatcctttccccgtttccgaccaggctttccacagaaagcagagtagcgaagcacatgtcgccggtgaaggtgttcggctcggcgccgttcacgaacgtggcgcgggtgctgctctgcctggaggaggtcggcgccgactacgagatcgtcgacgtcgacttcggtgacagggagcacaagggccccgaccacctcgccagaaacgtatgtgtgcgcagagacaaggattcatttctttcttgctttcgactaattcattaaaagagacaaattattgccgagttgcaacttgattttgtcgctggtgttcatcagccgtttgggcaagttccggcgttccaggatggagacctgatgctcttcggtgagtaatatacacatttgaactatcgagcaaaagcattctcagtttctcacgaattcgcctcaaaataaaattattcaatctttgtgttcaaagagtcccgtgcgatttgccggtacatactgcggaagcacagggcgacggacgaggccaacctgctgcgggaaggcgacccctccgagtcggcggtggtggacgcgtggctggacgtggaggcgctccggtacgagccctcggtgcacgccgtgttcgtccagcggcgcgtcgtcccggcgctgggcggggagcccgacgagcgggtcatcgccgagagcgtcgcgcggctgagggagacgctcgccgtgtacgaggcacggctggaggccacgcgcgggtacctcgccggcggcgaggtgagcctcgccgacctgagccacttcccgtacacgcgctacttcatggagatgccgtacgaggtgccggtgttcggcgcgtaccctcgcgtgacggcgtggtgggagcgcctgctgacgaggccgtcggtcaggaaggtggccgccatgatgagcggcggcgagggttgatacgtgtgctgatgcttgctactgttttctttttcttaaaaaaagagaatcatactctctcattcccataatataaggcatggtcaaaattgacacggtcttcaaaactaatctttatcctataatttctcatatattataaggtttgtagtaacaaaatataaccatatgaaagaaaattcaaatgtcaattcaatgataaattttttagcaagtaaattcatattgtactaaatattggtcaaaatgtttgaaagtgaaatcttgaaatacgtgggtgtcttatattttaaaatagagggagtaatggagagcgtttatatttctggcctctgcacaggatgcttggtacagtattgtctattgtttgtcataatgactactctcttcgttttttaaaatatagcaatttttagatggatgagatatattctaattaatactatgaatctagacaggggctagctaagatatatctcatccaatcaaaagttgttatattttgggatggagatggtgcttattactatgtatacatgaattatgtccttgtgattaagacagtgtgtatacctttgcgatactggatatgttttccatatccttgagttttcacttaattcttttcgtgtgactaagtttcatgtcaaatttttgttttgcccttctacatatgctcattatgttagttgacttcgagagttcgagtgggttattaacattttagaagtgatgagctgatgatattgtatctcgcttataatcataggtgcatgctagcctctgtgaaattagaggtatgtccgtgcaaatttagccgagacacatgtacaatacgaaaaacaaggatctatctcaaaatatggcgacatatttttaggtaaaatataacaaatataattatagtttaaatctagtgtaattacatattaaatttaagggcttacatatatatttatattgtaagcg

SEQ ID NO: 2590 - DNA, 9639 bp, Oryza sativa
  unsure (1)..(9639): unsure at all n locations
atacatggtgattattttttatgaaaaatatggtgacacatttatagcaaatcccatcataatattgagctccagctcttaatagggatggaaagactcggtgtacaagtcgactgcaatacatagacaacaaaatataagacatctcataagttaagctctcgatataacatccgtacatttccccggctttcgcttccgttgaacattatttgttctcctttatctgaaattcagacgaatgcaattatttttatagtttattcataaccaattaaaaatataatggtttgaaaatatttttcatgttgaatcaaccaaatgcatattcttatataaaaaagttttttttgtgtgtccatcaatttttcaaaatattgggttgtctagccgatagatcgactaattgcaattatttagttctcattccgttcgatgcagctgcggcattgttgtcttgctgatccttgagcttctcgaacagcttgcgttgcacgtgctgcttgaatgtgcgcggcgcgaagagcggcttgtcggcgccgtcggcgagcagctccggcaccggctgcagcagcacggactcaggcggcggctcgcagaagacgacccaggagaggcgcacggcgtcgcggctgacgaggccgcggtggagcacgctggtgtaccggccgttggtgaggatctccagggcgtcgccgacgtggacgacgatggtgcccggctcggggcgcgcggtgacccagctcccggcgtggtgcacctgcagccccggcacgccgttgtggaggatgaaggagagcgcgctgacgtcggtgtgtgcctcgacgccgacggcgaggtcaggccgcgggcacctcgggtagtagttgatcttgagctgaaggagcaggtcgtcgtcgacgccggccagctcatgtcctctcaggcggcggtccagcgtctcttccggcaggccgaggccgagggagaggatggcgagcagcttggatgcgagggtccggacgcggccgccgaagtcgcgcgacacggggacgtactccggcgggtttgccggccagagcgagtggtcggcgaggtggtccgggtggacgaaggggaacaggtagtcctcccactccctcttcccgctggcgttggcggcgagcttgctgccgtacccctgcagccgccccgccgccgggtcgttggcgtacgcctccttctccgcgatgggcagcgcgaagaacgcctcgcccgcggcgcgcaggcggccgaggacgtcgcccgggaggccgtggccggcgatgtgtatgacgccccactcctccgccgccgcgcgcaccgcctccacgcacgcgtgcctgccgtcgccgtcgttgtcgaacgcggagatgtcgacgacggggatgcgggcggtggcgtcgtcgtcggacgcggcccgggcgagctccagggcgtcgccgaggtcggcgcgctcctcctccgggcggacgtactccggcgggatggcggagacgccgctgaggctgagggcctccactctcagctccacatccgtcatgtcgccctcccgaagtaggctagtagatgagctgcgtgcgcacgtactcgatcggcggccggtgatggcgaggcaggcagagcgcgggtagatttatactccggcgctgccgccgctttgctccatccatggatcggtgcatgcatgtgttacgtttgtagctaacaacaaccagcggtgtcgggcacgcgcggttagctccatccatcaatcacgtgcgcgttcgtaacattggttgattggtccctgtcaataatgcccctgttgtttcttaattcagatgatacgatccgtatgtataaactcattgcatgctcgttagcctatataaggcataacaagaatttgactttacaagttagaaatttaaattgtagaacttattttgtagttgaattttttctattgttttctagtttccaaccttaattagcatatatttggacagtgaagaacgaaagtttaaaagtcttaagcaccatttctactatgtgaaactatgattgtgtacgcgcacgagggcatgaacaatataggcccactcctatccaatggcctcaaataacaggtaggcgctgaggcaacacctctaaaaaaaacctacccttttgggcacttctcattttagtcctcgtgcttctaaattttacaagaagatttaaaattttacactactagtaatctgtccgtgctaacgctacggcactataaaatttgtgttaataaattattaaattcatgttaatcaaattaaatttcccaaattctgtccatttgatccatgtcatatatgaaatatatttaagaaaaagtacaaaactatcacattgtctaaaaattaatcaaaaccatcagcaattgtatctactcagaatcatctagcaaatagtagtactaaaaagtctggaaaaactaaaagcttcatatcacgggtttgatttatcatccacagattgccatcctaaaatacaattcaacaaacttatagaatgtacaagggatatgacaaaaaaatatattactaccagagttttttttttgtttgggaatacgcaaggcacgcatatttgtattaagagaaataaagagtatgtacaagcgaagccaaacaagaaaattaggagggggatgcgaaaacaggagaacaataaaaagcttaagcctattctcgcgacatcagaaggaaacgacctagaacaagacctaaatggttagcaccggcagcacctcgtgtgccaaccgccagagagtcgcttccgtcatagctcgggctatctctgaccagggcctttgctgagagttgaagaccctattgttcctctccttccagattgtccacgcagtaagggttgctattgtatcaaatccccgcctgctagccctccccactttaaggcaggaattgtagacccagagataaaaggaatcttcattcaaggggagaaactatggcaaaccagtgctggaaaggaggacccaccaaagctgatgagactccggacaggcaaccaagatgtgatcaatagtctcttcatgttggtcgcagagcacacatccatccgggtgaggcaaacccctagaacacaggcggtccaccgtccaacagcgcctcattgcgaccagccaggcaaagaaccggcatctcgaggggggggagtcttctagatgggttcggagtggaaaggagccctacctagaaagagtgcacgggtatgccgaacgttaagagtagactcccgatgcttcccacttccaaatgaaagagtcggggtggtcagagagccgcaccgacgacctcaggagactccagagttgaagatattgaagaatagcttgcaaacccagcgctccggtgcagtctctaatccatctccggtcttgaagggccttggcgaccgttctgcgacagcgaagccgtgttgggacagacgcccaaaccgccggagatatgtagcgaatggaggaaccctccaaccagttgtcctcccaaaaaaggatggactccccattgcccaaaacacagactgttgaaactaccagagattagatatgcacatctagacaaggagcaacgagatacacaccttcttgccgctgatcaatggtgcttaaacacacagaaatattatagcaacatgtaacaaagatgcacacctaaaaacattgctcgtacttgccggctcgtcagccgtcagatggttaggaaccaaaatcaatattaaccagtattgtggccactcaaaccgttggattagaagggtcaccacgtttgcatccatgacagctgacaccctccaatgaagtttccccttgatgcaatcgaccaccgcaagcaagatacggagatatagacttgtccaacaccactgtgtcatcctcatctctcacctgtactaatccgctcttcatcctgctaccatcacaaaaggtggctgctataaaaataaattaaacagagtgtgagctacaaaagaatccttcgtaatagcatccgaagaacattcatctctagaactgtcacaagtaaacctccatagagcattttttgaagtgttggggctattgcataaaagtaagggtacacttacaaatttaatcgtaccttcaaaaggtcatgatcattccatggccctctgttagaaacttagaaccaaggcaacaccatgactgcatgcacatggaccacgaatgaactatggcaatttactgctaaagaacaatatgttttcacgaaattggtaagctaaatagatattgttgtataaatacgtgcaggctaagcgtttcaataaaggttgccaggcacagctagtaagtatgcacgtggaatccatgtggcataatatttgtgataaatagattaccctaaatcaagtcactcaaatttcgtaaaaaaacgttaagtggtctctctgggtgaagcaaactgaaattcatgcaacttcagagtcaagccacatttatatttcatctttcagtcttgtacatacatgttactaaaagcacttttgccaaaacttgcaagtgaacttcagaattaatgcataagtacataccaattcatgctacacagcaaatggctataattaaatctatgcaaattgatctcactatgtgtgtggggtcctcctgattggcatttcatcaagcaggatgccggagagggtacctgcataccagggcgtgctggaagtgggtggttgtgttgtcccatagtggacttggaactggaggggggcgcaggtgatggtccccagattcctgggttggcgacgtgtttttctctctcagtttgcagttgttcttcagtaacagagttgggagaatggagtggtcgagctgtgaattccacgaaaccagaggttcaagatttggcctgcacagaaggattcatctcatcacaatgcaaattgagagaaaaagaaacatcacaacagattacctgttcacgcaaagatctgatgtttgccatgtttaggcggaaggcataactggcttcgtcaacagaatggacacggtgggcttggagtgcggctgtggaggtctcgacgcttccacctgtgtggaggtggtccgcaacagtttcaggcgatcgatcttattattttatctgccgatgcaactggagagaaggtgatacagcttcagctcgccgatctccttatcccttctatatgagagacagctaacgagcgaggagatatcagacatatatagaagtgagaatcacaattagctttcagaatagtaaatccacatgcacatatgcataaaaaaagactctacattaagctgcattgccatcgttgatagcaatatagggctgttctccttataagtcgtcacgacagtaaaatagcaaaaaaaaaaaaaaacagattaattcctgtgcaatttgatgtggcaatgaaatatagaccatgaatctggttactgactgatcaaagccccctatcataattgaccatgataaagagcgtaatgggtgtaccttcaatttagggaaggaggttgtgtgggtgcgaagcagctgttcacggtgatgtgggaacagataatcggtggcggcaccgtagtctgtgatgacggcgaggttcccccttgacagcagtcctatactgaaacaaataattgagcactcaaccattccagagtactacctgatgtagatcagaacagctagggatatttgttggctgccgcggaggagattggcgaggcagtcgtacggacgcggaaggcggcggcgatgaggattagggcagggagcgcgacgtcagggcgtggacgccggggtggcggggtgcgggcggcattggcggatgccgtcggatgtaaatcatcatatcattctcgatcgttggatgtgtcacatgatgaatgagtaaaaacatttattgaacttatagggtagaaacatgctaaaaatatacaaactaatataaaatctctttttctctcctctccccactatccacgtgactgttcccctctcctctcaccactgagctcactcgacggcaacaaatgcatcctcttcacggtgatcacaagcttgcgttgtctcccctccacctccatttccactcgacggtgaccatgagctccccgctgttattgaattgctactaccgcttgtccactttggtagatatcgctgccttttatttctcactcactatctctttatagtgccaaggacaccatagacaggtcaagaaggccatgcttgtggttgagaccttagtagtggttgagtcctcgcttcagatccaatagtgattgcggaggccattgcagcttcagctcagtcacccccacgcctcagatctacttgtttcccttgcaaattggtcaagcaatggcaatagctcgtttgaggacaccgccaccctccccccttgccctcttctcatttgtcggccatcaccgtgctccgtagtggtgcaggccaaggtggcgtgggctggcgcaaacaaatcgagacggctttggtaaaggggccgagacagcgagtgcagatccaatggcgggccgggcctgggtggcatgtgcaaatccggttacgaggacagcggattgaatgagaaactcctagcgacggataaggggaagggcgagatagatgggaacctatcgcaaagatatgacttcgctaacacaaggctccaagcatgccttcgtggttccctggatagggcaagccgagctcatcgtgccatgcacaaggcacaaatgacctcatgtgcccacccgaccccaccctctcttttctccatatcgatcagcatatggcgtcgtgtggccagatgtcattgtgttgttcataacatgagtaaatccatagacgagaagctcatttctgtccatagtactttaaaatatagtgatggtaacagcgaatctgttgccatacctattttcattgtaattttaaaaattacccttgaacttagtattaaactcaataaaatctcaatggatagccatatataaaatcaaatgaaggtcataataaaacacatttcaaataatatatatttatataacatagcaaattacgggcattaaggtagttaaactttacttatattactccctccatctcaaaatacttgttgttttgactttttgttcgtaacgtttgaccattggacttattcaaaacattgtggaattattatttgttttgtttgtgacttgctttattatcaaaagtactttaagtatgacttatctttttttatatttgcactaaatttttaaaggaaaaagtacgaataaccctcttgaactatcgccatcgaccgaattatcctcctaaacccaaaaaccagacattgcttaccctgacctttcaataccggaagaattaacccccttgacccaatccagagtggttttgtcctacgtgacgtacgcgtggcaatccagtcagcattttatttattaaaaaatatgggacccacctgtcatacccctcttcctctctctctcctctctcttctctctttcacggggcagtgtgcaggggcagggaggtatgcggcggcatagggacggatagtgggcgggggcgggcggtcacgcatgggatggggaaggtagacggaagaaggagggggagtggaggtggatgggaaatgggaggagatggaggtggaaggggtggttggtgcacacggcggtggccgtggtgggcgaggcggcgtgtggcggagacgcggacagtggctggaggcagtagcgaggtgggactttggcggagaggcaggcagtggccacctcgtctccctttcgatctccctcccctcccacccacgtggacaacagcagcccggctgctccccgcgccgccgccgccaacgtgttgtcgtcacccagcaagccagacccgtaggcgcgtaggggaggcggtgacacgcccaaggccgtcatcgtggtcacctccgctgccgccgccgccgtggtcctcgcactgctcaccatcgcggccgcgttcctcctcacaggccgtatgcgccgaccgccagcccgcccccgtgcaacgttgcccgccttcgccttcgttgccagcgccaccagtgttggtatttcttaacgacattactagaaatataaattcccagcaatgacgctagaaatgatcctggtttaaagaaagaatccgcaaacgcacggatatactattgtagcatttcacccgaagtattccaaggtatcgtattaatttatttaatcctaagggaagattgtaatagagaactatgctaataatgtatacatgccacttgtataatcaaagtctaggcaggggttaagatatggcaaacgggtagagtgacacgaagcaaagcactcatatatctcatttaatcattcctaaactaagtggaagaagaaatagaagaacgatcaattcctataattctaatatacactcaactttagtttacacctgctagtatacaaccatatagccagtaccctctaacagtgacctcctagtgcttcgagagaccactccaggttgccgagtttcttacgataacctgtcatggccgttcaatcggggctaaatacgaaggagtaccctcctaggaaagtttcttaggaatatatactatcttggaggaatacctgtactgagctgtcaccatcagcgacccacctcaactgacccgtagcatatgtgcctacttcataatctagacaccacgtctacattattaaatactactctacatcccccgagatgacatatagtaaccgagtaaacgggcattaaacacacaccactacacctctctggtaggctaattatacgactgtaccgatacagatataaagtaaagacaacacttggatgtattaaaatatcgaaagtatataaagaataatatttcattaattccaaaagtcttacaaaagaaagaaggaaaactactaaagccataccgaaattcctccgaagagtccgaggactccgagagcaattctattctactccacttagcactagaatactaaactaaagtgtagaagagatatcttgagcttgctcgagtgtgtggaagaacgaatgaagtgaccccttcatatagccttggaatgacggttaaaacggttggaattgttggatttaccctgcaaccaccattgagaagtcatcacaagcgtacacgtggaggcccaggctgatccggcgctgccagggttcggcacctaggtaggctcagtaggcctccacacttcctaggtcactgacaggtgggtccctatgacggttgcgacagttatgacagtttccgagacggttacacctgacatgtgagcccatcttatccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2591 - DNA, 637 bp, Oryza sativa
ctgcgcgtaaccgaaccggataagtcgcgcgtaacttatccggactccacgccgtttgcacgcaccggatctttcggaacgtttccaaaacaaagacgaatccgaatttgcaacaaaacaaaactgcaaaaggaggctgcatctgcgcaagggtgaggagccaatttttcggaccattcgacgtacgcgtacgtcgtgcacgccctgccctgccctgccctgcccggccaggccaggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacactttcttcagacaacaagttaaagcttcagcacataacaagaagagataaggtgatatgggatcaccttgtctaataccgtgagagggttcgaaaaaaatccaaatgctccccgtttaaataattgaataggaaactgaagtaacacatttcattatagttcttacccactaatcatgaaagccca

SEQ ID NO: 2592 - DNA, 909 bp, Oryza sativa
  unsure (1)..(909): unsure at all n locations
ttagtactagcacaagtgtagtagtactacactgtactgtacaacgcttgaatacacatcagtcacctgcgggaagagcctctcaaatatcatgcggtagtagtacgcctccttgtggacgggcgtgttgtgcgggtacactttggcagcgttcttcatcatttcatcactgacctgaagaaatgacagagtaaacgggggtcaatttaattaggcgatttataggacaggacacagggaaatggtcggtaattagtacctgctgctcggtgaaagccttcaggccatcgatccagtgtagccgacgctatcattgnnactgctctttctgcttgtacagtatgtgctgtggagaatttcagaagtattagttcagaacacggacaaaattaccattgcatctgaagaaacaaaaaagaactgccatttctaccttcggcaggtaaggatgctcctcgtcgtcgaacgccttcctcataacccacttctcgatgcgaccaagatcagcattgtactgcgtgcacacaaataaattgtcaacacattctgatcagcagaaatgggactataacataacatcagctgtttcccctcatgtaagacgagaaatttaccatcttccactcagggtccatgctcatggcgacgttgatgaactccnnnnnnnnnnnnnnnnnnnnnnnnnnnnnnnnnnnnnnnnnnnnnnnnnnnnnnnnnnnnnnnnnnnnnnnntgatgaagtgctttcacctgcgttgcacgtacatcagagtcagaaaattcagagacagtttcgtgccagcatcagaaaggaatttcagcaacagcttctgttagtcgcggttgtagtgtcagcggttgctaccttgcggcaggtctccttgtggaactcttccttgttgggggcgaa

SEQ ID NO: 2593 - DNA, 5071 bp, Oryza sativa
cgacgcgacgaggagagatcggacagggattcccatcgctaggcttcagcagattggggtctgattcgtcctcggatcgagctttctcaggggggggggggggagggggggtcaatttctggtcgggttcgcttctccggaaggaatcttcacgtgaaatttggtcgcgtttggaaggaaccggcggggggaggggaagaggaggaaggaggattttagccatggacggagccggaggccgccgtttttaaaagtggggcgtggcttcggggttcgagatggttcgggaacccggtacacgtgtcgcttgggcgcgcttccagcgaattcgaccaatgggatgcgagctttcgagcccgttgcgtggccgtcgcggtgtctgattttgaaccgtgtgccacgtaggatggcgttcgtccacgatcctcctcttccgtgtgccgtggaggtggaaaggggatataatcaggaccgtccgatctcgggccgtcaggccggatggtttagcgtttgacttcgtgtgccctcgaacagtagatccctgtaagcgtatgcgttcgtcatccgatgatcatgtgcatcagcatcagtttatcagccaagttatgtctgttctatttcaacgtaatcatttttatcggttgacggattatatagttgaatggcttgttgatgattttatgtagttgggtggttgtttcttatactccctccatttttcatattataagttatctgatacatcaagaagatgttgggtcaagtttctctttacatggagcctttgctcttagcctattgcagcccataagtttaacaaatatgagccgttgatttatatattgattaatggtggagattgtcttatcctttaaaaaacctaatctccattaagagagtacagcaagtgtccaacagttagttactactccatatacgtgttttgtgatgtctctcagttaattatattttttttatatcatgtatcaaattttacctagagattaacctaccattgattaacagtaagaacatccttcctccgtataaaaaacagcttttgggggtatgtatcaagcttttattcatgttcatctcatatccatcaaaagttgattctttttacacgaagggtttactaggtactccctctgtttcacagtgtaagactttttagcgttgcccacattcatatagatgctaatgaattagacattattatatatataaatttattagcatctatatgaatgtgaacaatgccagaaagctttacattgtgaaatggaggaagtagatgggagaaaacgaatcgagggtgcaatgataaaatggccttcatgattttcatcggtctttgtttaggcttggccttattggcttatgtgatttataagtcggtggatttaatgtcctaagtttagtggtggaattatacatctacctcaaaaaaggaaaaaaaacttctccaacataacttttggcttaatagtgttagagtggcttatggcttaaaaagaccaaacgaataaactgcttgtttgtttaggcttagacttttcgacttataagttagcttataagactaaacaaagagggtctaaggatatggtatccgcaaaagaaaccaataaccgtaaagcttgagagggccacgatgaccgaatcactaaaaaataatcagtcgcgtgcctcccctcgtggccacgtggcacgtgcggagaagagggctgcggtggccctcctgtgcggcgcatttctcgttttttttcttcgtttttttctttcaatttttcttttcggtttttctggttttttcccttgatttctttctgtttttaacatatatgtatataaattttgtattcgtacatatataaagtttgtatgtgtatgaatacaaatttttttgtatacgtggtgtttttcttggttttcggttttctaaatatgtatgtatttacgtagtatacaaacatggtatacgccatgttttttcttttttcttatttttttaatacgtatatatatatatataaactttgtatatgtcgtatataaacttttcatatatatatatatagtataaaagatatattttttatagtaatagtatagtagtagcaacagtgtaatagatagtagtagtggtagaggtagtactttaccactactacgagtgtgtttagttttttaaaaaaaagttggaagtttaaaaaaagctgagagtttgaaaaaaaaattagaagtttacgtagtatgtgtatagaaaattttttaacgtgatatgatgtgatgcaaagttgggaacaggtaataacttcacggcctactagtagtactgccgtactggtagtagtactactgatcgcgcgggggcattagcagtccccacgatgacaggtgggccctccaagtgccacgtcagcctaaaaccctgtcttcctcgccgcaaggccgcaagcatcgccaagacagaatccaagagaagaaaagttacaaaaccccattccgttattccagcattcgccgttgcgcttcagctcttctccctcccgccctctcaaatttcccccaaattctcatccaccaccacgccgagacgccgaccccgccgccgccttcttctgaagcgtctccccgcatccacctccgcttctctcctcgctgctgccgacgcgagcgcggcgcggggaggcgcaggcgcaggcccatggctctctccgccggggacgtgcagttcatctactccgtcctcgccaactcgctcagcgccgacgcggccacgcggcagccggcggaggccttgctcgcgcagtgcgaagcgcgccaggggttctgctcctgcctcctcgtgagccctcctccccttttcccctccgcttcgctactccaccccacgagccgcaggcccgctgatttcgggctaatttaggggcggttttggctttgcaggcgatcatcacgtcgagaggggaggaatccgacgacgatgtgcggctgctcgccgccgtacaccttaagaactgcgtcacccgctgctggcggaacagcgtcgattccccgtgagttctcatcctgtccaacatttaattctgtgttgatgtgtttaatttgaactaagtgcggttttagtagcgatcaatggtaacttgaaagtgcagcgacgtttcttacttggatgatctcatttgtggcgtttattcaataatgcaagcacagcaaatgcctaagttgctatatgcggaaggaagtctcagctgtaccatcacctgtacggcgtgtctagtggttttggatgatttttgtgctacataggattcttctatgtttgggcattacttgctattgctggttttggtccaacactttatgagctaaaaataagtgttcctgtttatgttttctttgttattttgtgcaataagattcacgatggtagcaaatcagcaaaacactttgtaacttggtacgatagatttttcttgtctccagtgaattgtacactagattagtttagtgggtcttatgtgtgagatttttatattagtagagtggcattaacttctgctggagccatcggcagaaatctcttgattaattcctggtgcttaaatgtccctggtggaaatctaatatcaactacgttgttatgtccaataggctgttactgactttggcctccattttttttgttctgaaacagcaagggctggattggcctacttctgtgtttttgtctatagacggcaccctgcatatttctcacttctggggcatacatatattgtctactttgattttctatgatacttttcatactgttataagccttgtgttctctctgcctttgataattaatgtttgatttctcgatgaatgagtttaaattgtattttgcagtgccatagataatgaagaaaaggtctacattcgaaaaagtcttctgctaaatatgcgagaagaaaatgggaaggtgcacatttgtaggcagtacatatttaacactgttgaataaacacagggagataataatggtagtattaactttgacaaatgatgtggtgtagattgcacttcaattggctgcactgatagccaggattgtatactttgattatccaaaggaatggtatgatatttttatcccatttcttatcaattgtcttatgttactccaactactggactcgtgactcgaaatgtttctcataattttggttattcaggtcagatgtcttctctgtgttggcacagcaacttcagacatctgatgtattcacttcatatcaagtgtctacagtcctattccgatctttgaagaaactatcaaaaaaacgtcttgctttcgatcagaggaactactctgaggtatgttcacttttcacaggacatcttcatgttcaaccgctcatcaccgctaagatatgaactactctttgatcacattgatcttctatttgatgcctactggttgtagttatcctgttgaaaaggcacacatgagcattaggttcttccctgtatatagctgacattactttgtgatgacgacatgcccaatacaggacactcacagattaatgttggcctcggccagtttgtttgataaacacatgacctttcacacttaattttaaggcttatatattttttttaaacaaattgcagatacatctgctctatttgagcctttgtctcattataagcacacagagtactttaattagcaattatgtatctcattctgcctttgtgaaaactattatgttatgcagatcactgtctacttgtttgattatatctggaacctctggaagagcaatgcacagattgtattacaaaatttttcagtgctttctcagcataattccagtttggaccaatcaaatgatctactgttaatatatgaaagatggttagtctgtttgaagatcattcgcgaattgatttgctcaggttatgcaagtgattcaacaaccatgcaggtactaataaaatatttatgttcacatatgcgcttttatcttgagctcacaacctgaggctagaagtctaacctaaatgtttc

SEQ ID NO: 2594 - DNA, 1715 bp, Oryza sativa
gttgttatatgttgggacggagggtgtccagattcatagccaaaagttgttatatgttgggacggagggtgtccagattcatagccaaaagttgttatatgttgggacggaggtagtcacaatatttctatctaagaccatgttcattcagtattttttcattacactggagcaactatgcaattcttttacttgatatgtaaaataaaagcatgagaggcccatgaatttcacctatgattgtcatgtccatttctgtgtggatgttccaatgttcaatacatgcttattgcttttgcattgttcaatacagtcttatttttcaatacagtcatattttttgaagaaataaataccctttttgttagtatgatttggttaaaagctttggggttcacttccctcattggggtgatttttaagattcaggtctttatcatctaataccatagtttccactagtaaaatatctacatttgacattacagatcccttcttcaaagaaaggcaagctaagccgtggagccatgcaaaaagagcatgcattaagctgatgaaagttcttattatattacaagacaagtatccttattcatttgctcatgaaactgtgcttccagcagcagttgacttctgtttgactatgatcacaaatcctgaacaggcagatacatcttttgaggaatttcttgtccagtgcatggttttggtgaaattagtattggagtgtcaggaatacaaaccaggtcaaataggctttgaagcagttggaagttcagaacatgcaatttttgatcaaaggaagaacaacctttcagctactgccagcagcatggtgatgtctgttcttcctgctgaccgtattatgctgctatgcgatatattaataaggaggtattattctgaattgctagcaacccatatgccatatacaactgctccacagccaactgtttctgtttgcattcgtataatttcattcgtagttagcatcatgctgcagaccatctattgaagtctgtaagatagaactttggttctcttttaattagattacacaaattgttctgctatcactttactagacaagcaaatcattgggctaatcaagtaaagcaccatccattatataaacaacaataaatgttttgaagtaccattcgctgaaaaatattttattatagttacactaggtaattagtaattacaccttctttttaaaactaatgattattggtaaataattccataaatgtcttagagtggtttacaggagcaacgttcagcaacttataaagtatagacggacctatcgaatggcatgaggaaattatacacattttaattgctgtacggggaatgtgatgccgttatccatgtgtgagaggagtgtcaaattagtaaattacattggatgttgtttgggtttgatattttactataatattttatacaataccataatgtggtgtcattccctttggccttctcttctaggacccattaacgcaagttttaattcaactgcaggcacttcatttatacagcaacagatatgaatgaatggcattccaatcctgaatcctttcatcacgagcagaatctgctacaatgtacagagaaacgccgaccatgtgctgaagcacttttcattattttgtttgacaactacggagtggtatatgggcatttcatggtaattccaagtttaataa

SEQ ID NO: 2595 - DNA, 8164 bp, Oryza sativa
  unsure (1)..(8164): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcatggccatgatggtgcaaatatgtgacaaaatcaagccacataacaaatatctgcataagggtttacaaaatgtgaacacatacatcaccagacactcccatcaatccaaattatcattttgcagaaactaataaaaatatcatgctcttaccacgtatggaacagcatagagctttaacattttgaggggccccatcacaaaggtcagaccagcaagaatcccaaccattgccagccaggatgcagttgatgttatcacatccttcttctcatttggttggaacagatcactgcttgggttgaagtgtgaaccttttttccctggactccttgcaaactgcatagacatgaaccccaaaccaggaatttagtatgatattacaaaataagaacctctaatacagttgataatgaatgtcaagaagctcttggcctaaccaagtataatgggaatgccagcatgggaaacggcatggtgaacctcaatttcttcgtcatatagtccaggctattgtacagcctctcagacagctgcaggttgtcacgattagagaaccatcgagcaaaattgcagaattcctcatgaaccaaccaaaaacaaagacctaccggttgccaggactcgtctttctcgacatgaccgtggttctggtggtgcgtcctgtggctaatcctcctgaaattggatcgaaataatgtgagatgctgccttccttagcttcaacaacaattcctgtccaaaacgaaagaaccaggaatacatgaagcgcgctcatcttaccagccgtggtatgggacaaggatggaggagtggagtatgtgtccaaccacgctgttcaacttggcgttgcttgagaagctcccatggccactgcaaagacaccgagtagggaaggaagggtcaacgatccgggctgccaaagctaaaacccacagaaaagaaaaaaaaatccaatctctaggatggaggcaggggcgtaccagtcgtgacccagcacgaagagcgcccagaacatggtgccctgcgcggcccagtagagcggccagacgagccagctgtcgacgcgcgcggcggcggcggcgaggccgagcaccacgacgacgtcgcgcagcacgtagctcatggacctccaggggtccttcacccagcagtgcttggggatggccgcgcggatctccgcgagcccgaacggcggcggcgccccggggtcgaacccgtctccgtcccctcctacctcccccgccgccgcctcggccgccgccaacgaacccctggcctcctcctccaccacctcctcccctctattatcctcctcgacgacggaggtgaggcgggtgggggcggaaacgcggagcgcccactcgcggtggatggctccccccgcggcggcggccgacacggggcggcccggccccgcggcgaggctgggaggcgccggcagcgcaatggcgccgcgcccgcgcaggcggagcggcgtgaggccgcagcactcggagaggacgagccgtgccatcgcctccgccgccaccgacggtagcagccgctgcccctgacggcttacacggatttcctttctgatttttctgctctgcgttcgcggatgggccttgctgtgcgggtagtggtggtgatgggattaagagaagtccacgatttttatactgccattgccagccacggaccggaccgggccgccgtgaagcgcgtgggggggttcgcgcgccggtgaaccgaaggggacgacgcggtgcggtcgactcggactcgggtcagacgagaagacggtagctgtcacgtgtgaatttggcgtgcgacgccgccccgcttttaactcgtgggttgactgactggtttaattaatttagcgctgtggcgattatattccaggaattagcggttcgatcgatctaatgcatgtgtgtgaaagccgtaggtttggtgtggatttgtggaattatcggatgttgcacgatgcgtctttctcactgctaattaagatagtttagtttagcacgtacgtacggtattgtatacgtggcaatacagtagtacgtttggtatgcatgggtggtcaaaggtggattgcagcagtgagtcaaccaagtctatggtatgtggtgtcaactttggcacaaaactttttcaaaaaaaggaaaaacaaacgctctctcgctcatgtatgcagcataagttcagtgcttggacgggttagactaatggaacacattccacgtttcgtttcaatcgaaaaggagtcagcgtacatatataattaatgtctgtgtcatgatcattgagattgtaataggaacgcttatgcatttttgcgtgttggtgtagaatgtatgtactagatcattatcctaagtgcactaaaaaattgattgttgcatatgtataccgtgatagacaacgcaataaacctgtctgctgcaactaattcatccaaaccttctcttgcacatgtggattagttacatcacagttcagattataaattgcggcataattagaaattctctggtcccgaaatataaacatgcccaaaatatgaacattcttataaaatggcctaagaatgttcaattaaatgccacctgagtaatgtcacattagaatgttacatcactgtttccaaggatgccacatgagtaacaaggcatttagttgatgattaaaatagcttatcatgttggctttgacccaatagcaatatagattgtgctacaaattttgtatttttgtggtcataaattatgagaatctatataagagcttccaccgccatcaaagcccttactatcaaaataccaaaatataaaaatattctattttttatgcaagcttttggaaaaaaaatacaaagcaagaataaatcgttgcttgatcttttatctcgcacataatgcaacacccaattgtcatcataccgatcgatcttttatctcgcactatgtttcatggattgggatgaactttgaagtaagcatgaagtctaaacatttttaattatacgtagtgttacgttgaaagttagtcttacgtttagtttactgttaaacttttgttaataaagatggttcaaagtatatctcattctataaactatcattgttattttccatttaaaaaataggattagctaccctctccatttcaaaatatagtaaacctaagactaagatggacaaatcataatgatatgaatctaaacaagccctatatccaaatttatattattataatgtgtctagttttctaaattactatattttggtacagaaagagtaggaggtaagtaaatgtatttttggagggggggaagaaatgcgttcacacggtaaaacttctttatgctgatggttaattaaatgttttaggtgtcatctgtctacgtcaataagatctttgatgacacacattagtacagtgtggtacaactgtatatacatccttcgtccaaaaaagagtatgaaagcaattaaacagtccttgatctgatctctacaccatcgacccaagagaaaatttgatttatatactatcatgggaagggagcttgtaccacgaaatagaacatttcaaaatgttatgcctccctttaacctgatgcattcatacttggagaagaaaccacgtaatccctttttggtatcctttcctcgagactctttcgtcgtatcatcggaaaaaagaagggagagatttgccttgaaaaggaatgaacaagtcagagaactcaaatggcatacgacgacgatgtgaagatagtacactaatcaaatgcgatccagtccatgctagtactttatctgtctcctattaaatttatttttgggtccttacatttatttcaaaataaattcatttctactataattattatatcgaagttggtaaaagtaaaaaaacatttgtgtttaaagcagataaaataagagatagttatattattgtttgataaaatagtaatattctaatttcttttatgtgtgtggaattgataaaaataaatttatttggacttgctactactcactccacttgaaggttcgcttttatactggtcgatcgcgccacgcttagaagcacactaggggttgttttggtttaaagtcctaccaaaattttgttaatgctaaatcttggacaagttttggcactaccaaaattttggtaggattatgttgtttaactctattgaattggtaagatttggcctcaatccaaatagctaacgagtactgttcaaaactaccaaataattggtagggcaagaattggtttcaatccaaacataccctagtactccctctgttttttaatagatgacgctgttgactttttctcacacgtttgatcattcatcttattcgaaaattttatacaaatgtataagatataaatcacacttaaagtactataagtgataaaaccactcataccaaaataaattatatttatgtaaattttttaaataagacgaatggtcaaccatatgaaaaaaagtcaacggcgtcatctattaaaaaacggaggtagtattactactactcatttcgctttcgaaaatggaaaaggcagggccgcaccgggaggggtgggcccggtgctccaggcggtggccgcgtacgtggagcaggaggcgtccacgtcgacgagagctgcgcgcgcatatgggtggcttctgccatgcggatggcgtggcatcttctaccgccgttgatcttctaaccgacggcgctgcggcgatctggattctggaccaccgggggggggggggcttggccgaccgagtggccgcggggaaaaagcggtgagcgcatgtgtgatgcttttttttcctttcgatttcgacgtggacgtgaaccggatcggatcgtggaaaatccatttgctagtcacccaatcacacccgtcgtcattaggacctgattaagacctcgattagattaattaacccatgtggcaaactggcaaaattgatagtgcaggtcgtaacatgtcctctcaagcggccggtcgcctcgcctggctatgttgccatttgtgcgccaagccattgcgaacctcacttgcgttgtcgcgcggttggacgctttgtggtcggcagcaacggagagcgcgggggcgatatccgctgttatgacggcccggtcctaccatgcatcactagaggggccacaagataatccggcagtggactccggccaagagtttaagaacccgtttagaatggtgttattttgaattatatctttttaaagaaactgataaagacgtgagtgtatttagtttgttactaaactttaagtaatatttggcaataacacatttaatctattctaataaaatttagcaatgttgttaaaattttagtattatcaaattttgaaaaagtttatttggaagtactctgaacagctcctaatataggactcatgtaataaccagcccaaactaattagaaaggctggaccgcagggtagaggactaaacgaggaccaaagacctcagctccgtcaagccaacaacgtgcatcacgtaaaactatatgtttttttagtggacggagaaggggttgttgcttgttggtccgtggtccatggccggtgcggtccggtgcggtgccccttgccttggcgtcgtcgttggttaatcacgcttatgtcctcctgcccgcgtggattttagcaagaaatcgctccgaatcgcggcaggatcgcatctgtggccggcaggaggacacgaggtcttcgtgctcgtgcggccaccatccatccaatcccgataatgaaatccctcctcattggtcaaatccatggtttcatgcgtgctcccccctcagctactagtacagtttatttatacattgtctaccaaatccacacgacattcctacaagttaaaaaatatacagtagcatttctttctgcatgacaatttaacaggaagatatgacctttctgtctaacaacagcaatggtgtggtattactgtacccgacaacgaaccgttcataggccccgtcccgtcctgattctgttgtccattccgcatgccattcttcagatctcgcctcgaataaaatcaggacttcaggagcatcttatgcaacgccaacgccaacgtagaccataacatacgtacacctttcatgcccctatcactctatcaggaccctgtgcaggtagtgtgaccgggccggatataagtgaacacggagagactagagagagctgcgagtaaacgggggcgccttacccacacttatcaatgggcgtccaatcagagggcgcgagcagcaaccggtagctgctgcgatatcgtgtcctctcccggcgcctctcatcacgccgtctcctcgtacatcctgctgattacgacaagcgagagagggggagaggctggatggtcagttggtcaccagccatccaaatcgtccataaacagtactatgtgctatctctcagtactcttgatggagattggaggcagataacatcgctgcacaagtgaaagcacgttgctctgctttgctttcattaactatgcgttagctggtagtacaaagtagttcaaaggaaatgataagctcaaaggtggtactacacattactgtcatcggttggttggtaatcaaggtggtttaggccatcaaggtctcaacgtaatacaagttatggccacagaaaccatgtaggccaaaatggtaaggagcatagggaaggcgatcgtatgaaaagatggcagaaagcccaaccagggatcatggcttccaccatttcttgttctccatggattttgcgatctgatgagcaagggaggcaaaattctctgactcgttctgaagttcggcggattcttggcttattctctgccaagtaaagaaccagaatcagttctttgtgttcaactgttcatagacgaaaggagaaaacaacttgatgcaaaaaaaaaggatggggaagtcgtttacagcaagtttctcgccccgttccttgagcttatcttttgcatgagctgcagctgcagcagcatcctgaaatgagcattcagggttagtcaggttaacaaatcagaggtgatcaattcgctatttcgctgcattggtgaaactagaaaaggaaaagtaccccgccaaatttgtatttggtgaggatctcttgggtgcttttcattcttggtttctcaacatcgcttgatccgtcaaatagtttctccctttccgtctctagcaaacagttaacattgcaatcagaagaagagtacctttttttaagaaaatttgagaagaagagtacatttatatatttcgaattgccagaaatcgcagcgctacctgttttggttttcttactaaacaaagaccttggggttgatgctgggctggtcttgcttcatcgtcaatctttatgtcgtctgcaatgtactcttaggtacatttcttgttaaatatgaacgagatagagagatagagagggcgcgcaccaattgccaattctcctgttggattatgggtgttacccattgacaattccacaaaatggattttgaagaaaaacacctagaactgttcaccttaggtttatccagcgcaacttcctttcagcttcttgatttctcttatgatgccacaagagtctaagagagccagctgctgtatcatgcattagaaaattcaagtcaaggcaacatacagaatatttcaacagatgctgcatgaacataataatgtcaagcatggaaatgattgtggaatcttgagatatagaccgtgcaatagaaacgcagcaagtacctgaagccgttctcagaaaaaaaaaatgcaaattaagacccagagcaacgtgagaataaacacaggaattcacatcaaccagagagatgaaaggaattaggaagagtcttgcagattacgaccacatttggtcccgaattgtgtgttgccccggaaagcttggtgtttatttttggacaccacacttcagggttctccgctatttttccatttttaacaaccgaacaggctg

SEQ ID NO: 2596 - DNA, 692 bp, Oryza sativa
aaaggatcattcactgataaaatatgatttgacaagaccaaatattagggaagcaatttactatgtatatcagaactggcagtggatatcacttacttgtctcactccgtcatgaaaattattcaaataatatcgtgaaagagcactcatgccatctttaatcaatccaggtaatgtctgccttccatacctgtgttattaagttgttgccatggatttaacaatacaaacgcaccacagttgataaacaaattattgttgtaacaataaatgctaaaaagttacctcactaggtccccctttagtgcataagaaccagcatattccaggcttagctcatctccatgttcaacccacactgtgaaagtatgactacaatatatgtaaaccatcttggtttctatagtaaacaaaaaggaaccttactttttttaaaggtgtcactaatgtctccagattgggaaatgctgccagatgatgatagagcccccatgcgctgcagctgtaagtccaacgattttctagcaaggaagctctggaaagcaaaagaaaagtgttaaaaacggattagtgttaatatagtcaatagatcactaaacatactacataacaccattttcagtatttacatttatcatcctcaacattagtaatgaaatattatatcacggtgcatgctcagtttaatccca

SEQ ID NO: 2597 - DNA, 1243 bp, Oryza sativa
  unsure (1)..(1243): unsure at all n locations
cagcacacggttccaaattagtactagtacaagtgtagtagtactacactgtactgtacaacgcttgaatacacatcagtcacctgcgggaagagcctctcaaatatcatgcggtagtagtacgcctccttgttgacgggcgtgttgtgcgggtacactttggcagcgttcttcatcatttcatcactgacctgaagaaatgacagagtaaacgggggtcaatttaattaggcgatttataggacaggacacagggaaatggtcggtaattagtacctgctgctcggtgaaagccttcaggccannnnnnnnnnnnnnnnnnnnnnnnnnnnnnnnnntcaggccannnnnnnnnnnnnnnnnnnnnnnnnnnnnnnnnnnnnnnnnnnnntgtacagtatgtgctgtggagaatttcagaagtattagttcagaacacggacaaaattaccattgcatctgaagaaacaaaaaagaactgccatttctaccttcggcaggtaaggatgctcctcgtcgtcgaacgccttcctcataacccacttctcgatgcgaccaagatcagcattgtactgcgtgcacacaaataaattgtcaacacattctgatcagcagaaatgggactataacataacatcagctgtttcccctcatgtaagacgagaaatttaccatcttccactcagggtccatgctcatggcgacgttgatgaactccnnnnnnnnnnnnnnnnnnnnnnnnnnnnnnnnnnnnnnnnnnnnnnnnnnnnnnnnnnnnnnnnnnnnnnnnnnnnnntgatgaagtgctttcacctgcgttgcacgtacatcagagtcagaaaattcagagacagtttcgtgccagcatcagaaaggaatttcagcaacagcttctgttagtcgcggttgtagtgtcagcggttgctaccttgcggcaggtctccttgtggaactcttccttgttgggggcgaagttnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaacatcggcgtgctggcccgtatcgtcgtcacgtcgtacgtctcgtcgtggtagatgacctcctcgatcgcgtcgatgccatcctaagaaaggccaaatatttcatctttctgtcagttttctgacccagccgttatccatatgagatatggtttggggcaaaattttgccttacg

SEQ ID NO: 2598 - DNA, 434 bp, Oryza sativa
atctcctgagtactcatgcaaagaccctttttctgtagttgtgtatgaataaatgaagagacgagctgattttcctattgagacaccagccttcttgcaaagtgccttttcatggtcgcagtttaccttaccagcctgcatagaatagagagttattatatagtttgctctttccatatgtttatctatcattaaggagcagcattcacaaatttgaccagcttaccctcagtgcaccatccagtgaacgagctacatactccacgacactttctagcacaaattgaccttgtgtgttcggtgtctacaataacaaaagccaagagattccttgatcagctgtttctttattgaaaatttgcatcgtgacctcctgaatgttgacagaactagaatcatgaccagaagattttgtaccacgtctggctttgcca

SEQ ID NO: 2599 - DNA, 627 bp, Oryza sativa
cccaccgccaaggcgggatggacgaaatggaggcgtgttttgcagcgtgaagggggcggcatggctggagaaggaggagacaagatcatggttggcaagctcgggaaggaactctgcatgcgggacaccgagctccgcgctatgcacacactagaggagcacgtccagccgaggagcactctcgccgcgctcaacggcctccacctagatctctagcactggcgttgacgggctagctccgttggatatggccggagcgtcgtgcctcgtcatgtgcgtgctcggcctgcaactggagaatatggtcttgtgcggcaagctcgacttcgccgtgccatctttcggttcgagaacaagttctccggcaggagacagcaagggattgaggagagagagctgtgagggatgtggacggaggagatcgtcagtgagggacaagcctagagccagcggtggaggtgcgggacaccgagctctgcgctatgcacacactagaagagcacgtccagacgaggagcactctcgccgcgctcaacggcctccacctagatctctagcactggcgctgacgggctaactcccgttgggatatgagcccgagcgtcgtgcctcgtcatgtgcgtgctc

SEQ ID NO: 2600 - DNA, 6820 bp, Oryza sativa
ccagataagggagctggatcccattagaaaagcatcgcttgtcgacatgctaagagagaatttgaaagaatgtgcagctctgcatggtgatgcagtcttcaatgcagctatcagcaggatcgatcctttagtaattgcgcagttgtggcaggccctggagattgggataatatgtgcaccatggcgattctcttcgccgttgtcccttctccgaacaaacacttcatcacaactcacaagccatacaatttgcatggacacatgtggctactacatcgtttttactgacattgaagtgtgctgttcgatagttacgacaccatggcaccttcaaaaaaacactgacgtccaaaatttagcatacataaaacactgactatctgacgtctcaaggatattcctttcgtagtgaatgtaacaagtatggggtagcatattcagggatagccgttttcttgataggatatactcccaaagtcccaatactcctagatcagatattgacatgttataggaaaccatttgaaaagagaacatatgaaaatgtatagaatcgatatcctttgcttttttttacttcaaaaacgaaacatttgttgtttgcaacaaccatttacattctgctcatgtgcttcatccccccttttttaacctgtatctctactggacgtatggtccaagttctcagtgagcatggtatacgtcttttgatcgtgtaactgacccaccgatttgccgaaataatttagcagaaatctgattgagttgtgaacgcgcacccgttgggtatggtcgattcatgtacgctgatcctaggcacgtccactgttgcatctgtaactgacccaaagatggccatgctctgacaaagcacctattccccttgaacagaaacatttcctatgaacaactcaaaacaaaaataactggggaggttctgaattttgagaattatgtggtggtactgagaatgctcgacatgtaatctttacctgccccttagcaaggattagatgcccctggatgaaattttgtccccctcttcgttggatcagtttttttccaccttgcttcctgattcttatacagaagagtgttttgttactagccgcaggagttagcaattttggctcactagaaatgacatgatttttaaacctaaggtggggggcactcctcaaactgtgatctgtcgctggatctctcttctgtggcagtggaggattttgacgaagccgaaggacacactaaaggcctgtttggtacagctccaactcctaaatttaactccaggagttgagtctggagtggagttgtggagctgcctaaacccagctccgcaactctagttcattttgtgagagagctccacccagctccactcccagttttggtggagctgaaactgtttgactgaacttcatctccaggaggggtggagctggagctggagctgtgccaaacaggccctaagactggagctcatgatatcttgttgtttgaggctgctggctccctgcaggtgcgggagggtgtgagctgattgtgtgggatgtaccagtgacctggggagggttgttgccccgagtggttttggcagctgctgtgtgcacttgtgggttttttctgcgtgccctggtcacctggtggctaaaactgtagccggtcaccggcaaaaaccatctattgctttctatcaaagcagggttctctgcctttgttttccaaaaataaaaaaaaaaataacattggcatctgggccaaaggagcaccggtagaaccagccaaccaggccaaggcccatcccaaccacgacggcctgtgtccacccgtcgcttgccagttcaccccaacatcccagaaattcaaaacccatctcaggccgtaacgcaggtacgcaaccctacgagagacgcccccactttcccaaagccgagagccctttcggctgcccacgtccccactcctcccaccttttttaacctttctcctctctctctctctctctctcccccctcaccatcgcggcggccgccaccactacgcgcagcaaccggcagcagcagcagaggaggaggccagggcaacccgcaaccccaaaccctactcccgccgcgccaccgccatggccgacccagcggagcaccgtgaggaggagcaggaggccgcggcggcggcggcgggcgaggacgaggacaccggcgcccaggtcgcgcccatcgtcaagctcgaggaggtcgccgtcaccaccggcgaggaggacaaggaggtcctcctcgacatgtaagccgcctccccctccctcgatccagccccgatccgatctcccccggctttgatctgagcctgacgacctcgttttttttggatttcccgcaggaagtcgaagctgtacccgcttcgacaaggaggggaaccaatggaaggagagaggcaccggcacggtgaagctgctgaagcacaaggagaccggcaaggtccgtctcgtcatgcgccaggctaagacgctcaagatctgcgccaatcccctcggtatccaatctttgcggggatcttttgttgttggtttcgatctggattccagatggatggggttcgacttgactgggtgatgtttgtgtgtgcagtggcgacgaccacgaagatgcaggagcacgccggcagcgacaagtcgtgcgtgtggcacgcgctggacttcgccgacggcgagctcaaggaggaaatgttcgccatacgctttggatccgtcgagagtaagcactaaacaccccaagaattatgtagttgctccttttgtttcttaaccaaaatattatactgctagtagtagcatgtgcttggatgggctttgagcaatcagattgttattgggtgtccgagaattgaattggtgatggttttctgcttggtcgaggttcatcactcaaatgagttcgtagacagaccatagttttatgaattgtgtgatcataaataaagtttgatctgcactgtgagttttatttcgttagacggaccatagtttcctgaattgtgtgatcacaaataaagtttgatctgcaccatgggtttgattcacattcactttgctgtattgttttcatctagtttactatcatccacctttggtgtttggatctaaacgccttaactataatctggtgcacagtgttattggacgactagcagtcattggcgtgggactgtttttgtgcgaatgatgtacatgatttaaccatctaattgcatcaatttgcagttgctagccttcacatttgttttatcacacaccttgcttttggaagtctgcgcttagaaattgttctgtgattctagcatgttttttttggtgaattgcagactattttctgcttttcaagttctcgtcataatttgggaggacatggaatttgtgtcctgtctaaagcaaaattttgaaatagcaagagatctttaactttctggatggatttaagttcgaaattagtcctatttctttttgcatcaaaaccaagaagcaagtaactcactcaccatgtggcaaaaccaatgaacatgcaaccaataagtactagaatgacttcttggtttccgatccacaatttaatttagcacatagtgactacaaataggacttagatttttggaaaaaccaaaaaatgaaataagcctcagatttttggaaggagggagtactttctaggccattttttatcttttgaaatagcaatagtgccaaggtgacagcagccagcacactaaagagatggacaagatatgtactataatccttatactgctccatgttttatcaatccaaatattattttacttaagattttgattcatctggtatgtactttaagctaattaaaggcataaccacattgtgacgtggattattttgtgaaaatgatctatattagttttcattaacagttaggatctgctggtgcaattctttctcattaaggtactttgtccagtgattaaatgcatgttcgaattgtatgatgcatttaaaattattctacaattgtatgattgtgtcaatagttatgtactgtttcgtctgttcctgaggtttgacaacatgtaaattgaaatgaactgtcttgctatgaaatttgctgctgtgactatttgagacatcaatatgtagttctttgtgagagactgctatatttgtattgacctacctaagctctgtttcatctgcatttctttcggacttttttgtctgactgttgtccatgaattttgtttcagactgcaagaagttcagggagatggtagaagagattgctgagcagcaaggaaagaacgaggagaaagaaaatgaggaagtctcctctactgcagggttggttgagaagctttcagtgaccgagacaaaaaaggaggaaaatgcagagaaagaggagactcctgcagaagaggataagaaggacgctaaagagtgaaagcacccgcaacctctaggcagctttgatatgcctgaagcgagtgaagtgttaaatgagcgtcatttcattcattttgtggtcaaagttcttcctttcacaaattttcattgtgttttcttttggatgaatgtttgtgctaggcaaaatttgagttgtatcagtcgggttcttggttactacactgttacttaaaccttgagttgtttatccgagatggggtggcggagtgggggcacagcatgtttgtacaattatttgaagttgcttttggaatgggcacggtttgggttgtccaaaatttggacggtgatgccctgtcactcacaattcttatctctgtcttgcaattatatgcgatgtgaagctcttcgcctcttcggtgacgagttgtcgagttgtatgtgtgcatttttactgctgcaacctgcaaaggtgacgcactgcagagcatgacgcatatcattatcatataggagtagatccatgtgtattgccgggcaaacgcatttagtgtgaatcatgtagtacatatcacagcacgcggagcatatgtcgtctcataagctcgtaaaatcgcagcaatgaatgttggtaccaagtacttgttgctgtagtgctgtgcttgtaccgcccccatgttatcgtgaaaagcttctgtgcttgtacacaccccatgttatcgtgaatgcctgtcgcccatggcgtctaaaaggcatttctcacggtgtgtaaaccgttgcatcccatggcatatactacggcatctcgtgtgcatcattttgctttatcatcttcagtcaggtgatctgtagccagtagactttacttgctacgtctgtaacctgcaaaacactaccatcctgcacccatcgatccgcaatactaccatgctgtctgtacccatgttccgtggatctgggttcacccccagcatggaggcgtatgcactgcgcagatcgtgatacgcccccattgatctgcattaaaaaccgatgatttcccgggagccacataacctgcgtatcttcccgatcgccggaattgcgatgtactcgtactcgttgctgcttgtttgctcatgatgattgcccgtggtactgacacagtgacaagtcgacacgtcctgggagcgtactacggatgcgcgatcggaaggatctcccgatgcagaaattgcagatggacgcgcactactacagcttcagtacgacaagttcggcggcaaatgcatgtgacgtgagtgtgtgaaacacgcgcttccccctcgcatttcttttgtttctcaaacgaaagaacgtgcacgatgaatttgttcatggaattctttcccgccgtgagcccgtgcactgccccgtgagccttttcggccatttctcctactataccctgttctgaaagactgaaatctggcgcgaagtgtttgttacctggtcggcttagtttcagaatttgaaactgagagacaagaaacaggaccagttctcgcttccaacctggctttccaggacactggtcgtgtatgtgtcagagtttactactccattgccattagcctgcttgtggtttctcgatctgatcattcagacgaccatgtaagtaaattgttcccaggtacagtaccgtttctagataattagtaccacgaaactgtccccgcggtcgggttacggttaggcttcgctctcaagcctcgcgccgatacggtaaacgcatttaacgagacatttttccgccaagtgaatgggccaaaacaccagcacgccgcggtttccaactaggcaacaactaacctcgttggctggctgtctcacactctcatgatctcatccgaccagcagaggcagcagcagcgcgcattaccgaaagtcatatgcaacggaaaaaaaaaagaattggaccaaaatattgcagagaaaacggcggcttgaattgaacccaaaatatgattgaatcaatgagataactgtacatgacagcagccacggacgcaacagccaaccgagctcgcctagtgcgagctagctcgcatttatagtgcccatgctggctgtcacagcgatcacggccggcgccggcggtggcgacggcgaggacgctgtcacggccgccagcgatcacggcgggtggcccaccggcgtcggcgaccgcggcggggttggacgggacgggtgcattcgtcgctgtcgtgtccggactggacggtggggcccaggtgtcggccgcctcccaggtgggccccgcgccccactcgcgcccccagcttgcgtttgacgccaactcgacgagccttcccttggcgcgcgccatcatctcgtgctcgctgcgcgcctccgcgccgcccgagtcgtcggagt

SEQ ID NO: 2601 - DNA, 31061 bp, Oryza sativa
cgccgcgccgaaatccgcgagcttcgcaccgcggccgtcgccgtcgcagccgacgagcacgttcctccccttgacgtccccgtgcaccacgccagccacgtcgtgcaggtaccgcagcgcggccgccacccgccgcacgacgccacgagccccgcgctcaccaagccctcccatggccgccgccgccgcggcgctcccgccggggaccagctccatgtgcaaattcctcgtcgtcgccgcgtccccgtcgtccccgagatactccacgacgtagggcgagctgagccgcctcaagatccttatctcgctctcgaggcacgccatcgccgccgccggcgcgccgcccttggcctccaccgacttcaccgcgaaggcccgcccggtggccctgtccaccgccacgtgcaccgcgccgaacgcccccctgccgacgcatttcccgcgcacccactccatggagaggcgcgccgcgcgagctcgatcctcctcgcgccacagagcagagcacgacgagaagccgaggagtgagtatgagaggccgaaacagagagagagggagaggggtgggtgtggaggagccgccaaaaaaggagaggagcagaaggtgtgagggatgcaagaaacgggggagtgtgctcgccgcgtatatataggtgtggggatcagttttatttttgtgggtaaggatttcgcgcggtttttccctctctcttttttccctcgctgggatttgaggattttcctcgcgattcgcgtgttgagggggcgatgggatagtgaattcgacggaatattatacgggatatatcatgagaataaattggggggtttgcgttggagagggggagtggggagggagagcttagccgtgcaacttgtgctgtgttatcttcggggtgccgctacgttgcggccacatgggcaaaaagatttgggtgagttgatggtttggatatatggttggatggcatttacttgcaaggtttggtttccattcacctttcactccgattcgctgaaattcgattatgtgttgtgagatttgttggtctgttatccagagtgtttagctcaatctattttgtcaagacagagggtggatatagaccctacttatgttgtttcaacattggcttgaagttgatttattttcatctccccagtaatccagtattttttaatgtagtttttgaaaatgagctaagccggcattcaaaaaaaaaaaaggcattaaaaaaagagctaagccaagccaaggtgaaataatctttcaatggaaattgactcattagcatgttattaatactccacggtccatacaaaaccgattatcaacttctttaagaaaacgagatttggagggaaaaacgtttctccaaatattttttaaaaaagaaattataagcgtgttggggattaaacatgggaccttgggattaaaacaatacaccccttaccaccgcacttgatagtgtatctcgagtatgcaaatttcgattgtttattggtctctcttttcttaggcttttgaaacaaactagcaaactttccaacgaaaagtgacctattatttaaacgttgaagtagatttcagttataattttaatatcgggttttcatgggtagaattgtatcttttttatatagaaaaacacagtagaaatacagacgctcacaacattcgcatactcacgccatatccctatgaatacattattcaaaagactaggacaacgtttcgtctcgctatcaatgggtgtgtcacctatcactaaaaaagataattagtcgtaaatgcgagaactcgtgccaagtctagaatttgaacctctgtgtgggtagtttctactacaagaaatctaaccggttagttacgctcactttgctaaaaactgtattttgtaccgcacaacacttaaaaagaggacaattaaatttgatatattactcttagcttgttctaattttccatatcaattgtattttgattataactacctatcaatctacattgttataatctagatctaccataacataagggtgcatccttttttcaccttttctttaattgatatgggaatttatatacgagttttaggagcgaacatttctttttaggtcgcattctttttagaggatgaatctaggttattagttgcacgcaaaacaagaaacatactacatgaatagttgagtattaattattaaaaaaattaaaaaagaaattatttgatttttaatacccttcctatgtaaaaaattttcgcacgaaacatacactatttagcctttttaaaagcatgctaatgaaaaacgaggggtagctaagctcaaatagcagtttagaacatacccttaaactatcaatcttttatatctatactaattctaattattcactccgaggaagcatcgatttgtaacagaccagttgctggttactaacatcaaccatgtatgtaagtagtaaccaaaacgccaccttaaatgaggatcatcatttttaaacgttgatatcacaatgcaagtagcagaaagaagccaaatctcgtgaaattttgttatgtcctcaagcaccggtatctctataaacatccaaaagacatatatttcggatttaggcgtccacgggtaactgcacaagcatcaaccaaaatatttcgttgtctgagatgcctccagctcaccaaaaggcagagtaaaccacactaccaaaaccctcgcaatagtagtgcacatctggagctcgatccctgctgctgatgtggcagcggagagctcaccgatggcacacgcacgcgacggtgacatggctggacactagtggcccaggggattcggctcgcggcacatagccaaccaataagaatcctactccaaaacacacacacaaaaaaaaaagagtgagactagtagtagattgggagaacgaaagttgtggcctgagacaacgaggcgtgtgcgatcggaggtggctcgtgggatccgtgggatcgcgtcgcctcgcgggcatttatcgcgcgctcccgctgctgcggcggcggacgtgcgcggcgccgagccacacaacccggaccggcaaagcgctctctcccgctggccgcaaaggccacgggaacctggccgttctaccagtactactactagtagcgcgtacttctcgccggaaatgtgtggatcaccggccgcgtcgtggcctctttccgcatttcggccgtatactaaagtttcgcgtctgcgtaggaggttgttgcgtttgacggcggagggtgtcgcgccacagaaaaagcccgaccggggttgtgcgtgcatgtaacctctgttttctcccacaaggggatcgttgacgtgcgtaagttgagaccggccgcgcctccaaatctagaatcataagtgggtacatgattgagagatcgcttctttataattgcggtttagatttgcatacattttggccatcatttgcaggtataatgccacaaaagccaacgagtaacgtggagcgatggtttccaatgattggaaggggaacattctgtgtgtgccaaaccgagggacaatccatgcgcccccacaggatatcgaaagattgtaaggcaacaatgcgagcttataaattcatttgtgccaatctcaacgttggggagtacacattggcacgataccgaggcaatgtgtggattatgaggttgttcgtgtatatctccttatctacgggtctggaagattcgggctgcgcgagataacagtttttgctagttattgccggcgtatatatccacggatggacccaaaaatattgggggctaagatgcctagggaagaaggaattcattcgcgcctgatcttgacttttctcggtatgttgcaggcttagtttttcccttagcgcaagttgcaggcttagttgatgcgatcaactccgcatgcatgcgcccatgctcacccctatgcctaggataagatcttctttgattctggttccatggtgagaaatatccaccaaaagtggcaccagatcggaccatcagattatccagctagcataattcagtccccgctgtaaaatgcgcagagaatatcactgtgacactgtcccgtatttcgctccttctcgatcgcctttgctgtacgcatacgctacctgctcaagctagataccgttccatcccaaattgggggtgcttctgctccctgataacttcataaccaactcatccatctagcattctagctagaaactgggaaagctgcctgccccacaacttgcagctctcagcatctcactatacgtctataccacctttcctggtcaaaaaccttttctgcgtcgctttcgggagggagctgcctccgttccaggacaaacccaaaccggagccggtaaactggaccttaattgattggctaaacccagggcaacaacagctgttttcccccattaaacaatccgagtgttcaccccagccagattctcagcactactcccctggtccgatccgaagatacggtgtacactgggataccggaagaaaaggggaaactatcacgacgggagaaagcagtcaggtcaaaaccctccccccacaaagtcggcacgactccagcagcatcagccgactggccaaaaagcacggggtttttttcgcgtgcgtgcgtacgtgatccccccgcgaccgggggagcagagccgcggaggttgacgtgcggtgccggtgcggggtggggagctcgtttcgcggcgtcggcgtgtgaggcagcagaggccgcgacgacgtgagctttgccctggattgccgcgggctatcgcgtgggatggcgcgacacgggagggcacgggaacgtgggtcgtggggtgggggggccggggagaccgcgcgcgggggccaggggccaagggtgtgcccgccgcgagggcgaggacgagagaaaccgccgcgcgcgggatgcgtgcgtgactgccgttttttcggttcaccgaccggtcgttttcgtgccagtttttgacgcgggtgggactgggagcgaggccaggggtcctgatgctgatgccgatacgtcatgtgtggcccggaacggctcggcgtgtgtggactgcggcgagtcgtgccgtcacgcaggcctcaaactcctcttcgtcttcttttttttctttctttttttggtcgagccaatatgtttagggaaatattgttcatttgttcgccgttaccttggcgtttacgagattagcaacgtatagggtagtattatatagcccagcaaaaagtatgcccacgttgccgtcacgtgcccatctccgcggtgaaagcaagatctctcgtgcgctgtttgtgattttggccctgtgttggagccatgttctgaaagcgatgcgtacactgtcactgtcaaatccgcgcaaaaaaaaaaaaaacattagcttgtcgactcctcacctgactcttcgagtgctgaaaaaattgtattactctagtacgtgctgctagttgattattgccgctactctccagtaaggtccacatgtctgtcaatacgatcaagggggccgtggcactgttacagacttacagtgccactgcagtaccaccctccttactgtcgcatggtgcattgtgatccaatatgacaaggatttcgccaatgaggcaatgagcaagcatgaacaacgagaaacggtcctacaggcatgctcaattcaattcaagggtgtgctcgtgtgtaggcatgccagtcccacaggtacatctggcaggttccacaggggtaaagagggaccgtcctgtaccggcaaacaaaccagctgagcagcagcccctcctctcctataccggcaaaaccgccttttctattacgcaaagccaaccgttagcgcggatcgtgccggcgcgcgcggcaacggcgcggcacacgtccatcgaatctaaccgcggcggcgcgcgcaagttgcccgttcgcggccaccggcccgtgagccagcgagacgtacgccggccgatcgatcgatccatctcgagacacggtctcgctccaacgtacgcacggtctcgggcccgacacgggacagggcaacttggtggcgaaccgaagctgttgcgcgcggctgagtgagtgcgaggtgaggtgcacggcaccggccagccgcaaagccagcctgacgctcgctgctgtcctccagaggcttgcgagagccggagaccgtttctttcctttttctttcttttttcttttttcggtagtagcctgtgacatctgcgtggtcgatcgctttgcctgataactcacggggtcacgtcgcggtgttgccgcaattaggttaggctagtggcggcgctgcttgcatgagctgggcggctgggtcccggcctcccgggcatatcctgagtatttagcctacttggtactacgatttttatggctcgaccgtgcaatggatcaggaattaggatcgctcggtatggcatccgacgtaccaggacatgctattgctagaggaatgaattccttccctttgggttattaaaagcagtaagtcggcacatttattttataatcgtcactgtcactgtaactgtcgccgtcacacgcaaagatatttatgtaccatgagatttgagatggttatcttgtttttcttttgtactaatttttttcggggaggttatcatgttagtgatgatgcagagattatatcatgcaggttatagatatcaattcgataattttgtatagtacagttccgcagttccattttcccaattggatcatcgtgatgcagagcttcgagacctttgtttttgtaggattcaactgctcatccaagttgacgaactgaattctgaagaaaaggggaaaagttgatgaagaacgggtcgctgtcgttctccaacgcacttgccgaaatgccaaacggaaaaactaacatgagctgagtgcatatataggattttatggggcagctgcaaatggggaagtgaaactggttttcagttaagatgaacagtggataattaaagcagcgaattcaaacactggcactgtttactatttattgttaagaactccggtcagaaactatattgagcacaacgagaacgtacgattattatacttgaaataatttgccaatcttttcacttatacttatgtttgttagtcaaaatttgaattttcaaccttaaatttgaaggtgattttaggtttttctcatcgaagtttattttcagcctttgtttttagatcaccaagaacatgtatatataaatcttattcacaaattacttttcatttgtaatgtaaatatgacgtttggcttattccacgaataagtgaaacgatgaggctgaacatcaggtcttctctacaaaacaaataaggaaaaagtccgaattacctctgaactattggtgagttacccctcccccgacttaatccgaagtggtttggtcttacgtgacgcgtacgtggcattccaatcagaaaaaaaaacaatgggggccacatgtcatatcttccccatcctcaattgctctcttcactcgagtccgaatggcagaggcggtggcgacgagaaggctgctgctgtggaagcaataaaaggagagatggaggaggggagcataatagagctaggccggtggccatggctatcttcttctgttgtggcggtggcggtgctttcagtagggtgcggcgggtctcggttgtggtgacggtgacgatagcgacaagctcatgaggcggctgtggaggaggagcagcctccaccgctcgccgcccctgccacttgagctcctccgcctcgtcgtacgaaccgattgatggggaggaataagagagaaaggagggggggttgagagggagagaatctgccttgcgttgccatcctcggcatccagctgtgcctactacccccataatagatcaggcattggcgttggcgtgtcgccatcctcggcttcctatccaccgcccctgagctgcctccgtccccgcccccgcccgtcgccatccttgacttctcctccgccactcggtgatagagagagatgtgaggggagggaggagagagagaggattggggaaagagataagagactgataagtggggtccgccgattttttcaaaaaaaaaaggatgattgtactgccacgtatgcgtcatgtaggtccaaaaccactccggattgagtgtgtgtgtgttgggggagggggggtcgttaggtattaatagttgagggtgaaagatatctggttttcggctccgcctccggggataattcatactcattcaatagtttagggagttatttctgactttttccatcaaataatgtgtgacttaaccttttcctttttaaagactaccaaatttggtcaggatatctgtttaatacgaaagtcaatgtctcaatgcaaccaaattgtgcctcagacttgggcagttgggctgaacacatcaggatatgcaccaggaatatcttcatcagcatgtgaactaattctatggtgtagtttatttctagtttatttcctgaagaacctaaaaacctgtcagtacagatagtgacaatgtcgcttttgttgtatggcccatgaactttagcgcctccgtcgtagtgacaatgtaatttaatatttttaccgtgtaaagtgtggaagcgacaagtacgcaatcaactttgtaagcttctttctttacttaaaaagcgatgaggcaactatgaaaaatgaagtgctcgaaacagcagccaatgcacatctgatcaccctgcacaaactctgaaaatgtagtccctatccgattcctgctgggaagataaatatgcaaaaaggtcattgaaattttctccaagtcgtgggtgattttacgcagagattcagagaaccataattctgtaccccggagggtgaatcactcacatgctggtggatgcacctcataacggttaaaagactttgcttgtgtgcatcaaattgtttgctcgagatgtggagtgtggtgtatcactctccccaactggcaaaaacgatcgatgcatgcattatcatttgcagcagagagcatgtgaccaggtgaattgttttcagtattggctgttgagcaagtggttggaaccggcaggggctaaaagaaagaatatacttactctccgataaagcattgaacgcatgaggcgagtcgatccttcgcaccggtatagacaacgactcatctgtcgatccagaccgtcgattctttggcccgatagcctccccacgatgtgtggtcgctgatggaccacgacgtatgtatgtacaatctagaaatcggcagggtcctacactcctattggccagccaatgagccaattcgacgctgtactgcagagatatgtggccgccgaaaaagatcttttatttggcttcgacgcagccccacatcccatgctgcaatgcaaccacatctgcgcgtctcactcacctgtacaaaacgccaggggcgcatgcagaattgcagacgagaacggcagcatcaggcgcggctaatgttgggcgggagatgtcgctgctggatgaagtggtgcgcgcgttggcgccttctgggtgggacggtccagcccataggccattggactccacgacgatctcgcgcaaaagtttgcaaatcctacggggaaatcttacgaaatctcgacgtttcaaacggggccggagaggcggagattgaggaaggcgtagcggtcgtgcgagcgtaattgcctggccagagaaagaacgtggcgcatggcgtcgcgggaggcggaaaacgaattgcacggagcgacagcaaccggcgcagaaagcgtgcaagcaccttggacgatcggtagttgcagaagcatgtgacattacatgagctctttttttttctttttcgcgagaggggtttttgtccccgtttttttgtgtggccagcagaagaggtagtagaagttagaaccggatccctcgagggttctttttcaccggaggatgcgagtgaaagaggatctatcacggcgtcgtcacagctcggaattggatgcgctatcctggcgcaagtagccatcacgatttcacgatgatgaggagggcgcggttgagctcaggtggtgcgcaagccagccggcgatgcttagccttgtgctcttgttgcgtcagagacagcatcttgtcccggatttggttgtcagtcagggaccccccttgtcccagctaacaagtgagatcttcagcaaaaggatccagcaatttatgtgttagtgtcagtactttccatcgcaagctgggggacatgtttgttaatcacctgtagcagctgtcctttggtttcaagttgtacttgaaattcgagggcagttgtctgtggtacatatcccagaagtttcactcatcaggctgaaagcctgaattcagaaacaatggatacaaaagcccaagtttgctactaatgggctaagcattcatcttcttactggtcgagggccgagcaataaacaagaccatcagccttccagtttcacacatgaacagttgagcattctgcatctaaaagaacagttgatcacagaagcaaaacaggccggtctacgctattgcaatttactactccatacatacattgcggtcatcagcacacttgtatcaaaatccaatagggcgtttcaccattattgattgcttagaatacatcagttcattgctccggccagtactcaactcttggctatgaacaatctaatgtctaggtaattgaacagatacttttccgatcaacgattttgagtttttgacgccttgtccctctaccaccgatccaaagtgatgaactgaacaaatttgagttcatcacttaagtacggggattacatatgagccggctgcagatatgatctctcatagaggcccatcacctgatcagccaccgcccacattatagcctgaccaggtggaatcctcataagcctcggaagcaaacctttccaaagggctctgagaccctcttcagtgtatattgtgcgtatcgcgtggaccatacccttgtacttgatgtcaccagttctcccctgggccatcagtctagtcttcacgacatcgaagggtccagtgcagatcggacctgcagttcctgcaagaaaacctgaaatcattgactgccatggctggagaaccttcccatctccttcatgcttcttccagagaacaatatcaaatgtattcttggcagtgaacattgcggcttggtttgtgccattacgcatgacggttggtaatgctccagcccacaggccaaaaagaccctcctcagtaacaatcgtcctagcacaatgtattggccccttatatctcagcaggtcagggcttagacctttttgttgctgcaacctgattttaaccacctatacccaccacaaagaaacatgacaccggtcattccagagaactgaacctttaaagaaatgctggtaaaaaagtataaactgacttccaccataaacattataataaaatgcatcaatgacgaacttgggacaaattgaaaacacactattcgctatgattaacttatttaacttcatagaacatggagttgcataaaaacaaagtgcttagaatgactcaagttttcagatcgcaccaatctaatatagggagaaattccttctattaggttttcaacagtatgaaaatatagaatttccaaaaccagagaagaataaccatctggtgttcacgctaacttttggtttgttcgttgtacttcaatttaatttctatctttgttagcttctaaaatatgtagttgaccatcccaagaaaacaatcagatgaatatcatggtacaccaaccgtttctgttaagagagccaaggagaacaaagatagactgacggccagtacacttaaaattcatatcgtactgatattgcctccacatcagaacatgtcatttccttttcttaagatcttcttgtcttttgctttgtaggtactaatactatatgttgatttccaataaacatgagttacacgatagcgatgagtgcttagatgataaaaatgaaagacgagtcattttctatagagatgaacagaagtgtaaatttaacaagattatgcttttaaaaaagaagcatacttcgaagtgcacgcaggcctttcgcatgtttggtctttttaaagcagtgggcgatttgtggtaacttcttggtcaaatactatgtttcaaagcatgaggtctttgacagagttctgatgggctaccacatccttggtaattggtttgggcatgataattatgatttgactgcaaagtgcaaagccaccatttctttaatcccagctcaaagttggcaataacacatctaaacatcattcacagacaagattaaataactggtccacccatgttcctccgttccttttctatatctaaagtagtgaatttgtacttttacatcggtgtcctatatggcagctctcgcgagttcttattccggcaagaagcacctagagatgttcctttgtaaatataatttattcgcgctggagcagtgaacacatttttattcaaattctataaactatgtcgcagtcgcagagaaaccaagaattcaagaacgattcaagatctcgcagatactccaggtaagtaaaaaaggaacagatgcaggggtgatcttgcctcgaagggggtgacgatgaggagggcctcgaggacgccggcgccgaacccggaggcgaggcggccgtgcgcggagaccttgcccgtgccggggtccttgaacgcggactgcagcacggcgttggagccgaggcggagcgcgtacttgagcgtgaggtgggtggcgaagggcgtgagccccttccagagcgcgcgcacgccctcggagcgcacgacggtggtgccgcagtgcgcgatgccccggtacgcccccgagcggtctagctgcagccgcgtcttgatgacgtcgatcggctgcaggcagcacgcctccatcacgccgccgaccgaccccgccgccgccttcacgtagggggggaccggtgccctcccgccccgccgatcctccgccggcgaagcggcctgcggtgccggcgacatcggcggcggcggcggggaagaggagggggacgcggcggcggcggccatttcggaagaagcggcggcggccttagcgggtgtggcgcacgaagcgggttttggatttgtttccgtgggttgctttccccgctgctgaatccgagaaaagtgtggtgcacgggcgctgcttatgtaggaatcgatccgagggcgcacgcttctcgcgcggccgtcgcgtcgcggctcggtccagaagaccagggcccacatggggccaacctggtccagcaggccgggtcccacacggcagtgagtgtaacttattactactggggtacacgggcacgttacgtggcggagagagattcccgggaaggtgggggccgcttagccgatctgctggtcccacttgcaagtggttgtactaccagacggcggccagttttcaggagcggcgcgctacctacccaccacaagcgtcccctcccacttctcattccttttgttcgcgaaagaaatactcccaccgctcccattccaagtgtagacatggttttcttcatccaattttaattgttcgtaatatttgaaaatatttttaaaaaattaaaaacataaaacacgaataaaatactatttatgttttatcatctcataacaacaaaaatactaattataaaaaaaattgcgaataagacggaaaatcaatgttgagcgcggaaacttatggttgcacttaaaatgggacggagggagtaagtctaggccgaatctgattcattataggatatatcgatcacatgactatttaaatccgatataatttgactccctcaaaagttttaaggacggttgtactgacgtgacgtctatattgtggtattgacctgatcttcgtccaacgtggccgttaatgtgatatttttatagcattagaattataaaatatatatgggtcccatttatcattcacacaaaaaaaatattatgggacgcactgacatatagagtccataatcatactctccttcccttcttcctcctctctctccttcccatagaggcatagagctgaagctgtgcaacggcggcaaagggtggaatggtgacggcgagcagcaaaggctcttcttgtcactcccacagagcagagcggtggattcaagccgtgttgctatgagaagagctgtagaccgtggctggtggtggtggccacgggcgagagcttggcgacgctgcctctccacctcccttctccacccccgatgatagcctcgaatggaggcgatgcttcaacaggcagcagcggaggtataggagtagctcgatgagctcggcggcggccgacgagcaagagcttgacggcgttgcgactggccctcgcccaaccaccactggcactctcgtctccgatctccttggtcacagccaccgtcaccaaccacaggacatgccaccatcgctccaaccctcacccgccaccaccgctactccgcccctttccactgttgctgctgctctagctctccccacagatgcgcgaagagggagagaaagagaaagagggaagtgagggagagaaagagaaagaggaagtgagagggaggaggaagaaggaaaggtgatgatgatcgtggacccaacatgtcagtggatcccataatattatatatatatatatatatatatatatatatatattaattctaatgttataaacgtcacgttggacgaaaactaggtcaacaccgttacgtaggcggcacgttagcgaaactatcctctaaaaccacagagggagtcaaatcataccggttctaatggttggggatcgagatatatgttatcgttcttcagggatacgaatcatattcgcccactagttaagggagacaaagtggacttattcctcgcgaaaatgcccttgggctgaattgtgaagttggattccatttcggtccattttttatgttgcgaaataaatatgttttttacactcaaaagacttaaaaaaaatccactgtttgaaataagccctcaaattcttactccccggtaccaaaatataacaatctataacattcaaattttatcttaaaaataacaatttattcatctatattccttcttcttagccaaatacaaccttccactttttaatttcttcacctacccctctactcaaccaatgacaatatttttatatttagtttcacatgctcatttctttccaaaatataataatttctatgattcaaatcatgttacttttctcattaattatttcccattcaaaattcatctcatcctactctcacctacccttacacgtctattgagggacaccaaagtcatttcttctaaactataatatctgctaaacaacctataaatgtttatattttagaatgaatgagtattttctttgatatttgtgtcaaatctgaaaacttatgtttttgacaaatggagtactacgaggtattatatttttacagggtggtatattttaaattagttggaatatggttcatattcaaaattttgaagtacattatactgcaataatcattttcaaatctctattttgagtgttgaaatcctgggaacgaagcccagtatatatcaaggcagaaaattaaagtgatagagaaaaaaaaagaactacataacaaaagcaattaaaccctttgtcccataaaaaaaattctaaagataaacccatacaaacgcttgtccatattcattcttagaagttgtctgtttttgggacagagggagtacatagcatactcttcctatatatagtccttcatgtggtaatccaaacaagcagtaggaaagtagagagagacataagcaccggtagggaagaccgcaattctaatacagtaaagaactgtatctaatagcccagttcgaatttggaggaaaattcctgggttctgaatctagagtggtccaagctcttgaattttcactttacgctagttatttttaccttggttatactctggaacaccctaacatttttgtctaaccacattcaacctctcttctggtaaaactctaaagatcttcaatttttgatcctgcattgaattggagttctgcaaacttaacaattctttttttaggagaaccaaacataataattctacatgcactgaagttacatgcctgcaatcctttcaggatgagggatgagctacgatttttttttattgagtaagcaccatgtctatggtgtgaccatgcgacagcctggggcatcatacctgttatttcgtgtgagagaaggtattaagccgtgtttagttccaaaataattattcaaacttccaatttttccatcacatcaaaactttcctactcacataaactttcaacttttccatcacatcgttccaatttcaatcaaacttttaattttggtgtgaactaaacacagccttatgcaaagctttggagatcagtttcttcacgaagaaccattttcacgaaaacatatgacgtgcaaggctttggagatcagccaaatttgtatgaaaagttttgaaaaaggtgtgtgacatatttacgaaggcattggttcttcacattttctaaaactagctgaacaatctgatttcagagggttgggattgagaaagagacaccgttgagatatcagatcttagttcaggttcagaagatcagctttgtgtattcagttcagacttcagagcttcaccaactgcgtttcctgcgagttccaatttcttctctccccagtccctttaccacttgaatgtccgataagaaactttggtcaaagtagacgaagctcgacacgttaatgacagaaacacgcatcgccgttttaatctccttttcacacaatcacacgggactaagttcacagcagaagcatgtgtttacagctactaatggcctccacgaacatttaacttgaaaagaaaaataacttgactgaaagttttcggtccgagcacacatggccatgtgcgaatcaaaattttagaaaaagaaagaaagagagaaataaacgaatcatagtcatataaaacattctttcgaaatgacgcatgccgattgacttgcaaactaaaagcggcactaataattggcacaagctagtaattgctttgtcgataatattttcagacaaagaatcgtttactcgatatatacaaatccatcgcattcaacgcggattggctgttttcttgtgttgataattgaacgcgcatttcatttggaagcagaaacaattctgggtgttgcttagcccggtggatcatggggggaagtcgcggccgttgccgtttcagtcattgcttccataatttgatttctcgtctcgcgtccaaatgcatcgcctcgtcgaaacagaaaactggttcggttaatcagtgccaatcatgtgcacacggcctgccgggtgcaacacgcctgaagattcagtctccggagcagaacagacggtagtagctgtacgtaaacgtcatactacctggtcttttcaaaattgtcattatgtttgggggctgtttagttccccaaaaacttttctcaaaaacatcacatcgaatctttagacatatatacggagcattaaatataaataaaaagaaagactaattacacaatttgcatgtaaatcgcgagacgaattatttgagcctagttagtccatgattagtcataagtgttacagtaacccacgtatgctaatgacggattaattaggctcaacagattcgtctcgcggtttacaggcgagttatgaaattagttttttcattcgtgtccgaaaactccttccgacatccagtcaaacgtccgatgtgacacccaaaaatttttatttcaccaactaaacaggccttgaaggtttcaaaaggagatgatattatcatcattcgatccactctacaacgtactaagtgcaattgtcctagcggaagattctgctacggttgggaaatggctcattttcccctatggatataagtgcaaactttttttttagataatgataagtgcaaatacattatggatcaaatgctctcaacatcttgttccttgtgatccatatacttcagtacattagcatgtgaagaatacactcgtgcaatgaccgaggaaaggttagatagttttcaatttcctttatgaattgaattatttccagttgatgctatgtgcattctaagtacagttctatcaccttaatgtacttaattgattaagtttaataaaaggctaaaagcttcccattatctttaaaaaaaattcttatagaacttgtgtgatctcagcgaagctaaagcttgcaaaatcaaatgtagattcctaatctgatattaagttcaaacttcttgaataacaaaagtggtctagcaaagcttagggtgtgtttggttgggctgtggcttttaaaaagtagctgtgggttgtagcttttcgaaaagcagatgtgaaatatgggttgtggcctttggaaaagctcgtttggttcaacagctgtgggcgtttgaaacaactagtcccgcttacaagtgggccccatatgtcacacacatattggatcttcttcctctcaccatcatgggatgcccgagcttgctggagctgctcggtcgttgcgatgcgccggccaaagcgcttgcgacgggcggaggggcggcgatgccccaaccctatggcaaagcagcgcgtgaggaacgacacattgagaagcgacggggaagaaaagaacgaaccggtatcaacatcataaccaatatcaggtgggtaaaaacttaacccaaaaacagctaaaagcagggggtggaggtgctttcaatttgtactagagcaaaagcagcttttgggtagaagcagctatggcttttgagccctttggttgcttttggcttttgcaaaaacaaaagcaagttcaaaatcccaaccaaagacacccttagttcaatgttcattcagtcaccatcagagagcactgagcaagtatgccaatcatctcaaactattcttttatgctcagagatgatgtagattccatggcgaagtaaaaaaaaaaaaaaacccttagggtatatagtatgaggtcgtatgcgaagtaatttccatactatgctttgcatttaagcttagctaggggtgtttgttcagattggagcagccttggcaaaatataaacaaagtaatcataaataatttatcggtaaaatatttatatttgtattgtttgcagtaaaatgtttatctatgtattatgtttgcggtttaaagactcaaattttgcctacaggctttcagccaacccaacaagcaacacaacacacccatactgggccaagaaatagaaacatcttaacaaagctagtgcgactcagataaatattaaaggatatcttaagctgctgtgtattgaatcaattaaaatctcagagaaactatccataccaactaaccatgtacagaggcaaatagtagccttacagtatgaggtgagtagtaactcgccttattacattagaatcaaagaatgaattgaatcagtttacagaaagaatggtgctatgaataaaaagaattgaatgttggaaccccagcaaaatagtgcaagctcctaaaattttgcttgccaagtgacatactatctgaataccctcctcttccacacttctttaccaccgctctgttagtgcgctaagctggagcgagttcagtctcccttcaacaagttaaaattatgctatctgaataccctgctcttccacacattttaccaccgctgtgctaataagctggagtgtgagttcagtctctccctccaacgacaagttaaaattatcttgagaattgctgcagctgtatgatcacaatgctgatatcgtcagtcgagcccctagtaaccgcagtttcgacgagcctcctgcaagcagtcatgcgagaagctttgtcgttgctgatgtaaagcggcctggcaatgtcaactgcctcctggttctccaccttgtcccacaaaccatcagaggcaagaatcaagaattcgcactgcgaatcaacacccagagttgtggtgtctggatcagacaccacccactgcttgaggtgtgcatcaccgatgcctcttgacactgctaaggatccctgaactcgccatgttcctcggtaattcaccacgaatccaccctgaaattgacagaagaaaagcacataagtcttcaactcatgatagctcagaactcagattaaaacactctgcaacaagccaacatcatcaaaggtctacttagctagtgcaggaaatgatgcaagaaagcgagaatggcaagtgcaggcaccacttaccagattctcaattctttccctctcatcctcgcgcgaggcccggtgatcagaggtgagcgcctctgccttcccggcgcggctgagcacggcacggcaatctccggcattagacacaacgaggccacctttctgcagcaaagcggtgacgcagcaggcgcccccgctctcctccctcttgaggaattcctcgtccgtcttcaggtagcaccgcttcactgcctgttcagtctcgccactgtcgccgccgtccaccttgcacatctcctcggccatgaacttgggcatgttctcggcgacgaactccgccgcgctcttcccgccgtggccatcgaatacaccaaaaaaggcctacacaatcgaaaataaattccagaaattttagtacagaagaagaaatctacgaagtctccccaaaaccctctcctgatcgaagagaagtgtgaacttattttacgcgaatcgaacggagaagtcgtgtggagcttaccactttggggtctccgccgagggcgaccttggccacatgccggtcctccatctccacccttctcctcccctttcccctccggcagtacaccgcgaactcctcgccgtcctcctccacctcgttcctcggatccgattccaccgcggccaccgccgcggcggcggcggcagcggccgccccgccgcacaccggaaccacgagaggggccgggcgccgccttttaagcacggaccccgcaggggcggagaccgccgcagccgcggcggccgacggctggggcgacggcgtggcctcctcgcgcaggtgggcgcgcagcgcgaaggggcggagcggcgacccggcggggggcgcggcctgcgccggcgaggacgcggcgacggatacggactccggcgaggcggacgcggacgcggccttgcaggagagcgggcggcgcgacggcgagaacaccggcgagctcgggatggcgaccgtgcaggacatcgcgactcgcgagggctctatctctctctcggagacgcggtcttcttcctcctcgccgctcgcgtgttccgcttttcctcgggttgtgtttctgttttggatgggtttggcgaattgcccgttggaacgggcgttatatatggggagggtcaaggacgcgtgcggtggggaaacggaccgataagcacgaagacttcactgccactagaaagaaatgggagaagaatagatgcttcggttttactgaaatgttctgttgcaaggtgtaaaacttttgtttaccaacaagaaattacaaatacctacagtagctttgcatagaaaatgcacagttactccattcagaaagtttttttaatatcattcagaaagtctggtctaaccagaaaattcgttggtaatttgtaaatatttttcaataatatcttcagtgctagtagaaaacatcatgtatgttagttttatttaaagaaagaaaaataagcacagatttctattaattgttgcattaatattcatgtagaataatttaaatttacatgctgtcaatacatttagccaatctgtcttaaggaaacgattacgttcatttcgatctttaaactggagacagtgaaagctaaataaagtgactaacttgcccagctatcatatcactataccagaaatacgttaatggagtagtactagtagtaaacaacaagaaggaagatgcgtgttagcgaggtaatttccgacgataaaacggataagtccaaacacggacggccacggaatagattactagtactacgtcggtcgctgcggcggattaacggaggagtgagcgcgcgggggagtcaaagatacgttaatcccgtgtgatgtgagaaaccaagagagaagcttgtgactcgcgaggacgcggtcagtggtaatttaacttttgttttgccgctccattattcaagcccccgaattaattgattggcagcgaccgtcccgtcgcgatcccgtcctcgcgggcacaacaccagacaccggatggatgcaccgggcgaagggggccgcgtggcgtggggagtctcccggtttgggcggcggttgcgtgtgtcgtggtcgtggtgctgcggccggagaagggagatcgccattcgcgaagctgcctcgaagctacaggcgttatacgagtagtagtttacacggtctagacctgttgggatttggatgcgtcgtcgacggttggggttggggaggagacgctgactgtgcctctgcaccgcagttggacctgacacggtggggacgggacgaacacttctccggggccccatgtcagtgactcgcgtgcatgtgctggcctgctgggtgagagcgagagtgtgaaaagagggaggcaatcccgacaaaaagacgggagccgggagaaaatgtagccgttggcaattgccacgctatggggtgcggcggaaaaaatgcgggacttcctccatcaaacgggttcaggctgtccgctgtcagtgcagtgagctcacgcagtgtggggtgctgagatgggtcatgggtgggtgtgtgtggactgtggaaaggtggcacgttccgttggcttggcttggcctggcctgggctggcgtgacgtgtggtccgagtcggagtgcacgcgcggctttggtcgggtccggaatgccaggtcagggtggcgcgtttacagtttcgacccatggcgacggcccgggacggtgctgactgctgagcagttcagagttcagacggtgcacgcatcctctgaagaaacaaaattacaggtacctttcttgagacacaacatacgttccagcagcacgttccatttagcatcctgaaggacgatttggccaaagtagtaaggcctggtttagttctcaattttttttcctaaaaacatcacatcgaatcttttgacacatgtatgaagcattaaatatagataaaaataaaaattaattatacagtttgcataaaaatcacgaaacgaatattttgagcctaattaatccctgattaaccataagtgttacagtaacccatgtataggggtggataacgagccagctcggctcgtttgagctcgttgtcttaacgagccagctcagctcagctcgttaatgttaacgagctaaaaagctaacttggctcggctcgcgagatggcttgttaagctcgttaggctcgttaacgagctatatctcattaatatcatattaataaattcaaatttaacattttattatgtattaacataataataaacactaactaatataatactcactgaatatgaataattttgatataattaaaagactaagcactagtcaagaaactccttaagttcgtgaagatatggtgatattttatactaacgagctaaacgagtagctcacgacctaaaaggttagctcgactcaactaattaagactacgacttcgaatcgatctgagccgagcttgctacgagccgatccaagccacgagtttcaagctttttatccacccctacccacatgtgctaatgacggcttaattaggctcaaaagattcgtctcgcggttttcggtcgagttatgaaattagttttttcattcgtgtccgaaaacccctttcgatatccagtcaaacatccgatgtgacatccaaaaattttctttacgcgaactaagggggtgtttggatccagggactaaactttagtccctgtcacatcggatgtttggacactaatttagagtattaaatatagactatttacaaaaccaattgcataagtgagcactaatttgcgagataaatttttaaagcctaattaatccataattagataatgtttaatgtagcatcgcataggctaatcatggattaattatgcttaagagattcgtctcacgaattagtccagggtttaatacctgtaaatagtatcaaaacatctgatgtgacagggattaaaaagttttagcctcatccaaagagggcctaatgcaacacaataatcaatatatcatgtttaaatactaatggtttaatttaagtgataatgattttcttgttttacatagccgtatttaatattttatcttcaatgaatttaaacggccttagcagcacatctctgacaatggcagatctaccgttggaggcttgtgcaagccccacctccaattgctactccctccatcctactccctccattccatattataaggcacaactattttttttgatgttccataatataaggcatacatatatgtctgtaattaactatgacatcttcttcattaaattactacttttttaaatcattcactctcacattctctaattctattggatgcatccattatatttattaggatgatttaaactacaagatgataataattatttcttggtctttgggttaagggtggttgtgccttatattttggaattgagggagtataatatagcaacttactccctccgtccaaaaaaaagacaaaccctagtttccgtgtccaacgtttgaccgtccgtcttatttaaaaaaattatgaaaaaaattaaaaagacaagtcagacataaaatattaatcatgttttatcatctaacaacaataaaaatacaaattatgaaaaaaatttatataagatggacagtcaaagttggacacggaaacgtagaatttgccttttttaggacggagggagtaggagtgaacgagacatttcataggatgagtaataatgagtgtaaagttgagatcccatgtcatttgttgaggggtgaccctctctagcgggaggctgtgaggcctccctttgagagttcggccgggggcagcgggtgagattcgaagatttggtgagcaaagctgtgtgatcttgagggggttcaatcctccaaaaacgatgagacaaaagaggtttatacaggttcgggccgctaagtagcgtaataccctactcctgtgcttagaaagtccctgaatccctggtatgcaagctagggttagacaagctttggctcagggatcctcagtccgatcccccctcctcgctaagcatggtcctccttttatactctaaggggatactacatgtgctgcgagtgctacctagggagaagggaaaatattctctatattaattacatgtcttgtgccttagcccagaagctatctgcacgtcggttgctgcgcggggcccatcaaatcatgcagggcgcccttgtcattcgccatttaatggatgaggacttcggggttctcgttcacaccaaaaaacgggaacctgggttagtttagaggggttggaccagctctgaccggggtaagaggctgtgaagcccctcatcattatgatgggacgggacggagcacgccgctcgtcgcctgacacactgatagggcgggggtatatagtcgccgtcccatcggtcattcaaccggtcacagaccggtcagatgcgcagcacgccgcattaaatgtggcatggcacggttgcatagaccgctttaaatgcagttaggtgggcgttaggcgcgcccacctaaccctgtacacgtgggctgatacgtggagggggtcggggcagctcgactccaagcgagggcagcctcctccctctagcttggaaggggcagccgccgcgccaccccgggctcgacccctcttggggggagccacgtgggtttgggggcggcccaaccccaagctgggagggggcagccgccgcaacaccccgggctcgacccccctcggggagagccacgtgagtttgagggcgacctcctccctctagctgggagggggtagccgccgcgccaccctgggctcgaccccccctcggggggagccacgtgggtttgggggcagcccgaccccaagctgggagggggcagccgccgcaacaccccgggctcaacccccctcggggagagccacgtgggtttgagggcgtcctcctccctctagctgggagagggtagccaccgctccaccccaggcttgatcccccctcgcggggagccacgtgggttggggggctgcccgaccccaagctgggagggggcagccgccacaacaccccgggcttgacccccctcagggagagccacgtgggtttaagggcggcctcctccctctagacgtgatactcccgggctcatatcaccgacatcgtttattgaaatgctcagtacctaaaacttagaaaaatgtaatgcaccatgtatagaccattccaatttacccatagattttttaagaaatgtgttaatatagctacaaattgaaccggagatcgatatgttttcctttatcatatgtgtatttgggtttcattggaaaaaaacaagttgctatatctctaggccgtgtttagttcctttttatttttttaatgtatacggacacacatttaaagtattaaatgtagactaataataaaacaaattacagattccgcctgtaaactgtgagacgaatctattaaacctaattaatctgtcattagcaaatgtttactatagcaccacattgtcaaatcatggcgcaattaggctcgaaagaatcgtctcgcaatttacatgcaaactgtgcaattggttttttcgtccatattaatacttcatatatgtgtccaaacatttgatgtgacggaaaagttagaagtttaaagggaactaaatatagccctagttcgttttagctccccttaatttatatcatggattggtccagtaacatgtatagccctggcagttggtggttggccagttccgttgcgtggatctcgttcgttcttgtgccacatttggaattttggattttaagcttggttcggttgcacttttgaatgcaaattgaaacgggacctttccgattaataataagtccgttgcgcaattcaattcggagaaccaaacgggccaggtcctaaccttggtccaagtttcttactacttgaattttattgcacgctgacgaagtttttataggtttacatttaggagtactagggtgtgtttagttccacgttaaaattgaaagtttgactgaaatttaaagtttgaagaaaaaagtcggaagtttatgtgtataggaaagttttgatgtgatggaaaagttgaaacttccgatttttttttcaaactttcaatttaagtcaaactttcataatattttagtgtggaactaaacacagccttagtatcccgaatattagtctgttcaaaagctgcatcagtagtcagtacgatcaacaataattcaatatgttcaacaatgcgattcttcttggatcagcacgtccaaatctcaaaaagcttatttatccaaagaaagataatttcaaaagcttcattcacaatgtctggaatggattggcgaccacattaaacctctccagtgctgaccaaattccgcccacataaatccgagcgatgacgccatggctctcgaagctggagtagtccttggttcatttaaaactttaaatgcacagcaacgaaccgttatgcaaacgaggttgaccgctagcttagctaacgtaaccacgtctaaaaacaaaactcccaacggtcgccgaagcatatgcgcgcacgtgccgcaacccgcagctgccacgtcaagcccaacacctgcgtggtacacatgcgtccagctccgctcgtaatcaacggtcaagactcgcaaatcctcgcttcttctccccaacgcaactcggtggacgacgtaattctggcgatcgcgggtggcggttgcgcgcgtactacgcgcggcggtgccgtcgtctcgcgtcttctctggacgactcgcgcgagcatcgcgtggtccgcgcgcgtgccatgtgcgcaccgccgcggccgctagctctggcgtcaccgcgcggtcgaacgaattgcacgggatggacagcctggactaccgctggagcgaggaattcagctgatcggtgcatagatgctcgacgcgtgtctgtcgtcaagccggggatgcgcgacacgtacgtacgggtgccatggctgggcggtttgacttgctcgcctctgctagctcctacaaatgtgtccgctctgtactcgtgcacgaaattaactatatagttcctgtttgcgctgacttggaccagtgattgcttttttttagataatggaccagtgattgctaatgtcttgttttaattagtcttgttctttgacagccagtcaagctccgtgatccattgcatcatgggagtcatggctggacaagtagctgctaccgatatcgccttttaagttgacgacgagaccgtgtgcgtttcggggtaggcagctcttgcttttgcgtccgtgtgtgtttagggtaaaggattgcagggaaagaaacgtggatccgatcaacctccgagccgctgttcggccacgtgttaaacaggccgatatggccactgttttctgtaaacgggccttcagccacagcccacagagataggccgaccaggtctaaacttatgagatcaggttgcgaaaatgcttaggatcagacgttagacgcaaccaacaaaaattggacgcctctcactgtggctttgctgcatgcagcctcgtatccttttgtcagatactctcttttcacacctgttagatatgctcacttacttagtattggcatgcatgaagaagagaggacacgagattatttgcatgtacataacacccttttagcaaacttgaaaatgatttttcttccagactactcatccaatctacgatctgtttacaccattgtattcgttacaattaaatctttacaacaagatctcacatgactatattataataaaaaacacacatatgtttcaaccaattaaatttaatgtttcacatgtgagaatcagatgtttcaactaaaattctattatgttgcacatatttaattattgtcgtaatgtatatatctttctttaatgtatcacatggtgctatttgtatgtttcagtaagtagtttattatgtttcactagtattttgtaaatgttgcatatgtgttgattgagtgtttcgataagtattcattagttaattaaaaatgttgtatacaatatcattcatatgtttcagcaaatattatatgatgtttcaatagttaataccttgtgattaaattataaaaataatcatgtgagatcttgttgtaaatatttaattgtaattatcggtgttgcacttagtatttcttgaatgttgcatttctctgaaatatttttatagactgagttggaatatttgagcaagatttttatgtctcactcattgagagccaatgttttataccgatattatcggtgttgcatttagtattacttgaatgttgcatttctctgaaacattttttagagtgagttggaacattttgactagcggtgaaacattttttttataagtggtgaaacaacgttcgatttttctcattaaaatataaccgtgtgatatcttgttgtgaagatttaattgcatggagtttaatggtgaaatcgaatcataaatcggataattaatttagaaggaaatttaatttaaagaaataaaaagtagggttgagataagtgttgaaccatgcagtcatgcatgcgcaagcatatatactttttacatgtgctaatcaactagagtagacggtagagattgtgcatgcatgtgtaggcgcgcggcagtgaaaggtcaggcgtccgatatttacgaactattggacgtccgacgcgtagcatcctccatcaggttaattacgctacaccagcagagtttgactgtcaccctcaccatccaccagctcctccattagttttcctctactgagcctgaacttcaagcattgcctgcagaccttatgcagtatcataggcttgccttgcagttgctgtgtctgaatattgtcactttgtcagtgataagccgtatcatactccgtatagttataacttagtacaatccaacgtactaaaaggtaaaacgaattcattatgcgcgtgatccaatcatccaaacatacggtgcagctgctttgctgccgaagttttatgagcacagcggcacaggcagcaagctgcacatccatatggacagatccttgggctcccggcctgtaccgatctgaattgaggggacaccggactgggcccaaaggggccgcgcagagggcagccactacaacggcagcctgcaggctttattacggcacatcggctttgtacttgggaatcactggaagcctggtaggcgacaagcgcaaagattcagagatgcaagagggcgtggaggggtcctgtcctccactcgagagtgtaacatcagttagatgcatctttgttacatttcagatcgcagctctctggaaagagtgtgcgctttttttttttgtcattcatgtggcctctcttacgagtgaaattgaattttggttacggaattgctaaccatatgttgacagaaaaatctatctctaaatcttgcagattttatgtgcttcgcaattcgtgctccagctgcttcttctccaactcctatgcccctgtcagtgacaacccaaactctggcggagggccaatgaattaggctcttggggtggggtgaggtgggatgggagggggagggggagggg

SEQ ID NO: 2602 - DNA, 8793 bp, Oryza sativa
attccattgccaatctcttttctgaacattcgtgcatagtagtagttccggaacagtaggtggagtgaagtgatcactcagtgtaataaaatgaaaaggagaaacttaggaatcatcataattgaagaacggatgcacctcgtggcctttatacctctcttgagcatcaatgtactagaatggtgtaatacacaaaaattctttacatgtaaccctccctttttctttccccccttacatctcacatcacaccctttttttgctttctcctatccatgcatcctttatcagcaggacaagaaatgagctatagtcaacacagcccgcccacagatcctccttcaccatcctaaaccctccatttcttttttaacaaaagaatcacatgttaaacacagcacaagacagctttacgcaaccccagagaaagaaagaaaaatggtgaaaaaaagagaagaaaaaaaagtaacccaaagtaagaaaaagtgaggtggccgcggccgggcggcgggcatcgatggtgtgtcaacggtgttcttggctccttttcttgtctcgcagaacacttggaagctagccttatttggctctttttctactggtcggatgaccatggggcggaggcgatgcgggcgtagaggaactggttccaggtgtcggggaggcccgggaggcaccagtggatgcagtcggcgtacgtcttggggtcggactgctgctcgggggtgagcagcttcccctgccggagcgtgtgcaccgacgtgtgcgcatccttgcggagctccgacagcgccgtgatgtcgacgaggtgcaccggcacccggcggaacgtctggagcacctcctgcgccccggcgtacagcctccagtccgtgcccacgtccagcgacgtcgtccggttcgtgatcggcagcgtctccatcgcgcacttgatccctccgtagtttccccacgcctccggcctgccacaaaacgcgcacacgacacaagattataccaccatccgtccgtcaccacgtgatgccgtgatgggtagaattctgatgcagtactatggttaatgttccagcgaattggagccgtggtaccctagattctgtcgtgctgatgataccctgatgatgatggcactcgcatattggcgccattatcacagcatatgcacggaccgtgtaatttatgcggatactagctcgagattcttgcagggaccaaaactgatttaacttttgcttgtcgactactgcaagaatctctctgttttgagtattttgcaacagcaaagatgcaatggcaaaggctgatcatcattgtggagcacgattagtaggcttgattgctatcagtattatactactgtcttttgttgctaccttcaacttgatgtcgtttctctttcgtggggttagggctcgaggaaggaaagtgacatggagctcggggaattggattcgtatgcttcatctttggtagcgactagggtgggccatgtcgagatgcatgcctacaggtgggcctgggattttctatggtccaccaacatcagcttgtcaccgtagctcgcctctctccagctatccacatgactagttttgagcttactactctacacaaatacatactcaatttgaattattcttggttcaacaaacctcagttgtttctacacccacgtcaactagcatgttttgaagacatctcactaattaattaagctttttatagtattggctaaagaagcttagataccagtgttgaaaccgtgaaaaatgcaaatcttgaaccagtcagaacagattgtccggaccatgtcctgacgaagtacagtgacgcgttgtacgcaggtaccgtgccccacgatgccatttcacgagagacagctaccgatgagtagtacagtgctctatgatgggataccatgtgcagttgtattccgataccatgctactagtagctagttaatgtataagaggcttctcctactaatgtttctccgaaagctcaagagtcccctcaggctctcaccacctaattaaattacttgtagataaatattagtccagaaagcaagtgtgcctgctagataagtttcgtccatgcaaacgcaacacagttgctaggtacacctctagcacataattttgttttctgaacataccccaacacctaatcggaatggagttctctatgtaccatcactgtgcagcatatcttcctattgattggtagattaactccgagcgaactgtactgcgcgtgggcacgtgtgcactgtgcagcgaagtaaatcatggagaggggcaatgcaatgcagatgcaggcaaaggcataaatggcggcttacgtgatgtggttgggagacatgctcatgaagaagacggtcgtccggttggggtcaatgttgcggtcgacccacttcgcccacgtcttgagcacctccttgtacgccacgggccggtccacctccacgtactccgtcgcaccctggtcgaacgaccccttcctgtcacgtacaaccacacacatattttttcgcccagatcagcacacccacttctatatcactatatgtatgtgtgtacgctgctggggtgctaggagtacaacttacaggactttcatgtcgagggtgttgagccaccagatgtaggtgttgaagatgaggtagtcgacgccgagccagttgtgcgcgtgcttggcgatggagtgccactggatgacgcggtcggggacgctgtgcacctgcgggttgtccgagttcgactccaccaggaacggcgcccagtagaactccaccgtcgcgttgtactcctgcacgtagcacatacaccgtatcgtcagggggagatcatgtcggatcgacagcggagtacgtacgtgacgttgctgatgcctgctacgtacgtgtgcgtagaagatgttgctgttgccgccgttgacgaacttggtgagcgtcttcttgcccttggggatcacggactggaccaggcacaccatcgactcccactggttgcggttcagcgaatcccccacgaacatcagccgcttgttgcgcagccgctccagcagcagcctcgcgtcgaacctgcagtttttttttccccacaccacatcagctttcgttagacttttcctgcgttatttagcaaccagcgttgttggatcgccaactatatttgccactatcatcagactgtgccgagacacagatacagagcaagttgtagtagtatattctactcgcgtcactcacccactgtgtgactgactgggcgtcgctgcgtgcagctgttccccggttggaaaagagaataatttggcgtgcctgtgtttgatttaagtagtggctgcttcaacagcagccagatgctgagtgattagattaagcaaagcttaatccaacagggggtagcgcggctgcacagtacagtccgacgtcacagctcactaccagagtggtgtactggtgtggcatggtggtactactactctctgttccgtttcaaaaatctcgaacgttctattttaatttccctgacacgttcgtcttaattgtggcccgtaagtattcctacggttatttctgacttagcgtttcgaggtgaccgaccgatgctgatgaaaaaagaaaaagaaaagggtagaaaccggcatcaatttgggaaaccgacgatgatcgccggcgtgagtcaatgccggttacccggaatgcgtgaaacggcacgaaatgggcaagaaatggcgtgaaaaaattgtgggggaagaaatggcgtaccggggcaggtcgcagtcggtcggctgccagcgccacttctggtaggagtcgtcgcggcggccgttgcgcatgcaggtgacctgctccgtcaggaactcgcactgcgactccttgtacaccggcgcgttcacctcgtcgtacacccagttgccgcggtacaggtcgcaggtgtccggcacgctcaccacggtccgcagcgccgccgtcgccgcggcggccttcgccgaggactccttctcggcggcctcctcgtcctcccgccgcctcgcctcgtcggcgccgccttccttgacactcgggagcgtcacgtcccgctccctctcctgcccctcgtccaccttgacaccggcgtcggcggcgttggcgttggcgttggcattggccttggccacctcaatcgtgctgttgttgctgctgctgccggcggcggccgccatcgccgtggaggcgggcgcgtcgaggacacggacgatgacctcctcgccgcgcttggcgatgctgccggcggcgaggtgcgcggcgcccacggtctcctggaggacgtggaggtcgggggacttggcgcggagcgcgccggcgccgaaggggaagtcggcgatggacttgatgtcctcgttgtagaggaacgtcgcgaacacgaagagcgcgaacaccaccgccgccagcgacagcggcgcgccgttcctgcgcgccgccacgccggcccccagcgccgcctgcttcatcgcgaacggcgccgaggcgaacaccgacttccgccgctgctgcatctccggagcgcccaggaaggcctcccgctccgccgctttaaagaaaacttaccaccaccaccaccaccaagccccggcctttcccggtggcttgcaaacccgagaagtaaaaaaagcttcttgctttgcttcccctctcttcctcttcctcctcctcctcctctctatatgagtatatggaatggattaatggagcttcttgctgagctctttgcctctttgcttagctctgtgtaggctaggaggctaggagctccttggcctggctgtccttctcgactggacacctcgctctcctatatatgtgtcgatccctttacaagtttggtgacttttgctggatgtttgcccttttctttgcttccctttggtatgtttggtttggttcgcctgctttcttcttttatggttgcaagatctcttcccctccaccaacacttgtaaactcccccctgttctagctgcttaattgaatctcattccctttcattttgtatatagagagatagagggtagtactactactgaggggtgggtcaaatgagtaacatgcaaggctgcaaagcttccatggggggtttggaggttaagctgttgtacacatgtaacaacacaggcaatgtgcgtgtgtgtattctactactagtattctatttgttcgttgcatgttttaattatatgcctactatatcatacatttcgttttcattatcgggatacaggggtggagtatatggtattatggtgtatactcgtatggttgtaagtactcgttttttgtttatgcgatgtgagtgggtaggccgtggctgtctcggaagagtgcgagatggggaagcaaacaacggcgggggcggctacgtcaattgcccccctttcgcattctcggagatgatcattctgtatttggatgtaatcagcacgcagatactactacagtcatcgtctttgcgttgtgaacacactaatgatggaacgaatcgacgaatcagacaacgatacggtgcctgaatcgttccgattttcagatagtgttgcagcaggaggaaactgcagaatgtcgaattgttccgatcgacagtgttcggggggattggtctacgaaaatcattgttcaggaagtgatgttagtcatggtcagaggttgatttaataggaccaatgtttcgagcagaaaatggatattacagggggaaaatgaaagcaccgtgtacagcataggtgactgaaatttcaggtcacagaatagccttgcaaaaaaatcagagaatcggtgcatctttcagagtcggttgtcctgtttctgtagagtataacacgtttcagtttttacacagtgcttttctgcgggtgttcaatatgtttccaatcttgtcacgccaactcgtcttagctagtacgcatacgaattgatatcactgtctgttatcattttctttcaacttccagatctcaaatgatgtgcctatgtagggtcgaatattttcttttttcaaaagaatatcattgtcagatactattatttttcattgatcacttgctgtaaaaatgattcttctgttaagttgagaacattaacaatgtgtggagagtggagacatggatccgagaaatcggaagaaactgaaacatcttggacccagctcttgtttagtttgctgtaactcgtgaagtcgtgatcaggaactttccactctattattttgttgttcatcgggagaaatgctctcatccatcttccatgggtaacatcttgttacattgaggtctacagtttttattttcgagaacaactacaggtttaacagataattttctgagagacagagaaattcaattccctgttaaaaaaaaagagagagaacagcaatgtatgtataacacagtccattttccttcttcaggttattccatagctggaagcaatcagttgaatgttcagatgtccagttcttcttgagctcgctcacaagcaccgatcagtctggtggtatctttgctgtttggttacacctatgggaaccaatcctcttactagcatacagttactactatttttctggaatttttttgattttttttcatacctatttagttgacatgcaacaaataggtggatgtccacctaggcgattaaaagtgtttcccaacatgctattatagagaaaacggttgcacacaccatttccccctctgattgcaaccaccggtacaaattactccaaacttatgtcttgttcgaatactccaaacctgttgcctcgctttgttgagtgctatacggtatacttactgattctgagggaagtacagctgaaccactatcctgatccaatcttcagtccaaataggcatatgctacgtagtttaataacatcaatgttttatactccatcatggagatcccggtctgacactctgacctccatctcgtgttaagataataaagaaaacttcaataacctaaagtcacattgagctagctatgatgggttctcaacactgctggtcgatgagtgtagcgcagccggcatcgctgaagtcaactactctagctagtatgatttggttataattgagtccaggaacactggagcaggcacttgggccagctcaataaattttttccacatgaacatgacatagatgattgaatcgcatgcaacctgaacaccatgcttcttttttacctgaatctcgcccatcatccagacggacagttcagaataagcttgcatttcagccaacgtgggaaatagaggatccaagaccacgggagagatgaaaagttcctctctgcaactgctggaggaaatttcgtttttctgtagtgtttcttttgtcagaatgatgtttctctctacagtagtaggaatgtcaatatgtcattcacattttaggtgcaaatcattgatgcttttaaatcatgtcatcccagcgaacctaattctgataacagggcagtccaagtcaagtcgatgaacaatgcccaaaagtgaattgggtggttctctttttgaatcgtaggctagaaactatggcgatttttgtctattactcctaataatgtgcccctctttgtttaaccacacgagtggagcaagtactggcctatcagatatctatgcttcaacagaaccgtactatgtgatgaccaatcattcctgtgtagttactactagctcgcacttgcattagttggagtgcctatacttgtaaacatgtttggtcttctgaagaacgccactacaatacaattcatgtagggttgttttagcttttcttcctactttcggagcatatacaaatgtaagatcataacaaccatgaaagagagattaactactttatgttactaacggatccatgattccatatatgttgtgaaaatgttgcagagctagaggttgcttttgatcaaactgaaaacttcacccgacccactgtgaaatgtaaagcaccttgctgataactttgctagctaattcttttctttagcgaaagaaaagacctaaccgataatcttatcgctcaagaatatcgaatgcacactatatattcaactcagctggggtcaacaagaaggaacacttattcatggcgtttggtgtatacctcacggatggtactccggcagtttcgacatgcacccaacggtgtactagtttcggtggacagtggacacgatcatctgatcatctttcactgttgctctcaagattcagtattcaattagtactgtaccatctcgatctcctttctgctagctagtagttctactacaatactgattactgaatgatcacacataaatgaagtgacttcacttcatatagtactcagcgtaaatgaaactgttctctagcctgtgactagctgctataaattggtgcttgcaacaggtgatatgatgctgatgaatgtcactgcgtgtatgtgatgcacacatgcatgtacgatgcatcatatttcgcgggaaaaaaagaaataaaagcaagagaagaaaaaaaaatgcaggatcaaacatgcgtagtgtacggtgcagccgcaccaaccaatcttctcaggcagctaaagcggccccatcgatcagggtggtcagtcacaatgtctaaatgtcacatgtcagtggtagctagtttttgtctggtcaataaggcgatatacacatcgacggatgggagatgtaaagttgcaaatttgtaagggggcatatagcttaggctttgaacaaagtgggatggaagc

SEQ ID NO: 2603 - DNA, 4457 bp, Oryza sativa
tacgatctgaaaacgccgtgctgatggttacgagttcagaacttcagatcgatcaaccaatggaagagtacagtccatggcgttgattacagtaccctcatgtcaataattttcaggcatgcattatcggattatcctgcgagcaatgcacgggctagagacttcacatgcatacatgggtacggcaagattgttgtctcattgtttgtttgaaggacctaaacagaggacaacgtacttgtatttctgcgtggctctcaagcctatacacgtaggagtacctgcgacagtatcagttttctgaaaatgcaggttgatcgacaaactgacaagcctacggcagtgaccacacagcccgtgcagacaaatatgaactcgttgaaaacacacagatatatatagggggaaacatttgagatcgcttgtcagatggcaagagttgataattcccttttccaacagagcagacgttgctagcagaatggtgcgctacaaacgtctgagaacttaaatgcacaggaagatgggatcttgttttcagagaagaggatgaaactgcatggcaagtacgaccggccgtcgcttttgcatatgcttccgacatggcgtttttgtgccggactagtcgcatgcagcaccagtatggacgccacgatgagcaattgagcagaaatgcagcactagactagactagtttacaacttgcgtttggaccaaacaatctacctaagcaaggcacataagatggtcagaatgaaacattatttgcgcttgctttgcagaagagatgaaatcgatcggtgccttgtcaagctcagaagcccgtggcaaaggcaggaggcagctccccacattttaggtggaggctaccacgcgaggagctagaaaagcaggcacacgcagctaacgttttcaagtcaaaccacaccctccatgcacatcaatctgttgctgaatttgggttgaactttatttttttttataagttggaaccgaagcccaccagttgcaggtacaaagttttcccaaatataaaacctggacgcccaaccgagggtgttgtctttctacgcacgttgtacgctccaactccgaccacaactaggttgctgcaggtcggtcccgtagcagcagaagcatcggcaggtaggttacaggtacccgtagagcacttgagctcgaggttaacctagataatgcccaagaccaacaagggtttgctggtggcctttactctccgtaatataaaaaaatcaatctaaaattaaaagtgacatatcctaatataacgaatctatatagatctttattcagattcgcagtactagaatataccatattggttttttattaaacggagggagtacgtctgctgtgtcatgtgtccttgacaacttcaacagaaatttcggagaatacctgacctatttcttcagcggcggcggcggcggcggcggcgacgcagtgcgggcgggcgggcggcgcgaagagagaggaggcccagcgattttcgcggcgaggcgctaggccgtgtggcacgggacgttgggctgtttttgcagcgggggaagccgagcggccggagcctacgggccgccgaatcgggatgtccagtttgttgggccaggctgggaaagagtctcagcctgtgcacgtcctagcacgcaggccgatttgggccttgttggcagggaatcatgtatgggccactattgaggcccatccaaacgaggcctttgaaaatccaattgcaactcttgaccagcagcgggcagtgagtcatgcgaaatccttagtcagagacgaaggaagtttctctttttccatttgttttgttggtggtgttgcttgctcgatctgacgatcttactattgaggtgtcaacgaaaggggagtccaatgattgatcccaacctgggtgatgcgaagtcgtaagaacaagatcccccgccgcgaagcaaaccgtttgaaccgcgaaggttacaacgacctttgagcgcttcaaagtctccgcggccaattgctcgttcaagtgccaggcttgtactatggcgtactaacctacctaccatcttgcattcttgctcgctagtagctctacattggcccttcgctgccgtaagattggagctctgctgctgacttccctagctagtgcctgatcaggaagatcaaaagagtcaatgacaatttttttctcctatctatgtctatgactcttttggagcctgttcactttaatgccattttcaaccatactattttttagcaaagttaccagaattttggctatgtttagtttgttgtcaaattttagtaagtacatatgaaatcttaccaaaaatttggcaaccttgccaaaattttgacaactttactaaaatttggcaatgccaaaacttgataaggttgaaaatagcagcaaagtgaacaaacccttaatcttcaggtgacggttagccttgtttatgattctgcgagcatatgcgggaagaagatacgtataatcttacaattcacttttcgtcgatcgatcgttgatctaacagtgacccttgagtgaggctgaaacgaaccgttcggagcaggagcagacgactcctctcctctgactgaacacacaaacacttcgcgctcgccgactgcacgtttcgttcctggaagaggcatccatgatccatggtgtccttcgaattgctccaaaaagatctctgctctgcactgatcataccgtgatgcattgcatgcacacaacttgcgacttgcagtagcttgtatcacttgcactaaacgtacatatcatattttttggagatgggattattaatatatttccatcagatctaatacgctatgaaaaggtccaagaatcaaatgggaaccgctcctccctatcaaaagtctattctttttgtcagcagttgcatttctatattgcttcgtcagctcatcatcatacatggatttcgcattacttttagcaagctgagctatttgacttggaatgtttcttcttccgttttatatttaaatctgagctatatatgatgacgccagttcagggctaattgaggatctggatcaggcacacggctggatcggttcggtcggtctgtagcggcatcgagtaatttgttatagcgaaacggaagcagttttgcactttgcttgtgcaactgatctataatcattaacaagtgattagtactaatgtacactataatccaatgaacttttcccagttagctgtccaagcgtgattcacatctatcagagatgctcatgcctgacaaggaatcaactttgagtattgataagctgctcttgccctttacctgaattgaaaggttgagccactgtcactctgtcgcactcggtgacatcggtccgtttgagatagctgaagtatatcgatggataataggaaaagtattttctggcacctaggtgtatgcatgtagtttaaacatagtttaaacagttatgtaaaaattttataaaatttaataagatagactatgataatataagacactatacaaatatgcaagtataaattagatctacatatgaataaacaaaaatgataaattttatctgcgctataggatattattcactgtctgattttattattatttttctctagttgtagatcaaatttagtcttgcatgtttgtgtctggacttatattaacacaatcgatgctactaaattttttcaattttttctataaccatttgagtcgcatacaaatgatggtgccatggcacctagatgtagaaaatccttgtcgacggataatatgatttaactactacaaagttaaaaacagttgtttaaaataatatttcaagaaaattttatataaaaaaatttacacaaaataccttttaagtgcttaggaagtgtgtaaacgaaaatccagaatcactatcctccaaacagagaaaatccagacatgcttttaaatgagaattcattaaggccaattttgttcttggtctccctctctttaaatgtatccacattcgtggatgtatggtgtgtgcgtatagcagtgtatatgcgtttatcaaaaaaaaaattaaggagaatgggggatattttttacacacgtcgttgctcgaactttttagataagtaacgcaaccagtaaattaaataccaggtgagtgaaatcatcacggctactaaccgacattgttgacgcggaataatggcattattgctccgcccaatggaaaatttctaggttaatttatggcaattaagcaaaagtttagtcaaatctatcgatcatgacacgctgatgattgcatgattttgctttgtataatgagcatggtcctcgctctctaaagattcgccgtgtgaattatttgcggcttaatataaatccatttcgcgtgccatgaacggatcacacggccagctaccacatgtagaaagatct

SEQ ID NO: 2604 - DNA, 5960 bp, Oryza sativa
  unsure (1)..(5960): unsure at all n locations
ctgaagagcaacttaaacattctaagcatgtatactgaacttcagttagtttctttagtcttgcaaaaatattctcagtaaaaaaagacttgtaaaaattgccataagttttttggatgcaaaacttttaaatatattaatagtagtataattataggtaactatattgtaactatactatattacattataagttttatataatttatatggaaaacatacgtaacttttatataacttgtattgtactataactataattcatatataagttataatatagctacaatacatttacactatagttataatatacatatatcgtatagttacattaaaatcatactataatcatactatagttaattatattatttgaaagttttttactttaaaaacttgctacggctctttagcaattccaaaaataactctatatatctaaggctaacatgaaaaaacaaataattgatcgacacgtacttgatcgaggccatggccaattgagagttccttatgaaaagaagttaaaaatccaaaggctagctagcttgcttgtgatctagcggaaatgagaactaactgtgatggcgatgggctgccaacaaataaaaatatatttttttagaaagagagtgcatggatccaagaataatactggtgcagtaggataggcatgtgtatcacgtacatatgctgtatgcccaagcctaggaccagggctagggaagtagacgaatttaagcccggccggccggttgttatcgccgcgtacgggagtttacttgcatgattgagtgctcaagtcaagacaatctagtcctaattaagcttgcattggcctatgagatgaatggcttctggtctctgaaaacctcatcaaacgtctatcattctggccgtggctatgattgcagctagctaccgttctctcgatagataatacggacgatcgacgcatctagcaatgactctgaaatccaggtacttaccatctgcaaaggatctgttatgcgctgcttgtgctaagtcacccaatcgttccccacaacattctcaatggcaactgctcaggtagtgatgagtttcacgcgctctaagcccggcccgcgcacagttaggaggattggccgctatctgagcggtttaaagccaaggagcaagaaaacggatgcgccccgagtaatcgacccgtttcccaagcagagtttcgcgaaacctcccctcgatgtgatagcatcgtcctttgtaacgatcaagactggtaagtccattagtccaaacagttgtccatgtaccagtagaagattcggcagctactgcagcccctgcttcaccttcatatttttcgtggtctatatcatgcgagttatagcagtcctaggaaatggttggttttagaatacacgaaagtgacgaagttgctttgactactgaaccatgcctggatcgtcggagcgaattggatgatcgggccgagggctgccccctcttccccttgctctcctttccttaatattcaccgtcgagtcatcaaagccgtcaactaattcagaggggctcggcgccctttgagtctatagccgccaaatctaaatattccttaagttgtcgtacggcgacgtcagatcgatgcgtctgttaattaaacgttaataacattgatagaagaaggaggttaatttcgtggttaaataacttggacggtattgtacgtcgttgtcgatcggtatcgatttcactctcaatctttacgtcttctctctttttctcgtctttgggtacgatgattaagcatgacgaggacaggtgctgagctgcatttaggttaattnttgcatatatcccccaaaggcccaaggcccccactgcatacaactcgtttaggaacattaattagtggggctggatgtatgagccactcatcagctaataaaatgtatagagattatttaaaatatgcaatcaatacatcttattagttttatgttgtcttaatttttctctatacttgttccatgctatggcatgcagggacggatattgaactataagagtatgatagctagggctgcagccctatttccgaacctaaatatcaattgaaattgcattataaaattttaaaagataaagacaaaattatgtaaattatatcgattgagtcctaggcttaaaaagattccggttccgtcactgattgcatgcataattaactttcacttcaacttggtaacttctacaggtattagcaagggttacaattcgacctttttttctacataaaaagcacaatagattatcaaactggtgacaaaagagagtgagatcgtacttgttgggtatatattaatgaaaatggaggaacaatcaacatctcgctcatttgttgtttagtgggaccaagaaggtctgactggatatattacaaggacacacgtttttttaaaagaaaaatcaaagagttacatgtttctcttttgctctatggataaccaagtaaactcgaaccacttgcatccctcttgccgttttgtatgcttgttacatcaatcctagtgggcatgcattacagtatgttttggatctagcatgggttttctttaaggttaatttgatccatgtcattgcaactatgtcgtattgaaaaaataccactactattcacaaaatcgggtagatgtcactacaatcttctaaaatttgaaccgtgccattccatcacgatttcttttatctccgtcacactttgtgtcaccgcatcttcattctaagtcaatactagtcgtctttgtctccaagtagtaagcccgcaccggaggctggccggcgagctctgggaaggctaggcggtggtcgtgggtggtgatgactccatgcaatggtcgtggacggcacttgctgctccgcgcctatcccttcctccatggcgaggctgcggccagaagacggctgccttcgactatgacgaggcggaggtggaagtgctcctccacgcggcgcagcagatccccttgatgctgaactcatcggctgcttcgacacgctcatgtcccaaccatcggatccgaagccgaagcggcctgatgctctccccaccgccaaggcgggatggacgaaatggaggcgtgttttgcagcgttgaagggggcggcatggctggagaaggaggagacaagatcatggttggcaagctcgggaaggaactctgcatgcgggacaccgagctccgcgctatgcacacactagaggagcacgtccagccgaggagcactctcgccgcgctcaacggcctccacctagatctctagcactggcgttgacgggctagctccgttggatatggccggagcgtcgtgcctcgtcatgtgcgtgctcggcctgcaactggagaatatggtcttgtgcggcaagctcgacttcgccgtgccatctttcggttcgagaacaagttctccggcaggagacagcaagggattgaggagagagagctgtgagggatgtgcacggaggagatcgtcagtgagggacaagcctagagccagcggtggagggatggggctggggacgcgagacgaccatgtgatggggatgatgaaaatcatgatggagtggcacggttctaattttagaagattgtagtggcatctacctggtttcatgaatagtagtgatgttttttcaatacagcacatttgcactggtatggatcaaattaaccattttctttatcaagttaaaatgttgtgtgaacatagattgtttcctttgcaccaactaagaatgcacacaactatatataatttatgagcaccaagattaatttggggattttgttatggtagaccgatactttgtgaaccatccatcttattattctttattgatccgatggttaatgttcatcttacatcataggaggtaagacgtcatctacaaccatgtaaagttaattaatctcaatcttttactacaggaaggaaaggagcgatgtttacttgtgtcactataaaaaaccattactaatacaataagaattaactagtaatttcatttttttattattactagcaatagtacccgtgcgttgcaacgggaaaaacaccatttgatattgtgacaccttgaaaacctcaaataggtaaaaaaaacaagtctaatttgatatattaacaaatagatagaaccgagtctaatttgatgaattagcataggatttaggatttagttttagatttatttttcgagccttcttaggcgtttatccgacggactttaatttaaaacatctgagccacattgtttgataaaatttgcattcggcctaggtcttctcatccggtccaaacttgggctggcccatcttcgtcgagctgagtcaattcgacagcccgcaagctgagcagctgagcgcggcccacatatgcggggacagtccgatgcacttccgcggcccattgggcacagtgtaatcggcggtgccggtctgacgttgggcaaatctgagccgtccgatctaatggatgctccgatcgtccccgtgctagatgaagcgccgaccgggagagaggggcaaaaccctagctcccaaatccctctctcccgatcctatttctctccggcgacgagcgagcagaacaacagcgaaggcagcgacggcagtccggtgagctagtgagcgctcctgcttcgctggctgggtggcgcacccgagggtggtgcaaagttgtgccacggtgttggaggttcggctaggcaagcgcgcaaacggcgctgagcgctgagcggcctggacctttaagattagataagattttcacggacgacgaaagtaaattgaatcaaactttctttttttttgttttatgttttctttcgcccttttttcgttattacagaggacagaaacgattagtagagatagagatagagaagataaagaaatatagtaccatgtcacatataataggattcgattttttttaccgcgtcacatataattctttgtttaatcggacataattcatttttataattgttttccaccctttttttaccgcgtccacggaatcagatttgtttttttgcccggtttttttcacaagattttttttctcccgattcttttttttcgaataggacagattggttttttttttttgcctttcattacacggaatcgtcattgttttttttgcccctttttcgcccggctttttgcccgatttattattttttaatcggacagattgggttttttttcgccgtttctttacacggaataggattcgtttttttcgcccttttttcattcggttttttttcgcccgatttttttttgacgacgatggaaacatttcatattttttaagtagtagagataaagaatcggacagattttttttaattttttttcgtcctttttttaccgcgttgacggagttggattcgtttttgtttatcggacaagttccatttttttccttttttcgccccttttttggatcggacaggtttggttttttttttctttttttcgcccggttttttctggataggacagatttggttttttcgcccggttttccttttttcacctttttttatcggacaggtttggtttttttccttttttccgccatgttttttttcggacaaatttggtttttttcacccgattttttttacggacgatggaagcacctcttattttcttaagttgtagagatagagattaatatttaccagaaccagattacaatattgatttgtctttacttacaatttgtagtagaagttttcaaatattttcggaattttaaggtaatttatttattttcttcactcacagcaatttgaagagatgtttaactatggtctcttctgataatagaatctatgtagaccgttatcttttctaatccaataaaccgaatctttttatactactacaataatat

SEQ ID NO: 2605 - DNA, 8906 bp, Oryza sativa
  unsure (1)..(8906): unsure at all n locations
atttaagatgaaagctcacatttacggccaattattctttcagttgtagcgatttacccgtcaaagacgtccgtgatgacggctataatctcaagataaatcggttcatttttcggaagtgctcataagggtaagggaaatgtgtatgtgttcataaaggtgcgcgcgttatgaacgcccgtgtttggattgtgttttaaaaaaaattcataaattaaaggccacctcaaaggtactcgatgatctatacagactatactcgtataatccactctgaccttcgcccccctatggttacctatttgattacctcattcctgactactgaaaccatctttacttctctcttagcgcaacttccagtggatatatcaaactctaaacaaagtgttttaaaatgtacagtagtactgtggaagtgttctaaaacaaatttagtgatgtaactttcgtatatcgaacactccatgtacaaagttttgaacgtttgaccttttgcattctaaaacgttaatcaaaagaaaaacatacaaacagtacaactatttctaagtatgattgtgttctaatccactaccatatccaccaaattaaatgtgttctcaatattggtccaatttttcaaaatccagagaaacatcacacaattttggcaggcacaagaaacagagtattgtttgtgaagggaattttgttaagggcatggccacatataattctttgtagcttaaaaccctaacttttcccttggaacattcaagtgatcaaacaactggtgacccgatgtttttaaagattggccgacctattttaattcagaacgagaagataacttgtgttgttagctggattataggccattatgcttattaacgataaaatataaaacttttatacatatattgtcagtaacttaacagctagtgttgaataataaactacgaggagaaaaacattaaaatcaacttaaaaacaatagttaaattttaaattttaaaaatcatggctaataagccgaagagcaaacgatacaaagattttgcttgcgaggcatatgatggcacattcgctccttgtgataaggggaggcaggaacaaactttcattagttgtatcatgagacaacttcacttccaatgcatccggcatccctagacaccaagggcggcaagcgagggaaatgcatgaaagcggagatgaatgggacacaagcagttaattaggcacatcgctttcggtttgggcattgtgcgagggccgctctcgaataggcagcctgtgccgttgtctgttcttcacataacacccgttcttttcgatagcaactcgtttattttttttaaagagaatccatttctagctttcttcacctcgcttgattgtaaaatccatcgatcagaactgtctcacttttgtttctttcacggttcaccgtggatcctggctaaaataactaaagcaaattggcgaactggtttagttcaaggtctctgtacccagccgaagtataacagaaaatgtgaaactgcatcctacagtttacaagctgagatgtacttggtactgcagtggtaagaggaggtatttagcttcctcgcaaaaccagaatcccgtcagtgatatgtgtaaactcgaaataatgataaccctattggttagctgattaaactagaaataatgagctgcatgggtcttaacgagtcgagtagtatattttagtgcaaatgataaccccatcagtaatctgtgtaattaagcaagctaaaattaagctgaggtgccgtagctaaacgtaatacttcctcaatcccagtttgatcatctctaatagcaaagataatactccctccaacccaaattaattatcatatatatttattcaccaagactaaagataatttaaatcacatcaatcaggacaccatacacacattctcccacattacatgtatcgaaacatcatgctaaaagcaaggataataatagagctcacttcctactattagggcacccataatggttatctataggctctctacaagagatccatatcagcatattttcctatttgaaagatattaaataaagagagagagatcaaagctatctactaacttgaagatagtctatagagaaaaacgaggcaatgtattagagagctatagatacccatatagacatattattgaggtggtttactattaatctagtctattgctgagatgtacatgttttatagagagcatcttactttaccattgcgggtgctcttagctaatcttaaagccaacacatataatagattagctataaggttggctacaattttcttctcatctctctatgtctcacttatacattaattgcatttgtcttggagcttgtgttaagctagctcttgcatgagagccaacacccttaattttttgttatatctctcctccacataagcttatagtagccttatagctcactattatacttgctctaagagcaagtttaatagtatagcccactactagctctatatcatctatagtcaatgtaatagccaattcatacaatagttgcttactatactattaatatttggttccacctatcatacacacattacatcttggagtccatactgtagctggctatagatctgtagcccgctgctcttctctctctttctttatctctctaaaatatgtttatagctagcttatagactgctactatacccgctctaataacaccatagcatgtacacattctccaatgctgcattaattgtgttccgatgaaatacgagtccatacggttatatcagagtaagtacaatagcaggctataagccagcataactacataacgagaagaaaagagaagagagaataaagcgggctacatatttatagctagctgcaaaatggactccaagacgttgtgtgtatatgagaggtgggaccgggtattaatggtgtagtatatttttatagataactattgtatgaatgggttattagattagctatagataatttggagctaatatttagctatcatgaccaatttgagaaaatttgaattgcattatatgataatcaatttaggaaggagggagtaatggactataaggtaactatatacttatatgaataagagagataataaaaaaaataaaagatgttggctcttatataggagctagctttgcacgtgttccaagacaaatacgctgaatgcataagtgaaagtaaaagagaggcaaagaaaatttaaaaacgcccttatagctaattattatatatgttggttttaaaatagactaataggtggcagttaactctactattaagcaaaagacaccaagactaaggatgctaaaatattcatcattcttaaattaatctttatcggttaaggtgctatatcattttgtgtcccgtagttttactcatgctttaaatactgtatgtcattgtgcaaaaaaaaagttagtcttagttacatacgacgtattcaatgatatatatttacttttgcgcaaataaaagaaaagatacttgttaagagatgatcaaaataggataggatagaggaagtgcaatatatgatttttctattaatccatgatgagagagagatactttagaaaattcactcggcggatcatcgaatctccctaccatcagcccaacgacacgttaatcacacagccaagatgctctcaataatggccccatttgccccacgacgcaaatttcccaacgatggaaaacaaaactggttaatcacattcgcataacaaaccatcgatccatcgcatcacatggcagcagagcgcagcggccggccattggtgaatccggcggtcccccgtgcgggatgctcaaattcatcccagaaactgaacaagtatgtccacgttcatcggcaagtccagattcatagatatttccagattcattgtaatctagtactaaatgtagtaacatattatagttccgatccgtaaatatatctagattcattgtattagtaagtgtcacatctaatactccctccatctagttttgatagacatatttttaaatctgaaaaatttatttttgatagccatattttaatctaatcacttaccatcttaatgattttctcggatttaatgcgtggctctccattcttgcacacaagattggctagatgggcatcgagaaatataaatattaatgaatcgtttgtttacaaggaataactagtagtatatttaaatatatgataagcataattacttatttttgtcattgtggcaagataaaatatgactatgaaaaatagatagatgaagcattatagcaagtttaatagtatagccaactactaacttcaaattatttatagtcaatgtaagcaagttcatacaatagttgcttactatattattaatacatggtcccacctatcatacatacattacacatcttggagtccgtgatctagttgactacagatttatagtccacctctctctatttttatctctttaaaatatgtttatagctagcttatgatctgctgttggtctgctgttgcagctgctcttaagagagggagtagcccccaccaacccctccccacggtgcagggctcaccctcctgtccccagcctcacggcacccttgatccgtgatccgacggcccgatccgtggcatgacgcgcgcgccgggccccacgctgactagaccgccgcatccgaatccccaagaggggattatcctctcgcgcacgaggccgctcgaaccggcgcccgccacgtgctccccccggcgtcgcagacgcgaggccccggagccgcgcgcgccggctataaattctcgtcccgcatctcagcagcgcacagcatcacactccccacccatacgcatccatccaccgtctcaatctcggtagtaatcctcgcggcctcgccgttagttccaccaccgggcgccaccatgtgcgggatcctggccgtgctcggcgccgccgactggtcgcaggcgaagagggctcacgtcctctcctgctcccgcaggcaagcacgccacacacccccgcccgcgcgctgtacatgcacaatatcttaattctcttatccatattttagccggacgcatgcatgatgatcatcgatcacgagggtgatgggtgatgaacgtgccggtgcgacacatgcgtgcgtacgtgttcactgttccggtcaccaacttgtcatgcacccaccggctttaccgctcttgaacttgctatagtgaagaggcgtagggatcatggggggtgtggtggttgttgtggttttgtccttgtttatgtatttttgtctctttgtgaggggttcgcataggaatcgtaaggatatgagacagtaataacaaaggaccgacccagaaaaaaggaacacgggaatcttcgttgtgcattaagacccatgggtttagatgttatttttcgctgttgccgtgatgcgtatacttgcatggttcttttggggacggattggttctttctgaccgggagacttggtccggtgtgatattgtaggctgaagcacaggggacccgactggtccgggttgtaccagtgcgagggaaacttcctcgctcagcagcgtctcgccatcgtctccccgctctccggcgaccagccgctgtacaacgcggaccggaccatcgtcgtcgtggtaagagaactaactcatccatcaatccatcgtcagttcgtcacatgtgacaagagctgtcacgtctatctagtttgctgtttactaaaccttttgtgctgggtggggatcgaattgaaggccaatggagagatctacaaccacaagaagatcaggaagcagttcgcctccaagcacacgttcagcaccggcagcgactgcgaggtcatcatcccgctggtgagaccgaaatccgcccctgcggaacgtaatcaaggagatgaaaacgattaaacgtagctggatgtactgatactgacgttactgcttttcgctgttgtgtgatgtctccaaaagtatgaggagtacggcgaggacttcgtcgacatgctggacggcgtgttcgccttcgtcctctacgacacccgcaccaagacgtacatggccgcccgcgacgccatcggcgtcaaccccctctacatcggcaggggcagcgacggtacgtacgccgccgtgtaccactctgcttcaattcttcacgtctctgctgtgaccggaaccgagagagagagacttgacttgagttcactgatgatgtttcatctgtttttctcgtcttcttccttggctgtcgccgtcatgcacaggcgccgtctggatatcgtccgagatgaaggcgctgaacgaggactgcgtggagttcgagatcttccctccgggccacctctactccagcgccgccggcgggctccggcggtggtacaagccgcagtggttcgccgagaacgtcccggcgacgccgtaccagccactcctcctcagagaggccttcgagaaggtgccaagctataacacactgacgagagctagctaggagagatggccttgtacggtagcgtgatggtgaccgacacctctgacactgaccgtgacgtacttgctctgctccgctgcctttgcaggccgtcatcaagaggctcatgaccgacgtgcccttcggcgtcctcctctccggcggcctcgactcctccctcgtcgccgcggtgaccaagcgccacctcatcaagactgaagccgccgagaagttcggagctgagctccattccttcgtcgttggccttgaggtctgtggctttgcccatagtttttgggacgacttatcttgttatgtcgtcttctctaagaaccatggaaagtgattttttttttggcttgttcttggacgtttcagggttcccctgacctgatagctgcacgagaggtcgctgaccacctaggaaccatccatcacgagttccacttcactgtccaggtaaaatgaaaagaataaaaatgtaggagtagctgtccagtgcaatgatcgacctgacagaatatccagcttgaacagctcacaaaaaataaaacatgtctcctaagcaaaatttcagataattaaagattccaatcagaattcgtaaggcaaaattttgccccaaaccatatctcatatggataacggctgggtcagaaaactgacagaaagatgaaatatttggcctttcttaggatggcatcgacgcgatcgaggaggtcatctaccacgacgagacgtacgacgtgacgacgatacgggccagcacgccgatgttcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgcccccaacaaggaagagttccacaaggagacctgccgcaaggtagcaaccgctgacactacaaccgcgactaacagaagctgttgctgaaattcctttctgatgctggcacgaaactgtctctgaattttctgactctgatgtacgtgcaacgcaggtgaaagcacttcatcannnnnnnnnnnnnnnnnnnnnnnnnnnnnnnnnnnnnnnnnnnnnnnnnnnnnnnnnnnnnnnnnnnnnnnnggagttcatcaacgtcgccatgagcatggaccctgagtggaagatggtaaatttctcgtcttacatgaggggaaacagctgatgttatgttatagtcccatttctgctgatcagaatgtgttgacaatttatttgtgtgcacgcagtacaatgctgatcttggtcgcatcgagaagtgggttatgaggaaggcgttcgacgacgaggagcatccttacctgccgaaggtagaaatggcagttcttttttgtttcttcagatgcaatggtaattttgtccgtgttctgaactaatacttctgaaattctccacagcacatactgtacannnnnnnnnnnnnnnnnnnnnnnnnnnnnnnnnnnnnnnnnnnnnntggcctgaaggctttcaccgagcagcaggtactaattaccgaccatttccctgtgtcctgtcctataaatcgcctaattaaattgacccccgtttactctgtcatttcttcaggtcagtgatgaaatgatgaagaacgctgccaaagtgtacccgcacaacacgcccgtcaacaaggaggcgtactactaccgcatgatatttgagaggctcttcccgcaggtgactgatgtgtattcaagcgttgtacagtacagtgtagtactactacacttgtactagtactaatttggaaccgtgtgctgacacatggtgaaacgcgaatcttgatgcaggaatcggcgagggagacggtgccgtggggcccgagcatcgcgtgcagcacgccggcggcgatcgagtgggtggagcagtggaaggcgtcgcacgacccatccggccggctgatcgcctcccacaactccgcctccgcctccgccaaccacaccaaccacgcaaacgccaacgccaacggcaacagcaacggcaaggccaacggcaactgcgcgatggcggccaacgggannnnnnnnnnnnnnnnnnnnnnggccaacgggacagccaacgggaagatggaagcataacgctcgaagctggccggccggacggccattgatcgcgctagccgatgagatcgtcgacgcccgtgtggtgtacactaaaaaaggataaagctagtactagtaggtgtgcgtgttttctcaccaatcgcccatgacgttggcgcgttctgtagtactacccgtgaacgtgcgtgtttgttgccgatgctgttgtaccgtctccccttgtcgttgtacgtgtgcgagagagaccgatccaagtatgtgg

SEQ ID NO: 2606 - DNA, 15642 bp, Oryza sativa
gtgatcggccacgtctcgttgtagcacctgattcctccttcccttccccagtcctcgctcctggcacacggtacacgatattttaattacacccttatcaatcatcgagcaagttggagaggatgagtatgaatgtatgatgtgtgtgcctcatgtgcgtggtggagatggacatgaagaagacgcgggtggtggcgggatcgacgttggagtcgacccagttggcccacgtcttgaggcccagccggtacgccacccaggcgtccagctcctcgtacccatcgtccccgaacgatccccacctaagaaagacgtgtcgtgtcggtgtcacggggtgtggggttatttttgcttgttggacggcatcgagatttatcgttcgagtgacgggtggcttacaccgatttgatcctgtagccggtcatccaccagacgtagctgtcgaagacgaggatgtcggcgcggcgccagtgcttgccgtgctcctcgatggcgtcgacgtgcaggacgcggccgcccgcgcccagcgcgatgttccggtccgagttggactccaccaggaacggcgcccagtagaactcgatggacgcgttgtactcctgcgtgcagatttgcagttagccgagagctaattcgaggccttctctctgccggcggccagcgccgtcgtcgtcaagcgggtagggacgtactttgacggtgtagacggagagggtgcggctgcgctccatggacttggcgcccggggtgtccgggacggcggagttgacgaggcagacgaaggagagccactggcccagctgcagcgagtcgcccacgaacatgatccgcttcccccgcagcttctccagcatggacacagggtcaaacctgccatggtacacgatccggtccattattcttcagcaaagtgccaatgttggcccagcccaattacaatggaaaaagaggatactgtggaaggaaagattatagggaatatctttacggccctgttcgagaacccaacggagcggagataaagttttgaattttcatgacatgcttcttaaatggctaaacggtgcgtttcatacgaaaattttctgtatgaaagttgttctaaaatatcaaattaatccatttatcaagtttgtaataattaaaagtcaattaatcacaagttattactgtctcgttttacgtaaaacacttaattttcatcttcaggagattcaaagagagcctacgtcgtttaattgcatcctaaatcgtaataccagaaatctttacccttcatctttgcaaaaccattcaaatcgggtcccatagcagtattaaaggctgctttgactaacatagcttcctagccaacaaaaaataataattaaaagacatgtgggggcccacatgttagggtatgtaacatcccgcctcccccaagccgggtccacttacatctgatagcttcggtcacccatcccaaattgctctaggccaagcacgcttaaccctagagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctgtgtaaccactcccggtctacaccagccgcgcaactgcgacacacgcgagagtcggctctgataccattttgtaacgtcccgcctcccccaggccgggcccacttacatctgatagctttcataggtcatagactgccctcacagaccaaatatcttttctgcacactttgtcctcactcatgtgcacccgggaagaatttcccggtcggtcacccatcccaaattgctccaggccaagcacgcttaaccctggagttctttggagattggcttccggaaaagaagttgcagatatgagtattctattaattctattaagccctaggccgggatgttacagggtatttctatttcctccaaatccaaagcggcggccagcgctgataggaggagggggcagtggcggcaccttgccttgttacggccaagacggtgggagagaggagacgaggtgatggcgatagcatggaccagatccggtgtcgacaacgccctatcgaagaagaggcggcggaggtcggtccgagaaggaaccgacggtggagggtggctgacaacccagaggctagagaagagcgtcgagaccagtgtcctagcgaacggagaaggctgagtaggcgagggccttccaccaggaatgggcttggtggtggaggccgtcaactcgtggcggtgtcgggtagcttggaccggcggagttcctgatagggctggtacgtggagatgaggtcttgcaacccccaagcggcctcctccaaatcggcagctacctcgccttcccacgaacgactcgctggctcccttgcttgccacctattctcctccttggatcaccagcgatccctcgtcgtcgatcgttgacctcccacctctactgcctctcgcagataggctcgccgaccaccatccctctccccgttagcgagcttgaagagagagaaaaggtaggtggggaagagaggagaggtggaagtctacttagatgtgagccccatatatttttagttttttttactaggatgccacatctatactatcttaggacttgagttgaacggttttgcaaaggtgaggagtgaagatttctagtattacgatttatagggatgccaattaaactcgatgtaaagatgagggatgacaagtggacttattccagattatggggaccttggaaagaggcactaggagtatgacactgatgaacttcaaaatgccaaaaaggaaaggggaaaaaaaagcatagctgaataatctgagattataccaaattaagcaccactgaaattagcgcatacggttgcttgctgacctcgggagaaggcagtcatcaagatgccaatcccagtataggtagtcgctgtccggcctgccgttcctctggcaagagtcctgcctgtcaacgtatgggcacgtctggtccgtgtaaggcagtttcttggacctgtcgtacgcccagtacccatccgtcacgctgcaccgggtcgcgttgaacgccatcttcggcgctggcggcggcgttgccgttgctggttcgaccgagagcaccgctggcggcggcggctgatcagcagagagcaacgccgacgtcctcatcacggtccgcagcgacgttctcttcttctccttgtctgtcaccttctccttgacctctgaaaagatcaacaactgtcaactggagcactataacatgtacgctgcaaaaggtggagctaggcgcaatgcatggatgcaaatatgcattgcaatctgcaactacgtcgataagtttatgccacagattgcattagtgttgtgagtgatgattagtgatgggtttaccagtgagaccccggaggtcctctgtaaagatgatgcccgcgagagccagcccgccgatgatcgccaccaccactgacagtggggcccgccccttcacgcgcttcattgcgggaagctgaaccatgtgagctcactacgtgcaggcagaggcactgatggttggcttcttccagagtgagctgaggtttctgtgattgcagcttcaggtgctttagtagcagattattggtacctaatggtgctcatgccggtgcaactgcagcaagaaatgtaattaaagtgagggaattatatgactgtactgtcagggacagagctggtgcactaggcacttgctttttaacgacctatttcacttgagtaggagtgaagcaaaggcaatatttggagttgagacagccaaccgaagcgtgagcatcttttactgtatttcactgtcgttgtcaacccgaaaggtgctgaaggatactgctttgaagtagaagtactaggcattatacgtgctaactaatctgatactgttccaacaaattgtgttctcaacgcctgcatcaaaaactgcttattggccctgagccactgagtgtttgcccaactgcttctgctgtagtgggcaggggcagcaagtttcagacctgagtggttcgaaagctgcagatcactaaatcatgctttgcacttatggaagaattgtacgatatcatcgttcaattatactgcctgttcagcgcccgatttatttatttaatcggttatattatgtggtaatgtagttgccttcatgctgtgccgtgtaccactcgagacttcgatctccatccgagaaaagtccaggtttggtccctcaactcaactatggcattgttcgtatggtctatccactttttttttattagagaagggcatttatacccgggcctctatatccaaccagatatatgcagtatttttaaattaggaacttagcctttaaataacccaatctaaatttatttgaactgtcagtacaacccctagactgcatgccctttcacatggtctatccactatacgaagctcttcattgttgatctctcagttcttgaaatcaactatatttcatccttagacctaaatcagggtagtttgtggtgtcacgtggcatctaattagcaattttaagtaaattgtgggattttctagatttcaggcgtgtgaaaattgataaattccatatacctaaagttgtatattgctaagctgaaaattacagatgctgcgaaaatatgtaactttagttcaatttaattttaatttagttgttatatttcgttttactttgttttttattaagtttgaattttgttcaagtagtttatttcgtgtataatattatatgataaaataatttattgtttaacctttcatctaaaaaagaggcatttttttaaaaaaataatgagtaataggagaatgatgagaaccattgaattatcattcaagggaagaaaaaggtggctgaaaattttgaaaaatctaggcacatcaaacgtaaaacattcccataactcgtatatataggatattggtgagaaagaagaaaatgagatgatgttgtcaggtagttttgtagagtttacttcgttttagtttttgttattatctataactatgttgatgtcagtggcgaatacaggatgtaaattgagggggtgctagtgtaaaaatataatgtgattaaaacaaataaagatatatcaactaaagtattttccaatgaataccaaaagcgcatatgatcaaaacaattttctctattttgatttgtgtctatcttaaaatattcataaaaatctgtgaatatattgttttgtatactcagagtatattctattttaccagtttggacagtagaagcagggaggaagcctgcatctttgccgtctgggaattttcttcagtaatgactaactagacttgttaatgattaattaggggcagggattagagctgggtctggcgcaccaaccagccccaacagtggatccgccactggttgatgtcatcactgttcactcatatgaattccatgtaggcatcataaaaaaccatctcagtttagatacagagataaaatgtgaatagttttgagagttaaagggaccagtggtgaatagttttgtagctaagggaccaaacactactaaaaataaaatatttttgcatgcggttgaaacctatttttccatgcggctggggccgtccgtctgctcggaaaggtatacgaaaatagcaattttttcatgcgagtgatgcacccacatgtaaaaatatgttttttacgtgtggatgcttatgtggtccgcccgcaaaaacaaaaacaatgcaaaaaaatataaatataaatcccaaaaatcgaaaatcgaaaccctagacatgataccccccactccttcgccatcgtcgttggatccgtcccggtcgacctactgttgtgcacccttcagtcatcgagagagaagaagccaagcgagagaggaaggagaggcggtgggatctgcgcgatcggaggccgagcccgccgtccccgagcccactgccgctcccgtcgtcgtcgagcccgtcaccgctagatctgctccggccggatccacgatcgacagatctgctagccatcgggattgaagacgatgagggagaggaaggagaggcggcaggatctgcgtagttggaggtcgagcccgccgcagccgctcgtcctcaccgacgtcaccggtactcccgcagcctcctgagccctcgttgccaccgccgctcgttcttgtcgccagcccgagtaggaagtgggagaggagggaagaagttggagagaaagggtggagaaaaataagtggggagacagaaggtgaggagatgataatggaactttggaaaattttaaaatatgctgtaagggaagagaggagggaggtcaaacttgtagataggtctttttcgtatgcggctacttaggaggccgcctgaaaaaataattatattttcgcagaagggcctcctaagcaactgttcgcatgcgacccttcaactaatccccggggaacgatttttgcaagcgagaacggttatgattcgtctacaacttaatgatggtcttgtctagaaaaatcaattctgtagtagtgaaaatcgtcccaaaactatatttgggggaacaaatttggacttatctctgttgtttataggttagacttttggagggagaagtatcgatcatgtatactatgtgttatttatgcatataaggtagtactatatatattatattaacgtacgctcctaggagctataaacgcattgtagttttgatatgatgttcgaccgatctgttggagagatcttggtatgttgtttgcttcgatgctttactgatcgattgggcctgttttacattttactttatgatgggggcctataacatacaaccatcttccaaagttgtgctttaggccggtacaagtatttttttttcatgtgattcttggtcagtgatcaatgatcagcgaacacacagcacttcaactaaaagctaattatttgcaggcaccattaaaatggatgtagtcaccaacagcaacctaatgagatttaccgatttatttataatctttttgttgtttaaacttgtgttgaggcattcacagtgatgagtgcacattcatcttgtatctattccatattatcgtgcgaaactcacaacacagtaaggcaagactttccctattttctaacgccataggccacatatctctaactcagtaggcacataaaaaataacatcaaaagtagcatgacgacaataaattagatagcatgaataatttttttacgagcttctttaacatatatacagtgagttatacttttaaaaaaaaatcgttgtaatacatggtcattatgctagtgttaggaaacaaagaagaaaattgaacgatactacaaatctccttatgagatttgcaggaaaaaatatatatatacacaaacttaagacaacatacttgacacgttctttcatattatcaggaccaataatcataacatctcttgatcaacatcaaactaaaaagtattctactggtacagttactacaatagtggaaaactcggatgagtcttctctgaaatgcccattagtcgtagggctcacatatcaaccactaaaagttagatatagagaacgatacataattagaggatccatttccagaaaactgcgtgccccttgctgcattttttattagttcaggtttgtgattttctttggcaacgaaaagatttggccattgccaattctccttttcgttgtaaggtgcatgtttggattattgcatttcttttggatatggagttgctgatattttgtttggtgttaaagagatactaaaattttggttacaaaccaaacaaatatatatatttttagaaacaaggaacaaaacacatcgtcaggtatccggccaatcgaccatgacacaaacaacgtcaaacgtagaaatgatcgaagattcggaatctggttagctggggcctaaggaaacaacgcttcaaatctacggaactggtaaagtaaaccagacaattattctctctctagctaactaattcctgtaggactgtacccaacaaaatagataggtcaaccgaatgatcaccagtgcacgtacttactccgtacaaggtttagtcgatcttgatgacaccagactcattcgatctcatttagttgctgttgctactactcaacttcagtctgcagactacagtacttcactgtacctcctacttgtttgcttgtctcagcccctctgtttagatgagactaaaacttttaaaacttttaagttcatatcatatcggatattttgatattaattataaatattaaatgtagactattaataaaactcatccataatcttggactaattcgcgagacgaatctattaagtctaattaattcatgattagcctatgtgatgctacagtaaatattctctaattatagattaattagacataaaaaatttgactcgcaaattagcttttatttatgtaattagttttgtaaatagtctatatttaatactctaaattagtgtctaaatataaagactaaagttaagtccatggatccaaacaccacctgagttgctagcgaataaggccgtgtttaattcaccctcaacttccaactttccatcacatcacatcatatctaaaacttttctacacatataaacttttaacttttttctaaactttcaactttccctaaactttcaacttttttcagaaactaaacacagcataagggtagatggtaaatcttactcaggtgctgacaaattgactgatcaaatccctgcggatactcccccgtggacgtgagtggcgagacatcacacgagagaatgcgtggtggtatgctcctctctgatttgcatgcgttctgtttttttttctcaaaatacttctctttgttctcctctctctctacccgcatcattggagccagaatttcgcgaaatggttcatccgctgtgtttagatccaaagtttgcctctaaactttacatttttctatcacatcaacctgtcatacacacaacttttcagtcacatcatctctaattttatctaaaatttaaactttagatggaactaaacacagcctagtatttttcttccggaacgcggctcgatttgtgaagtggcaagagagcgcgaggaacccggaaagggagccggcgcgcgtgctcgaatcgaatctctatgaaggccggattttccgttgatggcccaaaatcagcccattattttccgcagcccgtttgcggcgcgcgtgccaggcctgggccgtagtaggccgaatattttgcaactgttgacttagcacagataggtgggccttcgggtgtaaacgttggaattttttttatttttaattttttttattaaaagttttacaaaaatattttccattttgaaaattgacggaagtactcgcctaccgccctctgggaaggcgatttttaaaaatcgccctcccaaagggcggccaaaatgacgtggcagacgggccgttcctttcgggcgacggccgtcaacgaaaattgcaggcggcccccttgccggcctccgcgagggcgattttgtactgtgcgggggcaaatgggcggcaagggggcatggaattttgcaggcggcccccttgccgccctccgcaagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctaaataatctcaaatctagattacgtattaccaatgaataggcttccattttcgtgtgttgtgtgctagtgggaaagaagatatgaagaggttgccttcaaattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtagactgtgcgcgctactggatctgacactaccgtgcagcgccgaaagtgtgttgtcatgagcataagttgttctagcaccatatgaatgaaaagaactatgtagacgagacaaacacaagtagtactgcagtagtaatagcaaaagtagtactactttacaagtttgtaagccaaaagaaacggtcacataaggactgaagaggtagaacactactgacgaggcctcttacccctatccctcctaccctgcgccctaatgtgcccgtgggagtacgtgagtcggtccgggggtacggcacggccaacccgtcctgcctgtacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacaaatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgttttttttggatttttagtgaatataatgaaatttcacagaggagggactgggctttatagggggagaggcaaaaatcgccctcccccagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgatttttaaaaatcgccctcccagagggcggtaggcgactccttccgtcaattttcaaaatggaaaattatttttgtaaaacttttaataaaaaaaattataaataaaaaaaattcgtaaacgttgtaccgtgcggtagaccggtagttgatcctcgtttgtatttacaatgcacattatttttttcgtttgtaatcgtgaattgatctgagaataatcatgtccgaaaaaaaaaaacaaagggagttcgtagttgaaagaacctcgcgtgtggttattagcgatcaagtcaaatatcctctgttgtgcaaggttatcaaagatgtttagatgtgggtaccagagtcacaattatcagagtatttagcgacagatcacagacagatcatagtacaaccgtgtacactgcaactgcaatttggcagcgcatgatcaatcaatgtacattcttgattcttctcagagtctcatccatgtgtgcctactgtcaccacgcctcctcaccttcactctgaagattgttacaccgagcgatataaaaaaaaacgaaattaactgcctacaggctacagctattggtagaagagaagcgcatagaagagctggttccacgtgtccggcaggccggggaggcaccagtggctgcagtccgccgagccgccgccggggttggcgcgctgcgccggcgagaggtcgccgctgtacaccgacgggtgcgcgtccttgcgcagcgccgacagcgccgagatgtcgaggaggcgaacggggctcttcatcgaccgcagcgtggcctgtatcacctggtcctgccccgacgtcgcctgcgccgtcgtcgcgttcagccccgccgccgccgccgccgccggggccgtctcgccgtagcagttcttcgacaccgggttggcccactccttcgagctggtcgatcgatccagcggcccacggcacagatcagaacaaaattagatcgcgttgtcagaaaagagagtgaaatacaatacaccattgccacatagtacgagtgtactactgtacacgtgcacgcacatggtaaggtgtctagtgtactgtgtacactgtagagagagatggggtgatggaatcatgaggttgagatgagaatatgagattggctcttgtgagatttacctgtagtgtgtgggggacatggactggtagaagacacgggtcttggctggatcgacgttggcgtccacccagttggcccaggttgccatcccgcgctggaacgccaccatccggtccatgtcctcgtagtaccgcccgtccgcgcccatgtaatcccacctgcatacgtgaagtgaaacgaagctgaagaggaaatctggcgggtgcgtgtggaaaagggcgcgtatcacgacgtttacaataccgtctaactagattcaaaacgatcagaaacgatttgataccgatactgtaatttttgttggaccggagtaaatatcttacaatacatacccctggagcgtgccggtgtgcgtccaccagtggccggagttgaaggagagcacgtcggcgccgcgccacgcctcgccgttcccggagatgtcgtccagccatagcaccttcttcccctgagccacgccgatgtccaccaggtacggcgcgcggtagaacgataccaccaaaccgtactcctgctcgtatacatacgtacgtacgtacgtacttaccatgagtacatctatatgacatttgcagtaagatcatgcaagtgcaatagggaaattaaatacgtacgtaccaggaacttgtacgtgtagagagggtcgacgagacgagctgcgccggcgactgcggcgccgcggcgtgcagcaggcagatgagcgactcccactggttccggcccagcgagtcgccgacgaacatcaccgtcttccccttcatccgcgtcaagaagtccgcgccatcaaacctatagcaaaatcgcgcgtcgatcgctgcagctaattcgcgctctagtcgtataatatgcgttacctgggtagctcgcagccggccggcttccaccggtaccggaggtagtcggagtccggccggccgtacagctggcagttgaactccgcgtcgatgaccgggcagttgtacccggtgtacgccgccgcgccgccgccgccgtcgtcgcggacccagctgccgctgaagacgtcgcagctcacggcggcgtctttccggtggcggcgcgctagcccgaaggagagcgccgaggccggcagcgagaaggcgtgaaggaggaggaggaagacgatggatgtagacacggcgacggcaagaaagccggcgccgtgcttgcagaagagcggcatcgatggcgatgagaattggaggaaaggggaggcgaagccggcctttcccccggccgctttataccgccgtacgctgacgattatgaatcgatcacgagaccagcttagccaagattaatcgtcctacaattcctgctgtcgcaagcaagagaaaaggcaatatagctgccctaattattttgctgtgcgatccaagcaaggaagcgattaaccgattagcagcagctcgtggagaagaatattatcaccaaaccgatggattgattttttttttatcagcgcacggggcagttcacgtgaggggttttgcagatcatctttgtactagttcgcgtagctaagattggaacctgagcctcatatatttggattcgttgccttcgcggctttgccccatggtgcacgtagacggtagacgtacagggaaaaggtttggttttggaattcgtgttcgcatcaatatggaatctgtggaattcgccgggtacgtttatgtttgcagtttgcacgtagcgtagtgtcctagtccgtctcagaggcagcaaacctggggtgacaaaaatggcgcggcagaagtgaagtgtgcgtcaagacaaaacgattggctggagccttggatgtacatggagcttgtccatgtcgttaggcccagttcctgccttggccatcggtagtatatcatgttggatgtcggatcgggccaaaattcagaagcagcggcggataaaaagaacctgtgtgtgtgtggtatatttagcagaacagagtgtctgctagcaaggttgcaggagtaattaaccacggtgattcgtcccctgaacaacgtgacttgattctcccgttcctgtgctctttagatataggagaataaagtgtggagaatatatcttcttgggcgacgctccggtgctttctacttgtagtatatactacaagtagaaataatccaaaccgtcgatttccaagggcatattagtactatgttaggactacagttaggggtaaacttggtattaggaaaatattcgtgatttttattacgtttcaatcttgtatcgcatcgatccttcgctaactttagcactattgccgttgttgccctatttcggtagctctcagccggcgttcatcactgtcgcaacgctctgcttcgctcatgtctgcaggcaatttgtttggtaaatttctcacatggtaaatccttctagtattttggtgcgactccttgatggtattttcgtgaacgaaaatcttctagacttttttctagggaaaattttgctacatgacacttgttatgtgtgattttagcactaagacactgcccaaacttatttttgggggaaaacactccataaacgtggtaatttgccagtgaacaccgcgccgattaaaataatactttccggttggggaggagagagaaaccgcgtgaaatgtcaaaaatgcccttgggcccacatgtcagctctatctcctatctctctcttttctctcacaaatggcgaggacggtggctggcggtggcggtggacgagcgtgcggccgctggagccacccctcgccgtgcccgtgcccgcagcagaaaggggcgtcaccgccacagcgggggagggggacgcgatgtaaagccggcgagtttcggggaggacgacgtgaagccaagcgagcacgaggcaggggaaggaacgacgagtgggaggtgggccggctacggagaagaagctcgttggcggccgcgcgagcaagatgcacgggagggacaaatgggcgagaggatggctggctgcggaggagaagcttatcggcagccgcgcgagcaagacaggggagggaccgacttgtgggaggatggccggctacggagaaaaagctcgtccgcagccacgcacacggggaggacatgac

SEQ ID NO: 2607 - DNA, 3029 bp, Oryza sativa
ccacacataacaagtatcctatagcaaaatttccctttttctaaagaccatctggcgttagcaacactcaaaacattaccattatcctgttcaaaattggaccatgtgtagtacactaccgataggtcattggggtgacatcgtccaatctcagaaagagctgcttttttactgatcaactgttttgtggaaccattgacatttacacatgcacacggagcaactgtatagatagcacttgcactcattcaccgaacatgacgtcacaagggcaccagaacatgtaagcatagttgagatcagataaaaacatgattttaaaactatacaattcaaggtcctaggttttcctatgtgcaaaattacaaccttatcccagtttcgagccaacatcaaagaagtcagagaggcattggatcaataaacatgtaagcacagttgaggtcacataaaaatatgacttgtaaaatagtacaattaaagtcagaggtaatatgggacaacactccttgagcctcgcattggcatctggttattctcctttcttctctagtcttgataagattagaaacagcttcgagcctccctcaagaaactaaacaaataggagtgcttcacagcaataattgtaagataagatagaaaatattatgagcaactaatgttagtcaggccacaggtaagataagtagctgtttacccgaaagttgatccggagatgcgttgcagaggcatcggagttataggatatcatcctgtatccaatttcaataataacatgagtaaactcaactccaaacaacatgcacggtgcaggaaatggatgccagataagaggtaacaatgctgtgaggcttgcctacgacacgagggagtggacttcatcagggtactcaacagaacacatttgttagctgtaatggaattactataaatttttcaatatactagttcacaattcagttgtgagttgtaggatactagtattttctggtaaagaggtgagggcggcggacgaggcgaggacgttggagccggcaaggtcggctgaggcggcaatggcgggggaagggaggagccacgaggcggggtcgctcggcgtcggcgccggatgcgatttgggacttctcttcgggcagcggcgtgaggaacaaatgacggaggaaagagcccggctagggttagtgaatgtaaaagatgattgtacccttccgcaaatatttttttcatagacaataataccctccatgattttactacccttaagtgaggtggtagtagaaataaatctgaaaccttggattaaatgagatcaacgatccaaattactttctactccaagtagaaagcacttccaagtaaaaagcaccggagtgagactcctttatgacttcgtcaaccagcctccttttggtctccaaatttatactccctgaggaagacagaacattcacattttttgcaaaggtgataaggatttacgtgcctttcttgcagaagggcgccaattcactatgacagtaaaaagaaaaaaaaagattggccatctttcctccgccccttcccttctttaaacccagattccaactccatatatggacaccagtttgatagtgaggcaagtagtattttcttttctttgtagatttattatccgataccttatcaaagaacaaaacaaggaattaaaactgagagttagcatggcctctcatttcccgtacttgggtggaaatggaacaaagtgacgaaagcactcattctatgagtccatctatttctatcaataactcgtactccctctgtcctaaaaaaaaagattcctaacatcccaaggcaaatttagtggggagtaaaaatgacccaaataaccctcatcaatagaaaatgtagtaatagtgataggtaggtaaatgatatttaagggatataacttctcgttttatgtgctgaagataaattggactctagaagttaagttttttttgacggagggagtatatagttaccctcacccacagataaatcaccatcaaattcttgagtaatgcatgaacgcgagtgtttaaacagagccgatcctgtttatccatggaatagttaagaaccaaagcttcaatcagaagcagtcaagtacggagtcgagttcgactgatcctctttcctacaagtccactgtcaagaactggttccagcagtgcggaaaagcccaacagcgaaaggctctcgaacacctatgggctggggccgcgcctgtcggtgcgcgcgggacgggacacccataggccacagcccagcgtcgaatggccacagcagtacagcccaccacctatgggccatggccgaattccacggatttccgtggatgtcacaatcgtccgtttcctactcggaaaaagtacaccgaaggtccctcaacttgtcatcgagttacaaaatcgtccccaaaccgcaaaaccggatatataacatccctcaatcgttcagatccttcggtggtttttatcccggttttagccgacggggcgactgagtcagcgtggaacccacgtgggccccacttgtcaggctgccacgtcacaccccctctctctctcccctcctctcccttcctcctttctctctcacttttcacctcaatgggcagccggccggcgggtggggagacggtcgccagggcaaggctggagaggatgtccggcggccggcgacgcgggagaagggaagggtggcagcggcgggagcacggggggagatcgaagaggacagggggagcacggcggcggcggcggcctccggtctccccgacctcagcccgtcttcaccaccgaacgccgccgccgttcttctcccctgctgaccaccggccacgccgtgagccaccaaggtcgaggacgcggcggccgagcgtggaggagcgaagggtcgaagcaaagcccgtcggtgcagcggcgaagaggaacccatcgaggagtgctaggaccacgtgccgcccacgtgcacttggtcttggtgaagaaaacggggaa

SEQ ID NO: 2608 - DNA, 5204 bp, Oryza sativa
aggaggggaaagagagagagggggggtgtgatgtggcagcctaacatgtgaggcccaagtgggtcccacgctgaatcagccgtcacgtcggataaaaccgggtcaaaatcgccgaaggacctaaagtgaacggttttgtaagttgagagatatcaaatatccggttttgcggtttggggacgattacgtaactcgatgacaagttgagggacctccggtgtactttttcctttcctactcggttcgtcaaccggcacacgatgacacgaaaggagcctgcacagcagggccatcgaccatgcgacgaggccttcctggcctgcgagaaaggagcaaaatattttttttcaaagtaatacatactaaaagaaactcatccgagtacatcttttatagcatggcatatagatgtttttttttttactgaaatggcatatagatgttagcgcatgataattgtcacgtggaaggttgcaagggggctacctaaaaaatagccaaccctccttcgcgtagccgttagtacgagctaacaaccatgtgccatgtcataaaaatcgtcctccccaggaacattagtggatggatatgtaatactttgaatttttttaaaaaatatttgaataaataaaaaattcaataccaactgatgatttctcgagagcacaagaacattggtaagtgcgattttcagtgtcacggttttattaagtgctcattgctcccataataatgtgaaggagagagagagagagctgatgttggggatgtactacctccattctacaatagttgtcattttagtattcaaattttgtcttaaaatagttgtcgctacaaactttaatacggagtacatgttaaatcaatcatctttcagttaaatttatcccaaatctacccatgattatccttaactttcaactacataatatttattaagggataatataatattttttcttaaatcttaatttatgctaaataatatagaataacaaatgttttgggatggtggaagtatgttaatttcaatcccattacaaaatatcgtgtttctttcgttattattgtgttttgagcctttgaatgataacacctcatcggactagtagtatagcactatagctaaacaaaatcaaccactatatttatctgtgtgtatcactgaatcatggtttgcaaatgtgataatcagaggatggatgactggatgcatgcttgaaatagacctggttatctagcttatatatgctcggaaagttttgccaagtgtgatgacaaaccacacattgcggtgagctgtggtatgaaaataagacatgacaaatggctccaattccttgaaaagtgtggcacaccataattatagcaacaacaaaatactatactaattcggtggtcagaagtgtggctctcgatcaaacaataccttattctcaatatatagacgaaacaaaattctgtggtaataatgcatgtttgatgtgagatgagatagtcgggaattaattcaaagtagacaatagcactgcatagattaaatggactcaattctttttaacaacacaaaactaatcacactttaatatgtgcgtagaacctaacatgatattggccaaataacctcaaaatcatatcaaagtgctatgtaatgttcacacaaccaataaaaatcagctatccaccttctttcttagttatatttttcttccctaaactctaagtgataccgcctctaccattcttagttgatcctcctcatatactgctacatccaatgagataaccttcgaggccatctctattactggatgagtttaacggccttatcacctcttctcatcttagctacttcgtctcctactccgcttaccctaaatattgtcaccgatgttctcatatacaccacatatccgtagttctacccacgatgcaggcagctctaccgctattcaacacgattatttgagattaggaatgtgctgctcatttccgtctcttttaaatttttgaatgaaacctgtccaaattagacgattattgatgagcctggggacggaagtgtaagacatgaaacattgcagtctgcggggttcccaaaccgccggggccggggttaccgcgcctcgacggtaagcacggttaccgcgcagtaactgtgaaaaaaccgtataaaatttatcaaaaaatcaaattattttttaaatttatttaaatgtaagaagattaccatgatatttatattaccgtacccgcggtaagcacggtaatactgactgtaatgtaaacctgctgcgggtccctcccaccccgatccccaactgatctgagcccccaccaaataaacccaagggaccacgtgcaatcagccatttctcgttccccttttccttctcccgtcacggatccggggggccgggccaccgatccaaacgtaaaccgagcgcgcacacacacacgccacgcgcctcgccgccgatggcgacggatgccgccgacgaggcgccgctgctcgccgaggagcccctccgccccggcgcctgcagccgcgagctcgagctgcgggagttccgcgaccgctacgtgatccgctcggtcgacggcggcggcgccttcgccgtctcccgctccaacggctccctccgccccctctccgcaggttaccacttactactcctcccctcaccgtgaagcgcgccgccgccggaatcgttccgtgcaaagcaaaggggaaaacaaatcgcggctatgttccggttttgttggttggtttgagtgctgggctcgtgaaccgatggtggttttactaacctgtgcatttgttcgcgtgcagaggaagcggctgcgggaagcgattgtagggtgtcgaagatttacggagtggctggcgtgatcaggttgctcgccggtgagtcaccatttctatatagcttgtggtttttctcacgtacgatttggatagcttcgtttgtagtttttgcctgcacaatagtgatctgatctaaatttgcacatggaactgatttatcttgctgtactcatattttcctcatagggagaaacatatggatgatgattgtttgcttagatgtgcttgttttccctccatttagccatgtacttatattaatcattactgtttaactcaagtttattcacccagtgcttgacaagcaatttcagtttaaattacatcgtgctaatgaaagttccaccatacaaaatcacatggtctgacacttgaacctcctattcggtaattaattactaatacttgttggtgtcttcaaatttagatatttgcctagcactaactgtatgctgggaaacttctgcatttcaattagattcattttaggttttacacttgaatgtagtttttattatacatactaattccacattgtcaggaaaaatataaaaaaggattattagaaaatttattggtcccacaaaaaataaaatcccaatactcacttttacagtgcaactaattactgttttgctgagagtatgacagtgcagcatacaaaatccatttgctcaataattgagcatacattgcactgctgaagataatcaaacttatatctggtagataaaaatctgaaatatttttcgcttggaagtatttgataaaggaaaatgatttccttatgtctttttgtaaagttctccatgttataattgctaattttctgtccttttttttttggaaattataattttatgcagcaggctttccactttccctttttttttatcaggaagctatgtacttgtcatcacttctcaaagggacgctggttcatatcagggatcccctgtttacaatgtgaactcgatgaaattcttatgctgcaacgaggctataaagcatttaactgcacaagaagtatgacaaaattgagtagttagcatccaattttatccacattgtttgggcattgtttatctttatctggtatttttggtcacagtatcataatttgtgtatgccatcttattgcagaaaagggatgaggcatatttcatgtctctcctgaaaatcgcagaaactactcatgggctttattactcttatgacagggatttgacactgaagtaagtatcaagttatgcatgactgtggataggtcaactaaaatatctatctgttcacatccttgcaataaactttgtcactagttattttctgtcttatgagttattacttcgtagcttgcagagggcatcaaagttgcctgctgggcgggtacataagccactctggaaacaggttagtgatgattcactccataatttagtacatactatttttctgggaatttgagttcattatggctgttatctttgagaaaatctttatggttgttctcttaagttatttataatactctttccaattaaacttgcattgttttttgcatttgtaagtctgattaactgaactcatataaatggctgaaatcttgtgttgcaaaatgtaacaaaaatgcaaagcctgaactgtgtaaggacttgggatgtggagatgtaacatctaaacaaatcagatgcaattttgaccattacttttcaggtgtaattttctcctgtccatgcttgagaaaaagaatatctttgagcattactttttgtaaatatattgtcgttagagtttataaatcctataatgctatggaagtattcttaatgatgaatttactgatgtagttctcatacatccaactttgatagttttaagaggaggtaaatttagaatgtttgacctcatggattcttaattgtcagtcaaaaaggaagagagggaacaactacttttatcatttaatctgttctgttggcattgtgaattttattgattcttgattgagctgattttggtatactgttaagtgctagctatatctgttctaactaccattactttatacatttcttaattatacaaaaggatttgatgaacgggatgtgtgcatttgttagagcagcttctgcacacagacctgactgctgatgcatttaatacagagactttatctatcattatgtatgctcgattgcactgtactgtttgaagcttgacctgcaacagccccagtgagcataaatattggaaacatgctaagtcagaaaactatactagtttttttttttgggtatggtacttaaaatccatcatttttactttggttcct

SEQ ID NO: 2609 - DNA, 649 bp, Oryza sativa
actcatgctagataatatgcactggactagtagatgaacaatatagcctaattcaaatacatacaaaatgttaatgaacctaaggatccatgggtattcatcggtttctgtggctttcatgttatgtgaaagttgcatcgctacctttgctcctgctcaattatgcaggttctgtggatatctatctattgatctttcaaatggcaaccccaatatgtgcatcattcgtcgaagaattgcattgttacttggacaatgtgcttttgaggttccgttattaacttcaatattttccctcagatattaaacagaaattagaagcagagaacatgttaaatttcctacttgtgtgtctgctttaacataaaaaataataattctacagataaagggcgttattcagaaagaggtctgcgatgctttggttggacttcttggggatcaggacatggccgttagggtatgtatcatagttaaaaaccttagcattaaaagcgagaaatcctttttctttagtttactaattctgctgtcaactttcagctggcagcatgctcttccctatgttacgctttccgagtttttggcatctgggaagtagatttgcttgagtgtattcctacatgtgggcaatgtgcttcaagttgat

SEQ ID NO: 2610 - DNA, 564 bp, Oryza sativa
cgattcatcgcccttgaccatcccaatatagcaagctccatcgcaagggccttgtccaatgcgatcgtccagctacagagtatcccgttatctattatgagcaaaagggatcccatcttcaccagtgccttttaagaggatctcttccagttggtatatgtcatgctacacatgagctttgccttttatccccaatcccattggcagatgtacctttactgcgtcgctgatgatcggcccacagtgagttcactgaatgccctgtgctaagattcgttgcaactcatttctagacagctaagcattccactccatttcgggtcatctatggtaaggacctgctagtccttcatgtctatgaagctggttttgcttgggttgtggccatcttcaatagcatgataagtttctggtggagattgcagcagctgtggtaggctcaaaccaccatggtgtttcaacacgatggccagcactgcgatgtcgatttcattgtcgatgagtttgtttggttcaacacacaacactggccagcctgctcttggctaccaatacatgggtgca

SEQ ID NO: 2611 - DNA, 653 bp, Oryza sativa
aactcgttttgagtttatctccaaaaccgagtttttgatttcccggagcgatttcttgcgggaggagtccgatctattcaacccaaggctataaataggaccccctagtcctcctctttcgtttgccccctctcccgtgatctcccgtgcctcgtagcgccgccgccacgtgctccaccccgccatcgtcgccggccgagttccatccgcgtcgcgccgccgcctccgtcgtcgccgccggtcgccgtcaccaccgttaggtgcgcgggagggtggagaagcccggccgcctgacccccgaagccgccgaccaccgcagctccggcgccaccgccgaccgaagtcgtcgccgccgctcttcctctccgccggccgtcgtccgtcgtcgtttgtcgtatcggtgagcaccattgagttcgcaatgttgtcctctacgcgtatgtgtcctccaaaagtccggccgaccaccctagctccggcgaggtcgccacccgtgccgtggctgccgtcgatgacgtcatgacgtcatcatctcctctttttcagttttttttaatagattaaatcttcggaaattcataactaaatcatcgtaactcggttttgagtggttcaagttgctaaattcatctaaaatcatgatctttgtactg

SEQ ID NO: 2612 - DNA, 2042 bp, Oryza sativa
gaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgagatactctcaaatcattggttcattgatgtacttggctagcgtaacgaggcctgacatctcatttgctgtaagcaagctgagccggtttgtcacaaatccgggagatgatcattggcaagctttggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggagggggcgctgtttcctggaagtcttgcaagcagaccatcttaacgaggtcaacaatggaagcagaactaacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggggtgatagcattggactatgtccaaacggctagaaatctggcatatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcatttttatgatgtgcttctcttctttcctgcatggtaggatggcttatgtcttaatgtgatccgagtggcttttccaagtagagatgttgacctgcagaacatctcagaaggaacacacctatatgagttcaactgctagtcacagtctatgaggtttgggcgatctctagatactcatgaaaggcctggagtttgacttatatgctccaaacagaggggatgcgaacggcagcccagtaccagtcaaggttctgagtgaaacctgatcacacaaaactcacaattcaaggcatagtccattgttcagttgtggtctaatgtagctcatttcctaggtggaagttcaacttaacagtctccaccaaaaccctggtatatcaaacaggcacaacattgagaacatttcttatgagccttgaaatttggtggggattgttaaaataattgggctaggcccaacttataatattaaatctcaaaggtccataataagtgttgaggataataataccacctcaggatttaagcgagaaatatcttaacctaaatagggagttattggaggttccctgttgaccagttgaggtgggggtcggaatgccacacgcgcgcgcgccgggccaggccgtgggcgtgggcgtgggcgtggcgtggctggctggcggcgtgcatgcgtcacgtcgctatgcttttgcagccactaacccacgttcccacgattccctccacaacagcgcgtccacgttctttctcgtgatagataaggaggccgcgagtccgatccggtttcatcgcttctttcccggtgttagtttctccttctccgcgcctgagttgctcttgcttcctcgcttctgatctcttgagcgcacgagagattggaaggagcagtgcctccgaaaccacaccttcgcctgagatctgcaccgggtaggcgggtgatcaggtttttggggagtgcctcccgcacgaatgctcatcgccatgtctggaagttgccgcgccactgctgacgtaggtggtac

SEQ ID NO: 2613 - DNA, 11959 bp, Oryza sativa
  unsure (1)..(11959): unsure at all n locations
actttttggattaaaatatgccgattaatgactatatttccaacatggtacacacgtgagattctttctggaaggacacaatttccacggagactacaccgagtcactggcaatatttgccgatgttgaactgccttttgcccaagctacacttcatttttacatagcagggtacactaggaagtaaacaagctcataaatgactgcaaattaaacgttactggagatgaaattttttgtctatattgttactgcaagagctttcacctctgattcagatcagttacagacttgcagtgagttgattctacagaaagaggacaagcaacttttaaactagaaatggacggacggacgcctctttgccagggtccttagactgaagaattgaaatgaaggaaggtgcatagcatagcagctacacaaggagacgaatagcatcgggacgtgaaaaagaaacaaacacatgtaacatgtaacactgcaaaatcaaacaaattagcgccatgtgtccaaatggcagagctctgcagccatgcaaaatatgcaattcctcattcagaggaaagcatcctactagccccgcaaccacaacacctgtccccaacattcagagcaacctactgtgtctgtgtgcagtcagtcaattactgtacacaacaagcatctacagtagctaccaatgcagcaaccccctttcgatgaagaatcatcaaacaaacagttcatccttcaaccaggaaaaatattcagcagtcactaatgctgtagtactacgtacagatcatgtgaaacatatgtgttgtgttgcactgtggatgatggtttgatggctgaccgtgatgacctcaatatttgagtaaattagtcatcccaattaagctcccatacctgactgccaaattatttgttttgtagtagatcatactcaccaaaatggtttatcacgagtctgttttctgaccacatttttgtctagacagtctgctgcaagacggtagttgcccagataattaggccatgtttagtttctaaaaactttttcctaaaaccatccaatcgaatcttgacatatacatgtaatattaaatatagataaatttaaaaactaattgcacagttagggagaaaccgcgagacgaatctttggtgcctaattagtccatgattagccataagtgctacagtaacccacatttgctaatgattgattaattaggctcaaaatattcttctcacggtttctagataagttatgaaattagttttttcattcgtgtctaaaatcccttccgacatctgatcaaacgtccgatgtgacactcaaaaaaaaatttcttttcggcccaacctgactgactgtcgattagaccgactgacgtcttctgtcaccaccatgatgtccgtccagcttgttcacattcctcagcagacagacatgcaatcacaacaattaacactaggtttatgtaccatatagtggtccatgatgcagaaatattaatattctcaactctaaattctactacaaaaaaaaagagtgacatgttgcttgtagtacaggcagtacggtttggttgttaaccacgtttctcatctactttgcctgcatttgaggtgctagagtgaagataaatcctaggttgccagattattcaaatattcaatcaagataaaagaaattccaagcttttccatctaacatctccctcattagaccagaaacatgcttgcttgcaagctactccctccgtattttaatatatgacgccgttgactttttgacaaacgtttaaccttttgttttattcaaaaaatttatgtaattatattttattttattgtaacttgatttatcatcaaatgttttttaagcatgacataagtatttttatatttacataaaatttttgaataagacgagtggtcaaacgttgattaaaaagtcaacggcgtcatacattaaaatacggagggagtacctgacaatgcaaccgtccacggactgattgcatatcgtacaaaaatttctgtaacacaaaacagcactagtcaaacctgaagctttcatggaaccaaaccatctctagaatgagcttgcactccaatttgttataatatccaataaagcacacactctctcctggtattactgtagtaatgatcaaatttcaatgttcagaagaaacaccattaaatcatgaattggatttaaaacatgtgtccttccatgtaacatagtcctacagagacagctgccaacagcagtcgatgcaaacttctggttttcatttggtataacttagaaaggatgaaatgtgcaaagatattgcaaatagaaatggatattgtagaatcaaatgcgaactgtttcagagctgtccacaagaatagatataatatttctttataatactaacagattattcccaagtaacaaaacagcatgcagatcacatgagagcaatgcaatgacgaaaaaatcattagtagagataatcctatggatatatatacaatagagcactactaattgcacgttccatttccaccactgcgcactacttgatttttttttctttcaggatcttctgatgttacaaataattattcccaggttaaaaagaaaatagcatgcagatcacatgatatcagtcgatgaccaaaaaaatcacaattagtagatagaatcatatgaacatgtatacatctctagtagtactaattgcacgttgctaatatgaatatcagtcctcccaccatagcgcactagttgatgttttctcagtatcttctaatattacaaataaggagacccccaaaatttaccatgttcttaaatgtcacagtatccataattaagtctgcattcattttctgaaatacatagtcatcatcacaataatttgaccttatctctcttagatctttactgattccccttccaaaacttcttaaatattgttgaacgtcatcgccctcaacagtttttgttggttcatgagtgaaggagaaacaagaacttctgccttttggtgtgtcaaagccatcgagatcatcactggagctatttgtagttcttgaaacgggggtcatcatagtatgactataagtatggcctccagacacatcagatccagttaagctaactgagcactgggtttggttgtcagattcctgggagggcaaaaaatacttgttacagtgtgagaatgatcgttactatccacatcatatacctacttgtctttctactaaaatgctgctggcaaatcaacaagagtatgtaatatgattccatacaacacattaagtacaatgtagattgtagacaattcaggaatatttgagtggataacaataggaatatgaaaatagctacaagatgccaattaatggagagcaaagactgtactatttctgaaccacatagtaaaaaaatttaaatgtttaaaagaatgttgatggaggttgttgggtacttcggttgatattcctaaaaagtacttcatatctcaaaacctcagtgaagtgaaccagcattgatttgctaacctcattatgccaatgacgatcagttggatagtgggtttctgcaatgcttgatccacctttgtcaaaagatgtatttctgttcttttgtgggatgttcacaactgagtttatttgagggtcctccagtgatgagaaatcagtgctatccaatgtcgagatcgatacacattcctcaaaataattcattgcctcttcagccaaatgcttcgatactttcagtcgttctacactactctggtaccacaacatggaaacaaaggtcaattcaaatacaaagaccatctatatttatgagcaactgcacttatcgtatctttaaatttcagaaaactacaactttaatgataaaaccatctatatttactgtagcagcatactccctctgtcccataaagaagtaattcctagattcccaatgcaaaactaaagagatagataaatgaccaaaataccccttattaatagcatattagtattgatggttaggtaggtaaggagtattgaagaaataaactttttcgatttgtgaaccaagtgtgaatgagaaggtagaagttgatttattttgtgacaaagtttgaattccagaagttgatttattttgggacagaacgagtataacgtaaaagttgtagttttgtgataatttttcacgttattgttgcagcaaactgatacttttatcactaaagttacagttttcggaaatttactcttctttaaaactacccttaaaacaagcattgaaaaccaaattcatggtggataacagaatgaccatgtagaaatacacaataccatactttcttatacttataagtcaaaatttaaattttcagctttaaatttggagttgattttagggttttttttcattatagtttattttccagatttttcttttagatcgctagaaacacatatataaaacttttattcatgaattatattccgtttaccaatatgccgtttggccaaacgatggccccgtttacctatagccatggctctagccgatgtcgttgaaatgtgggatgggaccaagctgtcagtcactgtcactaaagacgcttctacctccgttctaaaataagtatagccgtgaaaatccgtgtctaacgtttgaccatccgtcttatttaaaaaatttataagaaaattaaaataagttagtcacacataaagtattattcatgttttatcatctaataacaataaaaatgttaatcataaaaaaaattcaaataagacgaacggtcaaacgtgagacataaacagtgtaaaactccacttattttaggacggagggactactactaaagagaatcccataaaaaatgttatacaaatttacaagctcaaaaaactaaattaaacaaaaaaaagtcaaaataattcatcgtgtcacattcacgtacaaaataaggcgctgaaaattttggtgagcagaaaattaaataactagaccaaaaaaggcaacatatggcacacaaaaagagaagagaactaaattagacaaaaatttagaagaaaattagaggaacacatagctaaattagaaaagaatttagaagagcacaaaattaaattagacaaaagaaaaggagaagagaactaaaatagacaaaaacttagaagaaaataagaggaacacatagctaaattagacaagaatttagaagagcacaaaattaaattagacaaaataaaaagaaagagaaataaaatagacaaaaatttagaagaaaattagaggaacacatagctaaattagactagaatttagaagagcacaaaattaaattagacaaaagaaaaggagaagagaactaaaatagacaaatttagagtggagatgcgggggatcgaaccccgtgcctctcgcatgcaaagcgagcgctctaccatttgagctacatcccctttgatgtttgaaatgaaactaagaaaatcattatgaatagatgtttacttgagcaacagcaaactgtttagtcgcattcggatattcatcaaaaattgctgttctcgttcagaataaagggaacattcaacaaaaatgtttctgctttaacgcaacacaaatggccaagtgaaagtgcatctcatgtttaggctgagtccatcaatcgtgtgtttctaggctcgtggatcaccaatagttctctaggctggccggagtattctagattcgaatttaaacatcaaatttaaatttttacagttgttttactacttcctccatttcacaatgtaagtcattctaacatttcttacattcatatttatgttaatgaatctagacatcaatatgaatatgaaaaatgttagaataacttacattgtgaaacggagggagtaatatattgtagctgcattttctttttttgtaattgtagccggtggtttcggaaaaaaataaccggttattggcaggtaaccatcattgatctgaactcaaatatttagtttgaaagtttgtccgataaaggtttggataaatgatgttcccaaacgccaaatacttattactccctccgtttcaggttctaggacgttttgactttagttaaagtcaaattgctttaagtttgaccaagtttgtagaaaaaaacaatactctctctatttctaaatatttgacgccattgacttttttaaatatgtttaaccgttcgtcttatttaaaaaatttaagtaattattaattcttttcatatcatttgattcattgttaaatatacttatatgtatgcatatagttttacatatttcacaaaaattttgaataaaacgaatggtcaaacatgtgctaaaaagttgacggtgtcaaatatttagaaacggagggagtaacattttcaatccaagaaaaaattattatgaaaatatattcaagtttagtattataaatattactatatttgtctataaacttagtcaaacttatttcaaatttgactttgaccaaagtcaaaacgtattataacctgaaacggagggagtaattattattaaaaaatagttattaccaaatggaaagtatacagatcatatgccatcacaggaagtcaaatcttgatcacacctaaacgcaatgaagtgtgaggttgggcctacacatgtgtccgtgctgggcttgaggtccagcaagcaacacgacggcccaaacaagtcgctgacacctcacgctgtggagtggatccactcaatctgggccacacaagccttatccgacggtagcccagagacccaagggggctcggagtctaaaactccgaaccccctttgtgttttgaggcgcagcggattagcttatctctggctgaatatcatcaaaatttgtatattttccaagactaaagtatctttgtttctagacatgaacacgaaaacaccatgtatgcattagttacaggaatcatgtaaaagaaacatatttgtttgatatttattccctgaaccttcctaaatgataggtgtttcatcatattccagtattccacttgtacaagattggcctatttctaaccacatgcgcatgatctgtgagactgagaccgtatgaacttactgtcggttgcttttctgcatataaattcagtacgtctcctgccgaatgtctagcgttttttcttctagcttgtcaagactctgatgacatatattgttcttatcagtcttcagcttgtctcaaaaacgattcttgccacaaaatgtgtatccatggtgcaaattgtgtaggtaatcataaagctccttgctgacctttagaacattccaattttaagttcagagaccgcagatggttctattcatttcagaaggcccttttgcagtcatacaatgagcatgtgacacaattagaaatgtagacaagttgatttccactcttctaatgtcccatgttccatatgccatctactatggaagtccaagaatgttagaatgattgacaggggctagaaccaacttggaagttaaacctgacaaatggctgatcaaatctgtggacttacgtggattgaagagaggagttggtagtggctgaactttgctagtcaaaaaacgaaaaaacaaaaaagatagtatttgaacatatttaaaacattaacaatagttgctacctcattgtcaaagtttgtggtacagttgcctgtgggaaactttgaaactatgaaaactgcaatgacataataataatagtcatgtactcaagctgtcttcagattcaggtatttggtatgcattgatgtttttttggaatatgaagaaatgcattatccatgtgattccatattgccatctacaatcacagtcaagtagaagcggccatgaacttcgcaatgattgaagagggagcaatgcaaaggctcagcacttcacttggcaattagtttatggtcaaacatgtttacttaggagacagatggtccatggccagcctcttccatgtggacaggcatttttatgtagtactggatgcatcatggcatttccacttggtatgattaaccttggtctgtcctgcactacaccgtcggctgatctttcctcctggtggcgctccgcgcggaaatcaatttctaaacaagaccgtaagacttttgatgctggagttatcttggtgacctggcttatatggaaggaacgcaatgctagaattttcgacaacaaggccattctggcggcgcacttatgtgcagcgatggaagatgagtggaccacttggggtgcagcagggctgctgtgtccactgcaagccggaagcaacctgatggcgagagagcaacattaagccggtggtggtagctccctgctctgtagtacagacgtgctttaatgtctggcaggcagcatcctctgtagcctgaatctgcagcttgcacctttgtaatttgtttcttgtgacttttttcccctatcttaataaacttcggctggcttccgccagcccggcgaaaaaaatgattaactagggcatcccattagtaagaattattcttaacatagtattcaacattgtttcagttttgcaaatatagacctacaattcgaatgtttcagacaaaatgtagattcaatactgaattggataattttattctgaaataagcattgagctgaatatatactatccaaaatcaaaattcaaagaggaaggaaggaaggaaggaattctgaatttctgatgtttttgttaggcttgcccgggtctaaaaacttgattctgaaactgtggacagtgctatctgtgtacgatatgtttgtagccgatcggccgtactctccacgacgaagttagctgctatgctagccgatctgaatctgaagcatgcatcattattgagattcttatacatcctgaatgtactcttgaaaaaaatgaatgtccgatctgctcacatgaccgaacgtattgtatttggttgtttgtatacggccggcctgactgcaactctgcaagagatgctattagtcaaatagaagcatctctcacatggtcggcactcacgcatatatccctagaaagaattatggatcatatgcttaatgtgaagcattttaatggattagatcatctgagacgctcaaggaaaaggagatttttcagtcaaagagaaacagcactattattagcttgtcaatttgaggtctgcaaaacaaaactgaggtctcagggtggcatgttccagacccacttgatgcatggctcctgtcttcttaacaaaatattccacagaagctaaaatttacagggaaatgtgtggcatgttctctgcatgttcccaagtagtggatgcagcgtgcctgcacattgcatctgcatgttactactacaaacaagctagtctgtgtaacacaagttacaagaacaatatatataagccagcattgctcccccttgatgcccaactgccatacacgcacacagtactgcaactaccaccacatcacagttgatcaacaaagcatcatcaccatgaagaagaaggctttgcaccgcatgttcgctgccatcttcttgctccatattctcctcgctgtaactgctgctgcatcaccaaagaccagcaccggcttgttgcgtgacggcaacaacaatgcagtagctgctgttgctgctaggagtagcaggagattgctgctgcagcaacagcagcccagggcagcggcgccgacggcggcaatggctaccaacaccttccgagtcaatggcgttcatcaggcgaacggcgagcccaaggtggagttcgacgccagcatgaagcacaaccccgggaccaacttcaatcccaggcacaattagaagcatccggcccggctaccttctgcttctttctggattctgctctacatttttagttagcaaaagttttgcagatgagttttatcaacttgtagatagttttaacccagctttctttagtacaattaagatcgtgtcgctagttttatcattagttccactacactgctagcttagtagcttgtagcttaatcagctggatgactcacgttctggccgttaggtaagctagcttaatcagttaatctgctgtatccttcaattcaccgagaagaagcaattggagaattaacagcaatttattgtccgtcgttcaaatcagtatgtgaatgatacttgtgggctcttttcggcttcctttttctccccatctgtttcacaggctaatgggctatttcctgtgaccatgctgcctagactggaacaagaatcaacagaaacagcagtctgtaactctgtattcctgatccacaattgctcaggatgcccatatcaaagactcaaagttgtgtgttcatatacctgaagcacccagcaaatatatgttccaactggcttacttttactttgttaagctaggagatttttttttttcaggatttctgaacaaacaataatcttgccacagaggacatggtgtacttgtattcacaatgcagggtacagacttcacctcccctgaattatccactctgagtctgagctaacaacgcagccacatcctcagaatgaatgaaggaaaggaaaacagcaaacttgcatagcaatcattttgaataaaaaattaagtaaacaaataaacttgaatatgacaaatatttgcagttcacaacttcaagtaaggatctatggatatatggcttctctagcaaactaacagagccacaggtaagttctaccattgaggagcccaaaaaagttctttcacttgggcacctctttaagtaacaaatgtaatgccgacatttgtttgcctcaggactaacaataagatctggctatgcaaacaaaagtaaagtctaactaacttcacataatcaagaagagttgaacaaactcctcagaccaaaaggaacagttgtacatcacataagccgcaagcctatcctacaaatcctcccaattcataagcattaatcctgcttcacgatgcaggactcgccaactatcagatcaatcctcagggattattgtttaatatacaaagttagcacaaggtgcttcctttatagcccaacaattgttgtagaatcatcattgccgttgggcagatggagattgctgaacctgcactggtgggaagaacccagcacctggtggttgaaaaaatccagtcgaggtcggcgattgctgtggtgcctgtggagactgctgctgctggggctggctctggttctgagattgtgtaggcagaggcagaggtggaggcacacttagtcttggaaaacctgctgacataatgttgggcaatgggggtggaggtggcgcagagccactcaccatcccaaaaggtcccattccaaacattcctccagtattttgaacaaattgtggcataagtggtaatggaggtggaggtggtggaaatgaaccagctgcttggtttgcttgggttggtggctgtgtgcctccaagagcagctgttgctccaatctgtggttgcacctgcggcagttgcccaaagaatgggggagcactcatgtcactagcatgaatggggttgtcaagcctaggcttcttattgctctcaaagcctggaggtcctgcagaaagatctccagaagtcgaaccactattccttgcttgttcagcagcaagggaagagaaaatggaggagagcaccttctcaggagctgacaaagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2614 - DNA, 1251 bp, Oryza sativa
gagatgatgtggagttgcctgaggaagaagcgaatgctaagaatgtaagtatgggcctaacggagttggcgaggctgaaattctatacccgagaggagtgtgaggaggctatgatacgcagtggattgaacccaggctggttggagtatgatacagaggatgaattggatgagtccgcttcgactccgatgatgatcgtccagtgcgtaagatgtcagagcatgaaaggactgtgtttgcgaaactggtgggtagaaatccggaaataacacaattcgaggatcttaccagatctgggctagcaattgctgatggggatccacaatatgacggtgccttcgaaccaatgtgtgatgaaccaaggaaggggttggagtttcgattgatggatgatctgaaaatatggctacagagttattctatccgtgtccaccggccgtaccatgtgaaggaatctaacgcgtcagtaaagtatactgtggcttgtctcgatcgccattgcaaatggcagattaatgcaaggaagagtggaggagataggtggcgggtgactagggtgggcgaagaccacacatgatgtagtgcggaagtaaccggcaagcatttgcaacttacttcaaggtttattggaaacaggttacatgcatttgtgcgagctgaaccaactttatctccagcagcgattgtcgaggcagttgagcaaatatggcactatcggcctacgtatggcaaagcatggcgtgctaagcaagttgctatgaaggtcatttggggagattgggacgaggcgtatgttcgcttgcctacactgatgcgtgccatcaaagcaaagaaccctaccatgcatttccgtgttgaggctcatcccgagaagtccaggatggtggatggagtacagaggcgagtatttggacatgcatattggatatttggccagtccatagaagcattcaagcacttgaggccggtgctagcaattgatggcactttcttaaccggtaaataccaaggtacattgctcctggctccgaaggagagggcggcaccctccgcaacgccctacaggttatcggtggaaagagatgaaactacggtgttttctttcaaaagcgataacttaacatggattattttttatgcagagactacggcagcgatgtcggaagttggcagcaaggttcggctgcaggtcgactgatgtggtcgaacatgctcatgcccaccaagagggggatgaagaaggggaggtgg

SEQ ID NO: 2615 - DNA, 34749 bp, Oryza sativa
  unsure (1)..(34749): unsure at all n locations
ggcagattgcgtgtaaattgcgagacgaatcttttaagtctaattgcgccatgatttgacaacgtggtgctacaataaacatttgctaatgacggattaattaggcttaataaattcatcttgtggtttacatgcggattctgtaatttgttttgttattagactacgtttaatacttcaaatgtgtgtccgtatatttgatatgatacgctaaaattttacacccgtggatttaaacgcagacttaatttctctaggcatttcttaccgtaagcaatttatctgtccaactatatataactcttactacatacaaaatttgtgtgttaaccagaaaagtagaaaaaaaaagcttcaaccattcacctgagtttcgagaatacgcatacgcataacccggaactaaaaggggttacaaaccgggactgatgaggcattcttcagcagtgtaagcattgggatatttacaacaggtttacattaaaaaaacaaaacggaaaaggtaaaaacttgggcactcttgggaaatggatttttaatccctcgtgaggatatgtcccctagttattgcataccatccaatagttatgattttttttataaaaatagtaagatagattgatatattatatatcacgaatatacaagtttaaattcaatcttcctaagtatacgtgtggtcacaattatatttttttcagctcctagaagtcaatttcaaacttgcatatttgtgtagtgatcgatatatcatatattaatctattctatcaattttttaaatttgggatttaattaaagaatatgctataagtccaattaccgtgataaacaaataaaacatggaacaacaaaaaatgaattagcaattcgatttgtatgagctcattcccacaataacataattattagctagttattttttaaatctattgcaaattactagtagttgatatttggaaattcagactttgggaatttttaacatataaacagtaaatttttaagattttgttccacatacaacttggtaaatatgacttttgaatttcagacatattaatccaaaaataaaaatatatttctgaattacataaaatgggaaatttattgtacacgcaatatctatgtaaagatatataaaaatcggaaccgattctaaggaaggatgcactcccatcatttttgtctaaagatgattgattataagccataacacttattagcggcttaaaaaataatttatgagtaaaacttttatatatgtgctcttagcaacttaaaaaaccaatatacgttgaataaactatggtaaaaaacatcacaatcaactttaaaataaaatttaaattaacatttaaattttagctacggatgataattaagctgaatagcaaattatggttgaagacacctatagctagctgattaaggttcagagagatataaaaccccaaggccatatataatcaggttagtcttttacgtgaagctcaaatgatatattgagtctatttgggagtttctgacagttacggattattctaaaatctgaagctttccaaaccataacttttgatcgaaaatttaaaaagtagatgtagaatctagaaagaaaataaagtaataccataagctaattttcttagcttctcaagattcctaccactcgtttctcagaatttaaaagttacctcagacatgcgcattttgttgtgtaaaagcagtgtcagcactttcagaacgttacattgtctcaatgatcccctctgtacgtggtctaaaatggaacaacgtgtttgagatatactccctccgtctcacaaactcatttttttagtttttaatataacgtttgatttttcgtcttatctataattattattttcattgtaattagatgataaaacataaatagtattttatgtgtaactatttttttattttttttaaaaaaatagagatggtcaaacgttagatatagaaacccaaaactggagtctgtgcaggacggatggagtatatgttctcatactgtgcatatatatactttctacatagtacccactaacaattattacaagctaaagctcaacatgcaagtatgtcacatcatcacccactagcaattactattttagctcattaatttaaaatcctatgcaagtatgtcacatcttcactcactagcaattactattctagcctattttattatattatagagatcgacatgtatgtgtcaaatcatgttcctcgtattattttcttaatattttaactttcatcatttcgacaatatttaacatatactcatccataaatcccgcagaaaagcgcggggtatcacccagtatatatgatggtaggtccactagcttcatccaaaagctatttgccagaatgcccacatgcatatataggcacagtgagagtgatcgagaccccaattgatcggccaaaggtcagcaatgtttgtacgtgcagcctataactccatgtgtagtttaaaatattgtaaatgatgaaataaaatccatatatagatgtacatgaccttttaatataagaatgaaaaatattccaaattgcatttatttattatgatatatatagtttggtagcaaaacatataatgacagatcatgcaatccagggctcctgtagaaattgtgcagatatacaggagttcatcactagtatattatcagtgcatcacacggcaggtcacgaggaattatattattagtgccatatttatgcaccatcgatcataataatgatgtgaatgatagatgatcgtgtatcttgcatcttgtgggcgtttgtagttccacgttgtctcagccccgctcccactttaatggagtcgatcaatcacatcatttttctcatatttacaatatcccacgtgcctcctacaatatcccacttacttgtatactgtgtgtatattacaatgggaattaaggtaaagaaaatcatcatgatttctgcgtatatttgatactaacaaaaaaaaataatgagttggtggtgacggtggttaacatgtaggtcatctagcccattgcctttttccttaccactacctttttatagaagtctagatatcaccccgtttttaaatagatgctgttattatcttttgatataaagtttgatcatgtgtcttattcaaaatatttactgttaatatataaaaaataaagtataagtcatgcttaaagttttattaattagtaaagtatcttacaataaaaaaggacacttctatatttagatgagacgaatgatcaaacgtcaaaccaaaaattaatgtcatcgtctatatattaaaatcagagggagtatatgctcacgctcactctctaaaacatacaacgcaagagctgaagagcgatgctaatcatgtgtatacataaatataaaagattttagttatatttttttttgcctttttacatactctcatactgtcgccgtagtacatggtgccacaagcatgggttcttttattggtatattaccagcaagtggtttgaactttgaaagttagatatgggtctttgttcatttccaggcacttgtcagcaagggagtattgtattgagtaacaactaatctgccgagcaatatttagaagatggagagtcaagagagatcgaacggggagaaaaggactcacggcttaaatatatatttgtgatataatattcatatttggtgttatgaacaggaggaccacgtactgtcgtgtgggaacaaagtattaaagggttgaaaggagttatatgtatatatacctattaatcttgtgataagtcgacatgacacaattatgtcaaaattaaatccataatttgcacgtttcgtttctattttttaggtttagacgcataaccttgaagatccttgatgagttagaaacttcacaccgtaccttataattcgagcatccacaaaatggtcctttataactcttcgtcataccttcactaccactcatatgaaataaaatacgctctctttctctttcttcttttctatgttattttgatgtgatttttataggatgcagacactaacttaggcgctgtttgtttcagattaagattattgtaatataaatctagattactataagctggattataataagttaacatagaataagctgtgagttgtttgtttttttaattattagagacatctaggggtagtgggtctttagccacccagtaatcaaaaaaagctcctctagaggagattattagattatagtaatctgacttatagattataataatctatcataataatttacttgtttgtttcagtttactcctaataattcaaattataataatcctaaacagggccttaatgtcaattattatctttatacattgtgaataggtagtttaaaattttggtacatttaccaaagaatcattttgattacaaaatatttaaacatcacttaattaattcaactaattaaacacggcaataataaagatctaaaaacgaaccgataagatcaactcaccaagcaatcgaccgactcagttgcgggttcacgatcttgataccaaatagagagttacttcctccttctaaagaaaccaaacctaatgtatgatggaaaataatacagtacaacgaaaacagaatagattatgttctaccctatactactttaagttttttttggatagggagtagtacacgaaatttgacaatttgacccttcaaaaactattttacaaataaaccgcggccaaaaacttatttcaaaaatgattattttgttccacgccaagtcgtacggcactaaacttagacatatcagcgctaaatagtacggcgctgaatgcacgttggcacgtcgactcagcctcccatccacggtgacacagcatttagcgccagttgatgtgatgctgatgtgtctaaactcagtgtcatacgatttgacgctgaaaaaaatatcatttttaaaataagttttggccgcggttcatttgcgaaattagttttcggaaatggtcaaattttcaaattttgtggggagtagtaggcggctaccaaaattcagatgggccgaatggatcaaatcatttatccgagaattgaacccgggtggtattctttttttgcccgtattaaagcctaaacataatccaacggtgctagtgcccgggtttggagagtgtttagacctaaacaaaatccaacggctgagatcatctgtcgcacaggccgacgaattaattacctctctctccttcgtcttcctccggaaacactcccctatctcgagctcttcccatggcgaccgatgcttacccagtccagctcctccaccgccaagcaaccgccgccaccggcggcggccaatggcacaacctcggcgccgcctacgccgccgtcagattcctccgcccgcagggccgatccctcgtcctgtactccggccccgacggcggcgcccagcagcgcatcgtgttcgcctacccgatcctcccgggcgacgccttcgagaggatggacggcgagacgctctcctgggaggagccggagtgcggagacgagttcgcgctctgcttcctcgacgaggccgcctgcgccgccgtctccggcgccatctccccggtgacggagtcgctggccgcactggacggcctcgcggagaggctcgccgggctgcgcgtggcgagggaggagggtgcccccgccggagtggacatcgccggccggcttgctgcgatcagcatgggccgcccatgaatccaccactgctaacctagggttctatgtgaatttcccttatgtcgcctcgccgtcgtcgtcttgatgtagaatttctttcagtctctctgtagcatgtaaccctgtacatatatctgatggaaattgacaatgtatagtagtttatttacgcctgcaatattttctttcatacttaccttgatccttggtaggatgggattaacaaattaattaatcaatcatgggtatgtaatggtatccagacctgtagttatcatcaaccagctgaagaacaacaattgaaagtagggagaaatgtttattacagactaaatggaaacaattacaacaggagattggtttcaatatgcagagattgcagctcactaacaccatgaatcacacagcagtggaacaaacaatataggaaaatataatcatatttaagcagcagttaacccaataccgcattcagattggatgatgctagcaaaaatacactctggaggaaattctagagatcaattacatccgcaacaacatcaacagcgggaaaaaggaattctcatttaagtgatacagcaaaacaactcagggcatcaaaagtaagatacatttgcaattcaaggagatagtgctcatttaccaagagtataaatcagcaaactaatgcccatttgctacacttcaaattttatcagggaaatatgaatcagataaagctttgagaattgtaatttcaataactcatgtaaatattcactagacacaacagctgtgcatcaaaggattcaacaaaaaaaaccaagctcttcttatcatcaagaatgcaccaatatactacatagcacttcatttcatattctgacatcttgggaaccttacctcactctcaaggagtgagtgagagggtaaaggaaaactcttctgtcaaaagagttattctgttccatttaagcactagtcttagaagtccagtggcattccgaacatgtcattgatctcagccatcacatcgcgggtagtaatagtgggctcaaagagaccactctgacattcaaatttggaagcattgcttggtttaacttgggctgctggattttcgcctggttcatcatcagctaatatggagaaaccactgagcagtgccgcttttctctctgacaatgcagtggttttcttgtttttaggtttatcacctttgaagttcagtggtatcccaaacatgttatttatatcatccatagcctcctttaaattgacagttggttcgaccaacccatggtggcaagcattttccactttaggctctccaacaacagctgatccaacaaatctatgaaagacagtgtcttctcgaagtccagatattgcaggacgtaagtcatcacatcttatttttgaatcagtttgtctcgaacagagtgaagtgtccttatcatcagttagttgcacagttccagaattgatcttaacaccattatcatttttctcaagctgttcatcttcatcatcaggcagtattgcaaaccctcccacgaatggtttctggaagtcaaaattggcttgctgctttgaatcacgcgatggctttggaggacatccactactcttatggctcatggcattacgaccattgccatgagcctcattttcatcaacaaagatttcaaatccacttgcattctgatttacctgtgtgttctccttattaaagtgcctatgctgcaccatattttggttgttgcagtaaggatcatcttcatctacaaagatctcaaatgcgcttgcctgctgacttaactttggattatcctgcttcatgtttttgtcctggagtttgctgggtccactcttgttaggttcatcttcatcgacaaagatctcaaatgcacttgcttcctgattaaaacttggtttatcacgaattgagcgcctcttgagcttagtttctggttccaatggctccaaaaacatgctactgatagcatccattgcctctttagtgtttatagtgggttcaacaaggccatgatggcatgcatcttcagtttctgatttcccaaccaatgcagagcctacaaaccttacaactacagtatcatcactattataacgagacaaactcattgtttctcatgaagtgcctctagatagtggacgcctaaaggattctgaaaacccaaatgaggattagaaccacttcctgatctatgcactggattggacttcggttttgtacaacttctgctttgacctgcaacatattccaacatcaagaaccattccatgaaacaaccaacaaatatgcaaaaagacagttcaaaagtatggatcttgaataatgatagtttaagtgctgccaagaaggtatttttctttcatagtcttgatcagtaagcttcgaacagtaagaagcttgataaaggtaacactggtcacataagaaaatattgatttgcatagcctgatacatgtttttttccacttagaagtaccttcaacttcgttctttgatatagcaatggactgaaccttgttaggcattcgttcctgctgcactctagatttcctcctcttgtatagttccacgcgccgaataaattgttcatgtgctttctgcagctccccaacaggctctgcaaggctattgaatacattgataaatggtaagtacctacctttaatttgcaaggtacttcgtattgatattaattttattgtgaggtttcacttgcaaactgcaatccaaggatttgttactccattggtttgcagtaggcggatctaagatacgtccattgacaattgaattgagtacatgaaattttttttatgtgtccttacatatcagatgtttcctttaggacatatgagatgtagctgttgaactaaattttaagcaatgataaccgcaaaatatggtaccagcaactaaaatggtggtaaaaatcttacttctgggttcccaagcggtacatgttctcagcatcctcaaacctcttgtgcttctcataatacactgcataagccatataaaatgctgatctcttaaggcctattctgttcttttccatcttctttagcaatggctttgcatctttcacatagtccatctacaccattgaaaaaaaatgcaaagatcacattaggacctttcagtccaagaaaatattcatatcaaaagatctctgttgtgcgtaacaaagcctagataataagataagaaaatattcttatcaaaagattcatgctgtgagtaacatgcaagttatagtatgagcaagcaaacaatagtatgaaatgaggacatcggattgaaatcactatcgaactactgtagattcaattggcacagggcaaagctcgagccccaaacaaattgattttggtatggaactgcagccaatgaacctctcaggctatctcaacagatccccaacgaaatgaaatccactatatatgacaacatcagtaaaaaggaaaggaagcatatggcggatggctggatgtagaagaaggtggctgaccagctggatccagacgcggaggtagcgggaatcgtcgcggtagcgggcgtcgtcctggaactcctgggcgcacttctgcaggaacctgggcagcttcgcccgcagcgtcgcgggcggcagcgccgcctccatcttcctcatgcccctagcaaacaacgaatcgatccatcaagcaacatgcatcgagaagaggagaaggggaagcgattcggagtggtagagagagagagagagagtgtaccggagccatgggcggagggggtcggagccggaataggagcggatgtcgcccaccaccgccgacaggaggtctttctccttgtcgccgccgccgccgccgcagtgctgctcggtggccgccgccatgggaggggtggtggattggagcggcggcccgccggtcggggtgagcaacaccgagagggggggtttttccgggtttgaaatgcaagggtggctagtttgaaatctccttcactcgtgcggatgatgacaggtgggcccactaccatccttgacatatgccccacctgtcagcaagacaactcttgtcgccgcattgccaaaatccagtaatgataaattttaaaaggcagttcaagcatgggcattgcagatcacaaatttacaatcaaggtaagataaatgagcagccccatcgtttcactcatgttaatacttataattcaaaatttaaaattaaaatttaattttaaaattgattatatgatttttttattatagtttattttatagcatttgcttttgaatcgctaagaatatgtatataaaagttttacttataaattaaattttagttgctaataagccatacagataagcataaccataagcaaaaggatgacactgctcattggttccaacttccaaatttgttcaaaaaccttctgcgtacagtacaaaaattgatatctgctcaagatttatttaagtaatactgtgaccaaaacaaccccacaagtcacaagactcataatcaactctgcggttcgacctagaagacataggtttcaagccgttttgtggaagagatcctggagatcaagtatgtcagcaagaactccagctgcagtggtatcattgccagctccagcgccctgaatcaccagaggggcgctctcgtagcatctgctgtatatctccacctgcccaagaacaaagcagcgtcacttttacgtttcacatcactcactaccaacagtaaaaaatcacatatcaaacattctttaatcctctcaaaacagaaaaatggatttcatcaatctacttctaacgtgttataggccaacacaaacaatgtctttggtagttttagtgttccaacttccaagctcgtttgaacaacgcaaagaagaaatggggaatggtatgccaatacagaccctgctcacactcgtaggctcttttgttttcacctgaaaataaccagcccttaaggctaccaactgcacagtgccgcttgacattgaataaaatagaaatagagaaaggaaaaaaaaggattagcataccacattgtcacttcctctcaacccttcccagtgcagagtttttcgggagttcttcaaggcccacttggcacctacaaaatggggatgttactctacagtctacactaccattaaaagtacctttacaaaatgcacagaataggcctacgtgtctctgacaatagtatgctttgagtatcaaaacactacttagtgattcagatgggcatagcacaataaaaggatacgtaccctgtgctttcaatcttacagacatagcgaagaacatttcctttcaaagatgctgcctttactctttcttcaatgcttttatcaagctgtactaaaccactttcaaggaagtcctttgtggacattgcatcaggtccaaattcactggggtataaactctcaacctgaagataattacaaaaacttagcagacctgatcttttttctatgaacagggatgtacaacagaacatgtgcataaataggctatgcatgattagaaaatttctgaataagtgatttaggggttaaaatatctcaaaatcaaagttcttgtatcatagaaaacaactgaactagcggccactcaacaaagctaatggctacataaactaaataacaacttccaagatttggaggacattcatttcattttcagactataagatacataaggtgtataattcatcgggatccccaataatcctgaacacaaatctatggtgatatccagtgacctgatattgtagaagagtgtctgtccttatccatagaatccatgtgccaagatattatagaagtagaactaaagagaaaaggatggttccaagtaatgcttgcaaactatcaccaagaatggtatcaacaagaaatgtatcattttaaaccaactaggttttttttgaacagccagaataacaggaaaacacttgctaccagcctcatttatgttagtgaaaacataagcccgtgcacaccaagctatgtttacacaaaacattagaacaaataccatcaagattaattatatgcatacattaatattctccatgctgatccgttgccccagaagcctagctaagatcaatgcctgcattcaaagatgaacttgttagacctcatcacctaattgacaaagaatgaaataatcaaataaaacatctgaacctgaacataaacctcccttatgccaatgtctatttgcaaggttattattgaaattccaaatagggtcagtgcatgatataggccttcctgaactgtagtatttatgatattgatgtggtactgaatatattttggatcaaatcatagtatgatacaattaagcacaaaaaatagatacacagcagcagctcatgatatattagttcatggacttaggagtagaataaaattgtggcaatggttaacaaaggcacagataaagtgaattatgtagagtagcatgtaattcatcagatgaaaaattaacctttctagctacgtccatcccactgagatcatcacgtggatctaccaaaattaaacaactgagtaagtgcacttatcacaagcatcagtagactttctgtaaacatgaaatctgtaattacagataaggaatgaatactgagtacacattgatgttataatgtcaaatgaatgaataaatttttagacctggttctgtatagccaagagacttggcagttttcacaacttcactaaatctctttccatcctccagctcactcatcacataaccaagtgtacctgcagaatcatagaatggaagtggtacattgctctgctatttggaaaacaaacaccttttacaaacaaataagataataactgtgtaccactcagactgccaacaatacgagaaactggatctccagaggcaataatacgggtcacagaagctattacaggcaaaccggctccaacctaagagtaggaatagtaaatatcagcagagaccctcaactcctttgcaataataaaagaaacttccaaaaaaaggctgtgcttaatcatatggccagagtcatatcatacaatcccagatcaaataaaggaaagaatttccatgaaaaacaaatataataacattcaatagtgaaacgaaggaattactagtggcgtatgcatacagtagattcaaatctcatgcgacggaagttggaaaccaacttttcgaaatcctcctgcatgaaaaaaaaaacacatttggtaagcatgtcaaaatgacaaaaacataccagacggaagacttaaggaggacattacataagcacaagtaagcggtttcttgtttgccaatacaacacaacatccacgatccacggcatcctttagcatgccaacagtatcataagttgcagaacaatcaactagtacaagacctgcaaaaaggattgtaagataagaaccgaagaagatattaatactccttttttttaaaaaaacaaagaactaatcaacaatcatacagcatatcaaagattccatctttttccccactggtttctatcccatagaaaattttaaaaaacttaaccggcaatgtattctgcttagggagaaggatcacagaccagttgttttcccaagaacgctggcagtgtcaatgactttcctcctagcctcagggttgttgaatagctgacattgccctgaaaattgcacaatccaaccatccattactttacatgtcacgtgtacaaatgcaaattcatgacaaagtaagctatggagaattctaaaaaagaaaaaaaaggaataacgaaatagaatggggatacctcgagagagcagagaagataagggcgagccggcggacttggcggcgcagagatcagcgaggagcgcgtcgtcgaagccgttggagtggaggtcgtcggcgacgagcagagaggagctgtcggcgacgccgagcacccggatggcgacgccctatacaagtatcggcgatgagagcatccaatcggagaggagggggagagggaggggcggtcaaacgaggtacgtacctggttggcgtggagagggcggcaggagaggatgtggcggaggaggtggcggccgacgccgccgcagccgaggagcacgacggggagcaccgacctcaccggcgccgccatttgttggggcactggtgcttcacagcttcaccatttttggtttcttcggccgtctattcggcccagcccacgcagctttttttttttcagatgacggcagagaagggttaagcattggccaatgtccctatgctttagatttgatttagagaatatctccatataacattgtaataaagaggcaaattgtgtagcacataaattatctaatcatgctttcattttgaagaattcttgtaactgggttgaaccccctagcttctaaacgttgttgtgaacgttataactgtgtgttttgatatcaataaagcgcgtcaaatggctaaaaaaaatcttggttgcaggagaggagaagaattgtggaatatacttcaattgcatcaaatcatatcttctgcaatttaaaactggaatcattttacaaagcacttcattccagaaagggacaaatgacccacaactttgtgtggatattttctctcatttgatagtgtaatccataaatttactcaaaggtagaaaacaaaacccaatgggtacaatcaattcacatacaagcacttagccatacatgctctttccaacaaatacaaaaaaaaattatataaaacacataaaggtcaagcatatgctgcatcatgctaaaaaaaaaggataaggggcttatattcaaggttacttcactaaccatcgtggttcttccttggtctgacacttcgggggaaaaaaacatcatccatgccttgtgattaacatttggttcattgatgatggatgatgtgatcgtgaaggatcttgaactcttacaattccattatgaatgtgcaaaagtttcatatcatggatttcctctcgaattttgtgatcttccattatcatccgtataccatctatttagtctctctcgagcaatctctacctaaaaaaccaatagagcacaccattaaaatctaaaaaagtgtgctctttcaatggcccacatgtttttctagatagacccttatattatgtgaaaaagatatttaattaaatacaagataagaaaaaatatgagcaaaaagataataaagccaacctgtttttcccaatcagtcctaagtgtgatgaataaaagcacaagagtctgcactagtgttccaacaagcatgccaatccaaatgccctatagagccaattaataaaagtgagaaacacagcttagacctaagatttcctaatgaaatttacaatggcaaccaggaccttacctttacttcaaatcctagagcatagcctagtattgccccaatagggataccgatcaagtagtacgatgcaacattaacataggcaactatagtttgccaaccagatccaatagcgacacctataaatagttagaaaacgttgtaatttcaaagtgaaagtttaaattattttgatatattcatctgtcaaataaaataacatacctgagagcacaggttgaacactatttaataaaatggagaaagctagaaggggggcaagatcagcaactgcatctactacctcttgactttcagtaaatatgtatgcaaggcttccacgaaagaaaaggaagagcacaaaaaacacaaatcctatcaagaaagaagtggtgaccacattgaaaatggcaaacatagcccttcttgcactcccagctccaagttcatttgccacccgcactctaaaaatgtatatgtattaagtataagtcaaatttataggacataatggaatagtcagatgaaccacttaatgagtaacaagtaagatcatgaagttacccagttgcagccaaaaatccaatagaaatcatcatctcccaaccattgatattaaggctacaaattttgtaagtgaaaacaatagtgctcaataagcaagttcttcaagcactaaaggatagacacaaaacaataaattgatgtacatgatacaacatgcatgctttggctattattttctaaactactatgcaacaatagtatattaacatattaccatatagaaagagcatcaagagcaacctctgcattcttcatataaccagtgaggagcaccaatatggtgttgtaccataattctacactgaaaggcaaaggaacaacaagaacaaatcaatgagctaccaaattagctataggaaagaacttggttaacactagcttgatataacatattgccttttgtttgctatcatcaaaattatccagaatttcatatgtatacataaacataacagttacttaccaaagcatcactccggatgatatcgaaagcttgataatagcaccgagatcagtaaaagcagaggacgagaaccctgtccatgtttgaggacaaccaccaaaaaagacatatgcgagctgaccaaatatagggatccaacaggcaatgaccgtggagcccatcaccccagcaaggccaaggtgaaacttgaccaccatgagccatgataggaagagatggagtccaaagttgagcaaggagaggtaggtaacgatcatgttcttgctttgtgattgtagatacatttggattgttaagccccagacgtaggagaacatgatgggaatgtaccatagtgagatggtgccagccacaacagagatatcgggatcctgaccaagcgcaattaggagcggggtggtgaagaggtagattgggagaaggattactgcacaacagaagagaactatccatgagcgttgtagatatatgcctaacatgtggtattgcttagcaccatatgattgcccacacaaagtttccaatgcgcttgccatgcctatctgcagttacaataatgtatatgtatggttaactatcaattaattgttaatagtgaattgtttatgtatgcattttgtacaagatgatttgtaacaaaaaatgattgttagtaaaagataaacatttttataacttaaagtaaggtatgtttatgttttatttgtatattttgtaccataaagagtttgttattgttgcagtgctggttgtcagaggtagcacgaagaagataggatatggaagatccaagaagaataaagaaagagcacactatatagttattgcatgaagaaaatgccatgattaaggggtggatgactagatgaagagcctgcttcaaatattaattagtgttttgaaagttgaataatttgatgatccccttctcaagaagaaaaaaaaatgtgaggaggcaagtatcccatataattttcttccttcggtacgtttcatgtctttttttttacatcgagcctaactcttatctatagtacaatggtggaaaaaaacactttgaaagtataaaggcaaaccaaacatacatgatttgtacgaattaatcgatgtgcaaattaaattcaagaaaaaaaacttagtgacgctattagtatcgatagacataattaagtcatgactccaacattattaaagttatgtttttaaaattggcaaaatttactacaagatatccaaagagcgattttattagggatactcccaaaacgtggcttgaccagaggacacctaaaagaacgtgttaatttgctagaaaatatcatatctattattttatcatttttagcatatttgaaaacgaccagaatagcccagccctctcaggtgtgaaaaccagaccgtatccctatctcctagtctctctgctctctcgctgttgaaccctagcaagagtgaagactagagggaataatcgacattttgtatgtcttctcttttcttagctgagtacttcctcggtcaaaaaagaaaaaaaactaatcctgggtaggattaggttatttttgggatggagggagtagatcgatgttttaaggtgtattcgtacaaagccatgttttgatggtgcgtattagtaaataagggttaattactaccataatttgtgaatatcatgtatcaaattttgtctttaaatgttgctagttgcagaaagactaatcatgtgaaaaaaaatcgagttgaactgttacacgtactaacgaaaactaacttgtacctgtaattaaattaagtagtactacgtactaccgtataagcaagaataatcagcgttcatcaggcataccaggatgccgacgctcaagcgcatgaggacggtggagacgagggcatacgcggcgagctcggtggcgccgatgtgcccgatgaaggcctggctgacgacggtggcgccgaaggaggtggcgcgcgcgcagatggacggacccgccaccacccacagcttcttgttctcctccaccaggcgccgccccagcgacccaacctcttcttcctcctcgttgctgcctccgccgccgccgttgatcgccggcttaggctccaggagaggatccgtcagcctctcatcatcctccgtcgtcctctccattgctactctgctagctagctagctctccagtgcacaacaatggagatcgatggagttaacaggagtacgaatactttgagttgcagatattagtagctgtctgaattgaagaaggctgcagggagggaaaagaaagcatccatcgatgatgctcaggtctccccatctaccgtttaatggcggggccagagacgatcgagcgaggaagtacatgattggccctgtggttgctgcagatggtgggtaggtagggagggcagtgtgggaagaaattaataaacaattattcaagtcccgttctttttctccaataaaaaattagataaaattttggatactcgtgacacgcttttttgcgaaaattttatatataaaagttactctaaaatatcaaattaattatttttttaataattaaaactcaattaattatatattaatatcaacttattttacacttgatcatcatcatcttttatctttatcttgtgtgggaatactatcatcgattcaggcaggggttgtgtgtaaacataatgcatgtcagcatgtggcgaggagggcaatcacgtgtactttctcttttaaaagtcatacgtattctgtttccgacggatactgtaggtaatctccaccacgtacctccaccaccatcatgaagcacggccgggcgtacggaggaggaggagcgatcaagtctataataattaaaattaaaacttaattaactatatactactctctccgtattttaatgtatgacgtcgttgactttttaatcaacgtttgaccattcgtcttatttaaaattttatgcaaatataaaaatacttatatcatgcttaaagaacatttgatgataaattaaatcacaataaaataaatcataattatataattttttaataagacgaaagatcaaatatttgtcaaaaagttaacgacgtcatacattaaaatacggagtgagtaataactttttcgttttatatacatcaacgtaacttttatcttcatcagttttaagtccaattagaatttaactttttttttcttggatgaatggagtaatataagtagtactactagcagcgatgtggcctaccggtatcaacgtcatcgataaatggtatgtttgtccggcctcgctgctgtgctgcatcagtgcatcctcatgtatctgcgtcacggtcactggctcactgccaaattaattaaagtggttgctacaaaaaatgattcatcatccaacgatgccaacgaatgcatcccggaaaaaggagatcacgggaagggaaacattacatcattgcatggagacaccatcgacatcgagtcgccgtctcgtgtcggccatcgatgaactttttttcgaacctttttattttttttgaattttaaaaatgaactcttacaaaatttaatttcaaaactactccctccgtcccacaaaatcacaaaccctagaatcccaatgcaactttaggacaagtgacaaaagacaacaatgccctcaatacaagtacatccaatcattagttacaaataaaataataatacaagttgaatatctgcagccaacttgagtagagtagtacaagtagtacaccaatcatgggcaccaaatatctgtacaggccactaatccagcgcgccaactaatttgaatcaaacaacaccattgcttggcggcaagaaatacaaatttgagcacaccccagcacaagataccctataaaagctcaaaatgaaccattctcacaagtttccctcccaacttatcacttcatgagtctgcaaaaacaccaccttcatggctttagatctaaatgaactagcagatgagggagatgagcaagctgtgcctgaccttaatgaaccagtggcagatgagggagatgagcatgatgtgcctgaccttaatgaaccagtggctacagaagttgaaatgcatgttggtcaagaggaggatcaacttggaggtgatgtacagggaggtgccaaccataaccatccaggtgaccttgcaagcaagaatagtaaacgatcgatctttgtacatatgacttgcataaatcactctaaatctttggcatttttttttaaaaaagataccatgtgcattgatggaactgctatgttcttggttttttttctctttgttctttaccagctcgattctgtgaatgagttgggcatattgaagttcattcccttccataatatcacaagttatacatgtatctagctataactaatcaaatagtgctcacatgatgcttatcttctgtctacgatcaatcctcatatgctagattctacatgtataatttcctttacagtaccactgatattgagctagtattagtatatatcaaagttagattgcaccttcaatacagatcacaaaaatccctgaacttcagcaccaaagtttgtacaatgtagaaaagtcattcaagtatggccataatataactagagcagcaaaatacccaatggttctcctgactacagcacaagcaccttttgataaaatcacaatcatgaatagcacaagttagggaaaaagaaacatgagcacttccatgagtttatttacagctgacatggacctctattgaaaaacaaggtgaagagtacaataacaaaataggtagacaacaaaactaaatttgagatggatataaaattggtaccttgattgtggttttcagatatgataatctcctttgctgatgttgtactgcacaaagtaacctatattaatcattggttccattatatatatagcataacagatcagttattcatagaagtatttggctacattggaagagtagtataagcattattacttttagtcacacatatccagttaggccaatatgcatggcatgtcaaatagcaagtatcagcactaatgattggttgtaataatgcaatgtgtgagctatctgagtataatggcccataattattttattgtagaatgtaataaaatagctgcaatagtattgtacctaacaaaatattgatattagacttggtactcacatggtaattgttattgtagacggtgccgatgccatggatgaaattctgcaaatttatggaggtcacaaccaacatggctttccttttgatgttaactctgatgcctatgaggaacatctacaaatgcaagcaggtaaagcacttttagctgacatggataacaaacttagtaaaattaataaaatgtggttgtacataaagcaccactgaagaataagattaattaactgaaaccatgtttttaattagaagatactaatatgacatcatgcgaactacctagaataatctaaacataacattggatgcattagttgcaaattatggactgtcaatttgacatttcagcacataaagtaaattgtgtcaatgtttctatgtccttctgaaatctaaaatcagccataagtttacaaccatgttgatccatgataataaaatatccaccatctaaattggtacagacgactcaccttgtaattgttgttgtagacatgcaggagtacggtgtgtatgctggtgatgtggaaattgtttttgaacaagaggagttggatgattcagatgaggaagatgaacatccaaacaaaaatcttaccaacatacaaaggcaagagatatatgatgcattggttaagaaaactatcaatggaagactaagaaaaaaagcaacaactgaagttgctgaaatgttcaatatcaaaaggggtagagtgcaagatatttggcgaagagcaaagcagtgccgtgcacagggaattccagtcaatgtaagttctagaaagaaaactaattctggtcgcaagaagaatgaaattgacttgtcagatgttgctaatgcccccctgcaactaaggggcacattacggtcatttgcatcagctgcgggtataccaaaaagcacgcttcataggatgttgaaagaagggctgataagacgtcactcaaacacattaaagccattgttgaaggaagagaacaaacgatcaaggctgcaatggtgtatttccatgttagattggcatactttgccaaatgaaccgaagtttgttgatatgcgcaacattgtgcacatcgatgaaaaatggttcaataccactaaaaagacaagaactttttacctggtccattgggaggatgatccgtacagacccgtgcaaaacaagaattctattgataaagtgatgttcttggcagcagttgctaggcctagatacaatgaagaaggtatctgcacttttgacggcaagataggcttgtggcctttcaccaaaaaggtattataacctcttaatatatgcatttttacttagtgatgtgatgtgaaacttaattgcttatctaacttacttaatgttatatacataggaaccagcacaaaggacaagtcaaaacaggccaaggggaactctagtcaccaagacaatcaaggttgatcgagacaccgtaaggtcgtttctgattgctaaagtactaccagctattatatcaagttggcctcgagacgatgcacacagcactatatggattcagcaagacaatgctcctgctcatgtgccagtggatgattatcaatttgcctatgcagtatcccaaacagggtttgacatccgccttatgcatcagcctcctaattccccagatatgaatgcattagatcttgggttctttgcatcgctacaatcattaacatatagaaggatatctaggaatatggatgagctaatacataatgttgagcaggaatttcaggcctatgatgacaacaagctaaatagggtgttcctaacactacaatcttgcttgttagaggttatggaagctgatggtggaaatggatacagaatacctcatatgggtaaagagaggctagagcgtctggacattctccctaatacccttagttgtggtcgtgaactgtatgaaaaggtcatatcagcattagccaatcaagtgcagtaaattatgcaaaatgggaaggtctatcgtagtttcagcttttggttaaatgtgatgttgtatatatgataaagtaatatcagtattactcaagtaaatgcaactaatcatgcaatgtggcaagttctatgatggtttcagcttttgtaatatgtaatatgaagttttatgatggtttcagcttttgttggctacatttcagattgtatatatgacaatgcagtatcagcatttgagtatcatgtcatgtggaaagttttatcatggtttgagcttttgcctaaatttcatcctccctccgttcccttttgatcgacgtattgcaatcgtgcagcgagaccaaggtgaagtaaatttctcccattatcatttaaagcccacctcataaaaggcacaattagcacttcagttacttgcatgcaaaacggaagagagagagagaccccgtttttttattaaaactagtgcctagtatgcgaaatgaatggctagcgtctccttgcatgcatgcaaaaattaaatcagcatgcaaatctaagagtcatggccaccgtcctaggctaatgcgttgatcaaattggaacattttagttttacttatgcgctgatcaaaagggaacgagggagttttatatatatgtcacaatgtaaaatcaacattacatgcatcatcataatcccctaatctcatccagtaccacaattacacatgctttcatacaataccaaaagggtgcctactttaacataccttgttaggttgctattcataaccacctaatctaaagtactaccacaattacacataatttcatacaataccaaaagggtgcctactttaacataccttcttaggctgctatcaataaccacctaatctaaagtactaccacaattacacataatttcatacaataccaaaagggtgcctactttaacataccttcttaggctgctatcaataaccacctaatctaaagtactaccacaattacacataatttcatacaataccaaaagggtgcctactttaacataccttcttaggctgctatcaataaccacctaatctaaagtactaccataattacacataatttcatacaataccaaaagggtacctacttcgaggtactttgttaggccaccattcataagtccaaacaggcacacaatcaacacataattgaagcattcatctaaattttttactatgaaaacactctagaaatttttttaccgatttttccagtgcgtcttggtcttgtaggagttcttctaggccgctatcatcgtatggatcttgcgcatatcccccaatgaccatatcaacatcatcatcgcttgacttgtcctcgtcgatgctaacatctttagcttttcccctcttctccttcatgtcagtttgcgtgacgcttgccttcttctcgaacatggccatgtggtcgctatcatctcccaacatagtcctgtaacggataaaacacagtgacagttaatacaagatgggatgtaaagatgaatctatcatggaatcaaactgaaatgtacttcgattacattatatattcgatacatttttttaaaaagatagtgctgacccatgtaaataagcaatgtctaaattgaagtatagaccaaatggactactgaacgcaatgaaagccaaaagtagagtacatcagtttatatatgcgtggcctagttaaaggatcaaatccagtgaataatagaagtataacaatcgaaaaagatttgcagaaatcaaagtatagcatccacggtaattctcgtagaacaacatcaaggttacctagttaatttaattagctatgaatgacagcctaactatctgtgggtgcagttgtactattggagcaagttgaagcttctcaacgataggtttcagtgttaaaatgaacaagtcaagcaagcaacatacgctggctaggtagctgcagccaacaaagcgagtacgacgagctgcattcaggagtaagtttctttactgatattgaaacaagtcagaacaaaataattaaccatatatacttagtttttttaaacaagatgatcaatcaagcatcatgtcctacacgtcaataatgttttatatttaaaaacagaggtattaatattcatgcattacagtgtcaccacaattttggatttttcatcagcctcttgattgagcaataaagcagtcaaaaaaaactttgagaaataaaattcgcatgttcagtatcaaatttcttacagtttataattgtttcctatactcaataaaaatttctaatttcagaatatacctatgggcaacaaaacagaaaggaatgctttggttaggtttaaaactgcttggatttttgttaacactaatttattttatttgaaacatgtcatcataacccccttctcactccatgccaaattttgcacaaaacaaaatgtaaaacccagctaacccgcattacttcaacattggtaacactgaccgacatataacagctggatgattataaagatacaaaacaccgaataacattaacctaggatattctatgcagtacaatcaaaaaaattttgggatgcaaccgcacccagtgcatctgatctacacacgtcattgaaagcatctctcattgcataaggggaacagattggttgtagggaaaacaaggtgaagatacctttgagtcaatccacgcatactgccgccaaagtccctagctgttgccaccggaatcagaacaggaggtcggtaagcctcctcctccgccgacccctcctgtatcagatccgcgcgcgccgccacctccttgaccatcacatctgccgccttgcaaatctccgatgtcgctgccgcatctgaactggctccacccgccgccgttgcctccgccgccttcttgcaaacctccaaggccgctgccacatctgagccccctcccgccgccgccttttggatcaaaaccgcaagctgatacgcctcctccgccttggctttcgtctcttgaatgaaaaccctaaactgttccgccgctgcctcgaactctgccatcgaggcaaatccttcgaaaggagccgcctccggcatcggatctaaccgctcgcaaccctcccccgctgtatcgaagcgcccgcatcctggtggatggggaactccgcagggagttgcggaagtgagggggagcggcgtggagcggggagagatgtgtggggaggagcacgacggcagtagggagggagtcggaagcttcgaagggtcgctcatctggacgccgccgcttcgacggaatcgatccgggagggggtgagggagcgatggagagaaacgcgagagagagaggcgacggggcgatggaatcgatccaggaggaacgagagagagagagagagacgcgacagaaaaaaaactgggatgcgataaggtttgcgtggtgtgaacgagaggatacgcggtccacctatggcccacacaggatgagatagatgggaagtttctcgttttctgtccagaaatcggtttttttcgggacaaagctctccccccaggattcgtctctttctgggacggagggagtagaccttttaattgtattggctgatctgatgtggtgaaatactattgtcaagtcaaatgaggatgaacatgatagtttagtttcgttatgccaggcgggatggcgtggttaaaagttttaaattttaaaaataagttttaggatgtttatttaaaatttaaacacaaaaaaggttaataataaaaaaaatggccatcctattcatcaattcatgccctgttaccttgttctcgtcaacccatcggcagcacaccaccactacgtaccagctaactcacgatttaattcaacatcgtggaatatagttcaattgcatcaaatcatatcttctgctatctagtagctgtctgaattgaagaagggaaggctgcagcgaaaggaaagcatgatgctcacgttttatatccacacgtcttctaaactgctagtatgtattcataaaaaaagttattttaaaaattatattaatttattttttaaatttaaaataattaatactcaattaattatgtgttagcgacttgttttgttttgcgcatattttcagccttctctaatactcttctctctaacacaacctgctgtgagagattgcccttaaattatatggttctgcagatggcgggtaggtagggatggcagagggggaaattagctgtactatgtaagtaactcctgatcaggattctcggacaacgagggatcaaattaacaggaattaacagttggatcgtgtggcaaggagggcaagcacgtgttcttttctccaacaaaaagttggatgaagattaagatttttgtgacacgtttttcaaactgctaaacggtgcatttcgtgcgaaaactttctatacgaaagttactctaaaatatcatattaatctatttttcaagtttttaataattaaaactcaatcaatcatacgttaataccgcctcgttttacgtaaaaaacttaatcttcatcttcatcttcagaagttttggtcctacgtggcacacacgtggcagtccagtcagcataaaaaataaaaaatggtagggcacttgtcagttctgcttcttttctcggtcaccacatgcgggctctaccttatatatatatattttaatggtgattagaatggtacatgtgcgccangtaggaccaaaaccgctagcattccggagtctgtcaggggataattcgtccgtataaaaagttgagggtgaagaatatctaatttttaaatagagatggataattcgtactgccacaatagttcaagcgtaattcaaactttttcctaaaaaataggcccgaaaatcatgcctctctagcaatagcagtgccctttgcaaaatgttagaaatttgtcatgtcatcttaggtgggctctccttcaattatttgtttctagcgatctgtttcgtttttgtcacgttgcaaacgacctgcgagcgctaggttttgggcgatcgcgcatcactgggccatcgcgtcagcaaggtggacgcgagtgcgcgccagctgtcggggcaaggaagggtatcgtgagggttccattagctgccaggtcaatcagtcacgccagagcattgatagaattgggcgtgtcggaatattagggccatgattgggtatatgttggaggctgtgttttagacataatttccaaagtaatatagctttaggtaacatgatcggttatctcttggagatgctctaaaattgaaacattattacaaaacactatgccagaatggcccgtttgatatagctttttgctggattaaccgatttgcttataggagccgatactcaattagcgcatggtcttttttgagattgaaaatgatcatttttgagttttctataaaacttttatataatattttgttttaaaaaaaaacaaagtgtttaatggtttgaaaagtgtgatcgctatggtctagtagctagaatttgaaaagaacacgaatggccagtttctctctgttttgttttggtgaaatttgactgtttctcatatttgatagttcaatcaataaatttagtcacgatagataataaagcatagtgaatacaatcgacttacatggaagcatacaaatgctctttctaattaatacaaaaattcatgtaaagctcacattgtgcaagggcttggtgaaataataggataaggggtatatatacaataacttttcccggcggaaaagccatcatcccaagccatatgattaaaattgttctttggtggatacgtgaccttgatgaattttttgaaagttcaaaccttgaaaatcttaaatccgagcacaatcccattttgacaggttgattcataaatcatcaaaattctttacaagtgtgcagaagttttagatcatgcatttcctattgaattctgtgatcgcccgttctcatccatataccatctgtttaatctctctcgagtaatctctacctgaaaaaaaattaaacatcaagcacatcattaaatgagaaaaatatgctcttctaatgacccatgaattttctagagagacccttatattatttgaaaaaagatatttaatcagaaaagaggataagaaagaaaatatgagcagaggtaaaaaaaaggcaacctgttttttccaatcggtcctaagtgtgatgaatagaagcacaagagtctggactagtgttccaagaagcatgccgatccaaataccctacataaagaatgaacataagtgagggacacaacttaaatccagattaactagtgaaattctatcatacaaaaattccttacctttacttgaaatcctagcacatagcctagtattgcaccaagagggataccaatcaagtagtacgatgtaacattaacataggcaactatactttgccaacccgatccgatagcgacacctatatataattagaaaattagtaatttcattgttaaattttgaattactttgatatatacttgtccttcaaatggagtaacatacctgagagcactggttgaacactattcaacaaaatggagaaagctagaaggggagcaagatcagcgacttcatctgctaccgccttactttcagtaaatatgtatgcaaggcttccacggaagaaaaggaagagcacaaacaacacaaatcctatcaagaaagaagtggtgaccacattgaaaatggcaaacttagcccttcttgcactcccggctccaagttcatttgccacccgcactctaaaaatgtacatgcattaagtatatgtcaaatttatggttcatgttgcatcagttagatgaaccacgtagtgagtgacagctgagatcgtgaagttaccctattgcagacaaaaatccgatagaaatcatcatctcccaaccgttgatattaaggctacaaattttgcaagtgaaaacaacaatgttcaataagcaaccttttcaattactagaggagacacacaaaacaatacaatgatatacatgatacaatatgatctggttgttgttttctaaactaatatgcaacagattggagtggaatatattaccatatagaaagagcatcaagagcaacctctgcattcttcatataactagtgaggagcaccaatatggtgttgtaccacaattctaaactgaaaaggtaaaagaaaaatgagaataaattaatgagcttctaattatttgtataaaagaacttgattaacaattagcatctaaaatattaactttctatttgctatcatcaattttttttgtcaaaaatttcatatatacatataaacataaccatgttacttaccaaagcatcactccagacgatagcgaaagcttcataatagcaccaagatcagtaaaagcagaggatgagaaccctgtccatgttagagggcaaccaccaaagaagacaaaagcgagctggccaaacacagggatccaaaaggagatgaccatggatcccatgaccccagcaagaccaagttggaacttgactgttaggagtcatgacaagaagaggtgaatcccaagattgaggaaggcaaggtaagtgacaatcatgttcttgctctgcgcttgtaggtacatttggagcgtgaatgcccatatgtaagagaacattacggggatgtaccatagagagatggtgccagcgacagcagagatctcagggtcttgaccaagagcgattaggagtggagttgtgaagatatagaccgggagaaggatgactgcacaacagaagagaactagccatgagcgttgtagatagatgcccaacatgtgatattgcttggcgccatatgattgtccacacaacgtttctaatgcgctcgccatgccaagctgcaatttacaacaatgtgcatatacggttaatttgtagtatatactgtttttatatgcatatcaatagatgacttatagtgcaaattaatatttagtaaaaagaagttttcataggagtgacttgtagtatggtctggttatgttttatttgtatattccgttcaaaaaatctaggtaaagacttttgctattgttgcacagctagtagacagaggtagtacaaactactttaattactgaagaaaaaaaatatatatcagaagatccaacaagaatacacatgaaaaaagacccggcaaaaagaatacatgaggtagatgctatatactccttccgtccctaaatatttaatgccgttgacttttttaaacatgtttgaccattcgtcttgtttaaaaacttttgtgaatattattaagaaatttgagtagtagtagtatatttaacaatgaatcaaatgagaggaaaataattaataattactcattttttaaaataacataaacggtcaaacatatttaaaaaagtcaacggcgtcaagtatttagagacggaggaagtactaattaatgtctggagagaaagccgtgcaagggaaggatggctaggtcaagagtctacttcaaagttttactagtactttgaaaatccaaggaggcaaggtctcacatgattaattttcttcctgcagtatgtactatatccattttttttaaaaaaaaaatcgagcctatagcttcttagctatagtacaacaatgctggacaagatcgaacactctgttttgaacctataaagacagcaactgaacatccattgtttgtctcaattaatcgatgggcaaattaaagcacaacaaaaaacttccagcgcgcgcggcgctgttagtctctgaatcggcacaattaagtcaaaacttaacgtcatcaaagtcagcttttagaaataaaaaacagctagttgccgaaaacacgaaacaggtaaaaagaaagatcaatttgaattgttacaacgtagtaataataatttaaacccaaaactgtgtaatgataactctgtaataataagtaaaaagggaatcagcggcatgacttaccaggatgccattgctgaagcgcatgaggacggtggagacgagggcgtaggcggcgagctcggtggcgccgatgtgtccgatgaacgcctggctgatgacggtgacgccgaaggaggagaagcgggcgcagatggaaggacccgccaccacccacagcttcttgttctcctccaccactcgccgcctcaccgatccaacctcatcctcctctgcatcatcatcttcctgatgcttgtaggtagccggcttaggctccaacagaggaaccgtcagcttctcatcatcacccggcttctccattttgctaattaattagtggcggcttgtagtttgcagcaatggagatggagtggtggtgcttcagattcagtagcaatggcgctgctggaggaaagggaagcatcaaggatgctcaagtatggagctactgatgatatatataaagggagtcgaatggaagtacaggagaagccgtgggttggtaacttggtatggcggagggcagaatcgggaattaacaggacttaattaatcgatgattattaattaatagtgactctagtctagttgatcagatcaatgtatatatccagttgagaatattcaggatcatccatatacatgttgagaattaattagcaatagtaagtggagtaagaaggaagggtgagattcgatctggggttttgtgtacattgtactatgtggcaatgagggcaagaacgtgtactgtatatagctttgctgcctgtagttgtagactgtaaagacgcgaggttatacgtacgcgtacgcggtacgacggcttagggcctgtttggtacagctccagctccaactccatctcttctggagctggagctcagccaaacagtttcagctccactaaaattgagagtggagttgggtggagctctctcacaaaatatattagagttgtggagataggtttaggcaactccataaatccactccagactcaactcctagagttatatttatatttaggagttgtagctgtaacaaacaggcccttatttgcgaatgcggggcgtcggaagaggccacatagagatgctaggtacccgtacctacagggcaccaccagcaggctgcatcgtgaagcacaggaggccacgcacggcggacgtaggcggccggaatagtagctggcccgccgccgtcagcttaattcgtcaataaaatataatggacgtttgtccggcctgcaatcggccactgcatgcgtgatgcatgcgtcgtggtcggtcaatgtccgccgaaattaaacatttattcctttcttcacaaaataagccaacacgtaccaaacgagaatggtttattttataacagaaaaataaaccaacttgtattggatgagggtggtttatcttgtgacagagattgtattttatacaaaggttttttaaacctggcaaaacggtgtgtattttaattttttttaataaagacattgtttaaaaaattatattaatttactttttaaagtcattttaatcatcacttgtgataagggttactctgttttttttatagggacaaagtgttccgaaccgtgtggttcgaacacagcagagcgtcgtggtcggtcactgtctgccaaataagctcccgtctcggtcattcaactcttctcgtcgagccacactagcagtaacaccagtctagcacgcctgcagctaaccatacttatatcctttggtaggttggtcacgtgccgtctatttaggttggtcacgttcttttctcgtgaagctactccctccattctcgagaatatagagattttaacatctccattctcgagagattttaacattttacttgcactgtttgactattcgtcttatttaaaaattttaaaattattatttattttatttgtgacttactttattatccaaagtactttaagcacaactttttgttttttatatttgtacaaattttttaataagacgagcggtcaaacagtgtaggtaaaatgtcaaaattccttatattaggggatggagggagtaacaaatactagtactaagcagtacttggatatacactaaacagcaaattcatgattttttaatatttatataaggatatggatgaatgaattaattataaagttaaaataaatttaaaacaatattaccataaaaaattaaaacaatatcagaagaatttttatatagaaagttttaaaagccgcacaatttaaaagcttgacaacgtgccaccgttaatccgttcatcaattactcgaaaatactggagcagtattatttatttgtttacaatgtaaaattttaatcacaacaatcgtatgtattt

SEQ ID NO: 2616 - DNA, 16605 bp, Oryza sativa
  unsure (1)..(16605): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtattttgtctgtatgatcacctgctttgctttccctgttcccaaatgtactctgaaaataagaactatgttatttctcttcatatcaaatgtataaatggttaccctgttaaaagagattaatgaactgtcatgtggttcttattttcctgatgattgccagcggcaaactgcagattcaggtagcttaaatgcttaatgcatgcagaattgcagatagctcattagaatagagctgtaatacagatttcgctgctatcagaatataggaggaaagtaatgccgttcaagagtttgcccgtgaattctgagcttttcttggaccttatttctgttcaacaatagcgtccccgaacggtgtgctctattgtaagcctagggtacgataactgatgcccaagagctgatcaaaccaactaaccaaggaacagcaaatgcaaaaattactcatcaatacataagacggcttaacctcgcatatgaccaagtctaatgctgttcacaacatcatgttcagaaaaagaactttgccaccctcttttaatttacttttaagagtatatgttacaaaatcaacaatcttttgcctgccagtatacacttcggttggacagcctaacctaagctatgagccaacaattaacctgatatctttacatctcactgttccttgctaatctgtccgattatgttcatgaaaccatgagacgtgtgcaacggatgtgtcagtgaaatgctagttagattagccaaggccctagataacatgcatacaccgccttcctgtttattttcttcctgtgccagatcttgaaaatcttctagactaatggatcttctccatgtttattttcctctatcatatctagaaaatcttctagacctatgtgacttcaggcggattgctggcacctttctagccaatgcttgccagatcatttggaccgcatcatccttctgtgatgggtattgatactcaaaatgtttatccacttctttcagcctattccacatccttgtccattgatgcttgcttactcctctaatcagcctcatcaagtaacccttttttacagcatcagatgagcgaacaaagatagaaaacttcgaatagtccaatgcatcttcataaggaagctcgatgtcgtcactgatgataacagggacgcaatgacttactatagcgtcaaacaggcgattggaagaaggggtgtcccctgcaatgtttaggcaaaattttgatgcgtgcattcccttactggctttactggccccatggtcctggacacttccaaaggcaaaataaacatccttttcatctttgagcatataatatagctcctgcctaatgttccctccctgaacaaaaatgatgcaatttattagtccatgaatcgctagttttgtagcatatagataatatagataaactaataacctaaagtctacatgtatcaacattaacttttaaagaaggatacacatccagctgacaaaaaaaaagttttgacacagtaaatttatttgatgccagatggctgaaacagggaacatctgctgatatgtcggcattcaaacttttgatgattcatatgttgtaacatctgttaatttgatggactttgaaattttggagattgacatgtagacatactcagtaagaagttcataaatggatcatagatcatgagttctgtaccagtgcagtcaaaacgtatcttagtccaaatttatgaaaggatcataagcactgaactttgaacaaacagaactactcttgtctaacttgacagaaacttttgacaaatcatttatttggaacacctgttaatttgctgatctttggaatatcagagagtactagtgtagtcatatactcaataagaagttgataatcatgagttctgcaccggtgcagtcaaagcaatatttattcggttattccaaagtcattaatgggtcatgatttctgcactttgagcaaacagaactactcttgtctaccttgagccctagacaaaagcttgcagttccaacaagctccatttgacttgaagcagttagcccaccctctattaacctatcctgcccaaattctcattctttttttctttttgagggaacatgcaggagggatgcatgcctttgatacaatttaggaagatacaggtagacacgacgtgtgcttgatcagttactaccccagtgaccaacaacatacacaagagtatcattgaagggaaaaaaggagctaaacaaacactttatcaacaatttaccataaacaactaattgcaaacacacattctataccctggaagttctcaaggtttgttgtctaatttggctacaagcctttccttggcacaaaagatgagttcttgttactttagatagcagttgcaatgaaaatataatacttaaggaaagcaaagaaactaaacactacatcgctgtcaacattatgttatattaacacctcagagagtatgaacttcatttgtagagattgaatgagcaagcatagttattaatcgtgttacctccttcctgaaaattgctccccggaagtataacaatgtcggccggtcatcaaacccggcggagtcattcacaaacgtcttagccatatgcttgtaaggggcaatgacatccttctccaagctggctactctaggatggtatctcccgaagtcagacagcacgaacaccacggggaacagcactgaccgggcatggagcaaactattcgggtggtgtgcgacaatgacatggtcggcgccacccgacctcttccactccggctgcgccatcaggtacctgaccagcttctcctgcaattccttgtccctgctcaccttctccggaggcacaaccctggagtggcgattgtagctgagggacgcgaagaacggcacgaacaccacgtcggcgtcgcgggagtcggcgaccctgacggcggcaccgcacggcggcgacgaggaggagaggagatcgagcgtgagccagtactcgacgctgtgctgctggttgagcccaccggggtaccgcggggcggcggcgccgctgcgacatccggccacatggcggcgtcggcggctccatctgtcggcggcgaccagccgaggatgccgaagtggaactccggcggcaagtcgtacatgaataccctgacggcggcgtgggtcgggtcgcatctcgcggcggccgccgagctggaggcgggatcgtcggggcggccattctcgtcaacgaacgagagctccttcgcggcggcggtggtgtcggtcactgcgctctctaggacggccgcagagaagtcggcggcggggaccgggaggccggtgtcggcgggtcgccatcgagcgccggtggcggcgaagaggaagatggtggaggcgacgaggagcgtcgccgccgcaagcggcatgaggagggtgcgggcgcgcggcggcatggcggcgagctccggtcatggccggattggtggagtaggaaggagcatggcggaggtggatcgatctccctactccctaggctggagtagccatggatgagaagggaaaggaaggggaagaagaagaagacttttggttgcgacgagagcagactcatgggccgtgtgaaggcccataagcattcggcccatatatttataggccgagggccataagtactaggaggcccgttaattccctcgtgggctgcatctcagttcagtttaggcctctcttatcaaatctcaatctttgtcacgcatgcatcactgcttcactgtcaggctggcgtcagcgaccaagctttgatgctccaagatggaagaagaaaactactacctccgtcccataatataagagattttagttggatacgacatcctattacaatgaatgtgaacagacaggtatatcccgattttattgtactaagatcatatcttatccaaccaaaatctcttatattatactagcacggatggagtagcaccatactacgtgagatgccacgcgatgatcccagaagcaacaactggcgaacgatatggggaaggaatatagaggtagtactagatgctagctatcccgttttgctattgcaatcgccatcactagtcactagcaacagaaaaagaataggaggagatcaatcgattgcaagataaaaagatgcctcttgtctccgagaccaactccttccgtcccgtttcagagtgtcgcttgctcgcgacgcccgattggacgccaaccagataccatccatttcacggtgttacagtggcaggcacactgaccctactcaccctcttcatgcttctccagtcgctcacctagcctattatccaccgattttattgacatctgcagataagcatcagcgttatttagttagttttggtttcttgacgttttgctttctgctcagaattgtgctaaatgccgctgaacctgctgcgcaaaccaaacttgttctttaaaatctttgctgaaaagttgttgaacaatccagttgtgaattgtgagtttgacagacattgatgcaggctgggacattcattgaagcgagcaaccagatttgcggtgcggaggataagctggccgaaaagaaaggcccttcaattgcaagccacacacaaacacaaaatctcacatgcacctagcaatttgccaatttcacatacgtcgcattgcaatgcaatgcaatattgcaatggacgccagccaatttgcaacaaccactgtatgttgttggatcgccacatcaaagcataaacagctctcgtgggggaccctgcaccttcacatccttctcagcttctatccaacactactgtacatgtcatttgctgaaaaaataaattagtatgatgagctgaattattattccagtgatggcgactcaaaccattcgtgtacatctgatccttgattgctcttcatgggcaatggctttgataataacaaacattctaatcgccagaggatagcattagaagacaccagagttgatgaaccttaaagtgaggtgtgccccagctttgtcctaatatttctgtaatgatttgattggtggagccaaattccacgttatccaccagccagtaggccctaatgttgttgctactagtacttcataaggtcaaaattgagccccatatttccttactcaagcatggagattcaagagtacttcagtactttgcaaatccatttaatccggtgtacttggttaacttttcaaagatttggttgtcatgactgactgactgatgagatgcatcccgtggggtataactaactgtatcattatgtttattctttcaacttatgatgataagttagttcttgcattttactcaagttcattgtttgggtgtaagtaaatatgagcatggactgtttagaactttagtgcataaccccctgtagagaaaactaatagtacttttcatcaagtgcatattttaatttttaaactgaagagacaatggcacatgtacaacgatatattataagttatttaaagttgatggagatattaaaaacatcgttgtactaatcatagggtcttaagagattatgttttaatgaaaaggacttcaggtgtggtactagtttgagatattcctttcatttttgcagtgatgttttctagaatcctgagagaaaaaaaataactggtccatcgataatgccagcaagatcaggagcagaattcgatcgagttacttgattgatttcttagacttttaggtggtaataatctaacaagtctacttcacggttcatgctaacatgtcctcttttttcttttctttgtaaggacacctaatttactagtctttgacaaattaacttgacaaggctcagaatggtattccctggtcagaacatgctcctctttttcacctgaataattaaaagttaagcaaagcaaagaatgtgtgctgtttttgtcactagggcacctaattctttccttatttttgatagatcagacataaattatttgatgaccagttccactacagaagacaagtttggttgctgaatacgacctttctgtatctttgtcgcggcgatcagtgatctacttttatcgtttctacagcccatcattttccatttcctgaggagagatctcaacttgataaagcagatgtcatggaatctttcatatatatcaccaaacctcaacctgggacaatatccacgttcattgcattcagtagattagatgtcgttttaccaagcatggaagaactagcttaaagtcttaggtttgtgacaagagctagcagtcacacacagatcaaatgtggttgattgatagtgagattaaaggtaattcatgaaaaagtggcatgatttcgcaacaaagccaaagctgtgttgcttttgcaatgagctcggcaacgatgccttgtgttgtgctccgtcattgtttagttgttagcgagctggtgttgtaagtttagttctctagccgcccaccgtttgaagctttcggcaaggttttgtccttgtcgagatgttgttttttctctttttcttttaatctgttggattttttacttatatttattgaaatataattggtagttctcctaatgatttagtttcaaggaaaaaattggcatgatttcatcatgctcaaatgtgggcagtaggacatatatgcatcattggaattaggtatgttctgaagacgtacaggaaggtcccataccataattctctacacaacagagaatacagcttggcaccattgatcaagtggacagacttgttcctgaaaaatggaggagaaggtggcacaagcaagtagcagacagatgatgaacagaagagtcaattggagaagagtgcttctcaatccaacctcccatgtagatccaagaaacttcctctcatccctaaatttccttcttcttctgtgctttgtgttgtgcacaagtcactgaatctctgaattttgactttctcccccacactacttcaccttttcttcaagatgtccatgtcagtgaacaaaaaccggtcaccatcttagcaattagacgaatctccatcaacctaagagacgcataagacgttttgtcaagtcaattcatatctaatcctgtccactaaaggacctacttaaaatgcttagttagttggtcatggtggtccttaactaaatggcacacacgagtcaccaaactgaatgctctgcagttgccttttggtactggcaaatagcacaagaggacaagataagatatggctttttccaagtgaaaatattccagcactagcaacagaaataacaaccaaaactagctactagatcatgcttaatgtgccaacgtgctcaacatgaccatttctatggaaataataatataataaataataagttcaaaaggctcaatgcttctctgagaaaccaacttaactacgagtgcaaatttatctacttacctgaaaaatgataagcaaaaatcactgagagtatctactgattaacaattcaatgtagtcctctcatgccactaatatgttcaaccaaagttaattgcttgctaatttaatcatcatgcaaaaaaggtacaattgctgtacagaatagaaagtggtaccaatatttcaatttctcaaagatattaatttattataccagtgccgcgctagttcctgtgcatgacgtttttcttcaagaatggtattttttttatcacgtctctatatccaaccggatatatacaacattttaagtcaagaatttagtccctcagataacccaatctaaaattcacttctatagagatagaaactcagaactttgggatactaggtcgctgcaaaccactagaccaaatactctttcgctcatgtgcatgacttgtttaacaaaaaaggtaaattgtttgcaagtgaacaatatgcataaacaagcaaaagagtacacgccctagtaatatatttgagatcaagaaagcaaagtacatgtaaagtaattaacaagacaaaataaaaaagagaaacttcctctcaacaaaaaaaaaaggaaaaaaagaaaaagataaacttttgctcatctcctctcctccatataagtacgtaccatccaaagccgtgataccaaagcttttccattcctctcttcttcctccctttctcctcctcgccacctaacgtcgtcgacgctcgccggcggcgaggtgtgatctgtgaccgatcatcgatggggcctcagcaagaccggtcggcggccaagccgtacgcgaacggcagcacggcggcggcggcggcggcggggaggaaggagaacaacaaggtggtgcggtacagggagtgccagcgcaaccacgccgccagcatcggcggccacgccgtcgacggctgccgggagttcatggcgtcgggcgccgatggcaccgccgccgcgctcctctgcgccgcctgcggctgccaccagagcttccacaggcgagaggtggaggccgccgcggccgaatgcgactgctcctccgacacctcctccggcaccggccgccggtgatcgccgtggatttgattcggcctcgtcgtgcgagtagatcagcatcatcagtaggtaaggtggtattggcgatttggcattcaaaggattcggtggatgaatgaatctgattgtgtatgaaccgattaaaaagttctcttcctttttttctttcatattttgatttttggtgaatcgatggtgtgtaatgtaacataatatatgttaaaaagcatacgcataagaagcgttcatgtaactgctgtgtccatgtacagattatattcagatgaacatcttaattatattctctaaaataactgtgcttttctgtttgactattagtagttgtatatctgaattaattgtcacttaactttcatatgctgggaacagatttttgcagcagttggtactttcttggtggttatcatctgcttagtacactgttgttctcttcttctgacttctgagctgccgtagcacaaatttacttgatggctttcattttactaaaagaaaaaattaaggtgtgggtgcggttattatagtatgttattttgtcactagcatgtgtgagggttcatcatttggatcttcatgcctgaaaagtattagagctatatatatactctaagtctgcaggtcaactgttagccgtttaaacatcaactcctttttgttgtttctgtcgttaaagtgattacctagcatagcttgagtgttaaaataaagctaggctaatggcaataacactacaacagagactaggttcctgcatcatgggtaaataaaatcgtttgtcttcatgaaaagaaatattgtgtactaaaaaacaaggaatcaaaaaatcaacatgcagaaaggaagctggcctctagtttggtgtataggctctagaagattgagaggtactgtttactagtcaattcttcagagtttaggtatacaatttagctgcttcagattaaatctattcagtgtactgtctattctggagcatgcaagagatttagttgtcaaatgtcaatttttgcatcattttcagagctgtcatctctgtatctgactgtcactgccgaaaccataatgtttgttgatacttttcagaggattttctcttatatatgcttttcagatcgagtggattaaggataatttttttgactttgattaaggataaatttaattatacccatgagtagtgatcaactggattacatggtcatgcaactatatttaattttctttaacttactgtacttattacaaagttggtgtatttctcatttttcttcttctcagctaactaattaacaaagtatatatatacacatgcccatatattcttcacctactatacttgaccctccaaaaaggtcaggtccatttttaggtgagtgagcaagcacgggcgaagtccatgtgacttgttctttggccaacatccatctatcaaaacaaaactttaatttatgcatgccaggtatataaatcatgatatgtagctctagttcgctttcatagacacatatcatgcagaaacaaccacacgatcgatcctcttgcatgtgtcccagtgtatgattgggtcgttggcagctttttgatgcatatgcaatgtgatttggatatcacattttggtttttgtgcattatatgagtctatctcttgatatatatctatgcaactactttttggcgctccctaataaaatatttatttcatttagtttatcttttattcttcttagttgtactacatatgtacatcggttgattcaagatcgaacctccacatttttagagataattcaagaaaggccattgacaaatgtccaaatccaaaaaatatcatcgataagtgtgagtttcaagaaatgacatcgtccaaaatcattttgtcccaaaaataccatcgtcgttagggctccgtccattccgtgccgttaaatacattattcatcctatagcacttaatggcgcgggatagacggaaccctaacggcgatgacatttttgggataaagtcgtttgtactctgaaattttttggaactcacactcgtcgatggtatttttttgaatttgaatgcttgtcaaaatggcatttcttgaattgtctccattttttaacctccaaccaaagcaagtctggtgattaaggaagagagataatgtgggaggatatatttgatggcggatgcaacaagcacccctagtttattagatcattccaataaggatgggtggggtggaagagtgtactgtagggtgagaatcggaggaagaggataagttattaacaaggaaagagagatttggagggggtggtggggcctacccatggctatggggaagtgggagtgaagtggtagcatctcggatctcatggaaccaatccattacagatgggaatgaaaatggcttatcaaaactgagcaagtagaataaatacaacaatagagaaatacctcatgaagacatacaatgggaaaacatggagaaattttgaatggatcctgtagcaatcttaaccatccagaattaagtgaatttagaaaaaaaaagaaacaaaaatagaagaaaggccatgcattgcgcagacaactattgttagttttattatatgtttttgtggccggtgatggcgaccagggtttcccttaccgctggttaccgcggttaccgggcttaccgcgggggtacggtaatataaataccgcggtaacctccttaaatttaaataaatttaaaaaataatttgaatttttaataaattttatacggttttgtacagtttttcacggttaccgcgtggtaaccccggtcccggcagtttgggaaaccctgatggcgtcttgctgctttggttggtctacttttatgagcatgcatggaatagcgtttaatattggatttttattgaaatggataagtttggagtcattgagtcaacttaatgtatattctctatcctatccattctaggcttcgtgcatatataattgacatgcagtggaagttgaatatacaagcaaactctctctataggctgtgtttagttcacaccaaaattagaagtttggttgaaattgaaacgatgtgacagaaaagttggaagtttgtatgtgtagaaaagttttgatgtgatggaaaagttgaaagtttgaagaaaaactttagatctaaacacgaccatacttatgtgagataggggcaccacgttttctttatttcatctagtcactgtgttgtttaccactaaattctagcatattactaaaaacactttaggaacctggtctacgcatatacgtttggtttaaatattaaatagatttgaaatatttaaaatatgtatactcctcttttatttgatactatctccgtcttaaaatgatgatatcctagaatctagaatatgtgtagtcaagcctgatctaaaccttaaaccattaatacaaaaatagtggaattttaaagtctgaatgttatcctaggagattttttacaaacaaattctatagttatagttttatataagtttttataaatgtctagcttaaaataataataataaattaaagatgtgcattaaggatcatgcatgtcgatattcaaaacatcatccattaatttgagaaataaggcagtacatataggcctaaataaagacaattcacaccttcataagcaagaacatgcatgctaattgcaacttatatagtactagctaataaggatcgagtgtccaataatttgtaagctctttagaatctcttttaattgttggcaattatattatacatgctccctttaatttgaagcatgcatatgcacgacacgtaggcatgcaggcaacagcaaaattcatgcacatcatgctgttgagctgatcagtcgcgggtagctaactaaagagtccacattttttttgtgaatgaggagtattggagatagtcagatagtggcgtcaggcggatagctaggaaagctgtcgacctgtcgtacgcaggataagagtatatcaggtctttagttggtgaaatgaaaatttttgtttcacatagaacgtttgaccggatgttaaaaaagatttttagacgcaaataaaaagactaattttataactcgcctggaaaccgcgagacaaattaggcttaaaagattgtttttgggaaaaaaatttaggaactaaacggggctgatatctatccatcacgtacagaaagttacagtgtagttggtgtgcacgcacgagcgagataagtacagtacagctgcagagcgcggccatttaaattgacatgtcagctgcaaacttattatttaaaaggatatatatggatggtgaactgcgcgtgcttcatgcgtgccgatgctttagctgcatgtatggcttttaatagttgagttttgatgcaggcataatcactacgggaaaaaaatggtttttcctgactgctaaaatatgctttttctagcgggtaggctaaccgtcaacgtaggtaagtgaaaataatctattttcgttggcagcaagattaagtgaactcccagcaaaaataaacttctgcagtcagcaagattatgccaaaagctagtgaaaatgattttcaggaaaaaaaataaatccccagaatccctttctaccatctcatccaggaagttgccaaaaaaaaattgaaaatggacatgaacatcattcaagcacaatccaaatacagagcatcacaaatatcaacatattaacagcaacataacatattaacaagatatcatcatcacaaaaatccgctggccatcgttggcccaagcaaacccgccaccagcatcgtcgcactcgaggttgtcatggttggactcaagcaccattggcgttggatccacctcccccgagcatcgccgccgcctgcgcgagccgccatccctcctatttgctgccgccgccggtggggagggaggaggagacgccagatccactcccgccgcctcctccttccccacgccgctctcgaggcctggcggcggcggatccgccctctggaggcccaccggtgcctaatccaccctcttgaggcatgtcggcgccagattcgcctctcccaagcatcgctgctgcctgcgcgagccgccatccctcctctttgccgccaccgtcggtggggagagaggaggaggtgccggatccgctcccgccgccccctcccgcgcgccgctgatgacgagagacggcaccccccttccctgcgccgctcccaaggcatgatggcggcggtactgggggtgggtggggtggcgatggtagccggcggtggtggagatgggagggagaaggagagatgcgagggagaatggagagaggcggagagagggattttatttggcgtttggtgggcggtgaggtgcgcggtggattttttttccagcggtcctctttatctactgccagcgaaaacgtgattttcgttggcggacacttaagaagtttcgcgtcgaaaaatagagttttttatggcagatcttttagcgcggccagttttcgttgtcagtccataggctccacccctcgttacgtttttgttggcggttttcgcgtatagccgccaacgaaaattatagggtgatgctatgaaaaatcatctttttatagtgattgagaccacaattatttacgaaaccatgcaaaaattggtgtactttacacaatatcatcatgatattatattgatccatgcttatgaagtaatgaagcatccatctctaattgacatgattcggggaaaaacatcatctctaaattatattagttaaaagttagtatatatgaacttgtaaaacactcatttgatatatgaacttgtttgacgcgtgtgaaccaaagttaaaatgacaccgaaaggctaattttactaagttgtcgttgattaggacttgaggtggcatgcatgagacatgttatatttgaaatcttagtctctattttctctttctatgtttctactccttgcatcattttgttttggtttttcatatctttttgtttacgattattattatgtcttatactatactttttttattgaattgatgtgtgtctatctagtatttttttcatctacaacatcctttctttaagagtgtatttttagatatgaatatggacaaggacaatatgtgagaacaattaactactaagactatatatacattcaagataggaacctgacaggttaatttactgcaagtgcaatttactcttcactataattaatttaagcatagtccgttcagcatgtaaatagaaggggtaaatcgttctctcggatgatgtggctccaaacctaaagctcacacaactcacatgagttccatagttccatccaattttacgaggaggacctagcgtgtgaaactagagctacaatcttggattcagcgctactcctgctagcttagcttgggcccattcgtaccaactaataggaggcggcatgcaggtatgccaaaaacatcttggagctagcaatagcaacagttttgattgcagctcaacatatatatccaatcaactaatgtctcagactttgaacatgcatgactggtttgtgcatatattcaggtatgtagatatagataatatttgtaattttcgaatcaactcatgcacatacaacatgcaaagctagtagtatttgatctcatcacttactgggcctacatgcagataatccttggccattcagccatagaaaaagttcactttaactccgttaactagtggatggatctaatttatattccttaattgcaaaacaagtaaaacagtccaaaacaaactctctcaaatgttttaagagcggtttacgttgacgcgagaactacgtgatagtccagtcataaaataaattttaaaaaaaataaaatggaacgcgcatgccatcccttctctctactaatctgtctctccctttctttttttcggtgcaagcgcagcagggcgccgggacgaccacgaagagcagcggcggggctctcctctttctctcatcctaagagcatctctaacaacatggctatttttgcctctccaaatgtcctatttagcaaattgccaaaaatttagagagccaaatttgaatttcactccaacagtctctccattcaaatctccaatttaacagtgggtcccatatgtcagtcacactttttatttgtgatctttttcatccacttctctctcgtcttctcctctcttctctgcattgcaatggcgcgggggtggagacgatggacgccggcggcagcggcgcgagtggcagaggccgatggaaacgacggggcggtggaggcgatggacgccggcgggagaggcggggcggtgaaggccggcgggagcagcgcgggcggcggagaccggagagagcggagcggcggaccggaggaccggcggcgccgctgtgagtgacgacgaacggcggagcagcagcaccaccaaatcctctgaggccgatgcaaaaggagaaggggagcggcggtagggattgcggtggtggcatcggacagcggtagggatgacggcggacgacagcagggatggcgctggcgccagcggcgcgcttgcgactgcggagagagaatatgagaggagatgggaaaaaatgcgtggggcccacgattttgcaaggcaactctggctggccacagttggccagcgtagggaggagtttagccagccatatggcatggtcagccgtttagcaagtc

SEQ ID NO: 2617 - DNA, 14853 bp, Oryza sativa
gttattggaccggaacggagatgcggtttacgtgcggcccaagagcaattcttctaagacggcctacgagcaatcggctccatatgtcagtcactgaaacttcgcgggggttcgaatcgtgagatccccaaatttcgatcgagtggtttccctcccaaacccaaaatttccgaattcctccccgcgctgcccctctccaacccaaatcccttcaattcaatttccccatttcatcctcttcttcttcgtccccttctccatctccaaattccaacccattcctcccagatccccaatcctccaattcaccacttcgattgatgcgccaatggtgcgagagctccgcctcgactccttctacgcgcgcctccacgccgccgccgccgcgtccgccgccgacgcatcctcgccgctcctgatcctcccctccgccgccgacgccgacgccctctgcgcgctcaaggtgctcacccacgtcctctccgccgactccatccgcttctccatctaccccgtcgcgtccgccgccgccgccgcctccctcctcgcctccttctccgcatcccagccgctctgcctcctcctcatcaactggggcgcccaccgcgacctccgcgccgtgctgccccccgccgccaccgcgttcgtcgtggattcgcaccgccccatccacctccacaacctttcggcggccaacgaccgcgtcgtcgtgctcttcaccactgacgacgagcacaccgccgatctctcctacgacttcgacgtctcctccctagccgatgcctccgacctctccgctcagggggaggccgacgaccacctccgcgtcgccgaggaggacgaagattccgatgcttccgactcggattccgacggcgagggtgggaggaggaagaggcggcggctctccgacgatgcggaggcggatggcgacccggagaggctgttcgggaagctgaggagggagtactaccggctcggcaccttccacgggaagccgtcggggtgcctcatgtacgagctcgcccacgcgctgcggaagaacaccaacgagctcctctggttcgcctgcgtctccctcaccgaccagttcgtccacgagcgcatcaccaacgagcgctaccaggccgccgtcatggagctcgagcagcacatcaatggatctggcaatctcgatccatctggcgtgggcgcggtggtgacgctcaaggatggcaccaagatccgggcgccggaggcctcacgcatcgcctatgaagacgagccgcggctgatgctgctccgggagtggagtctgttcgactccatgctctgctcgtcgtatgtcgcgacgaagctcaagacctggagcgacaatggcctcaagaagctgaagctgcttctggcaaggatgggattcccgctcgccgactgccagaagaggttccagtacatgagcatggaggtcaagcggaagatgcgtgatgagtttgatcggttcttgcctgagtatgggctcaccgagttctattatcggagtttcttgagggtgcatgggtaccgctccaaggtttctgctgcagatgttgtttatggcgtcacagctttgcttgaatcactgaatgctgagtccaaggactccaaggggtcttctgctgctgagcaattctgggttgcatactctgcattgtcgctgagcaatgtcgatcagctgcggaaagggatgcagtctgcaattgagatacagagggcaatactgaggcaaggaagctcagcgattaccaagaccgggttcattcggagtgcaaagaagtttcggtgggtgaagcttgatgatccagtggatacagataagttatgccaacctcaggctcttaccaaattctgctttttcctaatggacgcactgagagagcgaggagcaaggatgaagccacttatctgcgcttgcttagcaagggagcctgagaaagtgcttgttgtgggggtatgtgggaagccaaggctgggggctgttaaggggaatgcatttggtaatgcatttaggtcagctgccgaggagattggtgcagactatttccatgacatgtttgagtcatcatggattgttctcgatgttgttgctgtcagctctttcatgattcggttaacagagaagctatgatgacatgtgcttgtctagcgctaatgattctttcagttcccatgaagatgggagcttgaggcttgattccttgattaaacactctaaaataaaggagcttgagggctggtggagtggtagatcgatctggtggtacatggcatgttctattttcctcatcaccccacatgatcttcactcagttagggatagcagcctggcaaaaattgcttgattttcagagtttacttgttcaacggctgtgttttatgtgttactgaagggaagattgtttgctgagtgtaactgctccattattagcaaatgatagatcaatagattcagatggaaacctgattctaacacacaaggggcaaggtatatttgcttgctgattttcatactagatagatggaatcgatgcttgtatttgtattcccataagcttgcagtttctattgtagggtagtgttgtaatcaatcttgtaccattgcagttacttgatatttttagtgtaactgataagtgtcttccttgttattttttgtgcagtcatcataacttcagacctattgttgcatttcgttttcttagtcacagtagatgactgcaaacctagaatatgcatccttatcttggtcaggtagatgtctgtaaagtgtaaactttgaatatgcattatactatttcctaaccattgtgtgttgtgatgctttcgtaatctcgattaattgattgacatacaacgggatctgctttatgtgctggggttattagttatttcatttcctggtttctctctattgagtgaagtgaactatgtaataagtgcggtagcttccttgaagataaggttgggattcttcccaaatacaatgggatctgctatattgttcttttgcttgataaaattcagctagagattagctaatctagcaacctgcatcctggtcatttatcactctaaataaaaacttcatttattcaatgcactggtccattgctgttgcgtttcattgttcatgcaataagaacaagatactgtttcagaacaaatccttttgtgacagatattttatagtgatttccagcccaaagggtatagccaattccttctaattttgttattaatcagaagggattccagtccagacattgataggaggccaacttcagtttttcgaaccaacgtgattacatgacatttctcaatcaattactacaggtctacaacttcacagcctcacagggctaagatgaatagaagaaataaaatttagcagatattcaattctaataatccaaatggaaaagttgcccttttctctttgtggtttgctccctgccaatgttgaagtttctatcgtagtcttgtagatctggatcaagtcaataaaattgtgactttgttaaagaactaactgtttttctttttctgtgtgaagatgttcagttgagtaaggtttgtgactatgaagaccttggttttctgtgagttctcttacagttcgacaaggcttgggccaatctctttggataaaaggaaattgaactacaattcctacctttctgaaatttggtcatagtccctaaaatggcttgctgtttgatgttataggtagtaggggaaattctattctacattcttggttcttacaatattacattcttactcaggcatgctgtttgctacgttctgttcctccatttcagctcatcatgtaaaatttatagtatcaagataccttgtttgctgttccatgtttgtgaacatgttttagggcttgtttggggagtttaagattctaagaagcaactgattggtatggtagccagcttctgagaatttggaaaagctggattttccagcttctagttcattttctggattctacaactacaactttttagaatctggaccaaaagctggactgtttgagggagcttctgattctgagagaagctgcagcagctagaagctcccccaaacaggcccttaggtagctggttacaagtctgatcacactgttttaggtttgtctgttgttgtatatcagatagctaaatgcatagctgtgagctagagttgtgataaactggaaataggtcagggaacgtctttttttgccaaagtatgggtaaagataaacttggtgagctcagctggggacaaaatcatcagattttgtattctcccagcagagcaaatagggatttgcctgtgagtgcatgcctgacttgtctgttggtctatgaaatgggccgtgaagtgtgcttctatgggccttgtcactactcaccaggcggtattgcagagcagatttcttgcccatttgtcctttttctctctccagcttcgctgctgctccttgggatggaagagaaaagagaggagaccgccgccggctgcccatccggtcatccgcagcctcgccggcgccatcgaccaagcttgatcgcgccagcatcgcaggaaactttgccggtagccactcaacatcctccatttattatttctatctcttttataaataaacttttctgttgcgttgcacgtcagtaggtcagtaacacaaattttaccgagcgttctagatatatatacagggcgtcaagataaattcccttcaactttcagaaaagaaaaggagaaaccatcctttctccaaaagttccgtcattccctgaaccaaattcgcccatataattcgcggaaattgctatgatgttccccatttatagctcataagttcatgtgcttgttccaaaatgacctagtccactgatcaaggataagggtatgttgactaaccttttaactgaatttgatgcaacaaggacaagttcaagttttgaaaatgacatgacatctaacaatgtaatccctcagctggtatgagtcctttctgtaggaaagggtaccatatacatatacggttgctatcacatatcatcactttgattggtaacggttaattcaaatcagtgctttgtatgtgtgtttagtttccatcaatcggaaaagccactttcaactaggtttatccataccttgctagtgttgtttatgtggtctgaacctgatgttctcctgtaggttaagtaggtcgttctcaatcgccaaaccacaaaataattgctcaaatttcagagttatattcctgtacgacttgcaaccaattagtggtcctatgctaattctatgtgactggaataattagtgtgatgtttccctttaaattctgattgacgaggcacaaggctactaaaagtaggcatgctcgtaacagcatttgttattctatatttacaactgcacatcattttctttagaaaacatacatcattggttctcttgagcttcaagaaccactacgctgatgatgcaacaacttccactcagatctaagagcatgatgctcgttacttgttttacgcgaagtcttatcaaaagtgttcatggaattcatctagtagtcaacagtagaagtcaaatccctattaactgataataaaccaatcgaaaatcacaactgattggtcaagattccctggcagtaaattttcttatgttggttgaaatggccttctattgagttagaaaattccaatttgtccttttatgcagatgctcttaattaatctcttttagttacttgtaaaatggccttaacctttttcttaatctcttatgatttgtctccttgaagctaagtcttttatttttaacaaatctattttggagttgatggtttcgagagaaaaaaaaacaattgggtttacaggttattgatttcttgttattttcttaaagacacttgagaatgtggtgcgaagggtggcaaaatttgcacaatccattgttcatcgctggatggatggaatactggctccagctggccaaactcttttgccgggttggcggaaggacgccaaccaaatttcattaagataaaagagagttatataggtatacacgacattaaactgccgagtcggggaagaccccgaaacagaagaaaaacaaaactatttacagggagctagagaccaagttgctactcctcgctatcaaaaataccggccgctctccagatcgaaacttcttctttgatgtcagccaccaaaagttcaaccactttcggtttgtcctcaaagaagctggccaaactctcaatgttgtagagattctgggaaccaatgttaactgaccaatccctgatatctcttctgactcaggtcatatataccacatgacagtcacctatcgtagttgtacctatctcaaaatgctcaatcaactcatatgcctaaaatgataaattcatattaatgtttccaacaagtagatagtgctatctatcattttttctacttgcagaggacactagatatgccaaatggttcaacatcttaatctagctctctgctcttgaatgggaccttgacatttttgttggaacatatagcagggtaacagggattgtgccaccacatatcaggccaattgatagtgcaccgttgggaaaatctgcatcgcatagttggttacgggacaactctcccataaatgtagatctgcctaagatgtgatgcaccaaataaggttctgaaaaatggtttattttgtctttgctttatggtataaataaacattgttggcttacctaacaaattaacgatgtttcatgaatggaggcatatcgtattggatatgttatataagatggttctgcacagagtatgttatcaaaatccaggtaactagaaagcaccaaccttgttgcggctctatgttatactagctttctctactaaattccaatcttaagtatgtaagagcgtcacatattttttgaatattcattaattttggctagcagtcctcaaatactaacatgtgtatcatagcagatgtagctacatttatttctgagaatagacatcttcaacttgtgtatctttgtctttgtactctttctagtttgttgtcacctgtacagatagatacgagatccatccacttatccaacaactccaaatgattattgattactgataagcattgcactctatgcaaccactccaaagtatatggcactataggtttcttgaagaaaaggtacattagcaatgtgcaacatcagaatatactgatggtggatcttcttgctctttttagctatcgcatttaagaagtcttacttctgagcatgacaatatttgtttaaaaagaacgatgcacatcacattcttataatagcaaggtaacaggattgtaagtctttactgaaggcattagctagggtgttcaggcagtcatgctcaatagcaaaagaattggcttgctgaggtggtccttgtggtgctagtttggttagtagttgggaggtaagctactcactctttgtgatgattatgctgtaggtttgtcctttcatgtgaactaatatatgaacaaactgaagaactgcctaaaggtgtccttgctgcaacgatgttatgaataataggctgagccgacattattatcttgtaatgtatattccataccacttagtgtttttctctgaaactatatctatactgtacgtactatactatataattcacaaagttggttatattttcatttttgaatggatagatcttctggaaaagttcatgaacaattattttttgttctttcaatttcggggcaattgcaaatttaccactgctttgaattgttattgcaaaactgccactagaaaattacaaaaatgccactggaactgtcattcgagtggcatccttgcaaaattgaaaaaaccggtggcaaatttgcaaatgccccatcaatttctcataggtcatggttatatctctccttgttgcaaatttaatggtttcgacaatggaaagtggggtcaagcatttaggtggtgttacttagtggagtagtttttactaaccatccccacggaatggaaaattagtacaatggtaccattttacacttttctggcaaaatgtatctacttattttttaaactaaaccggaataagaattaccaattgtgtttcaataagtagaagtaaaaactcagacgggttacaaggaaaagaaaaacaactacctgcggtcagctgaacaaccacacagcacacacaacaacttacaataccatgctctttaaattggcaatataatctatttagtcttgaatcaagtcctggtgcaatgtttgctctgtacagaccccccccctctcaattagacactgaattaaaactgtcttcctacgtacaaaaatctgtggctgatttttttttactcagagttattttgactagtaaagtagtggaactattagcagagtgaatattttcttgagtaattaagaaggtgattctaatgtcttgagtaactattataaactagccgactatttcatccacagctacacatcttgatttggttttacattgtaacgtggtaagtttttgtgccattgtgtggttataaaaaaaatgctaggagtttgctagtcaccatttacttgattttctagcaaggtttggagatgtaaagataagttaacccatgctcacttttgtgttgtcaggtttagcatagattttaccttgtcatataaatccattttttacaaaatctggattggaagccattcctgagttacctgagattctttcttgattaaaatattgatgcatgaaaatatttgggtccttgatcttttttacaacacctgcctattaaagatgaattaaatacctgataacaacactattcttacacattgtatgagtccctttcatatgctgtgtatacatactcatcaggatacctatagctggggtcaaatcggtgtcaacagaattctacttcaagtatgtgccattattctgacagaaatacgatggcaacttatgcctgctaattgacgaagtagttacagaatgtgcacttggacttgtcaagaactagttctctacacattaagactccttttgctgttagtgtcgatgaactactttgaggtatagttttgcagttagactgccatgctattggctgttgactaccactgatctttatctttttggaatggattttgttcatacaccagtagcactacctccactttcagaactgaacgtcggttttactttctgtcacaaaatgcatatgatgtgtcaattgttcttaatttgacaaggctaatgcttacattttcctggttactgttgtgctacaggatgcttcctggaagaatgaattgagcttgtctatgtactcccccgaggttacacagatagacctctcatacttatggtagctgccggttggttgtcatggcacactcccttggcaactcttaattacacgtgagctatatttgtactgccttggtcccgtatctactctgatggatacatgaagactgagatgtatacttccactcaataccatgttgtcaagaattgcagttcctttcctttttctaatttctactattaagcatttaagcattactttctttttctggagagatcattttacagggtgatttgaacatacagtaattatggccaagccttcgatcaactctatacaaactatgcaacaaaatttagttacttccagaattccagatgttttgaattagtagacttgaatcacttgaacatctggagatcttgagagtatttttctttctgaaccggtatggttgatcataatgctttcctttcttggcaggactgaaggattggagtcctgcatttgttgaagaactccatgaaggtatcaaatgtgcttcttatggaccatggcactatggcagcaatgccagcatggttggatgtggttgggccaggaaaaatgtaacctggtcggcctcaccccgctggtccaaagcctgcctgatctggggctggaacacaaaaaagcacatagctgctgtacaaagctactccctctgttttacaatgtaagtcattctagcatttcccatattcatattgatgttaataaatctagataacatcaatatgaatatgagaaatgctagaatgacttatattgtgaaacggaggaagtagctgattggcgtcaggcagttgagaatatcaccgagccaggctaggacaggttgagacttcatcagcttaattgttcatgcaatgccaggttttcctctcgtcttacgtacaatttaataggcgatctggagttgtaatttgtacactgaagcaggttcactaggcagaagcagaggattctgcaggttagcataaaagggacgtgtaacagagagagacacgacacaggccatgtcataatcaggtttaatcactcatttgtggacatcgaccactattctcagtagtgcagtaccatctatgagttttagttgatgtttaacaagctaacgctgcatttgctgtgatgctgatgactacctagagtagctatgcaccatcaacacacaagtttctgaagcctagctatttgcaaaaatatactcatagagagggacctgacctgtccaattgccctaacattggtgtaatttgcagggtaggtccggcattaaacgaaagattagggcactgtttatctttgcactcaatgaatgagaacagggcaagaaaaaaaagttgggagctgatttcgtttgcactgaatgtgatcgggggaccaacacagttgccgacaggtaaggagtctgtttaagcttcttctctccgcagctgctttgtaagaatagtatagtatctgcattcatatgggcatacggcaagtacataagaggacgaagaaactgtttcataaatcattgcaccagcccactccattcaggaacaaaaaataaactggaactttcaccatttccctctggtctcacagtcgttttaaaaggtgtgcactcaacacgagttaactttgaccataaaaaatcatatttacaatatcttttttagtattacacatgtaattttgtaaaatttctgctaaagaactagatagccatatttgtataatgttgactttaaaaacattcaaaataattttgttttgagacaagaaggagcacttattactttgttagtagagaaattttataatcttaagaggcaccaaaattttttaacgcaaattttcgtatctcttgataccagaaatataagagatatcaaattttacattagaaaatatggtaccttctggcacttccttagggcagccacaatgcagacataaacgtgagtcttaattaaacctctaaagtgaactttatacattatgagagtagtccaattaccatctaacattgctgaaattgtggaaactagaaattaagaattaggaaaggaagataagattgtcattttaaagacctctttaatccaaacaggagtctaacaataatggattggatagggattttgacaacgatattatattccaatattccagctctttgtgcatgataggttggctactggagacactctgtggaaataattttatgaattcattcgaaaaaatgaataagaaataatcttgatgagttacatcatgcttacatatataatcacacctgttaattcctgttgatatctcttattcttgtgctgacgtttgatgccagtgacacacgtacaaccggtcacacatccaaaactacaaataaaacaaatcttctagcttcaagtatagtaacaacaatagtttaacctagacatgcatctagctaattaatgtaaaattaattattgatgtgcacagtatacgtatcgaatgtgacagtgttttctttcattacttgagctaattaaaacatcattgggacggagcagcaaccgtcggagaggtccatgaggtcggcgacctgctccgccgccgcctcgtcgaacagccacttctcgatcgatgacagcggcggcgctgcctggttcatcagctgctgcttgctctcgtcgccgtagccgccgccatagccgccgtactccatgaacgacgccggctgctgctgctggtgctgctgatgaacgtcgaagcagcagtccaggtcggcgccggacatgcagtcgaaggacgacagcaaggggttgccgccgacatcgacggcgggcttgacgtcgtcgtaatagccgctgtcatagtgctgcagcggtggcggcggcggcgacggggagttggtcttcatgaagccgtcgagcagcttggagatgttgtccatgctggaggcgtatgaggaggatgggcagtcggcgaagggggagcgcctagcaatggctgccatctgggtgacatcggagttgctgctcaccgtgtagctaccgccggcggcggaggggaaggtggcgtcggcgaaatggggtggcggttggaggatgaagtggagttggcggcggcggcgagcttcttcttgaggtgggtgttccagtagttcttgatgtcgttgtcggtgcgctgggggaggtaggaggcgatggcggcccagcggttgccgagaagcgactggaggtggacgatgatcccctcctcgtgcgccgtgaagttgccgcgctttatccccggccgcaggtagttcgtccaccgcagcctgcagctcttgctgcacctcatcagccctgcatccatccatccacccacagcttcagcttcttctcagttcatcatcgatcaccatggctacttggctagctatagttcatctacaaaagaaagtaagaaactacacagaattggggaattaggacgtaccagtgttgatgggaaccgatctccagttgccggggccgtgttcttggatgtaggagacgaggatgatgtcctcctcgggcgtccatggccccttcttgatcccctccttgtcgcagcacggcggccggcccatggctacaattcctcactcactaattaactctgatccttcccggatcgatcgatcgagctaactactctttctggaagctgcagctagctgatcgatcgatcggtcgtctctctctgtgctacctgagcttccgacagtgtgcttgagtgtagagatatatatagctaggagactggggactttgggagtgagtgagctccttttcacttgctatctctgatgtaagccactttctgatcgatcgatgagatgatttactttcactttctagcaagtcagttgatctggttatcgatcgatcgatcgatctgtctgtatgtaggatgctttctctttctgtcaacagcatcacatgaatcagtgacaatgacacggccacaccttaaagctagcaagaaagactgttgtatgtctgtatagctagctccaacctgtacgtactactgcttggtctcactgtgtctaatttaaaaggcactgacttctcccatgcaaaccacccatggatatgactaacttaggccgtgtttagattccttggtaaaattttacatcctatcacatcaaatatttagacacatatacggagtattaaatatagacgaaaaaataactaattacacagattgcgccgtttttttgacaaattgacccttttcaaaaacttaattcgaaactaacccctgccaaaaacttcaaccaaaactaggccgtcggctcagcgccaagcgcattggcgctgaggttggccgtgtcagcgccaacgggactggcgctgacattgtgccaccgtggtggccgggccgatcccctagctgacgtggcagctaactcagcgccaaccgcttcggcgctgaggtgcccacctcagcgccaagtaagttggcgctgaccttggctacttagagcccggccgaggccgccccagccagttattcctccgttttttccccagccgcccgcctagggttcggtcgccaccgcgttctcctcgcccaatctcccccaaaaacctctctaatcgaaggtgatttgtgcggcattgagtttgggatcggaagagaagataaacccctctataaaccctaagttccccaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacata

SEQ ID NO: 2618 - DNA, 715 bp, Oryza sativa
ctatggtgagatgcttacaatatttggtagcaccatggctacgggaaagtatgcaaaggactcaagttcagtcctaggaacagaggatgtccaagaggaaaatgatgaagaggaaaatgatggccctgccactactgatgatcgtccggaggcatcatctgcaagcaagccaaagaaagctagaacacaagaaattgaagatgatgggctgattggtgcattcaccagtgttggtgacaagttagcttctgctatactaaaggtcgctgagccagacaataaactgccagatggtttatttgaaaccttgaaaagccttcctgggtttgaggagatccacgtatctgtttactatgctcatttggttgctaaccctcacattgttagagcttttgatggacttcctttcgaaaacaagatacattgggtccatttgttcattaatgagaagtttcctggatcaatgtagcgttgttagatgagttgggtagttcttttggtattatgtgttgccggtgggcccatggtcatgtatgacttgtactgccaatatgttgtaggcagtgaactcttaggtgcaagacttaaatttgctattatgtgtaagaccttaattggctattatgtgcacgacttgaaacttcttattatgtttggcttggactctatgtatggattgaaatgggatcagatgtgagctaattatgtgtgattg

SEQ ID NO: 2619 - DNA, 14961 bp, Oryza sativa
caacattttgaaacggagagagtagtaattaaaacttaattaatcatacgttattaccacctcgttttgcgtcaaacacttaatttgtcagggttatagataccacatacctaatagtagttgactaaatctcggcaggacccaccacataccatgtcttatacggaaaataaccttcggatataggaggagttccacataaggaaggataagtagagttctacatggaaacgacaaggactactcggattgtatccatattggtttccctagttctacttggacaaggggacacctatgggtataaatacaaggcccctaggagaagaggggacacggaacaatagatcaagacataagatcaacatacaagcaaacatacgctaagacaagacgccggatatcgacttcaaagataagcatggctagtcccctacagtatctacggatactgataggagagacatagcgttgtctttgatctcgccggatgcggattcgagtaggaaggctaccctattgtcgactacgagtcagtacttcagaccgccaagtcgacaacagttagataggctaccccaaatattgtactggtgtgattatggtgaataagagcaacgaccggcttcggccaacagaagtagggttattacctgacaattcaggggcccgaacttgtataaaaatcctcgtccccatctcttttattacaatctcgcatatatcttagtaccaacgatccccatactatgcaaataccggaatcgcgacatcaaacgtcgacataatcttcatcttcatctttgcgtaaaacacttaatcttcatcttcaggagattcaaacaccaccaaagtctctaaaactatctctttggtagtattattcagaatgcaaatatgcaagagaattttatttttaaagcttgctaaccatctgtctatatttggtgatctatgctgaaagatatgagaattacacttctttcaaagataccagcaagcaatcattactatctccaggaaaccttttgtccgaaaacataatctggcaaaaactatcatctagtaaaaaaataaagaggtgttccaccactctttagtgtggacaattttcccttatttgatactagtttagtcaataaatttagtcaaatgtagatacaaagccaaagggtacaatcaattcacatgcaagcatatgcatgctcttccaacaaatgcaaaaaaaatatgtaaaactcataatggtcaagcatttgctacaatagtttcgataacccggtaaaaatggataatttacgaccatatatatataaggttccttcaataacatcacggtttttccatggtgtgacacatggggaaaaacatcattccaagccatttataggttcattgaaggatgatgtcaccttgaaggatcttaaactctgagggcaatcccattagaacaagctgattcatagatcaccataattcattacaagtgtgcagaagttttagatcatggattttcacccggattctgttgtctcccattctcatccatagaccagcggtttaatctctgtcgagcaatctctacctagaaaaaagaacatgaaacacatcattaaatgagaaaaaaaatctagagagacccacatgctatgtgggttaagagatttaataaaaaaaaagataaggaaaattgtgagcaattaacatacctgtttttcccaatcagttctaagagtgataaatagaagcacaatagtctggactagcgtaccaagaagcataccaatccaaatgccctatagaaacaacaaatggaattgagaaacacaatttaagtcccaaattgactaatgaaattttatcaattggctcctcacctttacttgaaatcctagcacatagcctagtattacaccaatagggataccgaacaagtaatatgatgtaacattaacataggcaactacactttgccaacctgatccaacagcgacacctacagatgattataaaatattataattccaatgtgcaatttcaaattatattgatatatatactattcttttaaatggaataccatacctgagagcactggttgaatactattcaacaaaatggagaaggctagcaagggagaaagctccgcaactgcatctgctactaccttactttcagtaaatatgtatgcaagccttccacgaaagataaggaagagcacaaacaacataaatcctatcgagaaagaagtggtgaccacattgaaaatggcaaacttagcccttcttgcgcttccagctccaagttcatttgccacccgcactctagaaatgtacatgtataggtatgtcaaatgaaatttatctgacatgattgattgatcaaatgaaccacttagcatgtaacaagtaagatcactaagttaccctgttgcagataaaaaccctatagaaatcatcatctcccaaccattgatattaaggctacatatggaaaaacaataatgctcaataagcaagtttttcaactgctaaaggaacaacaaagaacaatacaatgatgtacccacaaacatgatctaccttttatggggcaattgcaaatttaccactactttgaatcgttattgcaaaactgccactagaaaattgcaaaaatgccattagaactgtcatttgagtggcatccttgcaatattgaaaaaaccagtggcaaatttgcaaataccccaccttttattgtctaaaccattatgcaacaattgaaagaggaatatattaccatattgaaagagcatcaagagcaatctctgcattcttcatataaccagtgaggagaaccaaaattgtgttgtaccataattccacactgaaaggcaaatgagaaagaaaaaagaataaaccacatgagcaattaattagctctaaacaatatgttggtcgacatttagcatctaacatattgcatatctgaaatttcatatgtatgcataaacacaattgttacttaccaaagcatcactccagaagacagtgaaagcttgacaatagcaccgagttcagtaaaagcagcagatgagaatcctgtccatgttagagggcaaccaccaaagaagacaaaagcaagctgaccaaatactggaatccagtaggcaatgaccatggagcccatgaccccagcaaggccaaggtggaactggaccgttaaaagccatgataggaaaaggtgaagcccaagattgagcatggcaagataagtgacaatcatgttcttgctctgtgcttgtaggtacatttggagcgtgaagttcccaacattggatatcataacagggatataccacaatgaaatagtgccggccatagcagcgatcttaggatcctggccaagaaaaattaggagtggagtggtgaagaggtatatcgggaggaggaggactgcacaacacaagagaactatccatgaacgttgtagatagatgcccaacatgtggtattgcttggcgccatatgattgcccacacaatgtttccaatgcacttgccatgcctagctgcagtttacaacaatgtgcatttaaggtgagcaatttataatgtgtttttatgcatatatagaagataagattacatctagaaattaattgttagtaaaagtctaaaatataaagaggtcatcattacttgtagtaaggtatcttttgataccaaagtctgtgattgagagcattgatagggagaaagcactgcttatggaaatagtcagatatgatcaactccaaaaacaattcctggctgcttggcataaggtttgcagactaagttaaaggagaagaggaggccattaacttgacaatccaaaataggcaccgctcatgaaacacttgaacaaattttataacaataaggacttgccttaggtaaaactgatttagaataagtattatgtctacctagtgcctaatttaactatcccaaaagagtccttctggtggaatgatgtttgtaaaacaagcatccactttagaggaattcctagatgtatcttacataagggaactgcctgcaccttctaggaagatatgtggtctcactagccacctccatgcaatgtatatctaaggctatattcctttgcttctaataaggaggcctctgtcaaagtgtttgtatctactgatctggatgataattttaatctgccatcatctcggaaaacatatgatgaggtttctcgatagtcaaacaaactcctaaacttggaattggatcacactgctgatcagtggaagtatatatggggaaacatgaactatgcctttcagaaattcttctatctgatctttaattacatccgtctagcctccacattttatttggttatggaagagtaagtgcacttcaaaagttaaagtttttggattgctacttcttatgaatagattgaacacacgatatatgcgagatcataaaaaattgctccaccaaagtatgacctagtatgtgtgttatgtaatcaaggggtcattgaaacaatgcaacatttgtttcacacgtccattttcatcttcatgttgagcttcaattggatttagttggaataccgtgatgggaacttaaattatgatggctaaggctaaaaaccaatatgtgggttacagcttcatcgataaattcttaacttctgtctagtgtatttggaagataagaaataacttcatcttgagcagaaacctcccaccttttcttccgggagatatctgtttaagactgagctcctccttttaatatttggactaaatgaggagataaagatcaataaaatatattactgtagggcctccctccctgctgtgcttccttaaaaaatatctagatatataaaaacttggcagtctgctattgttccagagctagctaacacagatatcttacgagcttatttgtacttgaagtcatgaagagcacacaagtatataactaatgcataaagacaatgcaatgattaagagggggtggctgaactaagagtccgcttcaaacattaagggatgctttgaattagtcggatggcccctttctaaacaaaaaatacataggtctcacataatttagttcttacagtacgaattgtgtcttttttaaaaaagaaaatttttttatgtgcctctgaatattttggatcccttccgtgacattaaatgttgcctcatctctctgacatgtctgatatttttttccccatcaatacactttccattactttgaccgttagatttttttttctaacatgactatatgcccacactatccatttctcatagactcgcacttatgtacactttaaaatataaatctcaacttgaaaaaaatacagtaaaaatcaaatcgagcaaagtttgagagttatttgatggaaaatttggaaaacaaagtttaaattagtttaaacacaaaatgtaattaaatagtattaagtgtagtgggtagagaggatagttacgaggatgccgccgctgaagcgcatgaggacggtggagacgagagcgtatccggcgagctcggtggcgccgatgtggccgatgaaggcttggctgatgacggtgacgccgaaggtggagaagcgcgcgcagatggaaggacccgccaccacccacagcttcttgctctccaccaacacccgcggccccaacgacccaacctcctcttcatcttcttcttgcttgtcgttgttgctgccttcgccatgagcgtgcttaggctccagcagaggagccgtcctgcagtcatcatgttcatcacccggcctctccatttctcctagcacagcttggcttagctagctgctgctaactttaattgtgcaggaatggagcgaattaattaatgggaataattgcacttgaggggaagaggagctatcagaattgatgaagggaagcaggttaggaaggctctcagctaccgttttaaaggagattgatcaggtagctgggttgatggctggacttggaccagagagttgagtgagcaagtacctgattgtccctgtggctgctacataaggtgggtaggtagtgagggcaaggtgggaaagtagtagtaacactgactcgttaatcatcgatttaggaatcagcattccagacaaaaggaaggaccaataatatagcgagtatgaaattaattaacagtgactgtcgtcatatatactacagaactatcatccatccaggaatctggggttgtgtgtagtgttaaatggctcaatgcaagtggattgtgttatgtacgtatacacaccagggttcgacttaccgccggtaaccgcgcggttaccgtggttaccgggcttaccgcgggggtacggtaatataaataccgcggtaacctccttaaatttaaataaatttaaaaaataatttgaatttttgataaattttgcacggttttgtacggtttttcacggttaccgcggttaccgcgcggtaaccgtgcttactgccggggcgcggtaactctggccccggcgatttgggaaaccccattacacacaaacggcggagcttgcaagcggcgtacagagccagtaattaacttacactataaagccttaagaagttaaagctattttttacttgtaatatatatatatatatatatatatatatatatatatatatatatatatatatatatatatattaagcacatatacccatatagtgacacaaattaaacatttatagtatgatagataataaataaagcaatttgtaggttgcaatataataatttattctctataaataataaacgataatataattacaactaaaaaggccatagtagaaataaagtggtataaataccttataaataattgaaactataattcaacaatgaattgaaatcgatagaggcacttctgtgagactgtgacctacgtaccttcaggatccaggaaacacagccgcacaggcagggctgcaggcaccggcagcttggctgatggcgtctcgctccgtcgctcggcgcgtaaggaactagggcattcgcgacttggggttcggcgacgagacgagtagacgacgaagcgacgcgcgctcggcgctccccggcctgggcgctgcgctatgatgtgggctgccgcctgggcccccttccggcctgggcccaggcggttgcacaaccggcctaggcccagggcaggcagcggctacgtacgtcatgtcgccggcccggtctgttcacggcagctatagttgccggacgtacgtgtcacgtgtggctgaccggcatccccgcttggcgcttgcatcctcaactcgtcgtggccaccaaaaccaaatgtaggacttcgttcatttgatgtcaaaaaaaaaaacttactaaaatttaagcaacttgtcaaaattttggcaggatttcttatatgctctagttaccaaaatttagcagtaaactaaatgtagctattttttttttgataactttaccaaaatttagtaaagttgaaaataacatcaaagtgaacaaactgtagagttcctcgtaaatccaacgataccacccaatatgcatctaagaactgggaaatgcatcttgacaaaaaggagatctcgctgcaaggacggcgttacatcattacatgtatgatcaggttaggttgtttatgccctgcagttcaggtaatacccacacaagaattgggtttgaaagtaacactagaaaagaaaagaacaaaataaggggaaggccggccgggggatcaaataacaattgattctttttttctttttttcctttttacatgcgcggtggtgcgtgcgcgtcacaccgccctttgaattttggttatcaaatctgcattctttttgttgtaggacttggtgatttaattaaatcttgaatatgcatgcatggagctgtaatgtataggtctcaccataatctctagagaaaatcccttatatacccctacaattttagctaatcccttctatatctctgaattttgtttacctccttgtatgcatccaaaatttgattttgatcccttctatacctctcccgtcagttgaccgtctaatttctataaaatgacaattttacccttttgatgaacatagaaatttataaattacattattgaaaatgtaaaagcttgctgtatgagactattatagttgtgtgtttattgtgcgatacattatctatgacaaaatttatttttagataatgaaataaaaaatatgtatttattttatttttaaaaaagtcataaaaaattaggagcatccatataaagataggactaccaatgctcacgatatatttttatgaatactccgataaaaaaaatccattgtcctattgaaatttcaaataaaaaattctatttattaaatttgttttattttcaaattttatgtcaaaatttcttgcactaattattttgtctcattagtttcgtaaaatgcacatattgtgcactcaaacaaaattttcaattgcttttcaagcatatattcaaacctaaatcctcaagggcataaaagacatttgcaaccaaacttaatagtgaaataaaggaaaatataacgggaagggcatggaagggatcaaattgaaatttcaggggtagagaagggatcaaataaatttcaaggatatgaaagggtttgagtgagtttttaaggctatacagggaatttactctaatctctgtggagtgcgacacgccatcttctttcgtcaagcaaccaatcgtcctaccgaattggctcatcatctatcacgccttccattcctcgtcaaatcctattaaattaatgcttagattttttttaagaaaatcctattaaatcatcattatcatcaattaattaattaattaatcaatgtgccattaactaagaacgtttaattgttaatatgtctgtccgggacgggagatgatctcacttgattttttacattttaactctttttaaaaacttattttataaatagacacttaaacaaaagacaacttcgacattgggcaaccgcgggcgcaactatgacgtccaaatctgtattagtcccactctatactctgagtaggccttccatgcccttcacatagcactctatttatacctttgttctcgtttctaaaagcattaacctggaggtactatatatgcttgaaatgaactgggtatataagttgacccaaatctatctacactctccatgtggagctcttccaccaaacgaacacttgggtctaaaccggaacaagaagagtcacggaccgaaacagactaaatgggctggattttacactctcactccctcatgggttgatgccctagcaactcaccgctacccaacagccaaatttccaggatatcccctcggtgctacggcattgtgcctatgcgtcgtgtccccctccacgggctaacacacacgcacacttgtgtaacacgggttgaagttctaatattacatgtaacactcgagagacaaaatcaacaatagtccactctacccgctaaatggacccacattcacattacacccaacttacacttttcatcatcacttttatgtaaaaatgttaaccaggaggtactatggttatatacacttccaatagatgttgattaaatgtgctagtatcaatttatgatttaggtgtatatatatcatgtgtctgagctataatatgcatgtttaattgcaaggtagttattgtcgacgtttgatgtcgcgattccggtatttgcatagtatggggatcgttggtactaggatatacgcgagactgaggtaaaagagatggggacgaggatttttatacaggtttggacccctgaattgtcaggtaataaccctatatcctgttggtcgaagccggttgttgctcttattcatcataatcacaccagtacaatatttggggtagcctatctaactgttgtcgacatggcggtctgaaggtctgactcgtagtcgacaacagggtagctttcctcctcgagttcgcatccggcgagatcagagacaacgctatatctctcctgatggtatctgtaggcaccataggggactagccatgcctatctctaaagtcgatatccggcgtcttgtcttggcgtatgttggcttgtatgttgtggtttctgttgttttgtgtatgttgattcttccctctcctcctaggggccttgtatttatacccataggtgtccccttgtccaagtagaactagggaaaccaatatggatacaatccgagtagtccttatcgtttctatgtagaactctggtcatccttccttatgcggaactcctcctatatctgaaggttgtttccgtataagacatggtatgtggtgggtcctgccgagatttagtcaactactattaggtatgtggtatccataaccctgacagttatatgcatttgttttttaaaaaaaaaatcttgcatatgctaattatgtttgtttgattaatgatgtaggagtatacatttttattacttgcttaaagtgcttgttttggttgaagggtagctatatttttaatttgttcctttttgtgaatcttggagatgtcaattgtgtttggttcactattcagtagtatttaatttttgatatgtgtttaagcactaaagtgactatttccttgtagcatagacatatccatttgtttgtttgtgtgaattccataattgttgattgtgctcaattcacaacttagtaggatttattttggtgatgcgtttcagccccaacatggatgtttgattccatactgaaatcttgttatggattgttgaacaattctaatgaaatcgattctcttttgtttttgtatatgttggaataaatataccaacttgatccaatatctcttgatattgaataatttctacccaacctaaaaaatgtggtgtattaattaattacacaaaaaagtgggatatacatttcaaaaatagatgtgtgagattatgttgtggtttatgcatattcttgagtgtgagtgcctcgcttagatttgttggtagccttatacactacgattgttctcaagagtaaggaattgaggttcttcgttttgatatgtagctcatgatttgcaccgcatcgtctgaatttcatgatcaacaaaaacatcttgattttaccttgtttagtgattaggtatgttctaatagcatttcttaaacaacatggcccaccttcgaagggtttgactattagttttattaatcatgaaagggatgaatttcattaatcagaggaaggtttttcacctttgttggtttctacatatctagtgtttttagtcatgtatcatataagatctatattttgcatcattgaggctatgatgccaggactactttattggttttagataagttttatactttggcacaatgtagaaaattccatcatcattcaaccagttactttagagtcaacctactagaatggtttccctggctaatcaaattagtaatacatggattgtggagctgacactttggaatttcgagggattacttttttttttgcattggtggaaataattcgttacagataactccattcagtgtggtcaatttttagtcttcacttatgataaacgatcacaattcttagtgacagtgttcgagccatcaggcattgacaagatgtcaacccactctactcacccttcaaaaaagatgatcattagaactaaaagtgatgaaagggaatgcaactatcacatcagaaaaaatggctcccgccattaaggagaataatggaaccgtaggaaagagaactagaaatgtagattgtcttgtgccttgtggaatatagggttccataaagaagttgtttgaggctaatgttttgaaaagtgataagagaaaatgtgcaggtccttctgttggtaagtctaaggcaacgtcaacaagccatagcaataccaaagatataatattcctctatttctgaaaatgttatatacactaatgtatttattttggcatagcttctcacatttgtttcattcatatagcatgtttaattgcattcttcatttgttccatgcatcaccataagttaggaggccatatgcagtgtcaaagcagtttttaatgtttgacgtggacttttggatatatatttgaccattcacgttattaaaaaacaatgcatagttatcatttattttatgtgatttgcttttatcattataaatacttgaagcatgacttacatttttgcatatgtgcacaaattgttttgaataaaacgaatggtcaatcatatgtccaaaagtcagtggggcgtcaagcattaaaaaccgaattgagtaattgcaaagagacctatatctagtctcttggcttgaggttaagttagtttatttctttcccttatgactgattacgaaagtcatttttgtacgtagttcatacatgttaagagtcctaagtattcacatgatcccccatcaagcttacttttgcacattatagattcctcaagctacatgtcagatgaagatatttgttttagcaagttgacaaagacaccagtactgatttgctttatgtctactaaggtgactccacgtggtaaattttaagttatcccctaaacgcagggttaataaatcacttttgtcgataatttaatgtggttacacttttcagacatttctaaggttctaagacatctatgagtaataccacaaaggcatgtaactgaagtagaaaaccatgctcttcaaagggcaaaagaatttaaaacctaataatcctttttaccgtgtaaataatgatatgttggatttttcatggtaatgttactttcatgtgttcattctcatcccgtattgaactttttttctatgtgcatgaggtattatctaaaaaaatgtggatgacaggattgatcttaacttgcataacggtactgcaactatagtttgagagttttggatgagatctaatttgaatatcccatcttgatgtttgatttttatgtatgtttattgtgaatgtgactgtaccaattgaaaaatcctacaactatataaatcaccaatttgtgatagcacattgtttttatgtcagaaacacaattttgtgtgatagcaaataacttgcaagattttcttggtgatgctagaagaattaacttccagcttctgcattatgaggcacatgtagccttacataactaagtttggtatatctaagtggccgtttggtcttatcgaccaatgattcattgaaattatatattagcgaaaatttaaacagatttttttaataatactatggccctaaagttaaacttctcaaactctttttaatctgctacagattgatatctaaatttaggacttactaggagatattggagacatatggccggtcaacatctccaaggtgatgggacgacagatggtggtgttggaatgagatggcgctgaccacgaccagtttgcgaggagggaggtgactacctcggtggggctatacaggtcccaccacacgtgtcgctgcggggtggggcacaccatctccttcgtcaagcaccccaccgtacccccgaacgggcccagcccacagcacgccttcctcgtctcatcaaatcctatcattatcattaatcaccatcattcattcattaattactgattaattaattatcattaatgactgcttagtaataacgagtcattgatttctgtatcaacgtttaagagtacaacaagagaagccagctataaacacatacttccttcctccgtactcgtaaaagaagtcgtttaggacaatgtttaagtcaaaccttgggaatataaatcataaataactctcaagttgttgagttcgaaaatgtaaaaaatatatgaatagatttgtcttgaaaaatactttcatagaagtatacgtatatcacttttcaataaatatttttatagaaacaagaagtcaaagttatgttttggaaaccgtgtcgttgtccaaaacgacttcctttacgagtatggagggagtattgagaagataaaagagtagagactagagagtagaagcagcaggctacagatttatagccagctatagcacagacttcaagacacaatgtatgtatcacatgtgggaccatgtattaatacggtagtatatgtttatagttaactattttatgaattagctattatagatgatttggagttaggccctgtttagtttccaaaaactttttcccaaaaacatcacatcgaatctttggacatatatatggagcattaaatatagataaaaagaaaaactatttgcacagtttgcatgtaaatcgcgagacgaatcttttgagcctaattagaccatgattaaccataagtgctacagtaacccacatgtactaataacggattaattaggctcaaaagatttgtctcgcggtttccatgcgagttatgaaattagttttttcattcgtgtccgaaaactcctcccaatatccggtcaaacgtccgatgtgacacctaaaaaatttttgtttctccaactaaacaggctcttagtagttggctatactattattaaacttgctccaatcttgtttaccgaatctggcaggatgggtgatgatgtccatgatccccttgtagatgtcgcagaagacgatgtcggcgccgggcagccgcggccgcagcgccgccagccgcgccgccaccctcgcgctgtacccctggacgagctcgttcgcctcctccacgcagctccggccatccacgacgtgcagcccctcccacatcacccgcggcgcgcaccccagcggcgccacccccatcaccgccgtcctcctcgccccggcctcgtacagctcctcgacggcgcgggcgacgcggtcggcgaggaggcgggcgaggccggggcgg

SEQ ID NO: 2620 - DNA, 11941 bp, Oryza sativa
ccgcgtccgcgtcctgcggcgtcggggcctccagccgcagcagctgcagcgtctcggtggccagccgcagctgctgccccacggcgcccaagcggaagatcgcgccgcgcccgccatcctcgccggcgaagttgacgcccctggccacctccgccgccgtgccgttgagcgtcgagatgaggggcggcggcgggaggcccatcttggcggctgcatcagaaatgattcgaattagagcaattcgtgttcgtggggctcacagttcatcagttgaggaggagctaggtggttggttaccgaggagatcggggaggaggcggtgggcggaggggaagagacaggtgccggaggaggaggtgagggagaggttgatggggagtgtggtggcggcgcagctggcggtggagtcgccgaggacgaagagggcggtggccggcagcgaggccggggcggaggcgacgatgcggagcagcagcagaagcaacagggggaggagcgccatgcctcgggcgttgtggcgccaaccaaacaaacacctcgtcaacttcaaagaggaatcgattgccgatttggagggtatgaattgaatttactaatatattaagggttaaagtgtaattatttcatctcatgacatatttcgaagaggccccctgtaacaaccaaaattactggtctcggtggaatcgcagcggcctgcagatctctcttctccgactcaatcattcgccctgcgctgcacaaggtgagaggaaggaagggaaaaccaattggatctctcaattaatcggggtgtgggagcaagccgcttcaacgcaattacgcaacgccggaggtagtcaggtagttgcgatgccttcctgttcttaatttcgccgttgttttcccctttactgaaatttctttaaactgtcccgaattgttcgatgcattcgcggggaacgaaaattttatgttcttgttcgtagtttcttgggtcaacggctccgtcggctgcagtttgggatttcaatttgggcgccatttatgggtagatttcggtgacatctgatgatagctgttaggtttgtcagcagtcaaccaattggcctgcccgcgagtttgtgcaaattcctttcgtccttttgtttgggcataaatttgatgaatgcccttgccctacattgcttgtagttatgtggaacacgccgagcagaacaatttcatggtcttagtgtactctgatacaagtaatgttttcttcagtttggtgggagatgtcaaactttgtttgctaccactagctatggctgcttggttttgtacctgtatttcatgttgacctagagcatgttttgcttcaccgtgttgtttttttggagttgtaatccacaaatttttgttggtgtcactatctattggttggttggtttcaatataaatttttcaataatctctttggcgttccaatttttcctacataacaggcatgattcatgcaatacactgactgaaaaaataatatggcttcaaaagccattaaaaggaagccttacactgctgatattgatagaagcgaaaaacagatggagacgatcataccagattctgtaagagaacctcttctaggaaacagaactcatgaaagcaaatccgaggttagtgaaatttctccaaatcatatgaatccaggttattaaccgcattttagttcttcatgcgccttaccccttttctcgtactttttttttagagacatgagcctaatatgcagccaaatttatgggatggaaaaggacaagagcgccttggttggatgcatattatatcgacttttattgctcaatctgtaagaaagataggtacctatcatgaatatgattccagagaagtggattttttagtgtcttactgccctctcgaatgtacacagcagaatgcttaaacttgaccttttagaacatttactatctgaaaaatcttctttttttttccaggaaatgcgctctctcagtttggaccattgctagcaaagttctttagtaggtcttgtgcttcccatggttcacatgatgaacaggcagttctacttgatctcagtccactacaggtataatcagtgctggcacatgcagatctcctatttccatttaaaataccatatgattgatgggttaagtttcccatcaaaagcatgaattcttatgagtatcagatgtgacatgttaatttcatgtaaatattttgagatatttcaaaccttttactgaagtatgaaggaaaatatcttttcttcctcagtagtttaagcatttgaatgagttgtttcaagcatactctcgacatctttgatgctcaattcatctttcatttattttttatccttttttacaataataaaagttcttgtttgcttttgtgattattcatggacaaaaatgttggtatatccatgaacaatatcatggtaacatccatgaaacttgttatttcttccacaacactcatttagtagttgaattgcatgctttaaaaattcaaatgaattcttgacttggtttattaattccaacccttctgttctacaggagcaatgatggcatctttatgttattcttgactgtttcaagtttttacatttaggaacttttttacatgatactacggttttgacagttccatgtttactttataggaagagagactgaggttcttgagacaaagattaaatgtgccatttgacagttcctctgtcaagcatcaggttccgcttctgtacctaactacctataggcctttggtattcttgttctattgttctcaccaatgggacaccaattttcttgctcagaagaaatgataaactgaacaattcatatactaacattcatgatagtaaaatatttcattttttctatgacaggatgctctgaaagaactttggagattagcttatcccagccgacaacttcctcctctgaaatcagatctatggaaggagatgggctggcagaattctgatccagcaactgattttaggttcgtttcgctaatccctagtaatgattttaggatatatatatataagctgtcatgcatttatcaacaccgcttgaacctcgacaactaatcttttgaagtatctaatgattgcagagcaggggggttcatgtccttggaaaatttaatatattttgctagaaattacccagtatgtttctattaatcatgaacatttactccgcattagtctgctgttattgggtgattcgattaggtacaatgctcaatgtctgctttaacatgcaggattcctttcacagtttattacacaaggcggatggtaagagatctgaatgggaatatccctttgcagtagctggcgtgaacatatcttatatgttagtgcaaatgttggatctgcaatcaggtgaaatttgcagtaacaccttatctttgggcccaatttacctcctttgctcttgacttcgaaactctcttttttttttcagctctatgcagagctacagcttatctctttcacttcttttgtaggaaaaatgggcacaaaagtcagttctcaatttgttcaactacttagagaagacgagatggcttttgataaccttttctgtatggcctttcagatgcttgacgctcagtggctcacaagacaagctagttatatggaattcaatgtgtgttctctgtagaacatctggtctcttctattggcttctcattctaccaccttattcagttgtcttcatttccatttttcaggaggttctaaagtccatgcgtattcagttagaacaagaacttactatcggaagcatttcttgtgttcaggagatgccatcatttaggttgctaaaaaggtagccatgtttgttgtttacagaaaggagtgtatcttacttgtcagtaggatcttgtgcatactaccgattctttcattggttgtacaacatgacacactgtaagattatttatcatagaataataaacccagtatatatctggtactttggtaagtgttcaatgttttctggggtaacaatttaagtatttctctaatgaaaattacctgcaacaggtttgcttcttgaaacatgtgaaaaatgtaagtaaagtaaatatcttttattaacattcctgatgtttggaatatcaataaaagatgcagcatttatgcattcatgcctcaaccaagatgtatagtatagtttattctgaaagttagatagatttacatattgtgatttctgtataacatatgctccattaccttataaaactgtgaactacccagagttttcttgtgggaatacctatagtactacccaagcattcaagattctgagtaatcagaattaactagctcaatctagggtaagggagaaaattctctccctagttaatcaatcagccttgggggtattacaagaaaaggaacacagacacttgtctcatgccaagttgaatgcctttgggtttctaggagactaggaccatagggagaagcatatgaatcttccccacctgaacagaacgcctacagaagctttgcttctttgtggcagtgccattagacagaaaaatataccccaagataaaaacctgaaaacttccctgtatatctcaagattttcaacacccagaaacacgcacacagagagaatcagttgcacacactgatcattttttgagggcaggagatattgtttgcttgaggagatattcgctccctatctgaaattgaaatgtccttgtctaaaaagtctgaaatgtccttgtctaaaaaatctgaaatgtccttctccaacatattgcattcctcaaacaaattgtattctgccatacctgagttatccatgctgttgccgccttcagttatactggagcacccttcaaataggtactccatgccgccttcgaatgcctcatcattgaaccattcactgaaattcatcgagttgctgaagtaagccccaggcattgtatccaattcataatccaagcaagggctccagaggctttcttcaatgccatcaacaattggaaggggttcattcatgcattcggcgctgtcatcggctgcaagtggctcattgttgtcacttgatgtatttgcttcactggaactgagctcttggactgcattctcacttcggtcatcatcttgaggctcttcatgtaatgctggcaccacctgtggctcttgttgcagttgtgccaataactgtggttcctgttgcagctgtgccagtaactgtggctggtccaggtagcagctgatgtcgaagttggttaccgcattggcacctcggtattcgattgcagcaagatcataggccttggctgcctcctcttgagtatctgtaaaaagaggtacgtttgttgaaatgagaacaaattttctggtgagacactgaatctttggggcaacttagtactactaggagtcatgaatacttctagtaacattggcattacagaattgatcaggtcatgctgtatagatttaagactttagaaaatgaatgcattggatcttaatactgagagatgctgaattgcatcccatattcacattttttttcactttctagtttgacatgtgctggacaccatctgagatctgatatgacttttcccacattgctggttgctagaactgtgctggcaaccttctgtttactagtaatcggtgaacactgttcactctcccttttttctttctttatttgtgatgaaagtagtgatgaatccatctgtgtggttctggatcttgaatcttgatctagtttggcacagggggggtaatagcctagtagggcattctccatgcacgtgaagtgatcacttgcaactggctgctgactcactcagctagctctagtggaaagagccggcagtgatgaacaattgaagatccctatgcaccatctggtttttactactggcattgcagcaccactcacgtgcttgtcacatgcatttccaagtcatgtaccatataatgtatctatgtatactaggattttgtctagtaattaggacatggtggtgatcaagacatggggcttgtttttatgctatttctagggcaagttgggcagtcttctggggattgcatacaggatggtatcttggtctcatggtctttgatcttgacagcaggaaaagattttctgatttttttaagtaaaagaaaaagaagtttcaacactatgcttccatatcagtgatatcaccagctcacttaatttatagtaaaatggagagtttgtggttcaagaacatacaaggagaataatatatactactttctctgttctaaaatataagcatttttagaatagtcctaaatcaacatttttaactttaactattaataatgaaaaattaaaaagagcaatcacgtaagaataatgttactagattatagagtaaatttaataaaactataggtattttgcataatttatcacaaaactacatattaaaaagcttgtctcacaaaactacagatttagtgtctccgtttatcacaaaactacaggtagtttgtacaatctatcacaaaactacgatttaagaactttcacaaaactatagatttagtgtattcgtttatcacaaaactacacatttagtgtcttcatttatcacaaaactacagatttagtgtctccattatcacaaaactacaagttttaacaacgctaaaacttgtagttttgtgataatgaagccattaaacttgtagttttgtgataaatgaagatactaaatctgtagttttgtgaaataagtacttaaatctttagttttgtgatatattgcgcaaagtacctgtagttttgtgaaaaacgaagccactgaatctgtagttttgtaaaacaagttcttaaatctgtagttttgtgatagatcgtgcaaaatatctgcagttttatgaaatttactcaaactagtatcataatatgtaactctttcatttaagataacttgtttttataaatattattggtcaaagtagcatcccgaaaattatattgaaatctaaaactgtctctattttgagacagaggaagtactacctagtaagtaatcctcaagaaaagcaaggggtcaaatctacatcgaagggaaacaagaaaaacacgccatttaatttcgcagatgggttgatcaaccatcataaaatttggtaaaagttaggtggccggcttacagcaggcaaattctccaacaaacaagagcggcttgtaaatgctagtaatcagcatttgattaagttaagtgggctccaagaaagaaagaagagcaaagagcatgaaagattggatgaaagaatacgtaccgaaagtacccaggtagaggtacttgttccccaggacccgccctatccgtgcctcccaccgcccattgtggtgatgcctgaacaaaaccagacaaaaaaaaagttcagaaatgaattactaacagacagctactagctctgaacaaaatggaaacagcaagttggtagcactggcaccacaatacagtaactgatgttggaagcagatttcatcaagaaagagagaagcttaaaacttttgcagttctgacttttcctagatgcatgcatgacattgcacgaaactgacacaagaaagagaccatggggcatccatgcagagcatacacggctggcaaatgacgttgccagctgatgaatgccaccctagctagcaatactatgctgactcatcattcagggagagagagagagagagattaattagagttaattaatcagtagtcctacctggcaacgcctctgtacttggagacacccctggagaaaccgctgctccggcggcggagggaggccaggtactcctccctcgacacaccctccatctccgacctctccttctcatattcctccagctgcaataattcacattatcttcagtaataattcagattacacaagtcgcaattgtctagtggtaagttggcaaacttactgggaaattgagcactgtctcaggaccccagtacttaagagctgcaaggtcatatgcacgagcagctgcttcctcactatcataagcccctaaacaccattaaacattgcactaatgttcagaaacagatcaaacaccaacacaataagtagttatgtaacaactagttgctatatgcctatattcttagggataaactgttttcatattgagacaaaccaaggatgtgacagatcaaacaaacaaaatgtgagattatacaagaacaggaagcaacatgcagcatgaatctgacaaaacagggtgtatagacaactagtttgtgggacttacccaaatagactattgagaggagcatcaagcagcagcagcagatcaaggtcacatgcgcatcacaagggcaaggtcccccaaagataacagcaaaaaagaaaggagataaaaaagcttaatcagaatgtcagccttaaaaaattcgctccactttatagtaataagctttgtactaatggccgatgtatcaagatccttggcagtatacagaagtacaccaaggaccttgtatgtttcactttttctttcattatagtacattatactgtaaaaatactcaatttcactttctttacagcattttcagataaaattcatgttaaaaatcctaaaaaaaattaggcaactaatgcatgttgcgatcaatgtaccttgcctccctttcttcttgttctgaagtgaagtggagcaattcttgtcccacagatgggcctcaaatctgccagtccaccgatgcctgtttatagacacatgcatgcagcaaatgattccaccgtatattgaatttattaatgattgataaataagcagcattcaagcattagtgtttgctttacaggaggaagaaaaactgaaggagttgaccaccccagcagtaaatgtagatcaaccaactccctacttcccagctaataataattgactcactccaaggggaggagcagcaagaaaaaagattaaaaatgggaattatgagatcaagaaatggatccgatcgatcatgctcgccaacctccaaaagatgaggcatgaaaaggggagcagactcgccacccacaaaacgataaaataactgatgatctctgacatgcaagtgaaaatattcaggaacagattggaaagaagcggctggtaattttgggagcctgaaaggatggaaatgatgcggaattttgggctggaaatcagccattgattaactagcggcaatgcaggatgaattcgcgactgaaatcgagaggggatcagaaagaacagcagaattgggatcagagggatggaagcaactgaacatgcagggacgcatacctggtgactcccctgtagatagaactcctcttgccgccgccgccgccattggaagaaggatcagccacctccttgctctccttcttgggcctcttggccttgccggtgctcttctccgtcctcggcctcgccctcctcttgcagggcatcgacatgggcgaagaggaatcctcggaggaagaggaggaaggagacgacggcgaggatgatgcagatggagaagatgatgcaggatcaggagacgatctcttcgccatgatctctcgcgttggtgcaggtgcaggtgaggaggaggaggagaggcagcgaagtggagcccctgaatttttgtaatttatagcggagggggggaacgaaaggaagtgcagcgcaaagatgggttttttgggttgctaatcaccatcatcagcattaactgaagatgacacctctgttttttttgtatttttgtgcgtcagggcctcaagctggccaccatacgagtcaattttgatacacttattcattattttttttcatttcagatatttcctctgtttttatacattattattgatgtaagtgcgcattccgtttgtgcacaagtagtggtcgtattcagatttctttctctttctttatttttgcagatttcggtatacgtgcagacgctcatatacatacgtgtatactcaccttctataaatgcatatgctatctctatgaacacctttgaagattaggcaaggatattggcgtttctgaatagacataattttcaaaggaagcacaccggtaataatatctttgagatttgcgaagatacaggacaattttacatagcatagcagatgacgcactggcaaattaactcaagataacaccttgttttttgtatttttgcgcgtcagggctctgctggacaccgaagattagcaatcaatttcgttgcacttattttaattggtttctttttgagagatttcctctgttttaattatattattaacgagtctccaccaaaaccctggtatatcaaacaggcacaacattgagaacatttcttatgagccttgaaatttggtggggattgttagaataattgggttaggcccaacttataatattaaatctcaaaggcccataataagtgttgaggataataataccacctcaggatttaagcgagaaatatctcaacctaaatagggagttattggaggctccctgttgaccagttgaggtgggggtcggaatgccacacgcgcgcacgcgcgcgcgccgggccgggccgtgggcgagggcgagggcgtggctggcttttgcagccactaacccacgttcccacgattccctccgcaacagcgcttccacgttctttctcctgatagataaggaggccgcgagtccgatccgatatcatcgcttctttcccggtgttagtttctccttctccgcgcctgagttgctctcgcttcctcgcttctgatctcttacgcgcacgagagattggaaggagcagtgcctccgaaaccacaccttcgcctgagatctgcaccgggtaggcgggtgatcaggtttttggggagtgcctcccgcacgactgctcatcaccatgtctggagttgccaccgccactgctggcggaggtggtacgccgccgacaggagctcgatccggagctggtgcgccaggaggtgccgtgaacgacaacaacaacggaggcaattctgcctcaccatccagcggagggagtgcctcccgtacgactgctcatcgccatgtctggagttgccaccgccactgctggcggaggtggtacgccgccgacaggagctggatccggagctggtgcgccaggaggtgccgtgaacgacaacaacaacggaggcaattctgcctcaccatccagcggagggccattctcagggtataatcttctcctcctgctactattgttagcgctatcgctatactatgtgcgctatgttcttgttcctgttctacatgatgcctctagcatgttatcgcgttactgttatgttcctgttcctgacattcatgatgtgcatagtatgctactggttatgtgaagatcaccctacactgcttatgccatgatcattgctttaactttttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtacgtcatggagcagttctatgactacaagatggtcgatgaccattctgtagtggaacaagctcatgagattcagatg

SEQ ID NO: 2621 - DNA, 1699 bp, Oryza sativa
ccaatatggtacagaagaagaaccctcatgcatcccacaacaacaagaaagtcaagcctgatgtcaaacccaaggctgcaaccaattttaagaagaaaagcaagggaaaggcaaagggagactgctttgtgtgtggcaagtctgggcattgggccaaggactgtcctgagcgcaaagataggaagtctgccaacatggtcattagcgagggcggaggaacatcggggtacggtaaaatgttacctacagttctctctgtttatcattcacctgattggtgggtggacactggtgctaatattcatatatgtgctgacatttctctgttttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtccctttaataaagaagaatctagttagcggctctctattgtgtagagaaggttttagacttgtgtttgagtccaataaatgtgtcgtatctaaatatgggacttttgttggaaaatgttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagcataaggaagtaacaccattcgaggaataggaaaggaagaaataaaatctctcatacctacgaacatggggctgtttggccaaggtaaatgtacctatagccaaaaagcggaaacttggacaaaaactgttgattgtgtgtttcttggttatgctatccacagtgtgggttatagattcttaatagtaaactctggagtacccgacatgcatgctggtacaattcttgagtccagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttg

SEQ ID NO: 2622 - DNA, 502 bp, Oryza sativa
cgtagtaataataatttaaacccaaaactgtgtaatgataactctgtaataataagtaaaaagggaatcagcggcatgacttaccaggatgccattgctgaagcgcatgaggacggtggagacgagggcgtaggcggcgagctcggtggcgccgatgtgtccgatgaacgcctggctgatgacggtgacgccgaaggaggagaagcgggcgcagatggaaggacccgccaccacccacagcttcttgttctcctccaccactcgccgcctcaccgatccaacctcatcctcctctgcatcatcatcttcctgatgcttgtaggtagccggcttaggctccaacagaggaaccgtcagcttctcatcatcacccggcttctccattttgctaattaattagtggcggcttgtagtttgcagcaatggagatggagtggtggtgcttcagattcagtagcaatggcgctgctggaggaaagggaagcatcaaggatgctcaagt

SEQ ID NO: 2623 - DNA, 2071 bp, Oryza sativa
  unsure (1)..(2071): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataatatcttaaacttctatggtggcttcatatatgcattaatagttacatctctatttcaggtgaactatttgttcaagtttaggttcaaaattacagctaatatctccaatgaggaacaaaacataatatccacactaatttctttaatcaaggattaaatttctgggatgttaaagtcccttaaaaacttgatgtgcataaaaggcaacatcaagttgtggataatgaaatggaaaaagttacccccctacactattctggaagtacgaattacccgctcaattaaaaaaccaaatattcttcaccctcaatttttcatacgggacagatttaccctgatagattttggagcggttttgtttctatgtgacagtccagttagtataaaaaattataaaaaatataggacccacatatggtaaccaagagaagaggccgaacgaataagtgggcctattatttttaacttttttatgttcactggtcacgtgtgcaccatgtaggaccaaaaccgctccggaatcgtcagggggtaattcgaccgatatgaaaagttgagggcgaaaaatgtctaattttttaattgatgggggtaattcctaccgccacaatagtttgagggataatttggatttgtttcctaacgaaatatggataacgaatgggcggacaattaatcggaatttgttggaaatttaacatttttcaaatatacgttagttgataataatttgacctcttttagagagaaatatatttaaatgtattcctaccatccttgtctcatggtcgtcatcagaagcaaagaagaggaagtcagttccttcattccttgttactttcatagtgttgcgctgtgagaattttgggaaggcaaacgtctaggtctagccagccaatagcagtaaagaacacactaatgggttggaatgctagattattgtgggatgggcctatgtcatcgcacaattatattgttactagcaaaagtgtccgtgcgttgcaccgagtgattacggagtgtgtacagtgatcaaaaaagtgttgcttagggacctaaatcagactttttcccgccctagccggtcggcccatggcctcttatgcgcacatgcaggcgctccccacctcctcgggccgcaacctgggcctaggccgggaagcctccccacgcgcgcctccacttgggttgaattcggtctagccagtgccggccgtccgatcttagggtttcgatcagacggttgggcgccgacgtcggagggacaaaaccccttccctcccggcgccggcgaaaaccctagcctcctcggcccttcaccggtgtgcgcactcgtcgcagggtgagtgcgccgccgtcgagcggccttgccccaacggccctccccatcgtctttcaagcggcgcccctccccatcgtcttctgcggggcaccctcccctccactagatccagtgggaggggaggcggcggtggcccggcggcctagatccgatgtctcggatctaacactagtagagaaaccatctttggtcggtcgacccaaatccataatagtcccggttctattaaaaaccgggactaaaaatgatttttagtcccggtttataagagaaagatctttaggaccggttgttgttaccaaccgggactaaaaatcatctttagtcccggttggtaactccaaccgggatctttagtcccggttgattccatgtcagaccgtatcagggtactaggatctttagtcccggttagtaacaccaaccgggactaaaaacctatttttagtccctaaaaataaaaataaaaaacacactatataatccctattaccgatcctcttttcctgtccacacaacaaactcctccctctatctttttctccctctccaacttctttatctcttccttatctctaactcctaccttctctttcttttttttccttccattagtcacagcgaagcag

SEQ ID NO: 2624 - DNA, 6849 bp, Oryza sativa
agattttcttttctaaaagactatataatcctatacacttgttaaattttgcaggaaaaaatgtatttggagagtctactcaactgagcgacatgtaggacaaaaaagctaaacaagtcatcaaagaaaaagaactaataggtatttatttgtgtgatatatgattaaaatcagtcttcccaaaatgcataaactcaaaattacataggcacacaactaatattacatatgtaatttcagtggaataggactgtaactacctatattttcagattttcttttctaaaagacaatatattcctatacacttgttaaattttgcaggaaaaaatgtatttggagagtctactcaactgagcaacatgcaggacaaaaaagctgaacaagtcatcaaagaaaaagaactaataggtatttatttgtgtgatatatgattaaaatcagttttcccaaaatgcataaactcaaaattacataggcacacatctaatattacatatgtaatttcactgtaattggactgtaactacctatgttttcagattttcttttctaaaaagactatattttcctatacacttgttaaattttgcaggaacaaaaaagtttggagagtcttctcaactgagcaacatgcaggacagagcagctgaacaaatcatcaaagaaaaagaactaataggtatttatttgtgtgctatatgattaaaatcagttttcccaaaatgcataaactcaaaattacataggcacacaactaatattacatatgtaatttcagtggaataggactgtaactacctatattttcagattttcttttctaaaagactatatattcctgtacacttgttaaattttgcaggaacaaaaaagtttggagagtgttcagtgttctcaactgagcaacatgcaggacagagcagctgaacaagttatcaaagaaaaagaactaataggtatttatttgtgtaatatatgattaaaatcagtcttcccaaaatgcataaactcaaaattacataggcacagatctaatattacatatgtaatttcagtggaattggactgtaactaactatattttcagatttgttaaataaaaaacttgcataaactgaaaattttatgaatattttcaggtttgtttacaccaagagttacctacagcccacaagcactacatgatgagttaacaatgctcaactcacaaacgacacaggttggtttttataaaagcattacaaaaatctatgcaattcatattaatttctattatactaacattgaaaaaattgcagccgggaaacatgtcctatactgaatctaatgcaacatgtcattaatagtccacgcgttacactacaaccttcccaggtaagaatatttctagttatattaaagtacatataatatggatcagtaataacaaatattgcaggaagggcaacaaaacttcacaaggttgtttcagacaccaacagcatatcatgtaagcaaaaaaaaaaggagcattgcctatattttgatgacatagaaagaaaaaaaaattatacaatcatgcacctataaaaaagtatacatgtactaattttgttattactaacaatgattaattattttaatcatgcagaactcaatgatctttaacaacaagcagattttccccaaacttgggaacaaatcatgcactgccaagcattgaatggaactaccaggaatttgatgaaatttacaacaacagcagtcacaatacttatgaggtaatattaacaacaaatttttccaaacttattaataaaaaactcattgctgtgaactaacatttgtttgaaaaaaatgcagatctcagaatggacaacaattgaagatttgtatgaattgaagaacacacatttcaaatcacaggtatatatatatatggttcaaaaataaacagttatattgacaagcatagaaaaaaaatagttaaaattaattttgctactaataaacatgcagggaaaatcaagcagtttcacaaatggagatgaacaaccagcaatatacacaaacaatgaacaggtgaaattgaaaacttgacagtgtaattagtagatatcatgcattattcataatagagcttacataatagtactatttaacttttgacaggaaattagtctatgcatacaagatcaacatatggacaaggagaatggaactgctcaagaaacagttgaagaaattcaaatacagcaaacagagcaacatgagacaatgccagaaagcaatgaaacatcaaattcagaacctaacagcagagaagaactaaatgaagaggatattgataatttcttgagaaatgatgaggatggcaatacacaaattgacaaaaagcacatacctgagcttggaatgaaattcaaaacagacaaagaagctcatggcttcttcaacttttacgcttatttagctggtttttctactgtgataactcatcactacaagtcaacaagtaaaaagagaaatggtgagattacaaagtatacatatagatgcaacttgcaaggaaaaaatgaaccagaggacaaaaatgcagaacaagaagaagaagaacaagaagaagaagaagaagaagaagaagaagtggaagaagaagaacaaatagaagaagcaacagaacaagaaaggcaaactaatgttcttaaaaagactggctgcaaatgtatgatgatggtggaaaaaatgtttgccctaggagatgtatggcaaatagcaacactagatttgaagcataaccatgcactttgcccaaggagagaggcaaaatttctgaaatcgcacaagaatatgacaataaaggagaaaaggctaataaggacattgaaggagtgcaacatacccactaggagcatgattgttatcctctcatttctgcgtggtggcttgccagcactaccctacaccaagaaggatgttagtaatgttggaacagcaataaattcagaaacaagaaacaacgacatgaagcaagtgctggcttatctcagaaaaaaagaaatagaagacccaggaatatcctacaaattcaaactagatgaaaacaacaaagtgactagcatgttttggactgacgggagatcaactcagctatatgaggaatatggtgactgcataagttttgacacaacttacagaacaaacagatataacatgccatttgcaccatttgtaggagttataggccatgggacaacctgtttatttggatgtgcattcctaggtgatgaaacagcagaaactttcaaatgggtttttgaaacatttgcaacagctatgggagggaaacatccaaagactataatcactgatcaagacaatgcaatgagatcagccatagctcaagtgtttcaaaacacaaagcacagaaattgtctatttcacattaagaaaaactgtagagaaaagacagggagcatgttttctcagaaatcaaacaaaaacctatacgatgaatatgatgacattttgagcaactgcctgacagaagctgagtttgaatcactctggcctcaaatgatgagaagttcaatttgcagaatgtgaattatttgaagataatgtggaaaaatagagctcagtttgtaccagtctatttcaagtatgatttctgcccttttatacagagcacaacactaagtgaggggacaaacagcagatttaaaagacgagttggaccacaacatagtgtaatgagtttcatgaaggaatatgagaatataaatgatactatctttgacactttgtacagcaaagatttccaatcaagaacaaagaagccaaagaccttgtggttcaactatctcattgaagagcaagcatcagaactatacaaccttgaaatattcaagaaattccaactagaactaaaggaaacattgagtttgcaagtatcagtgctacaacaaggtaaagtttatgaagtgtttgtgtcaccaaacagcatacagaaagaatatagaccaaggaagcatatagtcattgttgacttaccaaatgaaaactatagttgcatctgtggaaagttctcaaaggatggaatgttatgctcacatgtcctgaaagtaatgttggacctgaatgtcagaaaaattccagaaaaatacataattgaaagatggagaaagaaggaaaggaaagaaacaaaaaagcacatcatgcagaaagaaaatggagataattcagtcctaatgtttaatgtgctgtctaggaaaggagctgacatagcttcaaaagcatcaaaaagaaaaagaacatatgattaccttgtagatgaacttgacaagttggagaagaacattgacttaatgattcaacaggaagatcaaactcaattctcacaacatcaagacagtggtatagaaattgcaaatgcagagcaacaagagcaagaaaaagatgttcaagaagagcacatagaagatcctgatacagcaaatacaaaggggagaaaaccaaaaaggtatagaagaatagtggagaagataatagaaagttcaaagaagaaaattgaagaacaagaagatgcagaagaaaatcagaataaagcaaggcaaaaaggaataacaatgaagaaaaacaaacagcgaattcagcaaccaaaggtaatgctgaaaactaaagaaatgtcatgtacaatgaaaaaaagataaaataatactaaatatttaattgcaggaaaaagaaaggcaacagaagacaagggaacaaacaagaagcagaaatcaaaacaaggctgaggaagcaaaagcattggagacagaaaaaaaagaatacatatatgacttttatagttcatgtaataggactgaatgagttttatatgtgctacataagtttctgtatgcatatcatatactatgtcaaatagaaaactataactttatgatgaaatatattctatatacacatttgactagacataaagctaaaaatgctgatgtgtgacactattcaagcatcaatagcacggtgattgcttggaaaccttgcctgcaaagaaaattaataatataaaacatatcaaaatttgataaataaaacaagtgtataaagcattatttgcaaaaaaaaatttgtggtgaaaaaaagaaacttactgaatcaaaccaattgacaccaacattttcaacttcggtttgcaacatcttgttgtttggatgaaaaaacatctgattcgcatactgtacgcggatattgttgatattttgtccagtgaattgattagaaagaataattcttggagaccaaatttccatgaacttcattgagaatatgcctgaatcaaaactacaaaacataacaaaacaataactaaacttattttgaattttttattacatctgagcaacaaaaactgaatatcatttgagcaaacaaaaaactgaatatcatctgagcaacaaagaatctactggcataattataaaattatgtcactaaactaaatgcagattttggtggtcaaaaaccaatcaaaatatcatcttccaaaaacaatacaacctacaaaaatgccaaaaaaaatttgatttctcaaaaatcagtttgaatttttttttgaaatgacataaacatgcagcatctaatatatttcaattcaattaccaagggataatttatcatacaaatatcaataaaatattgacagatttaaaaactaacctgtattcttggcgtggaacaggtgggaacttaattttaaaagtgctgaagttcattggagtgcgttcatatttatcccacacaatctgcaaattttttaactgcaattcatacataacaataaaaataattaccagcaaattcattcatatcaatatagttgttaaaaagggaaaaaagaacatggaaataaaagtacaggaaaaacacattaccagcaaaggcagaattggttcaaaaaactcatcatctggttgatgcaatgaatctaaaaacaccagcatcctatcttttatatcaacaacgagaacaaaccagtgctgaccatgtagtatagggaaaaaaagctgcaaaaaaacaaaaacagaaacaacccatacagtaaaaataatgaattacaacaaaacaaaataaacataattagaatagtaaaaatcaataccatgtcacaaaggtgtagtggccgagcactagcagctccaaggaaagattttttcactttttcttgatcaacaaaatcagggtcaagaataagttgtgcctagaaaagatatattgtacaatcagtttggggaaacaaaagacataattttaaatttttttacaaaaagatgtaatgtacaaatcagttagctcacttacaccaatggatgggaagaaataatgcttcttagattttgatggatgattgttttgaaacaaaaagcggcagaaaactgacatgacaaatggcaaaacaacaccagtctttttgagagaatggccaaagctagaaaacttggctctgacattgtcgatatcaacagcatcataactacataataaaaaaatgaataaatagtaaattaataatagatataaatgaacaacacatttttaagaaaaaaatcaaaaaaaaaatacagatggcaaattaatctaaaaaaatggctgtggcaatgtttctgatgcttctgctacttaacttgtaaacaaagggttcagctgtaaaaatgctattaactgagttcagtggatgaaatctagaatcagacaaaaaacatcgcaaatactctaataatgaattatgctagcaaaagacaaatcagaacatatcatgacagagacatagaagcaaactgattgataaataacagaatagaa

SEQ ID NO: 2625 - DNA, 3546 bp, Oryza sativa
  unsure (1)..(3546): unsure at all n locations
catgagcttgattatcctcttcatttaactgattattggcatcatcattagaactactaacatcatcttcagaatcaagcaatttgaatgaaggccttgaaaaatcaataatattgtctctggcattttgatttagtaattctggaaatcttgtcttaaacttctttgcaacattatgaatagaagcagcaatggttgcactagcagaacctacagaaacatagtataaccaaaaaattataaaaatttacactatttagcaaacttataaaagaaatgaaataaaatatcaatgaaaaaaacataccagccaaattatgatcagcacaatatttgaacttcttcacaaaagcactcttaggagtcaacaactcataatctaaaaaaaagcactaagtgaagagaaaagaaaacataactaaaataacatcttctgaattgaaaaatgtattaacaaataccaaaatctctgttacttgatgagataagtgcagcagcatgaccagatgcaataacatcatcaccattagcctaacaaagaacaaatgaaaacaaatcaaacttaaaacttaaaaatgggaaaaataaatataaatgatatagaacaaaaaaatacttacaacaaaagagttgacacatggatcattttcaatgggtgtacagacaacaacatcatctggtattgaagcatcaacatctacatataaaaaaataaatttaaaaaacatgcatatagaaaataaaaacagaaactaaatttctaatcagaaaatactaacttgtattcattggggtagaaataccagcattatcatcaaatctagaaggaacagcattacaaccttcagtattagtatcatcaacatcattttgaactttatctgagggtgtaacactatcttcagcaaccagaactagagcatcaataagaacatcttcacaagtatgactcccagcagcatgaacttcagaacaatgatgttccatcagagaacataatttctctttcatactaagaggcaacacagaacctagagcagaatcaagtttctctttaaatgaaattcttctctcagcagtaggatgaggctaaaaaaaatgaaatctataagaagactaataccaaagttacctagtaataaatcaaaaaaggggaccaaaaatatacctgataataacacacagatttaaaatctctaagaggcctaagaccaaaattatcatcatcaactttgtcaagatcagagtaagtttgtatcatgttcttagtccaaacagcaatgcgaggagtgctatttccaggattcttcttgccaaaatcaacatggtcaagataaagcgcctaacaaatttacatttaagtcatatattactaaatagaaaaataacaatatcataataagaaataaaggaaaaaaatacttacagcccaatagaataagcaccctccaaggttgttagacttgaagaactttttcagaaaagtcatagtccaatcataaatgaactttgaccaatcataatttctcagattttcaatatcctcaaaaactgtcagatacttggtgctaggtgtcaaagatgaatttgggcaaagaaagcaagctagcgcaacaatcagaaatgatgtgatcactttatcatcagaaatctattcctttttaataaactaatcaccaaagaaccgaactgaaggtagatcactgagaccatactttgatagaatgaacttctttccactttcaaaatccctactgaattgcaaaccacctggaggcaaaccaaaaatagtactgacagaatcttttgaaacagaaatcactttgttgctcaaaataatttcagaagacttgtaatcaacatgctttgcaatccaagtggcaaattttattagaacataactgctatcaaacaacagtagagatccaaaatcatagcttcgaatgacattcttttgatgctcagacagtgcagctataacatcagagaaatatttgcaagaaaacctcgagaaagatacttcattcttcttataaatccttgctctcttataattcataaaatgaaaattaaattaataaatcatacataactcaaacatcaatgcaatgtaaaaattataaatacaagtaggaaacttaggcttaatgatcagggtacactaatatttcacacataacaaaacatttaattatcaattatacaaaaaagtgatgaacaatgaaagacatgaaacttgcattggctgaaaacaaaaaataataataataattcatcatcaagcacattgtcaaattacatgaaaggtcaaaattggattaaaatgattaagataaactggatacataaattcaacaaacaaaaccaaaaaattaccaagttcaatactaaatatttataaactgcagaacatgccatacaacacttaaatacaactattatttacacttgaaaaacatgacaaatgtactaaatcaagaaggatacacataatgcatatataaaagatttaaatgcaagcatataaaaaaatgagacaaaatatcagaaaataaaacacataattgcaatatcagacaaaaataccttggatgtatggaaatcataagattttttcaaatgccttttaatctcatgaacaacctagaaaacaagaaactatcataagaatgaaaggaacaaataatacaaaaataaatttataacatacctctttcctgtgcattcttagaattaaatcatccaattcagattcactactggattcactatcaacattacagtcttctaaagcatcaacttcaattcgatccatctaaataacaaaatagacaatgcaacaaaacaacatgagtaaaaaaaaagtggagtttcatcagctaataaacaaagtatatatagagaatacttttataaactattagtataacattttaacagagataaactagtactataacatgcatcaaaagaatgaatatcaaatcaaaaataaaacattactactaaaaaacctagtcaacagatctagttaaaaactagatgtcaaacataaaagctcctaacagatcatacataaaactaactaagttcatatttaaataggaataacaggatcagattcaagtatacatatacatgagtacttcaaattgaaatgtctgccatatatacctcaagtatacatatacatgagtacttcaaactagaaaactaagtcagaaacatataattaaaatgttcataaattgaaatgtacctacattcatacactgatagtaaaaattacattgctttcaacctaaaattacatttgtaaaaacagtagatttggcatgtaagtacattgtattttagtataaatgcactgtaaatttggtaacttaaatatgttaactcatcnaaatttcataaagtctccatcaacagtaaagcataaacagaaattatataaaacaagacagggcacagataaagcacaaatcaatcagtcaagctatgaggctatatatcaagcacagattaaaaattttgaaacaactataa

SEQ ID NO: 2626 - DNA, 2105 bp, Oryza sativa
ccaaaaccaataaccaaaaaaaaacatgcaacaaattacactacaaaaccaatcatcacgagtactgtcttagtgattcttaaactagttcaagcaaatcatgtagagctttagttataaatatttcagaaatgttggcatcatcaaatgtaattttacagatctggagtatactaatcactaatacaacaataacataagccatcttatgattttgaaataaaaatcaacagatcaatcacactgcatcccgagcataaaaggacacaaaaaaaccagagaaactgaaacaaccataactaaacctccagtttgaaccctagccagattcaaatcgaacctagcctgattcaaatcgaacaaaacaactaaacctactcagatccagaaactaccactacaaagataactaaaaaaaacttgcaagtttgaacacaaacacaaatcacggcgaaatcaaatccaaactcctatgggattccaaaaactacaacgatttaaaacaaaaacaaccataaatcacaaaaaaaacaaaccccctttcaaaaacatcaaactcgaatcctagcatgattgaaatagaaaaaaccacaaaaaaaaactgggagcaagcagcgcagcacacaccaaactgtcgaatcaacaaattttgcccccacgccgaccacgcaatcagactaccaaacgaactagaactcaaatcaacaaacctaccaaaccaactacatggaaaactaccagatctaccatacgaactacacaaaaaacaacaataaacaactcctcgtggacatcatcaacctcaacctcaaatcatccatttcatacatccggaaaaatgccgagcacacacacactctctctctctctctctctctcaaaaagcaaaacactccacacataaaggctggaaccctgaatgcaggcataacccagtgagccgttctccatctccatgagggcaatgtcatacacttctcgtatcggcgggtcaatcttagaaaagcagttcatgccccagttgtacttgatgattgcattctcgttccgaagtgtgaagtagatttcatctccgacaagggctcctcgcctgggctggacataaggtgtacggtatgattcacctctagtgatggcttgcaaacgctcttgccaggtttgataaccataatcaagaattgctggcttgctccatgcacccgtctccgacgagtacacgctcgccttaacgagttcgtcctcatcgtccgtggccacaaagaccactctgaagggacagccactcacggcacagaacactgcggcagtgtacatcagccacgggatgccaggctctggcacgcggtgctgttcgcctgtgacggggtcccagacaatgagataccaaccgtcgtccgacgcgtggaggagggcgcggccatggtggcaatcgagggcccggcgaaaggtgggatcggggaagaggggcactgcggtggtgcgggcgaggtggcggacgggatcaccctgtaggacttggcgcctgtgaaggaggccgagcaggggaggggatccgtggaaggcgcggtagcggcggaggaagccggggtcgcagatggcgcggagccactccttgcagacgagggcggcgcggaaaaggtgccctggctcgtccggagggaggcggaggaggatctcggagaggagctccggcgcgagcgaagcggtgatgtcgtccatgaactccgggcggtggcagcggcgccatggtggtcggcggaagcgagggtttgggtggggaattataaggattggagaatagaggcacggggcacactgccttctttgtactacaaatttgctaacccgttagaccaactttgacacctgcgttggatggtgtccatgatgacagtccatctgtgcatcatgtgcttcctccgttttatattataaaactttttagcattgttcgcattcacatagatatgtctaaatccattaacatctatatgaatatgtatgaatatagtcaatgttaaaagtcttataatataaaacggatgaagtatttattatggacacacacctattatcgtcagtactcggtagctgctatcaaaatt

SEQ ID NO: 2627 - DNA, 7672 bp, Oryza sativa
ccatctcaatctttaaatattctttaatcttaaaaatctactaaatttcaggctaaccctttttatccggtccttatattttgtaggtcaaaaaattgggctcgttaccacttctatccatactacgctaggacccatgtatccttaattgatttttttatacgtgcacccaaacacaccacactcgctgattcgcacctccacaaatgcatcctctaacacatgctcaaagaaatgaaaatctaaacggcacatccctggtctaactaaatcatattgaaagtccaactgcatatgcgagtaatattgaatcccgtagaaagatcatcaacatgtgcataatattcatgaacataagatttaaaccctcaaggtatcatgcatccacgatttcaccgcccatgattccaccaccacaccactagtacttacccatccattattgatttctatttgcacacatatacaaatggttaaaaccacaaaggatatctctactaccttaaaagtggagttgttattctttggtcacctcctcccattttgcaccgcccacgcatgcttagtgtactacgtaggtaaccaccggatcaatgttttatcactaatattcttacaacatatggacatgttaatagtctacaaataataggcagtcatacgatcttggatcgacagactagattaaactctagtacggggtaaatgtttgcaaccaattggggtagagctaacttgacatacgatattttacacaattttcattgtctaactaagatagcgtttaattataacagcatcatcatatttttacaactactggcgttgtaatctatacttaattaaaaaatacatgaggctttcgtaacctttgtcgtctttcatcgtctctcagttggccccgctccgtttctcccccctcccccaagcctccatctctctccctcttggatcttattccgtatttttttacaaggattccgttttcttagaagtccaatccattgcacgcatgctgtgcacacctccagctgccgcccgggccaaaccctacaccgctgacacatcaatctgcctccccgtgagtttcctccaattgattgcggattcgcatcgattatgggtgaaacaaaaagaggagatcgagtggatcaaaaacccttaactggttttgggagatcgagaaagattcgtccgaatttgatggggaggatcgactttggcattgtacgggcacaaggctgtcgtccggaggttaaagacgctactaaagatagttgatgtatcactggaagaaaaaaacacctttacccattgcaatgcacgaacattttttctagtaggaagagaagatagaggaagttaccgaaagaaagtatgatcagaggacagttcagatgttagtgtacaaggagagagtgttgttcgacggccgcgggaggcggtggtatcacaagttctagtagagagaggagaagaggattgtgataggaagatattagtttaagacccaaaattaataatttcatcgtaatttagctacgtacaacaaactacgtgcctgtaacacctcacacttttaccactatagataaaagcgcaaggttgtggaatattatttaacaaagtattgttttttctaaataatacctcacaatcagagaccacaatagacaaaataattataaccacctttactttgttccagagttttgaggccatctctaatccatcttatacttgcaaagaatgggacctattgttgacaacttttttttggacgagtcacaaaagacaatcgacacacctaaatgtcttgcggtaatatgggatttccaaccaccgcgatctagaaaagccaaataaagatgggttaccggctagcagagcggatttaaagaccaaaattagcctcaaggccagtttagatcaatatgagggtaaacacccatctcatgggtgaattggaaggtttacgggacaaacttacaaaggaatttcgaactcttgcaacgatggcgaacgatttatggtgcaaatcaacaaagatggacgaaccaggcttgaactaggaaaaaaaagtagacgcgatattgaaaaaagattcaattggctaattacgttgaaaatagattatgttggttgtttttccaattgaactggccttggccctataaaggggttcgtcttgcctcctataggtcttcctccacctcaatttcagggtagaaatcaattagaactcgaaaaatacctccccatgcaaggaaactcaagactcggtgaaatttgacccggacttggactctgccaatctgatcggccacacgccgccagtcagactagctccacacaccggtcagaccggcctataagcggtggtcagaccggccccgtgaaggaaaccgggcgccttccaaaatttggtaatgttttcctatttcgaatctaggtgccaaatttgggggttaacatatgccccctgcctttttgtctatatttgagagccaaaaagcgtagacacacgtggtttaggcgatacctatacctgccatatcacctcctaagcatcttgccagacgcttgggaagtatttcttcaaatatttcccattgattgctctttaaaatcattttccttgcaaagtttcaagaaaatacgcattccctcgaacgattccacatatccgataaggaccttcccatctaggcaaccacttaccgaagtccttacatctagaacccaaaggaaaaatcgtcttccaaaccaagtttcctacttgaaatgatttttctctcactctttttatataggctttggctactctctttttttccttttctatctcctctaaagcctttagacgtttatcggtcacatcatcaagattgtctcccatcaacgtcctatattcttcggccgataaatcatcttgcttgatatatctaacagagccaagatttacctctactagtaaaacggcttcttgcaaatagattaactcaaaaggagtaactttagtaccaccatgcttagatattctatgagctcataacgcttcaaagagtacctcatgccatctctttggatgtccctcattatttttcttgactaatttcaacaaaatcttattacttgactcaacttgtccattagcctgagcatagtaaggagaagaacttaacaatttaatatcataagattctgcaaagcttttcagttccttagacataaaagaatctctttgatccgtagttaaagtttgaggaatgccaaacctatgaataatatgcttattattcttcaaaataaagtcaattacctccgtgtgagtcatattcttgagttgcacggctttggcccacttggtgaagtaatctgttggaactagcacgaaccgatgcccatttggtgatgaatgatgaatttgacctatgaaatccaaagaccaatctcggaacagccatggcttgatgataggattcaacactacagcgggtgctaattggacattgccgaattgttgacaagcttcacatcctctattgtacttaaaacaatcatcaaccatctttggccaatagaatcccgctctattaagtaaccatttcatcttgttgtaggatcaaggaagttaactagaggggggatgaatagcggttttaaaattttttgtctgaaaccgagttttgtatgcggaagcataaatcaaaacggttttgcacaattcaaaacctaaacaactagtctaaactaagtgcacaaagaagcctatgttgaggtttgcaagcctaggatgattttagcacaaataactctagtatgtaaacttgctcaaagtaaattggcacaaatataattgcacaaaataaagaagacaagagacaaagtatttttccacctgatgtttggaagtttgccaaagccaacttcaccactcaaatcaccaaacatccaaacctctcgtcaacagatgagcaaggtgggagccggtctcgaaatggtctcccaagtctctatcactatggttgttcttcctccactctggagatggcaaacaccgagccactcacaaccaattccaggccttctccacaaccttctcggaaaggtcactgggcaactcatttgttgggtaaaacctatcgatgacgggttttatttttggcccaattgagataactgttatccgtgatggctaaatgcttgatacaaatgacttctcacatctatgacctttggttcgtgatgggagcccttcctgatacaaatgagggtttccgcccgattgagatgacctatcccgtgctagtggttcgtcaccaagattttttagaaaaaaaatactgaattttagaaaatgcatgtactagctaattgtaggagttagggatgaaaacggagcggatagtttccgtccgctccggacaaaaacggatatggatacctttcggatcagataattctcggatagttcggatacggatacgaatacggatattttctcccgaatacgaatacgaatatggtaccagggtttccatcggatacggataataattcggatatccggtgaacagtgctattcggatatccgcaggaaccatgagacataccccatttctttctaactctataaccttcaatatacctttatagattttaataatagtttatctcttaacactagtccatactattaatattatttaaatttaaaaaatatttataaattatacctcattttatataaaatgagctaattatatatgttgatatttgtttctattagaagttgagttggttttcgtgttccgagaaaaatttgtttccgtattcgtgtccgatcatattcgattcttattcgtattcgagataatccgtatttgtttccgtattcgagctatccgtatttgttttcgtatccggtaaaaaatatgaaaacaaatatggtatgagcattatccgtccgtatccgctccattttcatccctagtaggagtgatatgtagtagcatggttgctacatactctaatccctagcatggttgttatttagaactcgacagccgcaattttgattcatcacatagcaacaacggagtgagtgacgatgaccgcgaagggaggggtggagacagtggaatataatgaagggattgctacatatcttggcctttttggcttagttcgtttcccctttttccaaactcatcactctctttttccgcgcgcacgtttttcaaactgctaaacggtgcgttttttataaaaagtttctatacgaaagttgcttaaaaaaatcatattgattcatttttgaaaaaaatagctaatacttaattaaccatacactaatggactgctccgtttttcgtgcagagaagtttgttcccaaccatccaaaactaacacagccttagtctgtttggttatcagctcttaaagccaagtaaaacactgaacgctaaatcccagagtagggggaaaataaaaccaaaggctgaaaataaaaacggcctttgtgtctttctgatttggtgcaacatttggattgcacttaatttgtgcccacccctacccataaggttgtgaataaatataggagttaacttatcaatacacgatgctcttttccgatgcaaatgaatatcactgtgaatatgcatgtcactcaactatgaccctgtttggagaactagccagagttattttgaaagcttatttttagcacaaggaaatagtcctccaataaaatagccctaagttgtttggatccaagagttattttgagagctatttggtctttaaggtaccttcccatggagagagatagagagaagacatgttttcagtgggccccatccaaaatagccccaattagcaccccttgagtgggatattttttttggatgggttatttccaaatagctctcaaatagctcactcttttagatttttttggactatttgagctatttaagggagggttaaaaatatcccttcaatcaaaacagagtccatgtggcaaacaagtaatttccctaatatttttatcagatggaggttgtaccgaaatgagtatgaaggcctggaactaaaaataagagcagcaattttggaaaggtgggaattcaacgacggaaacatggctatggcacataggaggcaggcccagatctcactaacaatattacacctactagaaatatctcatttgttgcaaatctctgatgttaacaaaaacatatagcaaaagcatattctctccgtccaaaaaaaaaaaaacccacttctgggtttaaatctggacataaccagaagtggatttttttggaacggaaggagtagcaaatatctcattaattggaaatatgatcaaagcagttatctgcataaaagttccagttatatttatctggatggcatgtttaaaaaatatgcaaaagcatagcaacttgttgatctaatgaataaaggctgaacacatggtaacatgtcctagttatatttatctggatggcatgttgcccttgatacaaatggacggtgcattagaaacaggagactagttttgggtaatagaggcggtacattatagaagaatagtgccttcacattccatcagtaaagtagttgacatggaactcttcaagcagttcagaagtagagttatgctcaaagagacggtgcgatactctgcccatcaagcatgaactgcaaggttgatgccacgctcatctgagtctggggctcagctgtttgcttggcattcttaaccacatcatttgaatcgacaatgtcatctattacattgaggttactgtcgaatgcctccaactcatgcagccccaatgcatttacatcactagctagcctcacatcctgaccacgctggtttttcttcttctccacttcattctcttgttgcaacttctggtacttcagattgagctcatgcactatgtcagtctcatcaccattgcccccatcacccatggtagggttactaggacccacaccaagtaagcgacgagtgacagcttgaacagtagggcagccaaagaaaaagggcttaccagcaggtgagagcacagcaacagcaacattgacaccacataatatgctgagttcgttagccttcttgattacaacctggcggcgcttggagaagcatacatcacgagcctttctatttgcaatgggcttgatcttaacttttccccttctcatggctgcttacccttcactatcacctaaacaaaaatgtgttctctgtattttgtcaagggatggtacaagaacctttatatagacctctatggagatgaaaaaggaagtgataagtctatattttgtaagaaatttattttgttagtcataagtatatacaaattaatagttgccaatgaatctagccaattttaacaattcgacttccaaaattgacgtttgtactgataaaaggataggctagaattgtgctaactctaattttagtcgaacgactatattgatcatattggtagggagtaatggacgtcatgacatattgctggctagtaacgcccctgattttacgaggcgttaaaactcttgtttagtaaaaagattaattactttttttttgcttttccactgtcatctcataagctgtgtcaaataatctcat
